United States Patent 10,900,036 (RNA INTERACTOME OF POLYCOMB REPRESSIVE COMPLEX 1 (PRC1)) - sequence listing, part 14

SEQ ID NO: 28252 - DNA, 1225 bp, Mus musculus
atactgggctacatatggccaagactctgcctcaaacaaatgaaaaacaaaaccagacctatagtgagaagtttgcttaaagacagaaacatttgagtctaaggaaacgataaaggagaaagaacagtgcttgaagactgtcactgtcggagctacagtgagaagagctaagaggcagcgggaactgtggactccaagatggttgtaccctaggtctgcgtgctgtctttcctattcattctttgtatgatcttgtataaactcctcgtctatgttttaatttccttatctacaatagggatgaggtaatattgtgcagggttgaaaagattccccagctagtgtgagaaagcagtgcctgatgcagactaatacttagcctctagctgctgtggtaactgtcatcattgttaggagagaccttcagaccaaggaaggcactgcttaaaagggcagttataactgtctgcattttcttctcctcagctcgagcctgaaggcgaggtctaatgtcatcagttatgtcactgtcaatgattctccagactctgactcctccctgagcagcccacatcccacagacactctgagtgctctgcggggcaacagtgggacccttctggagggacctggcagacctgcagcagatggcattggcacccgtactatcattgtgcctcctttgaaaacacagcttggcgactgcactgtagcaacacaggcctcaggtaaggaggatctttgaagttagaattgaattttccttggatgtgcatatatttaatatttagttatattatgctagtggttaaaactaagcatagatatttttaaatagtacttaattcagaaatcagttccctgtaataggaatttttgtttgatgaatttatcttcctacatttatttgcttggattaatatgggaatgaagttgttttgtgtcagcattagtgttttcaatatattcacctctggtgggaaaaattgagaagacatcctttagtagcaggaagcagtttggcttgccagacctgatttggatttaattatgtagagtagaaaggacttgataatactaaagatgactgggagctgaagatggtgagttagtagttaaaagtgcttgctctgctcctcttccagaggacctgaatttgatttctgttacccacatcaggcagcataccactgcctgtataactgcagctctaggggaagcaaga

SEQ ID NO: 28253 - DNA, 1198 bp, Mus musculus
cttctgcagtgcaaagaaactgaaaatagagccctctggctgggatgtttcaggacagagcagcaacgacaaatactatacccacagcaaaaccctcccagctacacaagggcaagccagctcctctcaccaggtagcaaatttcaatcttcctgcttacgaccagggcctccttctcccagctcctgccgtggagcatattgtggtaacagctgctgatagctcaggcagcgccgctacagcaaccttccaaagcagccagaccctgactcacaggagcaacgtttctttgcttgagccatatcaaaaatgtggattgaagagaaagagtgaggaagtggagagcaacggtagcgtgcagatcatagaagaacacccccctctcatgctgcagaacagaaccgtggtgggtgctgctgccacgaccaccactgtgaccaccaagagtagcagttccagcggagaaggggattaccagctggtccagcatgagatcctttgctctatgaccaacagctatgaagtcctggagttcctaggccgggggacatttggacaggtggcaaagtgctggaagcggagcaccaaggaaattgtggccattaagatcttgaagaaccacccctcctatgccagacaaggacagattgaagtgagcatcctttcccgcctaagcagtgaaaatgctgatgagtataactttgtccgttcttatgagtgttttcagcacaagaatcatacctgccttgtgtttgagatgttggagcagaacttgtacgattttctaaagcagaacaagtttagcccactgccactcaagtacataagaccaatcttgcagcaggtggccacagccctgatgaagctgaagagtcttggtctgattcatgctgaccttaaacctgaaaacataatgctagtcgatccagttcgccaaccctaccgagtgaaggtcattgactttggttctgctagtcatgtttccaaagccgtgtgttcaacctacctgcaatcacgctactacaggcaagtacaaaatactgtgcttaacacgcataggatagaactgtaactgttctacccaggagcctacttatttctagattccaagatggcagcaggatttgtctcagcttacgtgtatatgtgaagttcctataagtaacacacaattcttgcttcaatcctacttagtact

SEQ ID NO: 28254 - DNA, 1238 bp, Mus musculus
ccccggctcacattagcagagctgttcctctaactcctgagtccaggggcctggcgctaaaataccttctcactccagtgcatttcctccaagcaggcttctcttccaggaacttcgacaagcaagtggaaaaacaccagagagtacagcgtagcagtcctgcagttctgagcccggtggatgttggctagtgacaggaggtggcttgctgtcttcctttaaaagaaccctggggctcaccccagcagctcttctgaagcttttcatgaagtcctagtgcctatgagacccgtagctttatagtacactatattgtttattttaattttattatatttaagaaacagatttcattataaactattcagtgttcataagcacattaaaagttctaagaagttccatagcaatttaatttgttccacttggtttaacccagtttttctcaaacctttatcaacatgcagttcgttttgttttttgttttgttttgtttgagtggaaaaaatagagtctgaatcaaaaagaaccagtatattgttattaaatttgtcctgtccccatcctcaagtcccagataaaagatgtcggttatttgttttcagattgtaattcatggtgctggaggataaagtaggagtcctgttctaaccctgactgtcactgacttgctgtgacatgaccctaaccaaggaacttcctgtctttgcctctcggagcgaacaggaaaccatgaagaggcactgaaacagtgttaggaaaataacaccttccttcttcatgaaggggtttcgtaactgtcatgagacatccatctggaacatagccatttggaggttaggcaccacgcaccaagggggtacacggaataagctgaacattaagggttagagtatgtcagagctactggatgcttggagacactactttgttaaagctacagggatcaaatgtgctgccagatattctccaattgttcacatagctgggattttccccccacccccacaagtttgaattagggagccagagcacagagcttgtttgttttagtatccaggggagagaccaaggagccagctggctggaacgggtcagagtgtgcagttctaccctgtcctgctcataacctgacaaaatgccaaaccaataagcaagacagctgatagcacagccatgaggaaatgcggtctgggagggtgcaggcgaggaacggcctgggcctggaaccttgagcc

SEQ ID NO: 28255 - DNA, 1106 bp, Mus musculus
gccccaaactggctgtggtagtactggctgtaacctcagcacctgggaggtggagataagaagggtcagggttagggtcacccattcccacatgttcacttgaagctggcttgggactttgagacttgtctcaaaataaaacaaaatttcttctccggcctcttattttaaaagttggtaagattggttttcatgttttagattgtggaaaaaccctcacaacacataaaaaccttatgatacgtaaattctctgtccatagataaaagttttattggaatacaactgttcatttatatattgtctatataggtttttgcttttgttttttttgcattatagtagcaaactaggagtattgaggcagagatcatatgctctacaaagcctgctgtgttctttacagagaaagttggcaacctctgacttgaggcatggactgtgactaagagacatgttcccacacatcaccccagcatactcaatccaaattcaaatacaggataatttcagatactaccacttcagacgcctggcattgctcataaatagttaaaagtttggtatgtatatacttactccaaaattggaagtaaaatgattttcagagttgaggtaacatgcttgaaattttctaatggtagaactgaatattagactcttaagaaaaaccaaacacctcagagtccagtttgctctttctgctgtgctcattgattgatgtttataaaaacaatattaagatgtttgctttatcttattataagcagtatgcttcagcttacctaagtagctacttgtatcctttgatcttaatttctttctctcctttgttattgttcataaagcaaagatcaaagatagttcatcaaaagtaatagtttctttttaattgttgttggctggtaactatgatcttaatatattaaggaaagggtcagaagatgcttgcctagctcttaactccattgccattaaacttagaggattgctcttatgtggctcttcatagtcagcttttctgtttttcacttttgacctcttcctaactgctatcatgtggaagtgttttgtgagatacaaaagacactgggtgtgatggcata

SEQ ID NO: 28256 - DNA, 1163 bp, Mus musculus
cttagttgccagggatcctagctcactggccatatgcccaggaaattctcactaaaaagaagaaagacagaatacttaggaataattagtggtttgctttttggcatcagatttactcagttggtacatgttactgtgcttataaatgctgttcacagtctggcttgtgttactaattatttaaataactaacaaaaaattacatttattagaagttaatgcaagtgacagtgttgatcagtagttcttcttttttcactctctttgccagagtataatggttgattactgtgtttctacccttaacatacataaattcaacaagtatttacatgaggcatgttgcattgcagatacactgcagtgaatagtagacttaatatttaaacatgttgcctgttttctcctatgagtgctttaattgggggtaggtaaactttttctcttttgttttttgaattagggtttttctttgtagccctggctgtcttagaacttactctgtagagcaggctggccttgcactcaaaaatctatctgcctttatctatctttagtatttggaactagaagcattcaccaccatgcccagctggtaaacttttttctactaagaactgcatagtattttaggaccatactgcttctatttaaattggggtatataaacttttaatacaaagactgcataggatctgcctctatctcaagtacatactgcttcattctgccattgtgtgtaagtagaaatgaatgggtaggaggatttccagtccaatttggcaatcctgagtggtctgttagagatgttgtgtctagtcaaattaacagcttatgtttctttccttatcaaccatttgttaacttttaaaccagtgttttagtaaagatgcattctggataatttttcttctttttttcaaacctaatattcttggccattgtttgaaatgttaaaagttattgttgttgtctttcactgtggcttagttgctttctttttcctctttctctgtgtggtcctcctgtctcagctgtttttttttttttttgtttgacagtttatttacttgtctttactcaaatatttgtaacattttaatttttggacctttgtttctctatagttttttaagtcttagtaactttaaaattagactttc

SEQ ID NO: 28257 - DNA, 2165 bp, Mus musculus
ctgcaccagtcttactgatgagggctgccacagctgagcatcaaactaaggagaaactattcttgtgacttggcatctacttttgaaaacactttacaattttatcaggctaataatacctgggtttgttcattgttattcagtgttgctattttctaatagcaggcattagacttccatcctagtttcaggtaggctgaaacttagtgtctggatatttactttgttttccctttttcaaacagacctccttcatccaagtagtgtggctcttattttggaatgttcatgtgctatgcattatcctttctctagttatcaacttggtaggccttttgtttactaaaggaagagtactctccacacctgagaccagattcttgtatctacctggttacagtgcaatttgatttttttttcctggatggtgagatttgagttatttgcattaacataggcgaaagaaaaagatgctgctttgttatgtctgtcaccatggaaacttcgctgcatctttggaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactacagtgattagttagaatctgtattattccttatatatatgtatatgtgtgtattctctgttacaaaggatgaagacaaataaatagggaaacacttcaatgtaaaccatttatgaattggaagtgatgttgcttttagttatctttgtaaataaggtaattagaatggtatgaaaggtaatgtgattattacaggggtgtttttaaatcctgtgtataaattctagggtaaattctagtttatcaaactagtttttaagggacctttgagggtattttttgttgttattttgtggagaaaaggggcatatcacaaaatgaatgggtttgggttatttcttatttttatttttttctgtccagaagaatttcatagagctttaccaggctgtgcaaagaaaaattcttctcaggcaacatttgcttttaaaaataatcatgaagagaaaaagttgttaacgcaaaaagttttattttgtttttcttgtcttccaagatccgatttccccacctcccacttgccatccagcagatgccatcctgtcatctaagctggtcattactaatacacaaggagactgtctcctgacagccagcactgtgcaatcactcaggaaccagcggatctgcaaagacctacaatcaaacgcaaatctccattttccttttacaaagcattctaccctcacttccagtataaacatattaaaagaatataaaaatgttgaaaatcatgtactaatgaagtcattgtatattagattgcaatagaatggaaagacacatttagctagtaatgtacctggaaatcctgaatgtcctacgtgagtattagattttgatagcatgctttaaagactgatgaatataaaagcagaagcttcgagtttcctgctgctttcaaaactgtgtcctagttgagtgatacaaatgatcgcaagttttctaaatcattaaactatttggttggtggagtgaggcatggtctggtatcctctgatttgtaaaatagcgatggcagtgaagttgtaactgaaattgaagctgatcttcctttctggtatgttatctattgtgccagcccttgagattacttgcagaatgtggctataagttttagtagtttatggatcagagggatatttttaaaatatgctaatcgaaagaacctagtaaattaaatattcctaacagcaaatagaatgattttatggtaaccattaaaaagaataagtcttcccctgtcccagaggtcattctataattatcaagataggataagagttagggttacgattctgagagatgtcccaaattcataaagcaataataataacctttatattggttccctcttccaaagtttaactcttgagaaatgaattcttagtcttaattgtactttgcttattcagtacttacagttttacatgatttttactctaagacttttggaaagtgccctgcgccctcagaaacagtcggactat

SEQ ID NO: 28258 - DNA, 1149 bp, Mus musculus
tgagttgaatagttcaaaactgccatctttggaggctggacagatgactctgaagctaagagcatttgctgttcttgcataagacctgagtttgtttccacatcagtgtcgggcagttcgtgactacctatagctctggcttcaggggatctgaccctggtcatggcacatacacagactcttttacacagaaatttgaacataaaatctttaaacacccaaactgtgctgtgcatggcatctggttgtcctgtggtggaagccctctagggatgtctggatattcctgcttccagtttgcagatatttccaggaggctatttctcacttactcaggtctaatggtttagggactggttcactttattagttgttttagaaagcacagctactggaagcatgtgcgcttacaagagtgtgcttttctggaccttcactctgcagtcacagcggttgtgttgtatctcctgatgcctattgtgagcgccagtgaagtgcttggacccttgtgccttatgctactcatgggaactgtccactgtcagattgtgtcgactcagataacaaggccgtcaggaaacaatggaaatcggagaagaaggtaaggtgagcttgcctggagtggtgtgctttcttttttgttgcatatttgacgaaatgacagttgtttgatgctgagaacttatcagtgtttagtttcatgtgaccttttttacatagcacggtaggtttaaaaggaaaattactacttttccttagcatatttttcagtaatggttttgagaagcattctctggctggaatgtattggttggtgtagggtacttgtctcttatgagcatgtgcaagaccctagatagggtcagtgtgcaccatccctgaaaagagagagaagagaacagggcaaagtggaaggagaagggagatagtgtggtgatacgtgcgtgcctttaatcccaatccttgggagacagaggcaggtagatctctgtgtgttcaaggccaacctggtctccgcagcgtctcatcgaaaaccaatcaaccaaaacaagaaaaaccccaaaccaccaccaccactaacaacaaagctctgtaatgtttgtgaaaattcactatgggtaaaggatttctgtacactgggttagagct

SEQ ID NO: 28259 - DNA, 1183 bp, Mus musculus
gagatggagatatggaacttgaaggctcctggcctcatggggtcctgcctcattttggggaagaaggaagatggctaacagatgacccgaggctagtcattggtctgttgtcagacaacaggtacttactcaaaactaccatgtctgagcactgggcttggccctgggagacagttgtgaaaagtccctgccctgcatgtctacattgcaaggaggaggaagagggacttgcaatggtgaaataacctgttcacacctaacccaggtgacatgacgatggctgcaggtcagcagacagacttgagaatggtgagtttgagaacaaccatgtggcaggtgtttctagctccttctggggaagcagggatcttagtcattggccacttggtgacaggttcctcagggttttccgacactgggtgcagggtgcaaggctgggctgtggaaggactctttgccatggtggctgtggacttgtggcacttcctgacgtgagggaggagagatcacttcacgacagctcagcttggtgtggtgagggcatgtgtgtgacacagtgagggtcccaacaggaccagttgtctcactcattacaatacctcaagcagaagggtgctggatgactccgtagctggcgaggggattcatagctgctcagaccctagcagaaggataagggaagtagatattgaactgggaagaaagggcatatagagatggcttgtcttgaagaatctgagatggccaaggctggggcctcctaatgggggtgggacatgaggactgaacacagtgatcctaatctcttgctgtccatttttaagtggggttcccaatagcaaattccaatgagaagtcagtggacagaaattcaggaggggacgagcaaacgggaaacaccacatagactcaccataccgggacacagcaatctccatacagaaagatataccctccactgaataccatgggtcttctgtgagagcagctggctttgggaagggacagccaggccccagccctgatgtgtcttcttacttgcctctgcagcaggcacacggagttcctcagaacttctggtgccacaccctctctgctgagcatttgtcaccagggaggggagctgagcagagatgttcatgtccttcttctccctcacccaggcttctgtcggcccagtctt

SEQ ID NO: 28260 - DNA, 1229 bp, Mus musculus
ttccagagcccagcagtgttgccacagccctgtgagcacagaagatgacttatttcagcaaaatactttgatgacaaggaaaccaaagattggccttttttatgtttactctgttttcagtctccttcacgaatgtagcatattaagaagggaagtgtgctcttgggagtagatcacacaaaagttcctgtactctgtcaatttagtgtggttctgtctttatacaagtattatttaagccaaacagctttctgaatttttgatagcaaaaagctttatgtaaacaaagaatgttaacactaatgaaatgtcatgtgctttcagtctgtcctatgagtataataccagcttcctgctctcaacttttaaaggtgtctatttataagtaactgtatatatacagagttccaaactcacagcttcttagctttttgtcagaaagttcaggtgaatttctgacatttttttcccatgctttttttttcaaacctaagttttcttcctcagacagcagcactgtttgcttttgaaactttcgctttttatttaaacatgttttcttcatttccactttgaacatttaaaatgtatagtgctctcatctgtttagactgtatgccttcttttaggctgtattccaggttttttactggtatgacaaggcattaagagcctgctcccttggcactgctcgtgctggctgtgtgtctgagtcttactgatagaaagagactgtttattagctgctctaagctgctctccagttcccgccaggaaccaaagaggattgtgccacttgagtgaagagctgcctttgtgaactgttagctagatcaagggtgatgctgctccatctaacttgagctgtatttatcttgccaatacaagacttaacggtctaagacatgctcaggggaggaaaaaatgttctgcttctaaacactgtcagtaaacaaaaaactcacatccgaattggaaaagttgtcttttgtctggaagctgctgctcacaggaggctcaggatggaggtatacagcagctcatttatagctggccatcccactttgtctgtggtcagagttctgtgccctcacggagagcccagggtagtcagggtagagagcaggccttgacctggtcctctagaaacaccttacccaagatatcgcctccaagctccagctgtggcccttctgctgcggtgtccattggatctcctgagaattggg

SEQ ID NO: 28261 - DNA, 1171 bp, Mus musculus
gatgtagcgcaaggaaacaggcccggagggttccagcaacttcccagggtccccgagcccgggttccaggcccacatcggagtctaccagtgtccgtccattcaaaatgctgttcagtccccggactccgacggtccatcgccttcgccctctgcacctcagggtccgccctcagggcagtttttttttccccttttctcctccagagcctgaggggtgaggcccacgatggcgtccccggcacgcgccaaaagaagctaccccctcagagcgctgataaggatgtgcggggtctccgggccgcggcgccgggtcacgtggcgggaaggggggcgccggcgcgcgcgcccgagcgagcgagcgggcacgcgcagcccgcagcgtgtggaggcgcgagatgccgagctgggagtatgtatggcagggagggggcggcggccgggaaggccgactccaccccctgtgcgcatgctccggcccccgcgggttataaggcagccgcgcctgccccgccagacaaagtggcgagctgcgacgtgactggtcggtcgtgtaggtgcagcagccaaggagcccggcggcgggcaggggacacgagcgggacccccccggctccgaggaactgcggcccgcgccgccgcgtcacgcatactccgggcgccgcgagacacacataacggttagtccgggctgagcgggcagcgcgcggcacggaatccgcggtgcccttggtgccccggtggggtcgcggagccccgcgggcacgcggggactttcctccctggggcaagggtcggggcgagcgacgcggcatcctgggcgcgcggagccgcgtggcccggaacgtggcgtgggtgaaggggaccttgaggcgctgggcacagcgtctctcccggccgagctgcgggcccgtggtcaggtggcggccgccgggctgcgggagtcgggtcatggtgcccggtgaccttgggggagacgcttccagcgctgcctactctaggcgcctggagagatgcttaggtcgggaagagggacgacctgaggccgcttcacgtggtgcactcctgccgccttctgctggggcgggagttacttaggactcgtggcatacccgcccagcctccccggtctgccaatcggtgtcccaccaggtgacttgctagagtggtgt

SEQ ID NO: 28262 - DNA, 1381 bp, Mus musculus
taagcttcccagtatggatactgcaagaggaatacatgccttagccatgccccacttactctaatgtctttgcttagtaagtaattgaagagatacttctgtttatgacagtgtgtgctatctctgctcctttccctaggtcttgggcttgctttcaacttgaacccagctctgactatgattggcaagtatttctacaagaagcgaccactggccaacggactggccatggcaggcagccctgtgttcctctctaccctggctccacttaatcaggctttctttgatatttttgactggagaggaagcttcctaattcttgggggcctcctcctaaattgttgtgtagctggatccctgatgagaccaatagggcctgagcaagtcaagctagaaaaactcaagtccaaagaatctctacaggaagctggaaaatctgatgcaaatacagatctcattggaggaagtcccaaaggagaaaagctgtccgtcttccaaacaattaacaaattcctggacttgtcgctgtttacccataggggctttttactgtacctgtctggaaatgtggtcatgttttttggactctttacccctttggtctttcttagtagttatggtaagagtaaggatttttccagtgagaaatcagccttccttctttccattttggcttttgttgatatggtagccagaccgtccatgggacttgcagccaacaccaagtggatcagacctcggatccagtacttttttgctgcttctgttgttgcaaatggagtgtgccatttgcttgcccctttgtctacaacctacgttgggttctgtgtctacgccggagtctttggatttgcctttggttggctcagctctgtattatttgaaacattgatggacctcattggaccccagaggttctccagtgctgtgggcttggtgaccattgtggaatgctgccctgtcctcctagggccaccacttttaggtatagtatgtctccctacatttttgtttctgatccagttataaaactaggtgtgaaaagcatgtctacctttaaagcagagttgagagctgagctttgtaatagtgcacattgcagcagtagtcaggcaggcggaagacgtcctcttccgtggcatcaagtgtaccagccaccgtccttcctaacccctgtgcatcttggactcacaaagcttagggttattttagtagcagttccatagataattctgttcagttactttagtttatgagtcattatataatttgagagcttgggttactaaactttctctttgaatgttttagggttttttttgagggggggtagtgttggtttttttgtttgtttgtttgtttgtttgtttcaaagcaaagt

SEQ ID NO: 28263 - DNA, 1682 bp, Mus musculus
tatgtgccttaagttttagtttttagaactctttagagagccttaacttttaaaaccattctgctgaattcatttgttttaaatgtcattttaaaaggaaaaataacaactagcttgcttgaggtaactaaccttaatcttgttttgttgttgtttgtaatgctttgtcagacattgttactggaacatttatgaatagaggtattggttaaaagtcgcaggtttataaaatactgactaaagtatttttctagcattatagttgcctggcatatccacctgctaggtatatatttaagaaatttgaaacataaaattttgggaacatcttggcagttccagccacagcctgtcacctgctgggcacttctcaaatgcttactacagcctcgtgctgaagtgttatcactaaactgtcacctttgctcctattcagagacactgaaatcaactgcaaaaggttagtattaacatctacaaaacaactctttaacacgtctgatttaatgtatgcagtatttcaagcagcagctgaattcagtgtaggtttccccaaaccttagttacggtatgagaatcttaggtatgtgtgggtttgaggggctctgaggtgttggttcttaggtttgaacccagggccacaagcatgctaagtgcatgctgtaccactgagccacaacccacaggcaccctggaatccttctccttgacccctgaaaccttttctcttggtttttgatagttccatttataccactactagtttagagctgtatgtgggatgattcagtaccgactgaatggatgtgcttttgttttttttacattgtttttcagtatttgcaaaaccacgagggttagagtttggcctcagggaagccaataaagataaaatgggaggaagtttgctgagaacttgtatcatgctttacgattatttgacatagtcttacctccacaccttaactttcatgaccctttcactcacctgaaatgtagaaaaatgggttcagtgtaaggataagaggaaagatggaccagattggaactacagtgttttgggttttttttttttttaacctgatgtcttctgaatagaggcagaaaaaaataagacatatgacactgaattgtactcaatgtgtttaaaataccattgtaattgacagggtgaatatagatttaaaaccttgtgtaagaagctgactttttccaaataaaacatttattttatttttagaaaacagttcttccgcatgtttatttgtgagacatgttatttttgtcttcattcttactaatttttattttattttaacctttctaatattgaatcgtccatttatataccttgactcgtacatatggttcattttatgttgattttcctcctttagttaagacaagcagggaaggattttaagaccgcatcttgagctgagatcccctgatgctgttagccttaagacactgtgggaaccaccttgcaatataaagtgttgtggtgagaatgtggtgagaatttagagaggaaaccttgaaagtttacacagacatcaactggtttggactcttatcttctgtgaagccatgtcatacttctgtgaacctttctcttctataaaaatgaaagtctctgttgatggtggaattttgagctctgtgtgtgtgcgagcgcgcga

SEQ ID NO: 28264 - DNA, 1922 bp, Mus musculus
tgagaactcccactctgttcctttgcagcacagtgccgtttgctttgaacagtttccaggccccccaccctataactggctctgtcccacagaccttcacagcaggccttctgccctcttccgggctctgcgattctcttactcatctccaagtacccagtgtcttgtctgtacctccctggcagctttgtcccctagagcaggtctgtcaccgtggttcctcctaggcctatctgatctttaaagccctgtgtctgcactctaggtgggctctgtggaagagttccaaggccaagaacgcagcgtcatcctcatctccaccgtccgaagcagccagagctttgtacagctggatctagactttaacctcggtttccttaagaaccccaaggttggtaggcttgtgggtggcgtgagtccttccatggggcctgtccctttgatgacatcaccgcttcctccatccagaggttcaatgttgctgtgacccgagccaaggctttgctcatcgtagtgggcaaccccctcctcctaggccacgacccagactggaaaacgtaagtgttcccagcccccatagttgctcttagccaccgtgagccccagcctggggcaggtttgtcctcgacaagcactggcttacttctcccttagtcctcagagctgttggtgttaacaatgcccaccctgtattaataagtgaggtggagcaactctgcctcagatgtgacagtgccgagcagaggccgccagactcggctccttggcagttccccatgcatgccgatgttctgaaccccacaggttcctggagttctgtaaagaaaacgggggatataccgggtgcccctttcctgccaaactggacctgcagcagggacaggacttgctccaaggtctgagcaaactcagcccctctacctcaggtatggatgggccctgctgggccagggaggtgaagtgtgggaagccggcaggataaccaaggatgtctcttttttttctcccagggccccgccgtcaccagaatctcccccaggagcgggagggtgaagggggcctgcccttacaagtggagccagagtggagaaatgagctctgaggccacagccgcccgccttctcacaccagccaagccttattgctgcctatccctgacccagaacccagctctcctgtccctgcaagagatgggaaggccgggaagtttacagcccagaccattccgccccttcctctgctagggaagacaacccaagctgctaaaactcggaggaagggggaggaagaaagcttttttttttttttaaaccctctcctttgcagtgctggggatcgaacccagagcctcaaatatgctaggcaagcactctgcccctgagctgctttaagaaaaacaaaatgctgttctatgcaaaagcctcttgcgtgtgtctcatcagcctggtcttgcttcctgtgcccccaagatgaccctccaggagggtttctgcctagagccacgccccttcatagctgcttagcggggaggaaacccgatggacagggaaccaacccacaggcatctatgtttagccaatggtccagaccactcccctcacccacccaggcagtctgccaaacatgacctcatcctgtactagactccaccctgtcccctgctgcctccgcccccagccctgcctcagcagacaggggcccagcctagccagcaacttggaaatgaagaggaaaagatgggactccaggctcacagccaaggtaggccagtaaagacaggaagctgccacacacggtgcaacctttgacctttattcatgtccccaccaagttaagtcaaataacaaggctactacccaaagcagaaaccccagtccctaccctagactcctcctgtgagccaaaaatatataaagtgctgg

SEQ ID NO: 28265 - DNA, 1183 bp, Mus musculus
aaaggcaggcttgagatgggtgggtaaaagaacagctatacatatctagcaacccaagttgggtttccccaaccagtgagcccacttgaaaggcgagaactgactctacaaggttgtcctctgacctccacacccatggcatagcatgactgttcacaccactcagtgacaattgcagaagttctgtagatgcctctgggtcgatacttaatagttttgaggtgtaacataattaaagagtgatgacaatagatgataatctgtttgctggactatctttgtttggtaaacttaaacccgagaatggatcctaatttctaagtttgttaaaaggaatttaaaaggctgctgagtgagagccctagcctttggcttggctctctgtggtttgcagcacctgacagcaaacactgatggctgttactgggcatggctgaagggccagcgactagggtggggagcacttgaagcagagctccctacgaggtcttggatcttgctctctttcctcctgccacctaggtctcaccccaccatcctggacatccctaaccagctgtactacgacggagagctgcaggcctgcgcagatgtggtggatcgagaacggttctgccgctgggaggggctgcctcagcaggtgaggcctagcaggcagagcacagtctggaacccctgattctctagctgggttggaggattgggaggcagggagatgagcctgaaggtttcctcttatttcatggcgtccagggcttccccatcattttccatggtgtaatgggcaaagatgagagagaaggcaatagcccatccttcttcaaccctgaagaggctgctacagtgacgtcatacctgaaacaactcctggccccttcctccaagaagggtaaagcccgcctgagcccccgaaatgtgggcgtcatctccccgtaccggaagcaggtcaggccctcagtccaagcctaggacttccctctttgcccgccagcaccctggccagcagcctgcctctgccttcctcttgtgtgagggggatggcctaagagaagggcacctattcctccctccaggtagaaaaaatccgttactgcatcacaaaacttgaccgagaacttcgcggactggatgacatcaaagatttgaaggtaacctaactctcgatcatactccccttatctag

SEQ ID NO: 28266 - DNA, 2143 bp, Mus musculus
gaacctcaaccctcacaaatgctagacagtacccttagctctgagcttcatagatctcaatagttgaagaaagcaaagtacgggcggggtggcccagctgatgcacagccccgttgtacctacccatcgatcaatttgctctacctgtgctgcctttgcccaagagatgcccactcattcctcagagacctgcccctgccccagacagtcctcagtgccctggcttgggccagtgagctgctccaggcagtcagcaagtaggcaccatcaccgtgctggaacgtatgggtgctccctgagtgcttctcaaggcctggtcagatagcttggaacccagctgcaagtgcagtgcctggcacttaccatgccttcgtaagtgtgtgtgcagtggctgacactgcactccgggtgctgagccgtgaggctgtcctgctgaccacttttcctgtcttcacctctctaggcacaaagccaggcttttgatctcgggagaaggatcctttcccttcctgcttgggttccacctgcaccctttgacttccggtggaaactgctgtccgatccgctaccttgcccacaccctggacatctctgctctctctggcccctttctcagccctccccacagtctgggccctggccgttcctgtgagccgtcttttcagctttccctgggccttagctcttctcactgtactttttattttttatttttaatatcccaaaaatagttcccatctaaaaaaaaatctgtttttctctctgtcttccctcactcttcccagccaacagcccaatattggacttttctccacagtgctctttaagccgattattttgtgttggaaagctccaatgcctttgctttaagttgttaaagattcctaccacccctagccagagtctctgccatgagtcccatcctgcctcgaagcagggctgctgtgtcccttcataaagcagccctcgggccttccccagcatcgtctccacagccaccctgccttccctcacttcccagtatcctctgcttctggcagctatgggacccctgcccctggcttctcctccatgctgtatggaatgaagatcgcaaatctggccttcgtcaccaagactcgggtcaggttcttcaaactagaccgctgggctgatgtgcagttaccagaaaagaggcgaataaagccagggtcgaacatcagcaaacaacacagatcactgttggccaggatctttcacgacaggtgtgtggggggcagggagggcaagggaatggggtatctggtttaaaacacagtggctttccttgggctagggtagacccccaccccctcaagggaggaagagaggcagggaattaatcctaagccttcctcagggcaatttcagtccaaggttccccctcaccattccccctacttgcactctccccagggctgagtaccttcatgggaagcatggggtagacgtggaggtccaggggccccatgaagcccgagacgggcaactccttatccacctggatttgaaccgcaaggaggtactaaccctacggcttcggaacggcggaagcaaacctgtcaccctcactcacctattcccactgtgctggacgccccagtttgtcttctaccatggagaacaggacctgccctgcccactgggccccggtgagtggtctctgtccagcaggctcctgacttgtgatgggggtgctgggttaggttgctccttcactcagctaactttttccaggtgaaagctatgaactccacatctactgtaagaccagcattgtgggttacttcccagccactgtcctctgggaactcctgggacccggggagtcgggagcagaaggagcagaaactttctacattgcccgattcctggcggctgtcgcccacagtcccctggctgcccagttgaaacccacaactcccttcaaacgcccccctcggctcaccagaaactctgtgttgaccaaccggatcgaggaaggagagaggcccgaccggtaactagataggactgcttgggcacttgggaagactgagcaaggagagacagaacccccttccccatcttcaggtcactccctcctctgggtctcatccctttcatatcagaggagcaaggtgcg

SEQ ID NO: 28267 - DNA, 1192 bp, Mus musculus
catagtcaggaaagccggctgaggagcactgatgggagtggctggaattccttcggatgggtgactggactcagcatgggtgatcagtcttactggctgctgtcacaaaagtgagaaatggccaagtcagacacctgggtacttagcacagcacctcctaagtccttggagcagggagctgctggtagaagaggtgttgctgccttgcactgtaactacacttagtgtgacatacctaagggttagctaggtttgtgcaacatggagttgttagtagttggatctgtgtttggtagccccgcctatggaagggattgacccggcaaggaggagatagtcaaacaaagccagaagtacagtcaacagtaacagaacctagaaaaataacaacacggatatgaccaggcaggtgttagaggcaatacaactgacaagcttggtaaagtttatgtgtaatgtaatctcgtcacttgggaatctattcaagttcaaggctagtcagagctacacagtgagaccctgtcagctatgtaactgaccaaggaaataaaattttaaataaaatactttatttaaaaaaaaatgttaaactagccaggcatgtgtcacttgcttggtggaggaaggaggatcaggactttgaagctagcctgagctacaagagacctaatctcaaaatattttcttaaaaacaatgtaaaaagagccctttgatcccagcactcaggaggcagaggcaggcagatttctgagttcgaggccagcctggtctacaaagtgagttccaggacatccagagatacacagagaaaccctgtctcgaaaaaagcaaacaaacaaacaaacaaaaacaatgtaaaaaatataaatggttgagttgttccagtgttagggactagggaaagggcagtctgaaactcatactaatgagaacataaatttgcacagctggctaggaggcaattttgaatattctgttgtgcagggtatggtgacatatacctacaaatccagtatttgagaggatgagacagtaggatcctgagttagaggccagtttctctctccaaatggaaatttcctttttacctaagttgtacaatttttttggttttggggtgtgtcttagtcagggtttctattcttgcacaaacatcatgaccaagaggcaagttggggaggaaagggttta

SEQ ID NO: 28268 - DNA, 1099 bp, Mus musculus
tttgggggggggggaagctggtaggttacccatgttccagtgggtggcaccccagaggtcttggtggatgatgttttagggcagggagcagtctggggagagggctcagctgctaaggatacttactgccaagcctgagaacctgagttcaatcgctgggatctccttggtggaaggagagaaccaactcccaagagttgccctcttgcacacctctgctgccacgctgcacatacaataaagaaaagtgagtgtttaaacaaaattaagtaaagaaggcatatactggagaggaaggtgtgttggtagaaaattcagggaggtggagtagggggtgggtgtgatcaaaatatattgtacacatgtatgaaattctcaaagaacaaattatattcatgaaaagctggagagaaggctccgggattgagagagcacttgttgctctcacagaagacctgcattcaattcccaggacctgtagggcagctcacaactatctgtaactccagttctgggacctttctgtaccctctcctggtctctgcaggcaccgagcacaccaggactggtacacagacatacacagagcacaaaacacctgttcacatgaaataaaaataaatcttttttttttttaaatcaaaagcaagcagagagatggctcagtggttaagagcactgactactcttccagaggtcctaagttcaattcccagcaaccacatggtgactcacaatggtctgtaatgagatctggtgtcctcttctggcatgcaggtgtacgtgcagacagaatagtgtatacataataagtaagcctttttttttttttttttttctcgagacagggtttctctgtgtagtcctggctgtcctggaactcactttgtagatcaggctagcctcgaactcagaaatccgcctgcctctgcctcccaagtgctaggattaaaggcgtgcgccaccacacccggcaagtaactcttttttggcaagtaactctttttttttttttttttttttaaacaaaaacaaaaacaaatcaacaaaataaaatagactgacataataaaggttttagaaacaaaatacgggccag

SEQ ID NO: 28269 - DNA, 1149 bp, Mus musculus
tatagttggtgatatataatatttaaaagcttgctgacagtgaacttttatagctatcttttatccctgtgggtattacatgtatattttttgatttctgaaagccacatacttactgatgagacttgcacatcagtatgtggtatgcagctattctaaagtcaggtcctatgtaagagtcagtggaaagtgattgggcagtctgcccctcacagtgtgcaacacttaaatgcttccacagaagacatgcaacaaggaactggaggctccttttctagtttttcaccacttcataacatatggtctatgcacgagaaacaccaccctcttgtaggagcatgttaagaaaggatcggctcaggcttcgctgcagagtctgaatcagagtctgagtcctaacaagatccccagcttatcctgcatgcacttttaaagctcaagaagcctccttccaccaccaccaccagttattctggccaccaatgcgaggaattggaacaccaggatagcatgctgccttatcgggctggagaagtggctgccctgcagagtgcttatgagcaagactctggaaccaaactgctttgctctgatcccagctctgacaccgcctatgcaacctcatgtaagttatgcaatcttctctagtcttcgttgtaaagtaagaaatagtgctacataggtgttgttggggtaaatgtgtttaacgtatatcaactgtgtagaactattcctccacagtaagaagtaagtggatattattccctctgattgcaaatgatgttaccactaaagagagcctacctcttatgaggataacaagtgcaaaatgagttttcccacagtaattggaatataatgatagctggatgtcatttaaataataagaatatacaactgatacatcatgtgtgtgtgaaccacaaaaagaggggaaaatgtttccaattcttggttctggcaaactgttgtttagaacagaacattttggcaagttataaaccgtcagattatgacaatataaagtaaaagctgatgaaatgtatttgtcctgcttcttaataaggcaaagccacataagaaaacatgcaaattattattatttctccattttcctttcccatttctgctccctcttccccttctttt

SEQ ID NO: 28270 - DNA, 2425 bp, Mus musculus
ccctttgggacagactaccgaaatctggccagcactgccagcccaagaggtgacaccagccattcacccactccagggaaagtgtccagccctctgagccccctctctccaggaatcaagtccccaaccatccccagagctgagagaggaaaccctccaccaatcccgcccaaaaagcctggcctcaccccttcgcagtctgccaccactccagtaaccaagactcattcccaggcatcctccctggccgccacagaagacctcgccagcagctgctcccccagtgccgtggtggccaatggcaaagatgttgagatacttttgcctaccagcagctagtccctagggctgagtctccacatttgacattccatcagactcgggccaagagctcagcgttaaaccctggagtcaaatcatgttatttatttgatagtagctacagccatctgtataatacattcagtgtatttacctttttgtatttttttaagtagaaattgaatactttggatttttatgactcacctctttgtactaagctagaaggggacctcatagacatagcgcatctcaagctctgcacttgccagcgtgctgcgacgaggcggctgactggggaccaggcggtgctgctgccagtcggggagctagaattcattactcagcactcatttcaaattatgcagaagcggttcgtgcagatttttattccagatgaacatgttttaaaagtgcctgaaatcgcctgccacgggaatgtgattctgcggcagaaacaaaagacagagcatttcttgcagcaaatgagatcctctgtgaatctgaatgtcaaaaaaccaacactgcttttaatcctctctgactgtttaatgccagctttgtgttctgaaccgaggtttgcataagtagagtggaaatccttctgaagggcgggaactctgtcaggctgagctctgtaaagccctcaagaaaccctccagaacacttagcagttggggtgctgattttcttgtgcttttgaaaacttaagtcattctccgtttcctgcatcacttcttgagtagtgaagtcacgtctccattcaaatccaccctcaagcatcggccatgggaacttctgattctggttgcttttacttgaataggaaatgacataatgaactctttattctgtgatcaaaaagcaataacttaaaagtcagtctttgtaatactgtaagtcagaattatacagattttaccaaattgttacattcactctccatgctgccagcacttctatctatggaaccaaatgggcgtatatctgtatctgtatagtacacaccccttttacatgttcagcattctcacactcaagcacataagtattagtgcaattgtatctctggagcttgcagtgtagcataaaggacaaagtagaatcaatcgcatgttaagattacctaccaaagcaattagatgtgacttggagccagtcagtcaacaaagaaatccatttgacaaggaagtggacaatcccaaactaagctcacatcatcagcatcataggaaagcccattaaatcgtcctagtgccacagaactcagctagccatgtgagtgagtgagacagcacagcccctcaagtgctatccactcagccatagcatcctagccccgtgtaatggggccacccctttgagccccagctcctgtcatgcaaaaattgcagatggaggttaccaattctctaaacgttcatggaattgagattcccacaagaagattctcattctgattttaaatgttttttaaatgctgctgattagacaaacatggctgcaaatgactttagcttgcaggctaccaagctgcagcctctccctccctagaacctgtgctgtttcccttgtagtgagtttgtacagacagaaacccccaggcttctccactgtgtcagctacatctgaccaagtccacagagcaggacagccttgctcttggcaagcagaacccccgacacaccagctcaggacactggttacacagttttttatccagagtaagagagaggaaggccttggtgtctttacataaattgttctggccagcatctacccagaagcccctggcctactgtaaccgtttattgggaaggagaatgggtgatcattggaaacacctgatcatgtttgcaaaaccaaaggattcagtgggcccattcagatgagtcacaaggaattagaaattgattttcttcttgaaccacagagctgaaaacaaaaagtctccctaataatttagctaatagctcttagttatatttttattaaccctttgagtcagtgggcaagaggcaggtgattaaaatcttggtgggcaagtcaacaacagggtatactgttgactctccagcttacagtttaaatggttaaggtaaat

SEQ ID NO: 28271 - DNA, 1177 bp, Mus musculus
ccagagcaaaggtaataagtcttacttggaaggctcctcagacactcagttgaaagacactgaatgtactcctgtgggtggccctctctctctggaacaagttcagaatggaaatgataccccgactcaagtggagtatcaagaagcccctgaaacccaggtaaaggcaaggcataaagaaggcgctaaccaaaggtctaagcaaagtcggagaaacccagcacggcgttcttcttaccgagtacagtcagaaccccaggaagagagttggtatgactgtcacagggaaacaactgcaagtttttctgatacttaccaggattatgaggagtactggagagcgtattacagggcatggcaagagtattatgctgctgcttcccattcatactattggaatgctcagagacatccaagctggatggctgcctatcatatgaatacagtttatctacaagagatgatgcgtggtaaccaatgaggttagcatgtgcttcagactagtgactgtcaacggataattggatatgcattcttcacctagaacaagtggggtttggtggcattttggaggaacttgagaggacttgaggctttctactgggacacaattatttttcagattatttttagaacttggatctaaagacccccaaggtgccacttcatgtaggctgttcccaaaagaaatctttaagaaggtgacttatgccactccttacttaaaaagcaaaataaaaacagttaaaatttgaatctaatgtcagtttattctgtcgagtttcttacaaaaggattgcactacattttctttttaatatgtatagagcattctacctgtatgtatacctgcaggccgggagatggcaccagatctcattatagagagttacgaatcaccatatggttgctgggaattgaagtttgctctagaagaggtgccagtgctcttaacctctgagctatctctccaggacttatattacatttctatattgctgcattctttttttttttttttttttttttttggtttttcgagacagggtttctctgtatagccctggctgttctggacctcactttgtagaccaggctggcctcgaactcagaaatccgtctgcctctgcctctgcctcccgagtgttgggattaaaggcgtgcgccaccacgccca

SEQ ID NO: 28272 - DNA, 1195 bp, Mus musculus
tcccattcctctcacctctgagagccccgcctccaaatcttccccctccctaaggcatcaagtttctacaggattaggcacatcctctcccactgaggccagaaaaggcagttctctgctatatatgagggggccaggggatggggtgatgtggagttggttcagaccatcccaggggttcaggttagttgacactgttggtcttcctgtggggttgccattcctttcagttccttcagtctttcccctaactcttccataggggtccccagacctcagtccagtgcttggctgtatctacatctgtctcagtcagctgctgggagagcctctcagaggacagccatgctaagctcctgtctgcaagtccagtatagcatcagtaatagtgtcagggtatggttcccactcatgagatggatcccaagttggacctgtcactggtcagccatttgttcactctttgctccacttttgtccctgcatttcttttaggaacagttttgggtcagaaaatttgaaggtgggttggtgacctcatccctccacaggaggccctgtctaattactggaagtggtctcttgaggttccatatccccactgttaggcattttggctaagtatccaacatatataaagaactcaagaagttagactcaaaaagccaaataactcaattaaaaaatggggtacagagctaaacagaattctcaacagagaaatcttgaatggctgagaagtacttaaagaaatgttcagcatccttagacatcagggaaatgtaaataaaaatgaccccgagattcaactttataccaatcagaatggttaagagcactgactgctttcccagaggtcctgaattcaattcccagcaaccacgtggtggttcacaaccatctgtaatgggatctgatgccctcttttggtgtgtctgaagatagtgacagtgcacttacaaatataaaatacataaatataaaaacaaaaaaactcaagtgacagcacatgctggggagagtgtggagaaaggggaacaaacactcctccatagctggtcgacttgcaagctggtataaccactgttctatcagtggttcctggaagttcctcaagaaatagtttctacctgaacacccagctatactgctcctggccacatacccaaaagatgatacaccataccaaggacgt

SEQ ID NO: 28273 - DNA, 1160 bp, Mus musculus
aaggctttgtttcagcatttctggttctggaatctagatggcttgatttgatctgagccagccaaaactgtgccatctgtaaagggagggagaacagctgagttcccagaaagcacctagcactgtgtagcatgtaccagaggttccagggagtggccgcagagctcagtgtacaagggtcttggcaccagacagctctcatttcagatggtcaatagcaataacttgtacaaagcatttatcttattattctagtacatttaaaattgtgaacataaacttactttccctaaatgttctttttcaaataaagttaatcacttgtgaaaagttacagcatagttcaagtattttatgttcatttcagtgttgtagtgaaaagtactgcattacttaatgtagtttttaatgtagtaaatactagcattaaatagaaatatttaaccttttatatgttaatgagaggaggtcaaagcatcctttgtgtatgtctgtgcgtgtacatatcacaagtagtaatttttatgtgccttttagaatttcatatacttaatttacattttgagtcttttgtagtagcagttatggttacacagtgaggggttttggccttccttccctgggcacacggttttgagatgactggttaatttgtttcaaagttaaatgatcctaatgagtattaaacatataaggttagctttattcattattatgttctgatcagccaagcagttcagcaaagaactgtgccgtgctctcatttcttcttgaaagtaggcctttcagagtgaggggtccgatgtgcactcacacatgcaccaatataaaaagggaagttgtgtgattactaacgtaaaactaaaataagaaatggtgtactttcataagaggaataaaaatagtccttttagtattattttcagaagtacctgatgtacacctgggaaattaactgttttatgaaataaactttagttattatacaagtgagtgactttttaaaagagtacttaacttacttagagcatatcaattttctgtagataaatctgaaagaatctttttgtaagtcactctaatttttgccagtttttttttttttagcttatttagttcatattgataggatgaacaaaacttaaagcatgtaaatcatg

SEQ ID NO: 28274 - DNA, 2103 bp, Mus musculus
ctgatgatgccaagtagccttagtttctgttgcttgtgttcttcgcttacctctcaccatctggttagctctggtgttagttggtcttgttgtctctgactggagcttgtctctcctgtgggcctataagcctatgatcttaagtgtgtcagcactcctgaggagaccagctctatctgggcgggattcagatacagagagctgtgggtgcagctcaggggtgcagatgcagaccggaaggatcctgttcccagttgcttcattgttcctgtgcactgtgtgctcctggcacatccctctttggacagttattggagcaagtcgatgtctcacctgtaggcctaggtgtgagagtactcctgggagaccagctctgtccgggcgggattttgtaacagtatttcttagttaaatgtaaattatttcttaattctccccctcacccccagaataacattgccctggccttggaggtcacttaccgggaacggctacataaagcatataaggaggtaaagaatcgcctggactaccacatctctgtacagaacatgatgcgtcgcaaggaggaagaacacatgatagactgggtagaaaagcatgtggtgaagagcatttctgtacagcaggtacattatgaccttttgtatcttctctggttggacctgaaggttagcgttcacgtgctgtttagtatgtgtgtctgcgcgcacacagaatgcaggtacccatggaggccagaatcctcaaatcctatggagctggagttacagacagcaatgagccacctgatgtgggtactgagaaccatactcaggtcctctgaaagagtaggaagtgagtgcccatgcctcctgagccatctctccagccccagttgttttcattattaatatttctgtattgctggtgtttgttggctggtcttttttaaggagctatttttacccaaactaacaggtaaaagtagttataaacatttctggccttaagttttttgtaggttttgctcataaaagctgtggaccaggaaattttagctcacaggatttatttctatcctggaactcactcccaggatttatttctaaaataaattgcatctatccagtgtactataattcgtttttcttgtgattagtaagcttttctatattaagcaataatcttgatgttctagtaggaagtactttagaattatgtcaccctttcatgttcttgagagaactatatttctctttccttattacaggaaaaggagaccattgccaagtgcattgaagatctaaagctgcttgcaaagaaggctcaagctcagccaattatgtgaatatgtctttctcagttgtgatagccagagagagttaaatgggaactagtatatgtgaagaactctttctgtattgctatctattgaaataaaatgatcaaggtccacttagtggcttaaccctattggccagtaaggtatttctgatccttgctctgtatgcggagttatctgatcataatttgaataagcaacttgcagcaacttgctgcccaactgaaattaccaagttataatttaaacttgtaattaactaaagcatcttgcaataaaatgtttgaaacagaatttataagtttcatactctgaaatagcacttctttattatgtataagaattacatgatttaacagctggagataacttagtaaagggtttgctgtgcattcatgagaatcagacttcaaatgcccagaaccacgtaaaagctgggtacatcaagcatctgtaatcccagaagaggagagacagagttcccagaagcttctggaccaggatgctgtacacagcagcaaacaagaagcaagggccagcctggtctacagagtgagttccaggatagccagagctatatagagaaaccctgtctcaaaaaaaaacaaaaaacaaaacaacaaaaaaaagcaagacaaggcaagataaacaccaaaggtggtcttctggcctccacacatgaatatacttcacatgtatgtacatatatggtgaaaatgttttaaatgtcattgaactaattaataccttgtttatgagatgttccaggagtaaagagc

SEQ ID NO: 28275 - DNA, 1148 bp, Mus musculus
gctcatgagttcacatcccagcaaccacatggtggtttacaaccatttgtaattggatcagatggcctcttctggtttgtcagtgacagtgtgatcatatatataatataaatcttagaagtatttcaagacattttatgtaagcaaatatttactagtgtctgcatacctgggaagagacatcgtcactgaactgttatctaaataaggctctctgggaaccgattgcttaggacctgctttctggaagcactagaattgattttacatcttatttccctatctccaggagttttcctcataggcatctggcctgttaggaaagcagtagggtaacaaaaccaaacggcctggaagtcagctaagccgttagtgacgtggactttgcttttacagttggctcagtagcaattcttgcttgagtcctaggcaggagttcctgccttggtacaacccaggctcatgcttcccttgtctgcacctcaccccgctctgtccccaacaggtgctgttgaattgtgggagctagatgagaacgagacacttatagtcagcaagttctgcaagtatgagcatgatgacattgtgtctactgtcactgtcctgagctctggcacacaagctgtcagtggtagcaaagactgctggtgagtccctgttttcattatttctatatctagacttcctgtggatatcccatctatcctgttaatttcattatgtaaaatgctttgggctgtttttagtctagtgagtaatggcatgtctgtttcctaagagacttggtagtgcattgtaaataaaacagcaggagtctaggaaacagaagtgggacatgttgtatgggtatattttaatgttgatactgcaagttaatattcctattttttttttgcattgtagcatcaaaatttgggacctggctcagcaggtatcactgaattcataccgaggtaagtgttgagtcctgcctatagttatcttttctttcccctttgggatatttgaacagtgtttgggtaacagtagtagccagtctgggttcttttgattggtctttccttaccccaaaactacagtcaggttccattatctgcttcctgtccatttctttgtgctcccgtttcggttgatagtctcacagcctt

SEQ ID NO: 28276 - DNA, 2788 bp, Mus musculus
ggctagtgttccagcttgatttagggagccactttggagaagtggaacttggtgtagggtaaaaaaaggcactggatgggagacctgggtatgtatccctctgccataatttcccattgactgtggacattattgcttccttgttctgtccactgtgtcttcacctaagaaagtagactgggttggataatctaacacccactggcctggtaatggggctgtatagatggtaaaatgtgtcctgagtatgttactaggttttctttccaagtagtttctccctatctcacaccctgtttttcccccttttgttctaggtttagaagtcgagcccacagagactttgtgagagatgctacgtggtctccactcaatcactcccttcttaccacagttggctgggaccatcaggtcatccaccatgttgtgcccttagagcctctcccaaaccctggacctgacagtgttgtggagtagaatggatttcagaaaaaccaaaacaagccctccgtctgtaagcgactactcgattgcccctgccttccatgtgtgagagcacaggagccttgtagagcatgtttcctccctagccccgtgcagtaacaggcagattctcagcctgagggaggctgcatcccatagtgactcagaggaagaaacttcctctgtaaatggatgtatgtgagtacacgtgtgagtgcggtatatagtttggagtggagaaaattattcttcagctttcccaaagcaatgctctttacccctgacaaagtgaccagaggattttaatgcttcccatgtctgggaattggcgatgttagggatatggaatgtgggtatccctagatttttgggaatacttcatactactcagaggtgcgtaacttatttttatatagagtttaattcactattatgggaattacttccatatacaaaagtctagcccactgtaccttgagaagacaaaacagttttgtacaagtccctgttatactgagtcaaatccattttctgggtgaataaatttggccctgcagtgtagctcttgttcaccctttccttccttggtgttgtgtgtgagagatgagtgttttcctgtcctagatttcacagataagttgtagggatgatggaccacttaaaagtgtttcagtgaagtgggaaaattgacatggattgttacagagaaatctgtcatttttcccacctaaaaattgatctgggtaccttcctctggagagctgaagtctgaatgtatttttggactcctaagatttgagatccagcatcagggaaactgtcggaaatactaaaaggtgaaataaagacttttatccttgattttccctccccagagctgttacttattacctgcttcgcttaggtgaatcaccagtgtcagacttagctgcccactgtctttgtaatctactgtattccactccattagagactgtggatctgtaactgatcttattggagctttccaacttgggtttaggaaaagcacataaaatgggcgccctgaaggaatgtgatcgtcccttctagtcttgccagtcatgagcctctgttgtaattaccctcgagcaaaacgcttgagagtttgcagtcaaggtcacctggggttgggactgtggaagcaaggacttgcattgttactaaattcagggaaggcataagataggtaggatcagtttctgcttcttagagataaagcttgtgctttgtgtcacttaggtaaggacaggtagtgcatttacatggcctgctttgggggctaagactaatagaggaaaagcctgaaagaaatgagtaaatacgggttgtttccttttaggtctgtattggtaaaagtaatccacattgattaattcgtgccacagatgtccaacttagtcaaagccacagtaaatgacaggcataattctacatagtatattatgatatacaaggtaatatacctcaaatcagatcaggaatatgagttgtagcaagtcattatctcgagaatagttccagcactgcaagcctcagtgaggtaacactagggttattttgatcgttgaaaagcatttagtttttttcacgttagtgttaactgttcaaatgtgtgaacgagagtgaacacatttccttagctttgtttttcttacttagcctcactactattgaactgctgacctctggccagccaaggtctgagacttgttcctagagtggtgggtgctcgggagaagaaacattgaagatctgtgtagtctcgggtgatgacaggtgttactagttttctaggtatctcactctgtagcacagctggcccctggtgctctagtgaagagctagctatatggatgtttcttgtggctcactgtcatggcttcaaaaatacccagtgagggccaggagattgttcagtgggtaaaagtgttagccatcaagcctgggactgacatggcaaaaggactcttgactgcaagttgtctccatgtatgcacatgaataaaaaagtacccaaactcaaatctgcttgggggctctatctttttgcaatacataaggaaggacaggatattcagaaagaggccttctaaaagtcatcaacttcacacagcatcgtaacattgctgtttttagaatatacagctccgattttaaaaaggtattgtatgtggacagtgcataatgtcttgtattttctttgcgttttggtagttgtttggtttagctttaagcccacgaagtaaatgtgaatagaaaaagacatttttaatgtctgtgtatt

SEQ ID NO: 28277 - DNA, 1155 bp, Mus musculus
acacttttttcacctccggccaaaagccattgggtaaaccaaggagaaaatcttctcaagtctgggatgggggatgggactccagatttttgaaagttgtccaaagttcctcagggaggctgagactagtttataaaagaagcataaaagtcttccagagacgggggagctctttctggaccacaaatggcagtgctggagctgaagatagtgctccatgctagatagtgctccatgatagagtgcctgcttaacgtgggtacctgggtttagtccatcttagcaaacccactgcagtccttagtaaatccaggctgctctgtgcccctttgtgccctctgactcagtagtatgattaatttggggtttcaggccccattttaatcgcttttttgaacccgattactttaactttccatgaagatatatacttacagtaattttaatgaaactttttcttactgaattttgggaataattaaggctgagtcctagaaaattacccgaataattcaacattccagtccaatttccttccttagctccaccttccacattaaaaaaaaaaaaagtcaacaaaatagtgcctttgatctcctacaccaacattccaggttttaatccagagtgtattttaagcccaagtatggtttctttgtttgatctggaaatctgcacctttgttctgttttttaaacatgggcttctcatcctcttaaagcccatctctaatttttcttattaaaattcttaaagaaggatggcttagtttgggagaacgctccgtgaacgcaaccatggaaacatgatgcagatatgggtgttggtgggaaagatcaaagaaacagtcagcagaaggcaaaacacagaggaagagataattatatactccagaaatgtttttagtgaccatccatgggactgttttcaaggtctttggtggcaggattgatactcttgaaacgttgagggctagtgagtaatgctggtttggatagaagctcaacgttgcattttaagtcttgaaatcctgaacaagctaacctctttgaatttgtttcgaaagctataaaatgttattaatactattttacaagattgtttaggatcaagaatatttcttactgcagtgtatggtagctcgcacttacagtc

SEQ ID NO: 28278 - DNA, 1194 bp, Mus musculus
tgattgtagtcctcagaaggtcagactgtttgcgtttccatctttcagccagtggtacaaaaaaaagggaaactgaagagaggatatagcaggtgccagagaaatagaaagagcctgtgtaagtctgtgtgtaatcatatatccagcctgcaaggtaggaatgatttctgttaatgaagtgatccctacttttgttactctcaaacaaatcttaagactttgaaggaaaatgtctcctgttctcagtccatattgtgagccattggacttaaatagggcttctcacctgtcttgaaactggatcattttatctgaatagaaacttacattattaaatacaaaagtcattgtggtctccaaaaacatgtcttagggtagaagaaactggagaaaattagggacacagcacttcactttatggtgattattagagactgctgttccttcttataaggaaagtaaccgtaaataagtcgttttgtttcaaagaaaaaaagagactgaacctttactgagccctcaaagtttatagttttagtggaaagtagatagtaaccacttaaaatatctatttggtaaattctataaaggagtgggggctgtgatcacatgagaaagaactgcttgataaatgtgctaaaccaaaaagcaaaggagttcttcctgaaaaactgcctctgagctatattcctaactggatgctctttaaaataagaacaagagaagccttgaaatcttttggtcaatggcatctattagaacttaagtaaaacatcttcttaaaagtgtttgtttcactgtgcgatagcaagaaatcaatatttaaatgtccatataaaaagtctatactcgccaggcctggtggtgaacgcctttaatcccagcactcaggaggcagaggcgggtggatttctgagatcaaggccagcctggtctacaaagtgagttccaggacagccagggctacacagagaaaccctgtctcaaaaaacaaacaaacaaacaaaaagtctgtactctgaaaacatcttagtgttataaagataatgatatgtatgcttgtttggttctgggattgcagatgatattactggtgaagagaggggtggaaacactctctgcttacagggtttttttgtttggttatgttttgttgttattgttggttttttttgttttggtttttttttattt

SEQ ID NO: 28279 - DNA, 2608 bp, Mus musculus
tgtttccaatcttattagccatcagaatcccacattggatattcttttaaaattgttaaaattttattttatgcatatgggtgttttgcctgcatgtatgtctgcatacaacatgctggctgctctccagaggacccaggtttggttcccagcacctagtcccttgggatccaaaatcctccgctggcctccctgaatgttcattttaacagccccccccccccccccccgcttttttttcttctttttaaaaatttttttaatttagtactttagtgtaactgctttttatcttttcagaaactcaattaaaatgaatagaaagaaaatttcttaagtatgctatttatgcgttaaatatactggtaaaaataagattaagacatgatcacagcttcaaagtttattgaaagttaagcaatcatttagcttctagcaaatggttctacttaattgtggactagtgtttcctgtaaagaatttttcatacagaaacctaaatttttaatgtgtacttgtacaccatcaaactaaaggtagttttcctttcagaattaacctattaaattgtacatcctctggcttctataagcttttgttatatcttgaaggtggtaacctttttgtgactgactgactcacttagatcatttgatacatagcagtaaaaggtgtttttcagagtcatagtttatttaaaaattatgttatgggcagatgttcactgactttttctttaatcttttttttttttattaagttagctctttttagctgataaaattgcccattttgcaggcacagcttgaactgcagtttgtatccacataagaaccatttatcaaaacttctgttgaaatggaattatgagatcttctattgaagagggccttaatgacttaagtgaaaaaaaaaatagagacaatttctgaacttttttcccctcttgtctttgttacaaagtctggttttgaaatagaagtaaggtatgagaacaagaaccagagttagccttgttaattttctgattggggtgatgcccttaacagtgggaaatgatttcaggcaactacagtacgtggttaagcttgatgaagagttcttatgtgtataccttgaacagaattgaaaagtatgagtcctgaagtattttctgactgttaagcaaattgtgtgttttcttaacagtaacacctgctgtctatggtaacataggtaaaggtggtttgtaaatggctttgtagttttaacccctgactacctagtaatggagtagtccttattactccatataaataacaaaaataagcgtagaggggttaaaagtttgtctaaactccatctttctgttccacttttttagttatatttagaaggtattaattataaacctgcattttcctgaacatttggccatgcattagtcaggttttttttttttttttttttttttttttttttttaggataaacaatattttcagtcctctaatccttgataacagtcttttaaaaagtcaaaccctattgttttatttgttatttgtgtgttcatatagtaaatttatttcaaggtttgtgccagtggatattattggtgctttttgaagttaaagtggactatccaggaaggtcttgttaatactatgttcatctataatggcataggggaaatatatatatttttaatactgtaaacgtttgtactgaataacctttttttccccctcccgcaagcaaaactggtgaacagcggatgaagatacggaattcaaagctctaatggacctttttgaagagaagtggcttatgtggagtttacatgggcctctgatggaagaaagctaatctgtttagtattttgtgcattttactaaaatggcagcttaacattgtgtatctgctattgtgatgccaatgccggtgttttaagtggaaaaatgacctctttgctttgtgctgtgtacacaagatttctggaaaagtaaagaaaaaccctttttatggctcacacagcttaaaagtagctgtcactcaaacatgggctcacagttgagctgcttttgttttattctaaataaattgtttcttttgaggaaaatgtttttctgcctggaagtgaattgacggcaaaccttgacccctttgtttgcagcggagggggtacttgctgctgctcagattttgtatgtcttgagcaagaagcagggagatcatcagtttccttttgactatcacggtgtgtcaattctgaaggatcatagtgttacagtgaccccctttgtttgcagtgaaggggatcctttgcttctcggtcctcaacacgatgagggtgctgtttgctggcatgcaagaagccggggcaagcactctaagcctcaacacagtgcacgagtcgggggctttgctggtttgaagagccggagttcctgaaatttaagttttgatttattttgttcacccatcacgtttggctttagtttcattttttaatttgaagaaaagtttgaaattgcattatcttgcacttttaacatttgcaccaaattgccaaaagaaggagaaatgctccggttgccttttaaatgttaatgatgatgttaataaag

SEQ ID NO: 28280 - DNA, 1196 bp, Mus musculus
ttttgatcgttttggagtcatcacagaagtggacattaagaggccttctcgaggccagaccagtacctatggctttctcaaatttgagaatctagacatgtctcacagggccaaacttgcaatgtctggcaaaattataattcggaatccaatcaagattggttatggtaaagccacacccactacccgactttgggtgggtggtctgggaccctgggtgcctcttgctgccctggcacgagaatttgaccgatttggcaccattcgaaccatagactaccgtaaaggtgacagttgggcatatatacagtatgaaagtttggatgcagctcatgctgcctggacccatatgcgtggattcccacttggtggcccagatcgtcgcctcagggtagactttgcagacacagaacatcgttaccagcagcaatatcttcagcctctgcccttgacccactatgaactagtgacggatacttttggacatagagcacctgaccctttgaggagtgctcgggacaggacaccacccttactatacagagatcgtgatagggacctttatactgattctgactgggtgccacccccaccaccggttcgagaacgcagtgctcgggctgcaactagtgctgtcactgcttatgagccactagatagcttggatcgaaggagggatggctggtcactggacagggacagaggtgatcgggacttgcccagcagcagggaccagccaaggaagcgaaggctgcctgaggaaagtggaggacggcatcttgatagatcacctgagagtgaacggcctcgaaaacagcgtcactgcactccttctcctgaccgaagtccagaactgagcagtaacagagatcgctacaacagtgacaatgatcgatcatctcgtcttctcctcttggaaaggtcttccccagtcagagatagacggggcagtttggagaagagccagagcgacaagcgagaccgtaaaaactctgcatcagctgaacgggataggaagcatcggacagctgctcccacagagggaaaaaaccctctgaaaaaggaagaccgatctgatggcaatgcacccagtgccagcacttcttcatcaaagcagaagccaccttcccagaaacaggatggagggacagctcctgtggcagcatcctctcccaaactctgtttggcttggcagg

SEQ ID NO: 28281 - DNA, 1242 bp, Mus musculus
gctcagtttttgcccttctctggaattatgagaggctctaccatcaagtagaaggtcaattctcccatttaagcagggaaggaaccaagattcagacacataaactgtcttgccaaagccaccctgagtttccaacctccagatcattaatgctgatgtggatcatgctgtggcgctctggctggcacaggagccaaaagacttgcccacagcggaggaacataggcagaggccaattctgagctgttcctggacacacaagtgggaataagcaattcataaaaaagtggtggggggaacccagctcttcaccaagcatcctaattccggggttttgccatgaagataatacattaatctctattattcctaatgaacttaatacagtgcccatttaacagattgaggctggcagcaaataaaccactggtggcagggttgtgaatcaaagccagggctccttcgtacctaagcctttactcctgtaactgctacgtattcttcccactgaagaagctgatggcagggtggagcagtgcctagctgcttgctccagcctgcttggtgtcctgaggttctttccttctgtgaataaacatcaggaacccaggaaccaatgggactcagaagtcaaagggaacaccagaagggacacttgccctgttcctccttaagaccagagggtgcagtgtcacagagttctgcagtgtcatagagttctaaagctgcatttattttctccactgaccccaagttggcagaactgtcccccatgggagatctgtactgttgcataccaccaatcagctggagtttccccggaaggagtttgcaacactaggggtttgtagacttgaggcatcacctgggagggcacatgggggcagaggagtcgtgctctgggcctcgaggcatctctttacatacaacagcccagtcgtttgactagtgcgttatgacaggagcaaaacagacacaaacggaaagtgaactgagctaattaggaaagcctgttgcctagctactggcctggccatcagttggtccattcaggaaggttcctaggcaggacgatcacccctgctgacttcactagagtcactgctcctgcagttcagctcctgtggtttgagctgagtgcaggctggttctagcctcagcctctcacggacactgccctggggcagggcaaaggcttccttggatgttgtataacccagtacgaatcaggagggcctgggc

SEQ ID NO: 28282 - DNA, 2658 bp, Mus musculus
tatagtgaggttcagtccccagctctacagaaaaccaaattaacaaggtagtcagagaaaatgtgtatctaccaataaatgtaaagaactaagtatcttaaggttttagagaaggtgagcctcacctcaggagaaacccatgaacgaatccccagtctgggctgggggaagcttgggaagatgctgttggtgatctcagaaggcatgtttacatgtctgtctttctctttcagatactaatggacatagtacagtgaccagtccacatgaaccacgcaactctaatagagtattttttaagataacttttattttcttcttattactttccttttgattttttttttctatcatttcattgttgttttctcatctcatcatttgagttttgcagaccacacaggaacttgctccatagctctttaggtgaaactgaggtcaaaggtttctcacccaagtcactaaaaggggttaactctgctgcccagaaagttgattctttaaccatttctgggaactttgatcgtatttagttaccttattaacagaaaatgctaaggcatcttctatgtggaacaatctacagtgtctaaattgccttaaaagagcctgttcctagctgctggaactagtgctctttcacttcttcagaggagccaggatggtacttcccagccaggtaggttagatgtaggtggtgcatgtcagcttcccatagacactctaagccctgtttcctgtgtaaggtggcatgtctggcagagatgcgttgcttgttcaactcagtaggttcacttgggtttgtagtccagccttccaccagtctctctcattgttctagttttaactaaactgcattctagcaagttgaattttgtcccttagcatttatttctgttttatttcttttaattaagaaaaaaaattattgttaaccctgaggaacagctcaggtggttagttaccaacatctcgtttgaacctttgaagcaaagagtgaagagttgaggctagaaaaatactagtctcagactctgatgtttccagctcatagtttatagcatcagtgaactggagccataagcaaaatttctcagctctgcctcacgcagcttatgctgacggctgatttcttgagccattactcagtataaaacactgagccctatctttagggtttatcctttaagagcaaacttgtgggcatctgtgcttctgcaacctaaactatttgaagggaagtctatatagatggaagaaagaatgataaattggaccaaggtgaaacaaatataactatataatctgttcagaactgtagaccttgtctggtgttagttttatagaaatggtgccacttttgattgacacttgccacaaaaatagaaaataaaaattataaactgagatcttaaagaggacttggagaaagtacatcctgattcatgctctaagagaattccaagaggccctctaaaaatcagagagttattcccaggccacgcacctgcttgccaatatctctgcatggtcaaatgagcttcatgctcacaagctttaagtatataactatccaggattttaagtcctcaacgtgttctagcttgtgatccttcaaagatgggttatgtgttaatgataggtactagaaatgtttacttctctctttccactgatcagagaaacaggcattaaagacagaatgcaagaacggaaagcttttaccctgcaccttccttgcagggaacaattatcttgccaaaacgtctttccctttcatctcccatttctctgtacccagtcccttcctgctccttgccaatgtgatcatgctttcttctctataaatgctaacatttgaagacccctttcctagggcacttaaccatccagtcagaccatcacattcagtagggacttgtcttggctaacagcagtgtatccatctggtcagctctactgagggaaggggccaagttactgctgccctctaatctgccctctggtcctatatctattactgtgtccataggaataataggtaagggctagtctctgtcaagccatgtaacaaaggacactgcaaaatgtctggcatcagaggggacatttggagaccaacttgggaggaaaatattcattttgtattgaatgatttttaatgaatgcaatattaatccttgcagatgagcaataatcattaaaatcagttaaaaatgataagacatttagtagtcgtgtgtcttttttggttaaatagcaaaacttgattagaccctgtttcctaggatgagacaagccgtttgaagacaagatctgtcttacataagctggcctcagacttcttgaatcaagtcatcctaactcaatcttccaagtagctgggatatagcattaaaccagtgcaccctattatcattaattaataccttaagttgttatgatatggatattgaatatcctaaaatctgatgtcactgttgagtggtgcactggaacctttaggaggtaggaccaaatggaaggtgcttaggtcactggaagtgtgcccttgacaggaatggtatgccatcgcccactattgtttttgcatcctagctagtgagatgaacagttttgtttccaccttgaatttttgtcttattgttctgccttaca

SEQ ID NO: 28283 - DNA, 1172 bp, Mus musculus
cttgacgttggtgccattagaaccggggaaaggcagtggccaacctgtcttttctcttcccagggccgtttacttaatctgagctgctccacagtccctacctttgttctttccatcacggctacaacacaggtatgtggcaaggtgcctggttttcctccactgagaaggaaatgtggcacacacagatacgggctctgatgagtgtactgcctgttcttactgacctattaccttttctacggcctaagttactgaagttcacattgttcctttgaagtggtatttgtgattgtgtctctgtgcagcaatctgcacagctaaaattatagtgttccagcttagttatatttagtttgttcttttgttagaaactaaacaaaaatatcactttctcttatatcatctagcctttatctcagggcagagccctgggtgcactcagatgaccgatcattgtcatgcttatcctaaagtacttttaaatctagttttattttatgtccttgactaagaaatgcttggttctcctgctctgtgtcccaccttaggctttggcactgatagagctttacaacgccccggagggacgctacaaacaggatgtgtacttgcttcctaagaagatgggtgagtgaaaactgaagcctgcactgaccctagttggctgcatgaccctagttggctgcatgcttttataaaatgattttcctaaagcactagctgtagagtcaggcttctgattattcttctagtgccgggcctcagagacattctattaacaccatgagccttcattcttgtgagaagtaatttaagaatagtactatgtcgtttccagaattgtagtaagaatccaagctaagtaaggaagatgttcttattctcaagtcccttccagagctcaccagacttcccagtgcagctaagtacagcttagaccaaagtgagagaaacagaaacaagttgtattatccatctaatgtcttgattggcaaatcacctccaacccaacctctgtgcctcatgggaccacttacactttgctcatgtggcataaaccctgtcttgtcctttgcctttctacatactggcactcaccccatacttaagccagtccacatgcctggctttacactaaaaaaacagcttgcatattggagatgttggta

SEQ ID NO: 28284 - DNA, 1128 bp, Mus musculus
aaaccccacttccacaaggattggcagcagcgagtggacacttggttcaaccagcgggtgcgcaagatccgcaggcgcaaggcccggcagacgaaagcgcgtcgcatcgcccctcgccccgcgtctggccccatcaggcccatcgtgaggtgccctacagtgagataccacaccaaggtccgggctggcaggggcttcagcctggaggagctcagggtggctggcatccacaagaaaatggctcgcaccatcagcatctctgtagacccgaggaggcgaaacacgtccacggagtcactgcaggccaacgtgcagcgcctgaaggagtaccgctccaagctcatcctgttccccaggaagccttctgctccgaagaagggagacagttctgctgaagaacttaagctgacaggacccgtgatgcccatccggaatgtgtacaaaaaggaaaaggccagagttatcacagaagaagagaagaactttaaggcttttgccagtctccgaatggcccgtacccaatgcccgactctttggcatccgagcaaaaagggcgaagggagctgcagagcaagatgttgaaaagaaaaaataattccatgttggagagttgcaataaattttccataaagaaaaaaaaaaaaaagaataggtatgataagcgtggcttgtggctgttccttcatagcctgctgttataggcctcagaaaagaacccagaacccaggccattgaaagccctgctccatgagccctgtgcaggattcccagacaaggcctgatggaagataacagccgtggaacacgtctcttagggtgtgcttggatccagagccctgcaggtctctggggtttgtcactcttgaggctgacaatcctagggcttgaatgggcagctgtgacaccctgagtggagcccagcttctggcagagtcatggccttggggactcaaagcagattgtgctggcccatcagtttttactaaatgtggccatctgggctcgaaagcaccttagggcgagcactgctcttctctttctgactccctacagcactctctcagatagggtgctcacagatagcaaaggtgggcccctttgaactctcagagcctgtgtcctcgtcta

SEQ ID NO: 28285 - DNA, 1147 bp, Mus musculus
tctaccttacatttttgtgacagtgtctgtcactgaacctggagtagagagactggctagattcattggctagcaagcacagaaatcctcctgtttcttttcccatggtgctccaaggtactccctggttggtttgtttttttaatgtgggataccgaggatccacaatcaagtccccatgcttgcacatcaaagacttctaccctctgaaccatctccccagcctctacttcatcttttgagtctgcgttttaagaagaaaattgttagtgtgatcactagcttagatgacacatggaagtggttacaggacatacacatcagggattttaactctgcattaaatgtctaggtcagactgttcactctagaatctcaactgtatctaggatgcttagacaagtaataatagtttcagtgttgatgtgagagatcactatggtaacgaaggtcgttctgttggtaagatccgaaagcttggagaatcagtaacatggctccttactgaaggagatgttacagatctgaatgcaagactttaactcctgcttcaaaccccgtcttctccacctactggccactcacaaaatcgggactgcagcagactatcatgagctgtatgcgggtgtccataacttggttctccaaagtatccacacggatcctctcctcctctgtctctccacctgcagcacacacagaacactcagcatcccaacccagccaagccaaggagattgcctgatatgccctaccctgcaggcaaccccactcacacaggttgtgcttccggccaaggtagcgcaggatggcattgctctgggtgaccttgtgtgacccatcaattaagtagggcagctggatggacaagcagggaaggtcagatgggatatgaggtccctccatcccttccctgggtgagagcagacacagggcctggcactcagtgtgcctgccatgggaagccctccatgggcacagtgtgcattgaatgagagagctgggacacagcccatcacagaaacactgtgcagccaacagggatggagcaggagagcagaaacactgatcctaaaccctcagccaggccaggagatgaggtgagatcaccacgtcttccccaaacctccctttccctgcacttaca

SEQ ID NO: 28286 - DNA, 1198 bp, Mus musculus
gaagtcctcaccgcactagtaggtagagcacggcctgtttcctggacgatttcagttgtttgcttctgcctcatgtaaggtcagagttcagagccatgtgctcaaagccgtctcatgcacagtggtcctgacaatggtggtagagaccaggagacagggctgtatcctgttgggctgtctaatcattctaactaaatgcttggatatcatccctgactgaatctcatgtaggtgacttctcctctgcttgctggggcctgcacagccctgtgaggccagcctctgccagggggtctgtgtctgaaagtggtgacagttgttttctgcttcaggagaaaaagaagccagagtacttagagggtctccctgagaagatgaagctctactctgagtttctgggcaagcagccatggtttgcagggaacaaggtaaagggagggggtgggaaggaggggttgccatcctttccaagcatcaaattccagagcactcacccttggcttcctgcaggtcacctatgtggattttcttgtttatgatgtccttgatcaacaccgaatatttgagcccaagtgcctggatgccttcccaaacctgaaggacttcatgggtcgctttgaggtgatgccctgatctcacttcctcttgaatgccctacttccctcccctgtttccagactgcctttctactccttcaaatggaaacgaaaatgattagcttttgttaagcatggaactgtgttcagttctttcatctcttgcatggaatttcccatcacaccctgcgttttgtgtgaacttatcagctccattggatcgtgttgggagctgattgtgaagactgtcagcttttcagggaaccagtaccactggaaggggttgtggttttctcctgtgtgcttctcgtgaccaaaaaacaaaggcagtagatccacctgatgccaaaggagagaagtcataagttgtcatggagcctggattttccagccctgaagcctatggaaacccaggacatggccagagtgtgtagggtgtactattcaggattgatgtacagtaccaagatgctatatccatatggcctgtagaattctttgcttagtcgggtccctgactggggaagcactgggactcaggactacagctagtgctgcgtagacagttcactgctgctgcaggattttatcttaaattgttc

SEQ ID NO: 28287 - DNA, 1209 bp, Mus musculus
ttcagctctcactggaatctcctgcctgtagctctcagcgctcagtttacgcacttgggtggctgtgtgtgtgtgcgtgcgcgcgcgcgtatgtgtgtggtgtgcacatgcacgtgcggggtgacggcgtttgtgcagtgtgggaggtctcaacgggtgaagatgaagtcatacaaagaagtccccacaatgtctgacctctgtctcttctggtcatctctcccagctgacacacccgatccgcatgctcctggaatacacagactcaagctatgatgagaagagatacaccatgggtgacggtaatgccaccttcctggtcagacacctgcttccctcttacctatcaaactatgcctagatttcccgttatttagccctgctggtctccctctagctaaagatagaggctgctgcttccagaaacctctttgagagtgcagtttgattttccaatatagatcatggagaatggagttccttggtccatttgtatttataattcgacagaattcactactggggtcttattgggtccaggctgcctttattatcagttgttattcagacccttctccacattggaaagtaactctctgtaacaggttgcagaggccctgccttaggggttcttgctactggtcgataatctgtagaagggtgggacagtggggtaatgccttttcacatcttcttgtttacagctcccgactttgacagaagccagtggctgaatgagaagttcaagctgggcctggactttcccaatgtaggtgcaggggaggagaggtttggggaagacacggtgatctcacctcatctcctggcctggctgagggtttaggatcagtgtttctgctctcctgctccatccctgctggctgcacagtgttctgtgatgggctgtgccccagctctctcattcagtgcacactgtgcccatggagggcttcccatggcaggcacactgtcaggccctgtgtcttctctcacccagagaaaggattcaggtaccccatatcccatctgaccctccctgcttgtccatccagctgccttacttgatcgatggatcacacaagatcacccagagcaatgccatcctgcgctaccttgcccgaaagcaccacctgggtgagtggggctggccacagggtgggagatgggggataatctcctcggcttggcaaggttgggatgcctagtgta

SEQ ID NO: 28288 - DNA, 1192 bp, Mus musculus
catcgccacccaggtgtggaagctcagctcctgcgatatgtgcgagctggcccgtaacagcgtgctcatgagtggcttctctcacaaggtatggaactcagcctgcttggggctggccattacccttctcccttcctttgtatttggggtcctgaccttgtccctgtgataattggatctacctgcatctctgcctgttacctatacccctgcaggtgaaaagccactggctgggacccaactataccaaggagggccctgagggcaatgatatccgccgtaccaacgtgccagacatccgagtgggctaccgctatgagacgctatgccaggagctggcacttatcacacaggccgtccaaagtgagatgctggagaccatcccagaggaagtgggcattgtcatgagcccagggccttagtgcacctggtctgtgcagtgctcgtcccatctcagcgacttgactgtgaccgtgattagacccctcccacctgatgtggtctctgcatgtctccgtgctatgtttctgtcctgcatgtcttcgaccatgtcttgcctctgggccacctcagtgaaagcaagtccaggaatctgcttcattattgtctcggctcaggtggtacctggtggctgagatttaagagttggccctgctcgtgacccatctcagaattgtcagaagtctggctgtcctatggtatcctcagtgtccacaggggcttgggatggttgtgtagggctggccccttgagcaccgggaacccaggctttggttagagttcaagttgagtttccctcttgtttatgtggctgtgggacaggaggggctcgttatctctctgctgtggcactggctgctcagcctctgaagttccagctggtctgcgctgggcagagcaggacttaggctcactcacggccctggaggcctggcctgaggggctggcccactgtccctgctgagtcactgcccatcagccccgttcctccccagcccacgtgttcctttgttaccagcccccttgtatccctgtgggagggggcagctgccctgacctgtctcagttggaggctattgcagttggagggtgctggaactgttactagctctggaggtggcaccttctttgggggtttccaggtctttgaccagacccagttcccagccagcctcttgtgttatgttctaga

SEQ ID NO: 28289 - DNA, 2754 bp, Mus musculus
ggtgttgctttccgtaagtaaatgctgatggcctaacttagctgggtgcaggcagctgttacacttgacaatgttggtcgtctgcctcaggttccaatacatacgaagaggcagctgcttacattcagtgccagtttgaagatctgaaccgaagaaaagataccaaggaggtctacactcacttcacctgtgccacagacaccaaaaatgtgcagtttgtttttgatgctgttacggatgtcatcattaaaaacaacttaaaggaatgtgggctttattgagaggatggcatagtaaaaggtaaaacttgagacagtttagttaccactgggggcggggtagctttgtaaatgtttttctgattaacaatgtcttctcttttttagctattacagggaggagtgttgagaccagatgtcatctactgtctcttgggtcagcagcacgcatgacaggaccaaggaatggcagcaacacgcagaatcttagctagcgctctccagcagtcttctctattagggaatgtctaattggcatgagatgttcaaatcagacctgggattggacaactgtaaagtatgactggatcgtcagggcgtcgcttggactctgtaatctaatgtttagggcatattgaagttgaggtgctgccttccagaacttaaacatgtagctcactttcccccatctttttgacaaatgaccagtagttaatttctaaggtttttcttatcaagagaagaatacttaaaaactcttccttgtttgcaaaagaaacttctgaggactgagtcttaactatgcacacaatgtcaccagacatcttgaaactattcctcttagtaggaactgtttgtttttaactcttggaatggtcgggagtaatatttcaataattaaaattcttcctggttattgggactatattaatagagcttttcggaatgaaatttatgttactgtcatgtttaaagtaccacaatggtttctaaacagcattcaccttggagagttctacagtacgattcctgctctcattgctttacgcttacggttggaagttgtatttgtcggggttaaccttgtttgtgctgattaccaaattactagatgaatactgatgtagtgtgttaaactgcttcttggacacacgcaggatagccgtcaatgagatgcagatgctaaattgagaaccagtggcttgctgctacaggtctactaagttgaccacatggaatcttgcctgtttgtctcggtcatggggaggttttgaataagatgccccttgttttccatcttcgtggccttttttgttaggagacatctaaaagtgtattaacagtgcatgcttttcctttgtaaatgtggtgccaaatccctgtttgccatcgtttttactgtagcaatgttaactgtagtagtagtccttactatattctttttctaaaacttgcatttggggactttttccaccttgtcgtgtacagatttgaatctgttacagttggcagcagtattaaaacaaacggtgagtgaagagcctacggttgctccgtgcataactagttctttctggggatcctgtctgtctcttttttcccctgacctctgtctgagagtggatttattaggtagaaaagtgtctttgaaagtctagctccttgatgtaatagtattaccaagtcaggactgagggctttatgtgcagtccgtgtacaagaggaaagtcacaatccggctttcggatgtgtacagtttgcttgtgctgagagctacagtccttttgtacagtatatatcaaatgtcattaaacactgagtggacactgagggacagcaaacaatgcatttggagcatttcagatcagtagtttgatcagtgccttttgaggtccagtcgctgtggctcggatccattcatctctatgttacctcctactcgtttgaaagaaggttgatggtcagaactgcttcagaagcaagccacggtgatcagtgcctttgttggcagcttttacaatttttaattcttacgtgttttgcaaaatcattattatgcagacagtataactgttatcttacaaatatttcgttagggctaggaaaatgtcacttgaaagaaagaaaagtattgatttcaatcggcgattgactcaattcccacaatgtaggggctaataagtcttactctgaatttatctttcctttgttgtattctgtaatataagaacatctggtgaaatattgttttcataatttttctatactttgggtttaataaaatggtgttgataatctaaaatattagataatccaaatttaattttacttcagaatgcattttgtattttcatttgaatctgtctattttttaaacctttctgttaattaaaaatagaagttcttcacttctttgtctctgcacaccacttttatttgtcttgtttttacatgaaatcattcttaccttaccatccaggttccttcctttagaagtcccccaaagtctgaagacgatgtttctttcctggtgggcctttaacctgtaaggtctaaaacggttttctttaggtagactttcacatcactaatgtttattttgaagaacatttcttaggcaaaatcaaaatgtggggggattaaacatcgtattagcctggagggggacaaaaagattgatacttaaagaagccaaaagttaggtgttttctctggaaaatgctgatgtttcatgatggatattattcatattgag

SEQ ID NO: 28290 - DNA, 1174 bp, Mus musculus
gcagtataggggctggagcaccagttccagagacaaggtgtctgcttgcctatctcagatcctcttctcccagtggctcagaagcaaggcaggtgggattcagtagaggaatggggactagggggcagaagtattctcagtggacctcaccgggctttcctcagggatctagcatgactctctaaatacagcttgatgaacagaggtccctgcagtgcagaggggaactaactgttcttggcttttccaaagccctctctccggctcaagccatccagtgtgctgtgaacgtggaggggatggttacccggccacgtgaaagagaccctcttactagggtcactttgataaagggcgcccatctcctttcctcattaaggccagtgctgggggctccctagggtgggccaggtaaggttcagcagcttgttctcagagcacagaggcgatgccagaaagcctgagcctgcctgaggtgttgcctcctcccaggtggtgcgggggctggtgggcgggcgggcaggcgtgctgacagccggcagtttgcgtgggctgtgccatctgatgtctattcgcagccccgggaggaaggggagtcatttatattctgcaggaagaaaggacccagctgtcgcttcctctgaccagtgggcctggagggcatcggtgcagagcacagaggaagagtacaggtagtggtggtctcctgcttagggatctgaccgtagtgtagggggcagggcaccaggaggagcccttcttcctgttaggccagattggggcggggctttcttccctcccgtctttccatcctagggcagcagctggacagccattagtcctcagtgccagggtgcgcttcctccagctgggatctgtggctgccggctgcggatgcctcctggctgaatgctccctcttccccacacctgcccccttttgtagcttctaatgtctgaatactacctgggcttctcagtagcaaggaaggggccttagcaggaacacaaatggctgtcctttggccatgttccttgactagggaaagctagtagtagtcagcctgttttgcttttttcaaggggacactcaggatgttcaagatttttttaaaaattgccaatcatttgcacaaatttccatatcatgctaagttctgattccatatttgatg

SEQ ID NO: 28291 - DNA, 1195 bp, Mus musculus
gttcccctctgctggaagccaagtatggccggcaaccctgaatctgggctcttgttggtgtcttatgctaaacaaatggccaacgtatgggaaacatggctgcttgtctctgacagctccagggatggagggaccaggccatcaaggcagaccgcagcctcttggtttgggaagactctagtgctccctgtacaacctcactttaaaacaaagatttctcctaatcccccccacagaaggcgatacagagagagtcttcctttgctatgaggaagtgcaactgctagtgggttctagactaaagtgactttgtgtttgcaactccagacagaagcaagagattgaataagacagctcacctgccttccctcccctcctcctcccctgagcctgacagctgcctctctcttgtgggtgggctgtgtgctatgccgactcctgaacattctgtctgtcctttaggtgaagaggatgactataccacgtggctggcacactccacagaccctggagattacaaagacggctgcattttgggctataaagaacagttcctacggctacggaagtcatccgtctgtcagaatggtcgagactatgttgtggccaagcagccatccgtctgtccgtgttccctggaggacttcctctggtatcagcatttctcagatccctctgtcagcccctgtcccacattcggggaggtggaaaatagttgtcttatccagctaagaaatcctgacattcctctccaccagactaaataactcttgcctgctgtccacaaaagtgaagcccagagaaaggggaccaaacggtactaacacttcacagattactttatcatactggatagtcactggacacagactgtccagccttagaggtcgtgacatggacatggtgggaaggacagaaattaaataagaagaggcggtctggcgtgtaactcgggtggtacagggtttgcctagcatgcacggagccctgagtccaatccccaacatcaaataaagcatgtgtgttggtttatgcagtaatcccagcacgtgggggtaggagcagttcggtaatagcctggaatacataagactgtctcaaaactaaactaagggttgcaggggcagtctacaaaatgataaactaaaaacaacaggaacagtagctcagggccggggaggaaattggacttggc

SEQ ID NO: 28292 - DNA, 2113 bp, Mus musculus
gacatgatggctcaccactcactagaactctggttccagggaatccaatgccctcttctggcctcccatacatatataatgaaaataagtaaatctattttaagttaaaaaaaaatacacctgggaccaagttatgcatgagcccaaagcagcactggagtgacaagaggcgcagagcaagcaggtgattgctttcaaactagcttcctaacttgtcaataacgcgcacgtgtctttcttttcaggacctcctggaatagctcttcagaggagctgggactgcgtgtgcgtggagccacagtacctcctacactccctgaggctccgacttggggaaataaatttcccacctcgtcggccccagctctgtttctgccactcctgtccaagcccaaaggacctacactaaagaaagcaggatgggggtgggggaccccgactgacctcacagttggctctgaggagaggggggaaattttaaattctttaacatttttgtttcaatttctgtcttttgtaagactgtgggctttaggcttctcttggtttgttttgtgcattaagggacataacttgggactcaaagggattgtttcgctgaccccgctcttgtgtgttccctctggtgcccaccccagggcatctgccaactccagcatcaactcaactcccaccgcatacctggtgctgtccctgggctctgctggtcatgtgaggcagcctcggagaaggaagcagagggtgtaatgactggcacacctggacagcttttctccatccgcagacagccctgttcagagagtaccgagcaccagccctgtgcggcttcctcatccccacctcacccccaaccactactgtagggcacaatgacttttcttttcccgtttaattaggcaatacccttgttaattgcccgttggcaactaacttaatcatgtgcttccaacacactaaatagggaaaacttacagggcaatatttttaacttgtggcaagagggaggcagagaattgactagctctgacacctattaaagacaaaactggctgcttctgagctctttcaggctgtactttgtgctgtgccagtggctctgcccaggctccgccatccctttactggagttcattggtcagtgcacagtgcagccacaggactgaccgtcgtaggcttccatttttcccatcacccactgtaaaggctcagagttgaactaccactgtggctgcttattgcttcctcctaagttgctactgttcatagaactgggactgggaatgttttcaggttgatggactttttcaagctcaaagttatgttcccagactatcctcacccttcccctagttttgctgagttatttgttgtccagaacctgttggctaaccccactgaaggcacatttctagatgatgccgtgtgtggtcaatacattgctttcatgttttaaatttaaggaaaaattttatctgatatttttccaaattaaataagttagagaatgcaatcggcggatgtgggggcggccatctggtagtggaaagctgtagcgatctgagtacagcttagatgttagctggagaggaagatggtgtggcaggtctctggtctccctacccctgctgtgctgatcacagtccctcccagttaccactaggacattctctagtagatccattttgctgtcactttattctatggctagaaagtcagtggaaagtaaatgtgccaaactcacttgtcagaacacacgagcagatggcagagtcctcctccccagcaggaacaaacggcatcagggaaagagggggaggaagaggagggagaagaagaggagggagagccaaagagatgtcaactgcagctcagtgagtcatggaacgtcagttagaaaacgaagttagggtcgtttctgggaagagaatcaatacctgttagagccagaatgctccaagtcttttagcttgttcattttgtaatgattctaaaataattccaaagatatagcagctcataaatttatcaaaagttctgtccaccctcacctcctgccaaggggagagatctatttctactacacgctgtctctcccagtacatccccggattgg

SEQ ID NO: 28293 - DNA, 1340 bp, Mus musculus
tctggctcatttctcttgagcaccgcactattcttgccatagagagagcccaggagccaacgctgaatcaggtgcccggagtctttggagctctgaaactctcggctatgcaagaccccgggtccttgcagcagagcttctcatgggtggcttgctggggccgggccgaggactcctcagaggcgtttcctgcagagccattattttgacgcctttttgttttctttttgaaaaacaaaatattattcccctgcttcatggctgaaataaaaggtgatggtaactgggggcaccccctctccctgggatagccactgtcggggagcacaggaccagcctctggatcagtccctctctgccccttcacttctgtctctagctcactggctctgtgggcttgggctctgcccctacaacggctctcagaagcattcacacgcacagatgtgcaacctcagccagaagttgaagctctttaagccattttatttattttgttttttacagaatttgtgctttggtttgccctgcgcagccttggagcatcataagcctggctggtgggcatagttattctcagcattgtggtggcaaatgacgttggttctagagacttagagacttgggcaataggatttaacactgctaggtagctcagacatatcagaaaatccatagtggcctgagttgtaaatccaaaacatatttttgttggcttgggacgttaggggcttggggttttcctgaggcaagaggtcatggctgaatgggcctgtgccgtgaattgaatggaacactactttgaggcccttggagagtgacagcagctatagggtggactcaggagctgtcagtcttaacagctgagccttggaccccactgcctctgagtctacattctggcaggcagtcccatgctctgggccttacctctagtcccctgcctgctcacacctggtcccctagccttttctcttgggcagtgtagtagtatgggcgagccaccctcagctcttttattggccggggctataaaccatggctgggcataactattccgaactgtccccccatcaggatacaagatgctgagagggctgcagggccattccatcaagccccagggtgaaagggctggcatggcatcgctcattttattgctctgcaggtaaactgtataggtatagagtcctccagtgctctgaagagccctgcctctatgcacgcccccggcaaagggcttgtcagtaggtccccctcaactccatactcaacagggatgcacaggattgctaacagagggcggggcacacctcagttttctatcaccttcctaccag

SEQ ID NO: 28294 - DNA, 1688 bp, Mus musculus
tatggtaccctctgatggcagtagtctggtagaattgggcctctagaacacatgctggtgagaacagagaagctgtagggaaatttaggggtaaatgtaaatgaaagatgaatgtccctgggcatgttgaggcatgccctgcaaaccacccccacactcctaggatagactagagtgcagagagggggagggagagagggaaagagagacagagagagagagagagaaggcaggagggattttgaatttgagatcattctgtgctatagagttgagacattgtctcagaaaatgggagtagaactaagttttcctcacctaaaagcagttctcatggccaaaatggagtcagggttggggattgtccccgactcgccgacaggaatgccttctgctagctgttgtccagcatggtgccatatttgtttttcagtcatgaggaagaagacataacagtattagtgagtccagagaaaccacttcgacggggcctcgcccatcggagtaacccaaatgaagtagctcccgccctccagggtgtgcggtttagcttgggcccgctcagcccagagaagctggaagagattcttgatgaagccaaccgcctggcggctcagctggaggagtgtgccctgaaagatcgggagagggctggtacaggccctggaaggcccagccccagagggaaacccagtcctcggcgggagaccttcgtcctgaaggatagccctgtccgagatctgctgcccaccgtgagttcttggagcaccccacctccaagcagcctagctgggctccggagcagtgataaaaaggggtcagccagggctgtccgggtggcatccggaaagaagccctccagcataaagaaggtgagtgtggagagtggacatgcgtgcgtacacctagacaaggtgcaggagacactgaaggcgtagtgtcattcccatacagggcagaggaacacagttaattatcccctggaatttttaggattaagcaaattgggttggagacctggccaggtggctagagtttgcccagcctaaacaaagccctgggttggattcttcagcatcacaggaatggatgtggcaaatgtaaattcaaggtcagtcccagggggctatatgctgagcttgagaccaacctgggctacttgactccctcatttaaaacaaaacataataataataataacaataataataataataataagttggtgagatggctccgtgagtaacagcactttccatcagggatgatgaagctgagttcaagccttgtgacctacatgtgaggactgttgtctacgtgatgagcacactcccacatgctgtcctctgacttacacatgcatgttgccacatatgtgtatgtcacatacagtaaagaaataaatataaagtgactttaaaaaaaggaaagtagccgggtggcagtggtggcgcacgccattaatcccagcactctagaggcagaggcagccgaatctctgagtttgaggccagcctgatctacagagtgagttccaggacagccagggctacacagagagaccctgctttgaaagaggggggaggaggaaggaaggaaagaaggaaggaaggtaggtaggtaggtagatcttgctggctgatatcttccttataggttctagacaacgccctacctactatctcctc

SEQ ID NO: 28295 - DNA, 1476 bp, Mus musculus
acactactttcacgtagtgttaaggagggaatgccttgctttctacgtggctcatggttttaccttggtcaggaaacacataccttcatccagtctttctgatgacgtcagctgagcttcgttctaactcatctcttgttaatttccatcaagcctctgtttcccagaaaacaaaccttccaaccaccagtgcggctcgaggcaggaccaccagtgccgctcgaggcagggcgcagcccctcaggaaagctgcagtccctggaccgactaggtaaaactggtccctctgttctcatcacctgggcttccaagctgcggtgcacacagcatcctcgaattctgtgttgagtggggaggagaggggtgaggggtgctactctcccatcctgagggggtgtgagtttggctgggtaccagacaggctccggaggaagaaggtttttttaaagcacccccccccccctcttctttcaggtaagaagagcacgtcagcaaacaaagactcaatagcaagccactaccatcttagccatcaaagtctggactctcctctgccagtggtccctaactccagtagctctgtgcccagagatgggaggaagagatgcctccagggctgacctctgaagtagagactatgggggatcgggtgccttgagcttgaggggactcaaccccaccctaccctgccctgaaagaagaagagaggggcagaggtcatctgcccgtggagaaactcacaaacaaaataataaatgcaggcagagtgacctatctgtctccttccatcttgtggtcaggactagagagcttgatcttctaccacggttcactggccattcccatatgagcggccttaggagcccgccggctcagttctctatgacatgtcttcctgactggatactggtctgtttggaaaggccaggaggacagctgatgtacagaacttgtttcctatgaattctttgacttctcacaggtcaatcagttataagcttactcacatcttcatattttttcttaaataaatgaattaaaaaaatttttttctgtatatctgaaagtagattttaacagttttaaaataaacgtctgtgtaattctagtgagctctcagacataggccctagggatttgaacctccagctcctgcagccgtgactagtcccttggtgccggtcaattccaatcaagtctcctttctcctttcagtgtttacagatagtccagatcaaagttgactgaggtttcacctacagcgcctgaggctgttatggtaggaactaagtctactgttactccttagacttaactattatttgacaagacaatggaaccccttaggggatagaggccctttgttggtgttgcttctgaggttgcctctacctcacttcattagggttgcctgtgctctctctctgctcctctgctggatccgagggctggcatcacaatttagtaactctgact

SEQ ID NO: 28296 - DNA, 1134 bp, Mus musculus
gttgtaacacaagttgtcaggacaaggattgggattctctgtaaagttactcctgcctgaaggctgtgacgcgcttagagaccagtatgatggaaaagcctgctagcacgcacatacattccctaggaagggcttctcgcagagagaaggctgagtgtggtagctgacactcctccacaggagcccctaggttccaaagcacgcgctgtggttatgaacagcagcttccgtctttacagctgtccccgcgtggggagaggctcgccacatagcagtcacttgctgtagtgtcagaggcagggcagaggggtgcaggacgggtctgtcctcaggaactcccactgtgtcctaatagctgggcacctgcccccccgggaaggcagtagtcaggctttcttcaccagctctctttcatctgtgatctgtatcctccgctctaatgacaccttaggtcagtctggagcttgccttctagcaggttaaagcgcttcctctagatgctgccttttatcttcgtgtggccccagaaggtagggtgggggcatgattatacctgtcccagagtgggagaatgaggtagcgtggccaggtgggagtctggctcagagtgacttgcagaggttgggagctgagtatgaccctgcttgtgacagggcttcagctcagcccacctcaactgctttggcccagtaccaagcaagcaaagaggccgtgtgcttatttcttctagggagttggttaaccttgctcttggtaagcctgtcaaaactgggtgcctacaagggggaaacaccgaggctcttctgcctgctgtggcagctggctgcccaggcaggctccgtggccccttggcttcagccctgggaaacagcctggacaagaggacaaagagccaggctgctcccatttgtgattaattcacattcccataaccttaacattcagttagaagaaaagcagcttgaaccgtgatggggagactaggctgtcccgcttacaagtttgttaggaatagctaggtggtcctgtgttgtcttgggcctgacctaggtctccacagctgctccccccacccccgtcctctaacgcctgtagccttgggcacagacagggttctgccttcctgtatccgct

SEQ ID NO: 28297 - DNA, 1099 bp, Mus musculus
gtttttctgatcagctgactgacattaaacacagcttcgatctgcctggcactctgagctggtttctcttcgttggcagatggacttagaaatatttgttgagtgcataagatgttgtacatctgccagcattgaccatttaatatcattctgtgttttgcagttgttcagtaagtttttaggctcttcatttgcatgtttgtttttatgagtgttggatttcctgtcttgtttgttcgtttttatttgtgtgtttgtgtcagggtgctttggtcagtgctctacatagcccaagctgacctcaaacttaaggccctcatggttcagattcctaagtgctgggatttcttttaaactctcacaggggctcctctttagatagacctgttgcctcgctgttttagccttcaccccaagcattgctatatctttcctggggcttcggatgcagtctttcctcgcatgtatccctcctccaggtgattggcaaaggcagcgaaaagtcagatgacaactcctatgacgagaaatacttgattgccacctcagagcagcccatcgcggctctgcaccgggacgagtggctgcggccagaggatctgcccatcaagtacgctggcctctccacctgctttcgtcaggaagtgggctcgcatggccgtgacacccgtggtatcttccgagtccatcagtttgagaaggtgagtggaggggagggggagagtcagttccctgtgtgtccagatcgtctcaggaggagcgtgatctgcctgcccactggctgcagcttttacattcattaaggatttcttggtggggaagagcctagagaacgcatgcagtgctttgtgcacagactagagcaaggcttcctaaatctcctgtgccagttccaccacttactagctgggcgacccctgtaaagagagcaaatggcgggagccgcctccggaggctggctgaacaccaggctggttaggttagtgtgtgtcaggcacttactgcaatagctagcacaagatggtgatgctctatagacgccatcgtcctggctgttgtagtccagttgagaactgatctcctctgggacccagcctgg

SEQ ID NO: 28298 - DNA, 1186 bp, Mus musculus
tcctgcggagcgggagcttcccggcacaaagctgctcggagcccagcctttgttcccagacaccccagccgtggcggggcccatctgtgccgctttcattcattcccttgtgaacactgaactcacagccggctggggtgcggtggggccttggagcctgagcagaccgaggtcagggcctggagcccaccctcatgtggcccggagaccaatgagagcccacaaagaaaaagtcctgcattctcctctgtaccccaggtgatgccaattgtgagaggcggtgtcttgtgcagggtttttggaaagctatttaaaagggtaaagagagactatactgtagatttctgagcaagtcaaggctccaagtttgctgactggcactgcttctgtgactttgtgactttgtaactttcttgtctgtcagtagcaaattcccttcctccttggttgtacatgaggcccgaagctggtgctcggtttaatggatgcactcaaaggctccgctggtctctgctatatgccccttctccattgtttcctcaggacgcagacaacaaagtagaacgtatttggggagattgtacagtcaggaagaagtattcccatgtggacctggtggtgatggtagatggctttgaaggcgaaaagggagccgtggtggctggtagtcgggggtacttcctgaaggtaagagtggggagccagaaggaactataaatatgtatatatgtacatacacacacacacacacaaacaaataaatgcgagaagcatgatcatacttgaagaggctcacaaatcctctacttgaacccgatgcctgcttgtgaactcctggcaattagacacgattctctttctgaggcaagagagcgcttacccagattccatagaacaaaagccactcagtgatccttcataatgaatatgttttgctgactgaatcagaacagtctctgcctttgaggagctcagtgtaattggacagtcagacaagtaacaaagacgccgagcccagtgtggtaagcctgcgctctgaggcgacccagcatgctttgagctgtggtaggtgtgggcagctggcacagactaactggagcagagtgcatgtgaattcaggaattcttccaaaaggaaatggcagaataattttggaagtgttgcacacttcaacattgtatattta

SEQ ID NO: 28299 - DNA, 1470 bp, Mus musculus
ctgtttttaagccaccagtccatgtttgattccaatccaagattcacatggtggaagaagaaaaccaaccttagcaagtttgaccttcacgtgtgcaccatgatacactgctcagactctgccaataaataagtaaaaacacatgataaacgataaacgtctgtaagagtgttcctatgatgctctttacattttatataaaactagtacataataaggaagcagggatttatgcctacttgtaatcgcagcacccggaggctgaagtgggaaggatcttgagtgggataccaggttggataacttagactttcaaacaaaatgcaacaaaacttgatttatggaaatcaatcctgtgtcccccgggacctccgagccactaggtggcagaagagaatgctttggataaacaaggtatgcggaagccgcctgatcgctctgtggttcctcccagaatcctttgaggcaagaccgagtgtttaaaagagggtgccccagccacttcctcgcgagtgggagtgcggctggggctgtggatgtctgtgtgtggtattgtgtgacgtgaatggtgcctttgggctgaatgcgagtatggatattggagtgtgtgtgcgagcgactgggaggtgcaaggcgagtgtgtgtaccccccctcccctcccctcgcctacaccttgatcttatttgatcgggtcgtgacccccgccccgccgggccgccccgaaatgaaaagcagccctcctgcgaagccccctcggtggggcgctgtgcagcgaggccctctgggcggtggcggcgtcgcggttcccggggttccgggatcggtcctgcgggcccggcgctcagaagtgatgaattgatcagatagacgaggccgggtccgtcccagccgctgattaccgagcgattctgatctgagcccggccccagggcccggccgccgagccccggctcacgtctatagcttcgtgtgctggtgaagctcaagaggctcaaggtgaaagagcccagggcagacgtcacgccgccccttttggaggctttgttcccgcagcagtttttttttccccaccgtgtgcgtgcgtgtgttctcaccgtgtatgtttgtgtgttcttttagttgtttgtccttttagtctgggcttgtttgatctctcacacacatttgtttaatgtatatgagcctcctgttttgctgacacacatatggttgtgagccaccatgtggttgctgggaattgaactcatgacctctggaagagcagacagtgtttttaaccactgagccatctctccagccctgatctctttctactaacagagtttcacctagggctaaaaggtaccatgccctgtacagactcagttgaggaatgtgtccgttacagagcatacatttataaactactggatgcagggacttgtgggctgtgtacgatataaggctttaagagtggatgtattgttttg

SEQ ID NO: 28300 - DNA, 1393 bp, Mus musculus
ctgtcctggaactctctatggagagcaggctagcctcaaactcacagagagccgcctgcctctgccttctgaattagaggcaagtgccaggagataatttttcaggcttcattttcttcattggctaatttggatctggatctggtgaactgaagagagggagaggggctagatgagaactgggagttacgaaaggcgaaacaattgtttggctgttggagtgtgttctttctgtgcatctgggaacttgagagagggtggttctgcagagagaacagattgccacatgctggcagcctgagggatttctcaagagaacctgagtgcataggaaagccagggttatcagtaagaagcagtaacagaagcaagcaaggcagcagtcttccgcttaccagggtccccagagaagacttcactcaactgacagagaaaaggaaccaactctcgctatttcctaaagctttttaaacactttctaaatcacctagtgctaaatactgttactgggttttaaatacgaatgctgggggaggggactattaaaaaaatcattgattaatatttgaagttctggtagaagagataagtaaattagtatatcagttcatatactagtaagctcatctagtgtaagaatttgctgcgatgaaaatgtatgtagatgggagttttgccatgttataaaagacacaagcttgttctctaatctggtctccagcaagttttagttgtgtctctgccaactcttagtgttgtccatactgcagtatttcactctctgttaagaccatgagaaactgaaatgagaaaacccactgatactaacatttggtcagctcgtagaattcattaatgagtgtgtttctgaggaaagaaaaatgaagctttgcaactgagtgttgagggcttttcctcggagttgggggactcctgagcaggtgatgtcagatgtctctgcctttgaagggacgatttctcccttccctccttacacccgaaaaagactcagtttgtaaatgtgaagtctacaacagtggaacaaaaagtaggtctaatattatagtacacacgagccacacatgctcagtggaattgtgtgtcataaagcttgacagaacaagtgcaggggctcactcccagaagtgaaattcgcttttgtctgcacactgcaccagaacaggctgctgggaatcgcaggtcctgatgcagttgactgctgtgagggtctgcagcagtgtagaaagtcaccaagcacacgatgcatgtgtaaggctcgctaggaattggtccacaggcaaattgcaatgattgctgttttctggccattcctaaggatccttcctcaggagagagaaaaatttaatgggtctggagagatcttgtggatggg

SEQ ID NO: 28301 - DNA, 1784 bp, Mus musculus
aggagcagagaagtaggggtgatggagaagagaagaagcacaaagaagacaaggaggacagacgacacagagatgacaaaaaagagtccaagaaaaaacacagcagaagcaggagcagagagaggaaacacaggagcaggagcagaaacgcagggaagcggagcaggagcaggagcaaggacaagtcaagcagacataaaaacgaaagcaaggagaaggcaaataaaagaagcagaagtggcagtcaaggaagaactggcagtgttgaaaagagaaaacgagaacacagccctagcagagagaagtctagaaagcgcagcaggagccaagaccgttcccacaagagagagcataatgatagcaaggaccagtcagacagacaggatcatcagagcagccagagtggagagccagagagccaagaaaaggaacacaaaagcaaagatgagactgtgtgaagattgtgtaaacttggatcacattgaatcctataaatgttgattaaattctgcttttttccccccaagttgagattgtgcagtagttatgcactctgagctccccgtaggctgtgttttcttttgtgtagggaagtgcctttgtaatcccattacgcattgatgttttcaccctgttgagttgacacatgatgcacagaatgttcttgcatttttgtttgtttttaaaatgtacagtctgtacatacgtcctggaaaatgttttaattcctttggcatggttgccatgttggttaaatttgtataaggcaataaactgccactaattctatttttgttttgtaggtgtgagattatggttgtgtactgaagttagcatggctgtgcttttcataatagaatgctaaagactttgggaatggatcttggatgtttgtttaggagaattatgtgtttttcagtatacatggaggcaacagttggagggttaacattcttgtccactgtatattaccttggaagctcttgttaatatgttgttattctccacagttaatgttcgagagaatttttaagaggtttaaattaggcttagatttgatcagaagtccttttagcattctacctcaaagggacactgttagtatgcctaaaatttattactttcctttttacaatgtgcttccccctccctcttgaattctttctcagactttaaaagtactatattaaagtgtgtaagcctggcgttgtagcagccctatactaaggagtgattgggagagggcggggcgcaggagcaggcgagggcggggcgcaggagcagaggagcagtcaagcctaagcttccaaagcattttataatggagaatacttaaattatgaaacagcttgatatagtatccttttttaagaatttaaaactttttttattgataatgaagattgctgtttgagtttttaaacttaatctaggacagaaatattaccagtaatgcagtgctgcgttatttaagactatcagcaaattatttgatagattgttcttatgacttgtattctgatttcagaaaaccatcatgagtgtggaataaatactggattaaatcctttatcctgggtgttggtttccccccccccccatttgttaacatttaaagaaaattgtgggaactgataaaatgtcagcagttttctgtagaggagatcttgagcaaaagtgactatttaaaaagaacacattgctcagcctgtaaaggtgcttcccacccagccagacctgagttcacccctgggctgggaggagaaggctggcaacaatactat

SEQ ID NO: 28302 - DNA, 1068 bp, Mus musculus
atgtggattgagactgataacatgaagcccttaaggctgcaggaggggattatcagaccctagaaagagcatcatgataaagttccacctacctccctcctcataccatttatttagccctctaaaaatacccaatcttgtcattttattaaaccaatgagcacagttgctagaaatgcattctaatagtcattgtgataggtatttgtaattacaagctaatgtgaaccctgctcataaatagatgtctaccactaaagaaagtaaaggccatttgttaggacctggatggttttagtgtcagagaagatggatactctgttttaaacactaagtagaaaggtttctagagatgctgatatacttgactaaagttccatacataattcttgcttgtgaaatgggaccatacattgtgcaagtggggctcggagcccagtatggagctgaggatgactttggactcctgaagctcctgcctccaccttccaaatgctggagctaatagcactgtaccactgtgcccagcatagtttttgacaaaaccttacgcacgcacaactctgactttctaattgtaaacaaaaattcactcctgttatactaatcctgcattcttcagttaaaagctggaaacaacatgccaccttaaaggtaacaggggttttattatttggtgatgaaggggcagtgttacatactagaaagtctagagctgcccagaagaagcatctgcagtgtataacttcttgagtttgacgtagtaggcactcatttggacagccccattgtttatttccttaacactaatcgaatgtgacactttctggggtccccagaaagctgaatccatgacagtggcaaagacaagtgaactccttgtcatttggtcatttgggcagagagacgtggatgtaaaagataaaatggagttcaaggtgactgaaaggcacctgctgcaaacagctgcctggcatcctgtttacttccagccctgctgttatccctacagtttacctagtgctgaggaaagatggctcctaaggagcctttactaacaggccccac

SEQ ID NO: 28303 - DNA, 1367 bp, Mus musculus
ctggaaagcatgtagtataaagaaactcttgtatttctgtttcttttgtttaactgccggggttggggggggggcaataaatgtgatctttttataattggtccacgagctaatctgacacctccccatccctatcagtatgaaactgggagaaaggcaacatggtctgattacatttcagaaacttgcagaatgatttttaaagctgtttctttcagctggaattctctcaagtcttgagtgcctacctgtgcttccttatattctaacgttcatattgttagtaaggaagtggggcacaggagaagtattttaaataaccctgctctccttacgcttaattcacggagtgctaaatttgatgaaccttagtaaaatggcttaattttacagcctgcctaggcaattctgagagtgacaggagaaaaggtctgaaagtgaaatagtgatggggtgttaatatttttattttgactttcaagactgagccgagaaaacctatgttttataatataaatatttttgtgactcttgtaaagcagtctgatagggaaggttgctgaacctagcccaagggcggaccctttacctcttgtgctggctttatttaagcacaggtctaattctgtatgaaaggaacgcgagcactctaatctaataaaagttcctgtcttcagttcttcttagttcagacaactgtgaacagtgtgcatttggggagctcccttacaatgatgtgtgagtcagattgtcacatttacttcacatatttcctttccctcctttctgtggcaaataaaacggcattctcactttttatagctgaggtctttagacgttttgtgtgtggtctgtgagtttactataatgctgctacttgtcttggtgtcaaagctcctgcagaactcagcttcagaacagctcaaatgatgattaacatggttttgagctctagctgtgtaagacttaacgggtgtggaaaactgctgttcttaagtactattgaatttcactttttgtaaccttggttctgtttttggctttttaaaaacattgtatattaaattgctaaagtattaaaactaatttgctggggctctattttgaaggaaaaatacaaatataaaaccaccagtttcacaaaacaagcatattttgatatcagaatacttaacatcttttataaatgcttggtttagaggtttaaaaagttcctttggggtctcctatgtttttaatcaagctttcgcctatagtgattgctggtgattttgattagcctttctatagcaattcctgtagtatttaaatgtctggaatccttttctgcataattctgtaaatacaagtactatatccaccctccc

SEQ ID NO: 28304 - DNA, 1219 bp, Mus musculus
aacaggtagaagtccttaaagaggaaacacaaaaaatccctcaaggaattacaggagaacactgttaaacaggtagaagcccttaaagaggaaacacaaaactccctcaaggaataacaggagaatactgctaaacaagtagaagctcttaaagaggaaacacagaaaatccctcaaggaattacaggagaacactgctaaaaaggtagaagtccttaaagaactacaggcaaatgctgctaaacaggtagaagaaacacaaaagtcccttaaagaattacaggaaagtgggtgtgggcagcttttggagaaagccggaagcagctctgggtgagtgttaaagcactcatggcgctctccttcagtggggcaattgggctgacttttcttatgctgggatgtgccttggaggactatgacatttactggcccctgttcgtcttgattttctacgtcatctcccccatcccctacttcattgccaaaagggtcacatatgactctgacgcgaccagcagtgcctgtccggaattggtgtatttcttcaccactgggattgttgattctgcctttggacttcctgttattcttgctcgtgtggatgtgatcaagtggggagcctgtggtcttgtgttggccagcaacgctgtcattttcctcacaattctaggcttcttcctcgtctttgaaggaagagatgatttcagttgggaacagtggtagcccctcctccccatggaaagcattgagtcttagaatttgtactgaacgtatatgtgtgcacatgtgtttcagatttgaatatgctgagtttttttatacctttatatcatgatcatcttagggagatgttgtaaacaaaagatgagttttacttctggcacacaggtcactccattgactcaaagtgaattgtttttatcttctagcttccagaaagtctgttactatggccttgtagacagctgctcacttatccagggggatctaaaccttttgccttgggatatgcttaggagacactggggcagatctcctacagtccaaacataggtggcgctctctctgtacacttagactcatctcagaggaagtctcatccacacagagcatcagcatctgctaggagcatattggggatgcaggatcagacagggtacatttgatgagattgcacacttggcacatgcatattgacgggtgaggaggtttgttgtag

SEQ ID NO: 28305 - DNA, 1099 bp, Mus musculus
cggagtgtggtaatatttcttgtatatgtggatttcttcaacctaattcaggaacatgcttcctactttgtgttatatccaatttaggtggtgttctagttgcatttttgttgctgtgacaaatactctgacaaaaaaagcgtcttagtgaagaagaagggatttatttgtcttagaatttatagttcattgctgtggggaggtcaaggcatgaacttaaagcataatatccacagtcaagaggagagagaaagtagagccatagcttgcctagtctgagctagctttttcctattgtatgctgttcccatttcctaaggaatggtgctacccacatttgggctgatctcacattagtgaacagtcaagactaacattgtctaaatattctagatattgctttaagacttttcccaggtaattcaacattgtgtcaagttgataattaaaaattcagcacagttgttctatataagatgttgtaaaatttgactgggaaatgatctttttcttttaatagtaaatatattgaaaatgaacaagatttttataaaaaatccttaagatacaataagattgattgagtgcctttgacaagtagaaggatttgctttactctttgttttttcaaaacaagaaaactccaaaaacaaaatttaaatacacacacacacacgaaaagaataacaaataagacaagtttatctagttatatagttagtaaattatcttctagaaataagaacaattattccatcctgtatgattactaaaatttcccagaacagccagcttcaaattctacacatttaaattctgagaattttaaaatacatactaatgtattacccgttgatatttgttttctgtcttagaggttgattctagtgtattaatacagagagaaccaccaaggaagatgtcaatgtacaaatatttctagagtctagattctatctcagtgctaatcagaaccagtggaataatgtcttataagataattgagtttcccttagtaatagaaaggaacattgacaatttttttttagaaaaatagaaatccaagattttgtgggaattgttgctattataagtgctt

SEQ ID NO: 28306 - DNA, 1174 bp, Mus musculus
tgaaacaataggaccgcatgcttctagggggcagagatgtaaaatcttccacctgaaagatattcaagcagaagcacatacaaaaagctttgtccagcaattcctgctttatttatttctgaatatatgggcacagatgagatgcattggccccttcgtctgacttacttgtatatcccacactgatgtctatgggtttaattagtatatgaagcttgtctatgctgtggaaaatgaatactgttatgttctctctctgaaatgaaaatttagggaatcatatttttttcattataataagaggtttcaacattatttagagtatttcatagtgtatcagagaaaaacatacttactattgaaggaatgtttcatggaattaaagaacaactaccagcaactattttatacaaaaagaaataatctggtattcaaatacgtagttacagtgtgccttttagactagattcaagagaaatttatttttaaaagaacgtataaagttcatccaatcatatcatttgcatttgccgtatttttaaaattaataatttataatatctttatcctctggtataattgctcgggaggcttgaggcctttgttttcttcttttaaccttttcttttgatatgtttttagacttacagaagttgtacagggaattctgcatatggttcaatgatatttttcataattaacatttgaccagatttagttgcttgggctatatttttcttataaaacatatgtatgcgtttccacatctgaacatgcacataagtttttaatggatttgaacttagaaatggtgccctagaatttgagctttacactgatgctttgttagtaaggcatatctagggctacagggacttttgttattgaatgttttgaagaagaaagttcagtactttcttatttaaatgtgtttgacatttaaatgctattttttgaagaagataaacttttggatacatttttaatcacatctcctgttaatgtctcccatgtaccctatgctccacttatgctgagctaattacatttgctaaaaatgtctttcagacactctctggattcttttctatttaatgggggtaaattgatatctgatgaccatgctgtgcccaatcatgtatcagagaggaagctaatctcagatgagcttgcc

SEQ ID NO: 28307 - DNA, 1156 bp, Mus musculus
tgaagcactcttaggaagtgatttccagaggccacctcagtgattcagagctaacttagaatcaagacaaagtgattgtctagatagacaaagattgtctatcaggagtgttcgcagaaatgtaacagagaggcgtagccgttccattgaaatgtcaaataggtggggcttcagcgatgcactcatctttggtttatatttagccatttcctaactgcacagataacacagaaaacaaggtaggtctcctgtgctaagtattgatatatccaggtacttatgtggctttgctcagtttctcactcacatttttatgaagagaattttgcatgattttatgattgacagcatcttaaaatctagtttgtgatcctcctagcacggagaaggaatccttatctgggaaaagtctgtggtacagtagcaattcagtcttttctagtgactgtgtttttaaaagcccgtcagcaacactatgaagatccaagaagctgtggctgatctggttaggcttctggaaagtcagtggacactagtgatgccattgctatggggatactgacagactgcccccaaactgtttcctcctgtgctgtaagacgtttgctttgtaacttggtcacggatccaagcccatgctgggggaaatggcactagtgctccttacatccctctaaaaggcagttaggggaaactttcactggaagtcatggtagcgttgctcactggctgactgcgccagcgtgaagaacagagtgcctgccctcaggaccatcgtggggggcatcacctgccaagaagcacagatcgatgttcagctttaagtagtatctgatttacaacactgtgttttacttaaaccttgtcaatggaagaaatctacttcataaatagaagcctgtgccttcccacagctttgaacatgaatttgtaattctgattacgatgttggaaagcatgaaaaacaaaaacaatggttgcatatgcttttatacccccacgccttggggtatgttaagattctcgtgaaacagttacgaggaactcctagtagagagtagcaggcacagaccgaagctgcagctcactgcagaaagtgtacttggcagttgtggatttctgtaccgaccggtcttctgttgactttgtcctttcc

SEQ ID NO: 28308 - DNA, 1229 bp, Mus musculus
gccattctcgcacatcccgtgcagtggcggcgcagcacgtggccgcctgggcttttcagtgatgctgcctaaggcacagcggggatttgaggtcctttagggggttaatgctgaaggagcaggagcgggctgcactgcatccggggacgatagtgatgggcgatctgggtgggtgacagcgggccctgaaccagtcagccacgtctgcagagagccagcaggggtatctttcgtgagttcaggagataggacccctagctcagctagagatagatccccaagctttcagctcggactttccgcagcccccaagccccgcctcctccccgtaagcccctcccctgccggagtccccgcccccgcctcccgctttcccgtcccaggacgcgttgcgcggcccgggccggaagtcctcgaattcccgggtgtgtgtctgtgtctgtgtctcgcggcggtgccgcggcggtcaagcgctttggggtccgcgtttgaagcgtcaccgctgtcactgccgccaccataccgagtcacttctagagggacggagacccggcccttcgccgggtggagaagatgttgcccctgtccatcaaggatgatgaatacaaaccacccaagttcaatctgttcggcaagatctcaggctggtttaggtgcggggtgctgtgattgctgggagggggctgcccgggatgctgagacaaagctgggtgctaaggatggcctgaggtccagcatgggagcgtcaccctcctgctgtggtggaacgagcatgcggactgggtgggttttgaggggtccccgcaacccccttggctcctgcttgcttctgatcacctgtatcgtgcccaggtccatcctgtcggacaagacatcccggaacctgtttttcttcctgtgcctgaacctctctttcgcttttgtggaactactctacggcatctggagcaactggtaaccaaaggggaagatgattggggcggaagcagagggtgagggagacaagccactatttgcttagtgccacgtagctccttaccggcaggttcacgtcttacctttgccactaccacttttgctgagttgctctcagcgtactctcaccaaaagggaagggctgcagttctaagatcggggactctcatttcctgcaactccattaaacagaactgacaaacaggccccctcctcatattttttttttacttttttatttggcagatgcaatg

SEQ ID NO: 28309 - DNA, 1344 bp, Mus musculus
gttaacatctacgacggcatgcccttaaagtactccaacattatgatttcccagtttggttttccgtatgccaaccataaaagtaaaatgtgaaccggaaacaaagacaagcccaaaacaccgcgctgggttttcagtggcttctccatgctgtgtgtttttggttttatttttggttttttttttcaagcaacactatgaacttttatctagtccataagtctctataatagaaacaaaaaaaccatatgcggtacttctagaatataaaacacatggaccttcaaaagccaagaagttggccttaccgggataggatttcctgtgaagagcttttgtccaagatggtgacattattgtttacatctcgagactgctcctcagtttgtttgagccctggcatttgcctcaaggccctacagcaagctgcttccagagactcacaagagacaattttcagcttttcggtgaaggtcgattgtttttatttgaagcctgaaatgcctgcggtatagggaaaagccatgtgaggagagtttagtctgaactcagtgttgagagccaggaaaattcctggttgccggtgtctttctggtccatctcacagaactgactgagcccagcacggttctaacgaagctgtcagtgctggtgtctctgctgttacgcctgttggtgactgggagtgtaagttttcatggctgactgttgtttaattggtttttattggtttggtttggtttggtttttgtgtgagcctactctgcatggatcactgaaatgtgccagccatgtttcttatatgtaacttgtatgcaacaaggaatcagtgtgtccctgtaatctgtcaccgcatatgaccttgagaatctacattagttcttatattttacagaatgtgttgaataatgaataaatatgtataaaaataacttctggaagaatggttaagtagaagctagcagaaataaaaaactttagtatcaaagatctttattattaaagcataggctaccttgtgagtatttaataactgtattgcacaaaaatgtttccatacagaacccaggattttgttaggattttttttaagtcccaattcatgacgaaatttcaattacatggttgttgaaaataaaaaggactgagccatcatgtgagaaggcagtgggatgctctcaggagttcactgttcctaccacacacctctcgctgtgggagccagtgtctgtgtcttgcctgctgtcctttggtttgaccttgttcaccactactgaaaagaaataatctatcaggcctctgtgtatcacttttcttcttctcttcatataaggcgtgaaaata

SEQ ID NO: 28310 - DNA, 1151 bp, Mus musculus
aggcaggtgttcatgcattgagccatatgtccagcccatgaatactgttaagaaatggatgccagggccatgctgaggtcagaggacagctctctctcctcactgtttcctcggaattgaacttggatcatcggcgtagccttgggtaccttcactcgctgaaccatctcactggctccatagttaatatttttttagtggatagcaaacgacctatttttccccacttttgctttgaaacattgacgtttctcaagtttcataagattaaatagcattgagatccttcctgaaaagggcattggttaattccagacgcctgaaaataatgttacatcagtgctaattgggatatatcagttaaaggttttgattgattgtttttctgagacaaaatttcactctgtagctcaggctggccttgcacatgggacagttgtattgtaggttcccaagtgctggggtttcaagtatatgtcaccttattcagttcaggtaaagttggtgacttgggagtaatttgttgttatttattattgctcctgttttaggtgtgaatgcagacaaggttgggattgaagctgctgaaatgctattagcgaaccttagacacggtggcactgtggatgagtatctacaagaccaggtaacgacactgttaggatcaaaaccatgttcctgacagatttgaacataattatgttgcatataaatttcttttattgtgccatcaagtatccagacacatttgtctctcttgttctctcaaacacaaagggtctctagagttgacgcccattgggaggcggtgttgactctttggactgctactcttttgagacaaggtctcgttctctaccctcacattctccgtccttctggctctcctgcctactgtgggtggagtcttgtggttgctcctcagaagcaagaagagagggagaaggaagaggagggctcttcggtatttcttgaccattttctggagacagttttccttgtgtttagtcattttcttcttcctaaatttatgttcccaggaattctgtagactccatttatcttttaaaatgggatttttgaagagtataaaaacttgtcatgtacagcagcttcagaaatatttggtctaagtaagtgtatgagcgtcc

SEQ ID NO: 28311 - DNA, 1104 bp, Mus musculus
ttgtctcagttctcttctctctgcgagtatgtagcacctggtgattaataaatgttaactatttgaaatctggatgaaatgtaatggaaatattacatgtggggcaggagatcccttgaagaaattaagactcaggatatgacctcccagggttgggggaagaggaggcagcattgtcagaagccctggtgggtgcccactcgccggcagggaggaggtgttttctaaacctcctaccactgttgccagatcttccttccactatgagtgagtgaaagtttacccttgtttatttcttattctccattatttctaggctcttccccgatttgaccagaaaggagacgtttataaagcacagataatgaatgtgagctggtcagcggatcacagggtcatcgatggggccaccatgtcacgcttctctaatttgtggaaatcctacttagaaaacccagcgtttatgctgctggatctgaaataatggcaaacaggacatctgtgaacttttcgcatttccaaagagtgtgtgaggcctcgctgagccagcacatactctggttgcggctgcattagaaatggtttgtgctgccttggtagggctttaaagcacagtatttctcactgacacattgggctttctgctggaaaggagcggtgggtaaggctcccctgggtatcacattgtgtaggtcagagcggggcttccattatggtgctgagatctatgtgtcagtgagttgaaacaagcaacaaaacaaaattgatgtcactaaatgtcactaatgccactgaaggcgagtagcagtatacatgcagaacttgccctctttctttttaatttttaactgatttttttaatgaaacttttaaattatacttaatcggggaaaagactctgtatgcaagtatgttttcatttccctacaatcgaagtaactaatgtacaaaataagtgcaattctgtttatctcttcagcttatgagacatatacccttgccttatgtgtaaagtatcatctataaatgtcttatagctataaattagcattcttgaaaggggggagttataagttggtcttaattggaggttacaaccaaaaa

SEQ ID NO: 28312 - DNA, 1219 bp, Mus musculus
aaagcctttattccaagcacttgagaaacaaagacaagtggatctctgagttcgaggccagcctggtctacagagtgagttcacagacagccagagctatgtagagaaaccctgtatttaaaaagaaaaaggaaggaaggaaggaaggaaggaaggaaggaaggaaggaagaaagaaagaaagaaagaaagaaagaaagaaagaaagaaaggaagaaaagaaaagaaaagaaaagaaaagaaattcagtattttgaaatctaggtttggaggttttttccttctaatattatctaactaagtatatcatgaaaaaaattacttatctaaatgaaagttttgtggtagaaaaaatggtcattttaatgcctgtttgattttttccaaaaatggaactatgttataaatttagtaaatgctgtttggttggaaattcccatcatgaaacccattatttttacataaagaaaattaacaaaagaaaaccaattcccaataggcattttgtccgtagacctctaatccccacacaggcaggccttgttaggtccatagtgagacttcgtcggaaggagggaaaactacaggtagcgtggaggaaacacactgttatctataatctaaacattgttaacattctgatacatgtatctgtatacataggtaagtattcttttataaaaatgaaataatgtatctactattttataatttgattttttaaaaatttatccttatattatggatacctttatatgtcaataaacagttccacattatcatactttgtatgccttcatagtagttcactgtgtatatatatattcatatatatatacatatatatatgtgtgtgtacgtgtgtgtgtgtatttactattttgtgtgtgtgtgtgtgtgtgtgtgtgtgtgtgtgtgtatttactattttgtctgagtgtgagtgtgcgtgctcggaagtgccacagtgagtatatgaaagtcagaggacaacccatgggatttgcttctctccttccaccagcaacctctacctgctgagccatctcactggcccacctagtcagcgcctgttgtggttgtcgcatttcagtgcttctccccaaatcatgtattgctgttcgctttagctgacctatgcagagctgtctaggatttgaggatattaaggaacagatgggctacaggtgagtgctgcagacatcttcgctttcgtgcac

SEQ ID NO: 28313 - DNA, 1099 bp, Mus musculus
atgccacgagaaagaaaagcacatcaaccagctacaaacaaaagtggccgttttagaacaggagatcaaagataaagaccagcttgttctgagaacaaaagaagcattcgatacaatccaagagcaaaaggtcttttgtaaaagtttaaaaataaataaatcacatttcctacatgtactgttgatgcttcccataaacaaacacagtgtcttacttgtgttctgtttttttctagcaggtggctttagaagaaaatggtgagaaaaatcagatacaactgggaaaacttgaagctacaataaaatcattatcagcagaacttctaaaggttcgctttgaaatgtttagccaaatattaatatttcatttggttatataaatattcatatgagtttctcgtaggcaaatgagatcatcaagaagttacaaggagatcttaaaactctgatgggtaaattgaaactgaagaatacagttactattcagcaagaaaaactattggctgagaaagaagaaatgctacaaaaggagcgaaaggaatcacaggacgctgggcagtttcttcgtgccaaagagcaagaggtggtcactgcccctgttgtaggctagggttgctttgtgcagttagcgagcttccccacatggatgggagaacttgagcttgattgtatgaagacagttgctttgtcctcccccccacccccatctaaaccaaaccccactagataaggtagtgataacctcactgccggggttctcatgagtgcagagtgggtagctgtgtacgcttgtaattaactatttcattacagagttgaattgacttctgcattctcatttatctgtagtactaatgagatattgacttaagagtatacaatgcgctagtctaacctttactttccctcattctgatgataatattgcaggtatgcagattacaggaacaattagaaactacagttcagaaactcgaagaaagtaaacaacttttgaaaaataatgaaaaatgtaagtgatattatatttttctgtaaagaaggcttattatagttttgttaatttaaatttttatgtgaattaataaaaatgcagata

SEQ ID NO: 28314 - DNA, 1746 bp, Mus musculus
aataaaggcattgactttaaaaaaaaaaaaagaaaatctgagcagacagttgctgagacattggaggctggggacgggggctggggggagtatttgtgcaaaaaacattaactattgtttcttcctcagaattccatcatccctggtccccctttcctctttggagcctgttcggtactgctggctctgctcgttgccttgtttattccggaacacactaatttaagtttaaggtccagcagttggaggaagcactgtggcagtcacagccatcctcacagtacacaagcgccaggagaggccaaagaacctttactccaggacacgaatgtgtgacggaaatcaggaagacttctctctctcgcagcacccaggtcttagttttcacctgtagctctggatgtacattccatttccatctgcagtgtactttaagactgtcttaagaaatacttgcatgaactccgtgggaactaaagaaagaaccggacagttttccaaagatgttacactttctttcaaaaagaaaccttttgtttatattagcaccactctcttgccactaaactgttttattacacatctttaattaaagctctatctgtaactccgtctctgccatttccttaggtgttgagcctttacctgctcgtgctgactcagcgacactaggcaggatggttatggacctgtttgctttaaccttgtaaaacctgagtcattgtaaaatcttgggtcaaataattcaaagccttaatgcagatgcactagaaaagaaatggtaaagaattgtttgcatttaaaagaacttgtgaaaattgtagaaaaccagaatcatgtttcaagcttgtttgccataattttatttaaagcattattcacggctgttctgaagaatgaaaagatcagccacttagaattcaaattggggtggtcagagcctagccatctggctcaatctgtttaaatctgttctgcttcttataccactattcttttgatatttgcataatcataaggacctcaacacttgaatacataatctaaaaattatatagtaaagctggtagccttgaaaatgtcaatgtgatatctatatgtagataaatatatatagtggcctttcaggactgtcacagtaacactttatttacagagctaatgtttgtcctaaattttcaggaccctagaagagagctttatacaattactgatgtgaatttctctaaagtgtatatttttgtgtccagttatattatttaaaaaagtgttactttgtaaaaatgtacataaagtattgtatagtttacactgttttcatcttgtgtgtggttactgcctaatgctttttaaacttggagcattcactatgattaaataaggtctcaaatgtaaatattctgttaataaaattaaatattttaatgatttttttctttttaaaaaggtcttgatctgtgagtccctccctgtaaggccggtttaggctttgttacagtaacaaatcctcttaccttaacttaccttctgcaatccatttgctgccctcacctcacctcaccaaaaacaaaacaaaaagcctgaagataaaaataacgaagtgtgtaggtcaaccggaaatgcttgatttcctaagcacagttagtcttttatttcctaaacatgcttcttgcatataaaacgctcaagcctcagtgctttattgacaaaggtcacagctttcagaaatagcaaaaagcaacattc

SEQ ID NO: 28315 - DNA, 1554 bp, Mus musculus
caagtacaacccagatcctgcaaatgcacaaagttcaagaggacagattcatggtctgctcatattaaagcattgtgtgggcaagtgtgttaatacagtgtggattcaaaatgattggttatttagatatggtctaccctgtcttaaccctacagaaatatagacaaagaagcagttggatagtaaggttgttcaagttataatacattttaggtgtctgaaaatcttttatgcatcatttatatttttcctttctagtcagttaaaaagtaattgggctgaatgtatagtctaaaaatttataaggaaataataatatgtgggggaaatgggcttgtaacctagattgtgtcatatatattgatgctgaaattttgtgtaatgtggtttgtgttttgatgacattcaaaggtgttattgtgtcatgcttccataactcttcgattatttaaaagttatgcttttaaaggtgtacttgttatttctcagctactttcactaaaggcacgtgtgagttcatggagaagaagcctgccagctgagagctgtagtaaggttaggtacagcacactgggagaaagcttcatgtcccgggcaggcccttagtgcagcaacagcagctccttactggacgcttttcaggttgtaagttacctgtgcagtagagcatagaggttggaggttcagaactgacatgtttacatcagtttctatggaatgacacagaagttcatatgagaaaaaggcagcttgatatttaaaccacagtctatattaagaaattccaaaaagaaattagtcgacatcctgctctgaaccataaaatagaatactgttcttacaaatccggttactagactttaaaaatgtcattatactgtcattcaatgaagtgtttttgtttccttgtctttttgaggcagcatcttaactgtgccaccctggctgcctggggtttactgtgtagaccaggctggcctggaaatcacggagatccgcctgcctctgccttcagagtgctgggattaaaggtgtaggccaccacccccatttgagttttgttttgttttacttagtttttaaagaaaggctttagtgtcactcattctatttaaacattcattgtagaatattttattactatatatttttacccgggatttataaaaagtaattatgttatactgaaagtcatctcaaggatctccaggataattaaagtaatcgaatagggccaatgaaaatgcacctttatcacagtctggtcctatgtgccttgccttaccaaataaatacctgacttttatggagaatatactgtaatttacaactgtagacacatacttgaaagtgggattttttttcaagaataactataattctagcttttggttgtttcaacattttccctttaaatctattgtcaaaccacctgatactgagtatcctattaaagtatctaagtatcctattaaagtatctatgagcagcacttgcctaagtgagttgtgatatctgcaccatgattcaggtttgatactttaccatttgtat

SEQ ID NO: 28316 - DNA, 1190 bp, Mus musculus
ctctctctttagggacaggatctcactgtgtagctctggctggtctgaaattccctaggtagaccaggctggtgtcagtcctatagagatcccgcctggtgtcacacctggcgccatcatattgataaaaacactcactatctaccctttttgactttgggttctattttcattttgttaaaataaaatgactcatttttaaggtcaggaaatagaaccttgctgaagtctcacagttggtgtttggtaaaccagctttagatcaggtaccataccctttccagtatgtatcttgagactggtgagccaagccttgaaagaaagtatttgcataggatccctgccttgtgttatgaaaactgtcatgttgtattgtaattatatctgcaggtgacgtgtcctcacttgggaatggcggctccccagatcaccctcagtgtccttgtgattgccttgctcacttgctctgtgactgcttatcccaatggcaaagtaccaatgtcctgtggtgggatgatcccccaacataaccacagcccacagtctgagcctattcaccaaatcacagtgagtcagacgacgttcaaacctggagaccagatcaaaggtatgagtgctggagataatgatctgcatttttttttttagttttttttaaaattaatttgttttttacttttttacttattcactgtttatcccgctcactgcccccttcttgatcacctcctcctacaatccttttttttcgagacagtgtttctctgtatagccttggctgtcctggaactcactttgtacaccaggctggcctcgaactcagaaatccgcctgcctctgcctcccgagtgctgggattaaaggcatgcgccaccacacctggctcccctacaatccttcttgatcccctcccctcctctgagtgtgtgggggccccctgggtattcccccctaccctggctcttcaagtctcgtcgaggctgggtgcttcctctcccactgaggccagtcaaggcagcccagctagaagaacatatcccatattcaggaaacagcttttgggatagatcccatcccagttgtccgggatccacacgaagaccaaggtgcacatttgctacatatgtgaggagaggcctaggttggtttctctatgtagttttggctgtcctggaactcactctgtagac

SEQ ID NO: 28317 - DNA, 2028 bp, Mus musculus
tttggtgtagcccaggctggcctttaaccagttgtataaccaaagataaccctgaacctctgatctgcctgcctctgtttcctgggtggtttacaggtgtgcaccactatatctggttttaagggaactgtaattttcatgacgatgctgctatggtactttaaagactacatttatgtttgactagtttatttaaaagattttgtcttagagtttaaaaaaaaattactacattttgattttatgcgcacacacacacagacacacagacacacacacacacagacacacacacacacacacacacacaccaaacaagtaaaacctacaagaaaaaaaactaaacacgttttccgaccagcagttaggagattttctcctttgtgttcagtatttctgtctaaaggtagctgttgatttattcagtgggcatttccttaacatgtagttatattacggatactatatttcctttagcagttaaatgcaggtaggtgcccctgattagagatctcatttatttttcctttgtggagctgaaacgacatcttatgtcctgtttcagccgtgagatcagtccttataggagctagaacaaagctgcgaatctctcagttgctaaacctcacccttgtgaacggatccagcaagtgttcttgtctcttgaagatacactaacatggatgggttcctttggaagacatccctggtgctctagtgacagcacaggccgtgtgtttcctcctactccgtattttctatctctgctgtgaggacttacagccagtgggtggcgctgtaataccggaggactcatttgttctgttgccactaagtgtttttattatgggactatttccttacatcatatgctctgaattctctctctctctctctctctctctctctctctctctctccctccctccctccctccctctccctctccctctccctctccctctccctctccctctctctctctctctctctctctctctctctctctctgtaataggtgctagaaacttaatgactggtgttaatactttctgacttaacttttatttgttttctttgattatttataatgactgtttgatattttcttttgtatccttctgaccctgctgcaaatgaagataattttcttaggcaaaggaaacaagcaaaataattggtagaatatattttatttttcagatactttttcagctgatgatatcatttctgcttggccccagaaccccatcttcatctctgagtaatgaccccagctccatgcttttatttctaaccaataaagtgaaaacgttctgattttctctacatagattttagctaaaaatagcacagggttcaggtaggaatttcctgtgctcatggtcaatgaatggcacattacggtttatactatcccttgagaatgaatttatttcaaaagaaaaaggtctggagatgtggctcagtggcaccgtgcttgagcagagtgtgtgaagccatgcctccatcctcacactggagaaatgacacagcaacaatttaaatctatatgaaaaaaatttctttcagttttccattgtaagccactaaaggctaaaacatatgtcttaaccagtcctgttcaataacagacaaggaaaagttcttttcaggaaagggtttccaccttttttgttaaggtttgcttaggtacagtttgcagataggtgaacttgctggacttctgatgccaagggcaatataatgcatttttcaaaagaaaaattttttttattagtcctttaagatggaggtgtaccctctcagaggtgaaggggagatgggatgagaggaggaaccctgtgaggagaggcttggggggggggagcagcatttgggatgtaaatacataaattaaattgaagaaaaaggattttacataacggacagctgggtgtggatcccagatcttgggaggcagaggcaggaggatctctgtgtgttcaaggccaatctggtctataagagagtttcaggacagccagg

SEQ ID NO: 28318 - DNA, 2098 bp, Mus musculus
tgtgatatagatgccggactcgtgactcatcactgcacagatgctttgaccggctgtgagttcctgcacagcatcttttttacggagtggtatttgctcgggtttactcctccatcaaagtgtgcaaggaaacccgtgccacttaatcttagcatgcccgtttcccttaggaacgaacacgtcacggctcgtctgctccgtgtgtttctcatttttgtaataaacaacctaggtttttttttttttttgaaaaaagtattcatatacttttttaaaaacagcaattgttaaactaaatgatttttttctgtgtctaggcatattgtcaaaaacagtgaaatcatgttctcttaaagaagggatactctgcagaatagagattaatatatttttcacaggataaaagaaatagtctggaaaatcatggttaagttagcatgcagaaactgagtctgttttggttttgttagcttctggtctgcggaggtcaagccagggcacagatggcctatacctttattgactacgtgaatcacactcttgttagtactactcaatttgtgtgaggatctggggctgtaggttagatgataactcatccttcccggatccggcaccagcccaggaggctgtgggaaggacagcgcagcagatgccaactgggaagccgtgggggccgtgtggctcttggctctaactctgtttatctatgtattctactgaagcagggggaaatggggaacaaagggccttgttcaagataatccattattaatgcaactggagaaacggttcttttatgttctttatgaactggatcagccttctcaaagctcccatgtccttccttccttgtctaaccccggccatactcattcctaggcccacagcgttgtgggtgctaacctttccattctcatcctagccagaaccagattcatgctttctttcctttcatcttcctggttcctccttgtcctgttcccggcactgatccatctttgtaagtgggtgatgggaagggaggcagatactactgtaagttagaaaggcccaggagctgggaggcccgagtagccacagttacttctgaattccatgtttgtggcaatggcatctgtctcctaagagtcctctttgtcatcttcaacaatctatcccactaaacttctgagtgaaatgataccagccaaaggtgctcgctttgtacatgttgctggtaaggtctttgccacttgatgacgatgttaaactataacagttttgcatgtgaaatgtgtatttttttattattataagaatatatgatgcttatcttaaatattgtgctagatgaaattgtccagacacacaggacagttcttatatgattctcatgtgtgggatccagcaggatcaactgtgtggagaattcaggtcattgagtggagcctgggtagctagggggtgggagttgtttcttaacgagagtaaagtttgtgtcggggaagtgacgatcgtacagcgttctgaacgtattcaacgaacagttctgcacggagagatgattgacatgggaataaaccaataaaagctgagcaaaacgttccttgtagcactgttcctatcaagtgatgggtggtgcagcccacatgtctgttgacagaggaatgccacgtggagtgtgtgtgcagtgggacattgctcagccatacaaagcaacgaggcactgatagccgctgtggatgtagaatgaaccttccaaatactatgcgaagtgaaagaagccagcgatggaggttgtctgctctacggacccatgtgtatggagtgttctgaacagtggaatcagtaggaactgagagggtactgaggcttcttaggggctgggtggagccagggagtgggaggtgacttcttagtgggtgtgcatttttatttcaacctgacaaaaattgagtcttggaacttggtagatgcacaagatgagtgacaaggatggtccattttaagatggttttgtctttccataggacagtgtattcacataaaaaaaaaaagtaactacaccacgttctgcttccctgtgtaacattttcgattttcatccaggccctga

SEQ ID NO: 28319 - DNA, 1329 bp, Mus musculus
atcaatgcaatccaccatataaacaagtggaaagaaaaaaaatccacatatcatctcactagatgccgcaaagcctttcacaaaatccaacactccttcatgatagtcttggggagaggggatacaaggtgcatacctaaacacaatatagtcaatttgctgaaagccagtggccaacatcaaattaagtgaagagaaacttaaaagcatttccattaaaatcaagaacaaattaaggctacattccacccatctcttcaatatagtacttgaagttcttgctagggcaataagacaactaaaaagggatatgaatggaaaaggcagaagtcaatgtatctctagtcacagatgatatgatagcatatataagcaacctcaaaaattctaccaaagaacttctagagctaataaacaccttcaataaagtggctagatgaaaatttagctcaaagaaatcagtagctctcctctcctctacataagcaattaacaggctgagaaagaagttagaagacagtaagataccggaaagacgcccgtggagcccgaagtggcgattcaccgaattcgaatcacgctcaccagccgcaacgtgaagtcgctggagaaggtttgtgcggacttgatcagaggcgccaaggaaaagaatctgaaagtgaaaggaccggtgcgcatgcctaccaagactttgagaatcactaccagaaaaacaccttgtggtgaaggttccaagacctgggatcgattccagatgaggatccacaagcgactcattgatttacatagtccttctgagattgttaagcagattacttccatcagtattgagccaggagttgaggttgaagtcaccattgcagatgcctaagacaactgaataaatcgacttaatagtcaaattttgctggcaaaaaaaaaaaaaaaaaaaaaagacagtacccttcaaaatagccacaaataatataaaataccttggtgtaactctaaacaagcaagtgaaaaacctgcatgataagaacttcaagactctgaagaaggaaattgaggaagatatcagatggaaagacctcctatgctcatggattagtaggatttacatagcaataataaccatctcagcaaaagcaacctacagattcaatgcaattcccataaaaattccaacacaattcttcagagatcttgaaagaacagttctcaacttcatatgaaacagacaaaacagaatagctaaaatgatcctgaacaatagagaacttctgagcttatcagtatccttgacctcaagctacactacataataataataaaactgcatggtattta

SEQ ID NO: 28320 - DNA, 1111 bp, Mus musculus
atgctttactcggtcttttctcactctcatttgtggctttttttttttttaaagtcagatgggaattttagaagtctctagcaaaatctaatctgtatccctatgtttaagtatacatgccttttttaaagaaggcatatatgttcatcaataaagaacagatccataaattcatcctttgcttctttcctcaggctatcttagtagaaatggcataattgtcttatctactttgacttatttttccattctgactgcttatcaccaggatttctaatatgcggaagtttctcgtgaatttacttcaaatcttgctgattctcttctgtacatgtctctccatcttcctccgtcctttcttcttcttgacttttaagtataatcaggtttcttaagcaagctttttgctgctcatatctttgttcttctcgtttctctgtgcaccgtagtttggtttcatccataattccctaaactacccttttaactgtgatagtgggcactaaagttggagtagtcagtttcagttttaaacttgctgtaatctgtactatttgacactctgaccccactttgttaaggttttccctcctactttctgatactttcccttagatttcaccttcctttcttttcaattacccttcccctttcacattctgcttgtgtttggcagactttattcatacaacttagttatccttagtgcttttgttaacttctctagctcagaactttactaaaagacccagactaggaatctagccaatcattgtacactttcaaacttagactgttctccttgcaacttgtggttcctagtgttgctgtgtctcatagtgtaataagccagtgccactgttcttaacaagccagaaaacttggagtcattactccttccttccatcctgatttcagacattgattcggattcctgagttcctgtttgtccttcagctgttacaaccctattttgaacaggtattactcaaaaagtttttctgattttttttaacttatgtcagtataaaaataacatatttgtagctatagtttacttagtgctgatgctaatagaatgttttgtgtgtttacaaacaagcaatgctgt

SEQ ID NO: 28321 - DNA, 1302 bp, Mus musculus
atttgtttaataataaatcactttaataaaatcattttaaactttgtgatatatatatcacaaaattttaagtgattcttttaaaaaaatcctcaagttattctatttctctcctttcccaatgtaaacctcttaaattcttcctttcttttcacatgggtctcatgatagagacctacaagtacacaagtgttaaaagtctcatgccaactttcccttagcagtaacagaaaagaagtctcctctgcatagtattcatgtgtgatttttttgactgttagactttcctcttctttgctcactgagaattaatgccttttctcctgttagattccatgtctgcagtgcacacacaagcaactatactgtagtattttttaatgtctatttttttcatttgccaggaatgctttcattaatcaagaaaaaagtttgaggttcaaaggtaatcagataccatcatagttccgaccataaacaatgctgactggcgatgtagtggcattattcccaagaccctctgggcagcttccagaaaaccaaagtctttgggatctggcgggggggggggtacagttgcaaagctgagacttaaagaaattgacagaagggcaccaccaggaaaggagcctgtgacttaatttgactcgacacgagaaacctcactcagcccagacacagacaggatggacagattgatagctctttctcaattccgtgggtgagggtacatggcctttatttaaatattcttaaggaactgcagataggtgtcgatgtgggtaagtgcataatgctacttggactttgtcaagatagcatattatcaatctgtgtgattttgaagtatagctaatgtgaaagattaagtgttttatattggagtaaggtcaggataaggacgcttatcatccacgaacttgggcatcatctccagaacagaggtaatggcatttcttctattattctgttgtatggttcatgtcaattgaatcattttcctatgtacatttattatgtattgctttatgcacagtatgataatttattgcaataataatttgttccataatttaagttgatcataattttctaacatatttaaggaaaatatggatatcaaatggaatgctataggactttagtttttgaactctcagaataaagccactcacaggagtcaagagaaagcatgagcttctagaaacatctgtgtcacactgcctttatgtcctttgacttctttcagcctttatagtttttcctccactctagagagtgtcaaacattcatggcttgact

SEQ ID NO: 28322 - DNA, 10620 bp, Mus musculus
aaccaattgaaagtttttatgttaatgcattctgtgtgaatttaataatttagacagtgttaagaagtatagatcttatctgttatcttaccttgtgtaccattatgctctaataccaggctgggatgttagcaccgggcaccagaagagacatctatgaccagaagctgacattacagccagtggacaactcgaccatttctctacagatgggcaccaacaaagttgcttcccagaaaggaatgagcgtgtatgggcttgggcggcaagtatatgaccccaagtactgtgccgcacccacagaacctgtcattcacaacggaagccagggcacgggcaccaatgggtcggaaatcagtgatagcgattatcaggcagaataccccgatgaatatcatggcgagtacccagacgactaccctcgggagtaccagtatggcgacgaccagggcattgattattagagtcacacacaggagcgcagtatttagtccattgttttatccagtgagacccaagctagccttgaataattcttctctcgtcttcctgaaacactattatgcttgttgtacctttaaagtatgccttatgtacattcctttctccttttcctgcctcctccctaaatagctgccttctagtgctgtagcaagggagccctactgcatagccagtaactcgcgtctgtaccatggaaagggcggaacgattctccaggacagccagctctttcgttgaagatctatctatgcatttttttacacttacacataaactggtattttcgaacaataggaaactattttttctcctttttttacagttttagtacgtatctggcttgtatgtggaagactaaaaagttgatttgctaaatgtggtctttgccaactaaaatctgagatgcagctttagaccctgacacgtggatgttcttctgcagtcttgtctgctaagttttaaataaagtcatgatcagtgtgcatttgtgattacatgtgtactcattcttttcccaagctgacgaggtctctcccgagtggcgcttcgaaaggcgtgcatgcagaaatggccgaggacatgcaggtttgggtggtgtgcctgcagacttcatttgtgccaatgtattactgtagagtcgctctgtttccttcaactgtatttattgctgcgtttctcagcataaacttatcccattgtattttttataaataaatatttttttttgaacattcatatgaaccacaggctggttattttctggctctcttctacataggcagagtaaggtgagaaaccagaggccttgttccatgggcactgagagaaagtgttctaatattatttaattcatacaatacggcactcattggagactgaatctaagctgggtatgcactagggaggctgaagcaggaggatttctctgagtttgagatgatcttgggctacagagaccttgttttaaagctacagaaacaacaaccaaacgaagaagaaaaatgcccattgcctatagtaaaggggcaaccaagatttacctggtccttgttctactacaacttggctgccctgggtttatctgaaattcgatttggaattctctgaaacgcaagggggagttattacatgtgtcatgtaaatgatcctaaagccaggcatgaggtgtgctgtttgattagagcaggctaacccacagctaagtgtgggaaagggcagtgctgtcacgggggaagctgctcggtcacaccctctgaccttgtctcaggtcaaggctgactgatggcctcgggtggttttgtaaagacagataagagatgttgaacccacagaaaggatgtatgcttgttcctcctgtggtggcttgcttagatgcttctgggagtgccctgtaaatcactgtaggagactgggagctaaatgaattctgtggtactattaaagaaaaaatatctaaagtggtcctgagctgtcaggctgtttcttgtcaaattgcaaaagtggttaggaaagcaaagggaaggagccttgtattagatctcacgtgctggcctgccaagtcagtcagattgtgtttcctgttagaatgggagttccacacggcatctgggcccacgaggctcctgtcctcatgttcaaagtttccatttgcttagggcttttaaaaggaaaagatcttctgtttcggtatgtttaaaaaataattaaaaaaaaaaaaaaagctgtcagacaagtctcattttgggcaggggttggttgagcaacacctttctataatgtttgctggtgtgtgaaactcccgcctgcttgcagccggctgggtctcctcgtgttcagcagcctcccctgtgtgtgtctgctcttgaccttccttccctcactaagtctaagagctataacttggcatgctgatagcctctcgtagcatgtgtccaggctaggaagaatgagagaaacgcctgccctgcacaagagcattaatctaggtttgttagatttctgctaacaaaatcctcctttaaaaaaaaaaaaaaagaaaagaaaaagatgaacaaacaaaggtgaggtgttaacatttttatttattttttggtggtggtggtggggctgagtgagtgcactcggggcagttcacatgtggagctctgaggacaacttagaggaactgattctctccttttaccatgtgggtcctggggtattcagttcctcgggttggcaactggcacctttatccagtgagccaaccttatttgtttgtttgtttatatgaggtctctatgtagcattcaggctagcatttaacatctgagtatgtagctcaggctagccttatagcctcttccagttttgaattacagatgtgtgtccctgtgcccagccaatattgtgccttttaaattgatgcatatagacatagttttaacatcttccgtgctctagttcacgtgaaaacagctgtagactttgtctcggtgtcacaggtagtcaaagttctcttggtccctatctcacaatgggctggagttctgtcccctcttcatttggtaaagcatccttttgtccttgagacttggcattgttcaagttgttggtccgttttataacactctgaaaaacaaaagaacgaaagaccccagtgatgtgcctgcagcatctgtttactagaggctgtctccctacaggttgaggggattggatttttagcgcttttccaagtgtattgaaaatgtttgtgtgcatagtaaggtagatttcaaagcaggattctaactggaaattaacaagtcgaggagagtagaccaggttagctttaatgcatccatcccagtagataaaggtgggcagaaatcacatcttacgtttctatgagtggagagcacattcatatttattcattcataggaagtgttgaaatccagtacctgccgaaatgacagtgctctgaatgtttaaggccaaaagagcttaacacttaatttttatggcgacaaaaggaaagaaaattactaaaatgtcacttaacaccccttccctgccagaaccgccgaagaggagtgttgaaatgtgtcctgtctgcggaggataaggcaaaggacgagcaatgtattgtgtgttgcaaaaagctgttggaaacaactgcctggtagttccagatacaagtggctttgctgagggtgtgcctggttagcaaggggcccaagggctgttagtattggcaacagaggtgagcggtctgcccagcggtgtgctctacccaaagctttgtgggtatgcttgcatgtgcaagatactttacataaatatcaactctcccagacagaagtggccgaagacattgtagacataacagatcaggctgttagtgtcaaagacgtaccagctaccgctgtgttcctgggtatgctgcagtggaagagcctacacgccccattttattctcacctctggactgggagtttctgtggggaaatggttcctcgtctgacagctgagctcccaccccccaggtggaagttgaaactcattggagccctctagaccagaaaggaggctgggtgtgtctcctccctgtatgtgagtcttcaacacttgtcaggggagagattacaacaggagatgaagcgtttgcttaccaaaaaccctgggtccataaagtacggtttctccgacgatccatcatttgtttccaggtccacagcaaagcacaggaaaaggatatccagcgcagtttcaaacacggataggaaactgtgagccaccacgcaggcaaaaaaggcaaccagcagcagagggatggcccacacctggagcgcacggctgtagttaaacgccatcagacccccgaaaatgctgaagcacaccactagcacctggggaggaggtggttgaaaacctttataaatagggttggtgggctcttttaccgaagggtctgcccccccccccattataagtaatgctattgtgtgtcctaaacagaatttgacaggctgaaatagaagaagaaggaaaaaaaaaaagatggaagaagaaggaaaaaaaagcccagttagagccagagagattgtactttatctgtaaatctcaccacagtatggccaagtcatccggagcctcgctttagaagtgtacatgtatgtgtgcgtgcgtgcgtgcgtgcgtgcgtgcgtgcgtgcggtatacgtaatcctgtggctgtgtgcactgtgtggatatcagaggccaatttcagatgccttctttgattgctctctaccttcttttgtgaggcagggtctcattgaacctgaagcccatccatccgtttgtctaggctggccagtgacctccagagagtcttccatctacacacacacacacacacacacacacacacacacacagcactagaattaggcatgtaacatcacagtcatcttttatgtggtagtggtctcatgcacagaaactttaccacttgagtctcagctgcttaaaaagctttctctagctctctcttttgcttttgtttgtttgtgcttgtttttatttctttgagacaagagtttctctgtatagccctggctatcctggaactctgcagaccaggctggcctcaaactcagagatccacctgcctctgcatcccaagtgctgggataaaagccgtgcgccaccactgcccagcatttcttccttttttttaaatccccatttttatactgcaagcaattgaataggtggattaataatttcctaagtgattagttttaccctctgagcactaaagtggaaagacttccctctgctagtgtgcaagataattggattctcccaggcttttgtgacatgtaattactatatttccaagaacacacttacagggcatgatacacccaatttcttaagagtgacagagtccacctggggcccccattactcatggatgcctgtgaagatgaatatgggattttgaatgctatttccttcagaagcctaaagtcactgatcatcccatacattttgaaaggtcactagacatgatatgcttatggggaatctaagaaaatcgatatttaaagtgaaatagaaatataaatatgttaagaattttgaaactggctgggaagtggtggtgcacgccttttatcccagcacttgggaggcagaggcaggtggatttctgagtttgaggccagcctagtctacagaatgagttccaggacagccagggctacacagagaaaccttgtctctaataataataataattttgaaactgcattcaaaagtatttttggaattaggaaatacatcacccacaattcaactaaggcaatagattaacaaattgcatgcaaccattccttatttggctgttttgaaaggcataattacattgtacttctgttactgctgtcacatgaagcatctctggggccaggtgagccttaaatgtctgtgtaatgagcacacacacctgtgagatccaagcctgccttaacttgcttggcaccaactatgacagccctgcaccagactctgcatgcagaaacacagaatcctcaatggggcacagtcaccatatatggtattgcccaggtcacagctggtgactaagatcttgttcacttgtgggcattgcttgaaaactggcatttatgtcagagaaggaggaatggttgaaagaactgagagtgtttcgctgcgaatacagaagacgtggtgggaaagatcagagtcaagaattaaagtagcaactataggggctgtgggaccctggaaacatgaaaccttagagtcacctgtaaaacaggaagcctcacaggattgtgggactgagtgaggggtgagacatggcagctactccagagcaacaaacatgattccctttcaagtcagcctccttgttggctactttgttgacttccaggtacctagtacttatttagtcaagacatctcacctttcccaggaaaatgacaaagtttccaaagcagttaacagacgtgagatgacttgaattcttggctatgattgtgtgcgcatcttttgcggatgtacaaaagtctgtcccgttaatggcagttgcagtgtacgcatcctagaacagaaggcatcagttatgaatacggtgatttgtggcattttaaggcaacagaatgacagtacaaagtatgtgacctagtatctccacccaaaacaaacaagctggactatgatctatttcttatcatagtcaaatatatttccataccattcggaaaatgggaaaggacctcatgtcaatcctgcaggctgaatggcccagcacacacatggaaaaaatgagtcgatataagttattttgtaatacacaatagagtcggagggcagggaaaggtgtttgggtaacaaaaagagagcagaccctagggacttgtgagccaaacccaaggctgtagctggtatggagttagtgagggcttcttcaggatcccctgggcctgagagatagtattggttgtttctagagagctgcattccctgtacaaaataggattcataatttgaaatcaaccagacacttgggaaagcacttaaaaaataacctaacgtgtgcccaagatagttgaaatatctggggtccgggcaaaaacaagataaaaatcattccaccagggctggtggatcctcacaacaactgtactggcagaagtgggctccccagagcagggcagagccagggagatatataacaaacccaactctgccctgaggaccctggggaagaggtatgctgaaagtgctctaaggaaatggggcaggggctagagggaacagcaggatggtgtggaaaaggaagagacagaaaaaaacggaataggaatgaaaaaaaaaaaaaaaaaaaaaacaactcacacagtttaaattacatatttggcttttgcccctaagaaagcatttggtgttgttacatggcttctaacattttaatttctagtaactcagttttatggggcatgtgctttgcatatgtgcaggaaggtacactttgaatttagccaagaactcaagaagtgaaatgcacctactggctatttaaaatattctgatattaatacatactgaatgtcttaattttgtgatcctagatccttgaagattagatttccaaaaagtgagatttctgagtcaaagcgtgcatgcgcgcgcgcgtgtgtgtgtgtgtgtgtgtgtgtgtgtgtgtgtgtgtgtgtgtttagaatggcagatttggttttttgtttgttttagtttgtttgagacaagggctcacataatgcgaactggcctcaattttgcatctccctctcaaaggctgagtttttgggcctggggagccacacgggggtttatgtggtgttgggaactgaattcaggccttctcatatgcaagcccagcattctgcggactgaattctaaccccagcgcagactcattctttcaaagactggaaagcaagattaagggcactttcccaaagccccctgatgagtcagtaagacaaagactcttttctttaaacaccaactgtctggatttcacatttcatcagtttgcattgggccaaaactcaatctaaaagcacagtggttccaggaagcacaggccctgtaggccagctgtctttgggctcaaatcctggctcttccagtgaggagacactgggcacagggcagcgaccagcctctcagctccttttccttatccaaacagggacagagagcctaccgatggggatgggaggtttaaagatacaggcctgaggaccccagcatctggccatagtacctgaaggctgatcactctcacgtagctagagcacttcaaagatggcatcattaaccagccacccggagccctgatcaactccttaagattctggggggcatgggaaagacctgtgttctttatcctcatgggaactcagaagtggtcagctatgtgtcttggaccatgtcccggtgcccagtgtggtggccatctttgcttcctctctttagtcaagttctaacccaagcccacaccacaggctcaacactttccctactgattcctagtggacatcccgagtcacgtggggaagggtaggttgatttttgttttgtttatgcctttttttttttttttttgagggagggttttctccctgaaacctactgcctcacagttcatcactcatgagcaacaaaaatagattttgttcttcggctaagatgattaaaagttaaacggtacgtttttgtgcatgtgtcgattccacgactttccaggaggctcctaaccatttatcttttctttaacatctcacggcccactgaaagagaacactaaaaccacactgacagggaaattatatatgccttcctaaagtgactacggtaataacattttaccgtgagatcccaccctctctgccacatccagacctagattagtgactagctgaatgagcggtgggcgcagcactgcccgagaggcatcctgctgtttcagtattagtggtccacgcttaagctgagtagaagttgtttccttggcagccatctggaggatggagtgcactagactgtccacagtgtgtgcacgtatctgagctgacagctccgggaccatgtgcaaagggagctgctacagaggttgacggtgtgtggaaagagtgtcttgtgatgaaggataggaagcaagcacaatgggttgcttatggaaacgattagaggaggaactccccctccccacataggggaggaacccccttcccccatggctaacctttcagcaaggaaaagagagcaatggttaaaccgctctaagttgatgaccatgtaaaactcacagggtgaacctgagatagggtctcatgtaccaattctcagatttatctacagctacaatggctttgaacttctgatctcctatctgaacctccctaatgctgggattactagcactgtctagatgggtaagcactctaccaactgagctagcccaggtcgctgggtttaagatttgactttctatgctgtgcattagaaaggaaaaggagaagtgtgtgaaatgcgggcaggagaagatcacagcgggcatttgttttccctggcctaaagcacccagttttattccaagttttctcaatcacttaaaatataacaaaggtgccgggcagtggtggcgcatgcctttaatcctagcacttgggaggcagaggcaggtggatttctgagttcgaggccagcctggtctacagagtgagttccaggacagccagggctacacagaaaaacatatatatatatatataatatacatataatatgttatatgtataacatattatatgtatataatatatatctcaaaggcagtggttctcaatctgttctcaacccattgcagtgaggacctgtcagatgaccctttcacaggggctgcatatcagagatttacattagaattcataacagtagcaaaatgacacttatgaagtagcaacaaagataattttatggttgggggtcggtaccacgttagaaggaactgtattaaaagattgcagtcttagaaaggttgagaactaggaggaataagccaagaattatggctgaaaaaacatcatatcagaactctgcaagacattcccacacaagcgataatgcccacagggccctgctgcacttagggtcaatgtggtgtgaccacacagccaccgagtgcactggcgaatggcagtggcaaaccagagtctggcccaaagtcaagaaaactttcctctgaacacaactgccagggtcaggaactgaaattcttcccagatgctctgtctcctgaaccccacgccaccccccagcagatgtcctatggtatgtcccaaaacagcttgacacaaaccggaagggcgcttcctatttcctatctgtggcctttaatgttttcttccgtaggcaggtgtgcaccttctatgaggaagtaaatagtgacacaaacattcactcagtacacactgcgttccacattctagacacttcctgaacgtgcggattcattggcccctcttagcccccaacctgtagggtagctcagagcacccaagcacaaaagcactagaggccatg

SEQ ID NO: 28323 - DNA, 1162 bp, Mus musculus
ataccataattaaacacattactttgtatgctggcctaaaaataacttttttaaatgcaataatatgtttaagtattctgccttcttgcctctgttaacagaaagttctctttccattggagcccattcccactctgggctagccagctccttagccacaagcctcactattcccttccctaagccctacactatctagttctgatgccccaggctctgcctgtttccctgcttcatctcttaacccaatagatcctctggggtactgactaccccagccaactactgtctcttcgtctccaccatcagcactgtgccccctccttctctgtctttcccatttatcttctgttataatctctgccaccaaactcagggtcgttttttggactacatttccaacatgtgttcttccatccatctcccgtggctcctttctagtccaggaaccttgggtagctcatttaatgctgtagccactgtcagtttctctcaagcgtatgaggtcagataaattcttaatcaaagaatgagagaaagagtggaagaaataaatgtcgggtttcaaaaaggcgggacggtatgatttggggtcacgcccaccggcaagtggcgttcgagcctccatgttgactttacatctttgatttatttttttgtttgtttgtttgtctgtttttgcttttcagaaacactcatcattgtgggagcagtggtgctcctggccaccatctttatcatcctcctgtccatatctctgtgcaagcgcagaaagaaccgagcgggacagaaagggaagaacaccccgtcgcgcttggcatagaggaaaggctgaagccgctaacgctcacactgcctgcacggcactgttgcggagagctctgatgggaactgtgcaacatggagcgtggagcctgccgatcctagctcagagaggctgccttcatggcctgttactccagctaacgctttgattccaacactagcatttgtcacgttaggacgaactgaaacggtacaaactggttaacactacagcgccttttgcacaaatgctttagattgtatggtctacactcaggaagacactaggtcacccaggcaaagccagtggacagatgcctttcatataacctgggtgggcttttggaaaatctttgag

SEQ ID NO: 28324 - DNA, 1464 bp, Mus musculus
aagaatgtccttattcttgtggttaaaaaacctgcctgaattaaattgggcttaaatcagtgtaacctgattcatcctgggatgtaaaccatttgaagtcagctaatttgacttttatggctctgtctttttctttcatgaagaaccctgtttaaaactggggtcattaactgttctattctaacaaagtagtcttgagtttcatttcttatgccccatggtagtgggaaccagaccaatcacaatgttttattgaaacatattccatcgttacaggatagcgttcggtacacagtggcgggtttctttagctgctgtgtttattctcattcctcacacatgcctttaagtgcattggactccaggagagccatttggggtttctctagctaaacaataaatgtacctgtctcagtccgctggactgagttgttttgaaggttctcatggtgcacagcagtgtgtatgtggtgtacaacagtgtgtatgcagccgtgcttacagcctgtggttgctacctgttgtaccagtctgaccagtgtttggaatgttcagacataatctcctgtgtgaagctcaaggtcttaggaggattttggattttgtgaagagatggacagtctcatcagaaatgtggttgtataatggtgagcgccacatgagtgtagaggcactatatgacgtagtgtactgagcatgcaacgctgctgccgtccttgtctgtggtttcagtttgtaaaactgctaagccattctcatgcacatgggtgaatgacatttcctaggaacggtctctgactcctggacaactactcctgtatcggctctggctccccggaaccattagagactaactgttgtttccacaaaggagggctgagagtgaacgtgatcatacgtagttgtgaaatcggtttgattgagtgggctctgaaaggggcatttaatggtcttgtttcttcataactcacaatcactggctaccaagataaccctgatgtattgattccataaatgcatcacattcagttttaccatgtctccttagcaaacttgtgtacttattttctgttcagattaaaaaaaaaaaatgataacctacagaacatgtgcctgaccttttttattcttggttttgaatgttgacattcagaaagggctttcagcacccaggcggtctttttacattaccttattaagtgagctttaaaagattttgttttatatttctaggcagggtctcctatgttgctctggctggccttgaactcaacagagatctgcctaccttttcctcctgagtgctgtgattaatgtacatgtttaaatgtgcatttctttcttagaaaatcctcaccaaatgtttacacttcacaaatgctaacagatggccaggaaggctaaaggctatcgtgtcctggaaaggctttaaggcacagggaaactacacgttttcagattgct

SEQ ID NO: 28325 - DNA, 1222 bp, Mus musculus
cctccctcccgtggtgttgagattgcgcggcggccgccaggctgagggccgcagggctccgggaccgctggcccggttccgcgggcacccgcgcagctcgggacctgggagagaagggcaaggcgcgcgcccggagctccccgctcgggcccggggaaggcggcgcggccgcgagcctcacccgtgcaggccgagggcgcgacgccgcttatggagtaggcagagcagcaggaacgcggcccccgccagcgaggtgttccgtgccgtcaagtacttgctgaaggccgccatggcaccggcagggcgagcgagccgcgggataggggacgcgccggcgacaacctcagtgcaggaaccgcgggggaaactgggaggatagctcggcgccgagagagggcggggccggccgcgcgggaacgccccctggcgcgcgccgccgcgccgagcccaccgtggactttggcttcccgggcgcgcgcgcgggcgcggggcgatcgaaagggtcgttccccggggggacgctctgcgcacgcgcggacccccgcggactcggccggaaacgcggcgggcagacaacgctagtcctccgcgccggtctccagcagcccacgcttcggccttgcgatctctgcttgcacacaccctagctttctttcacaagaactggaagagcgggccgggcctgcgccacggactccgtgggccctgcccctccgccaccccctggatgggtcggtaccaccctcttaaagaagccgggggaggaggggaacggccccatcactaaaaaggtcaatatttgcaacttaaggagtgaagggagacctggaaaagaaagactacaatcagataatcttatttcaagtcgccgtggattaggtctctagttctgtaaaatcggtttgggaggacgggtccaccactctgttaatttttttataaaaataatgtagtgggaaaaagctcagagtgcgtgacaaaaaggagttttaagaaacaattactcttttttggtagatatgtacaaggatggcgataaaaaaatgtatttctttatgttaggtctggtcaaagaaagtttgagaaactctgttctttgcaaagggacattcagaaataacaatcgtgcgttgtattaatgctggccttactcccagaagcagacgaactttacagattacagcattcttctcctgtcccacccctatcatgcagaaagtgt

SEQ ID NO: 28326 - DNA, 1787 bp, Mus musculus
ctttccttgtgaacctcctgccaccttccccacatgccgcggcacgtctgtgccatcagagctgtttattggctagggtaaacaaaaccaagtgcacacgaggcaggtgctcgctctcccagacgctaatccttggcgctggattcacttctgctgtgttaaatgcttatgaacatagtaaggagcttctgtcttcaaacctaacctgtgtggtgttgttttagaactgctctctgaggcaagtttccaggaagctcttcaagaaagcatccctgacattgaagcccaggattgggtgccgctgtggctgctgaggtactcggtcatcgtgaagagcaggggaatcatcaagtctaaaggctacattctgcaagccaaaaggaggggctcttaactccagctcacacccacagctcaccgacctgctgttgtctggaacataagatacaaattcatgataacattgagatgtgtttaaaaaaaaaaaaatatagctccgccttacaagaagcatccccgaggtgcgagtgcagttgttcggcactgtgttgagttttgagggcctcccgtgcctctgcagcagcgcgctcacaggaaccactgtattctaatcattaagctgttgttttctaacggaaatcgtctataaagaaaaatacttgcaatatatttcctttatttttatgagcaatagaaatcaagaaaatttgttttaagatatattttggcttaggcatcagggtgatgtatatacatattttttatttccaaaattcattaattgcttcctattctatacttctataagcgattacattacagttgttaaaacatactagatttttttttcccctgtcattggcaaaataatctatctcagtaactatagcagtctaccagtaatgtaaataaaattcattctttgatccacgaatggaaatttaatgtgtgtgttcttgcttacagcgtagctatagctatgcattgaccacatgttctgggtcatgtttcttccacctcttatctacaaaggcagagtgtctaagaaggcggcttgatgctttaacattattgtttgggggtttcataaaagcaactactgttgctatcttcagagtctttggacctcttcctgtactctcagtgtgttgctgctcagttggactcaccacatgcttagcactatgggctctggagagatgaactaagaatcagccaagtaaaacttttgatctctgtacctatcaattgccgacaaggagtaaagccaggaaaggcggaggggaagaaaatcatttagttttaatgtcatactagtttaagagtcagaaaaatgcaaagaggctatggtccttacatgtagcattgaaaggtcttaatctctaaatgtgtgtctgtacccaggttcagtttctctttaaaaggtgtcttgtatgccaatatttttaaaccatgagtctttgtaaaactaattttgctcagaaaatttcaatgtagagaaaagaactagagttctatgttaagccaatacagtagatggttttcttaagtgagactttgtggttactgactggatgctagtctcaattagaattatgtgaaaacaactgatttgcctactaaaacttaacagaatttgaactaaaagcctataattatattgattgtatataatgctaaatacataggtaatggttaaatttggaaatgtaacttttctatagcgtatatctttaaatatatgttgtatttaaaatctgtgcagtgcggtgtctgagctgctctga

SEQ ID NO: 28327 - DNA, 1181 bp, Mus musculus
cctttaaaatgaaaagctaagttatcagtagtgtgtataaaagatatatttgaatgtagtgacccagaatagaaaggttttgtgggtaatttctaagtaaacatttttttaaaaaggttttaacttactacattcccaaaattgagtggtaccttattcagcagcgctctgtgacttgggattcattcctcgtgtttaccttaaattccacccaagaattttagacatcggaaggatcaaggtctctttcaagctaggttcatgtgctgtaaagtctgaagccctttttgtttgttttctgagaaggggtctcttatgtagtcctggttgccctggaacttgctatatagaccagactggcctcaaatagagatttgcctgcttctgcctcactagtgctaggattaaaggcggtgccatcacaccctacccctgacgagcatattggtggcagaacactaatacagcatctgtttaaggatgagcagtgctagaacgtgaatcagaactagctaatagatagatgttcagtcctgaaaaatggttgtctggacttgtgagtttatgctttcatttggttgtcaatgatgagaacgtctaggatctgaagccccacattaaatttgaactacttgaatttaaacagtataatttgaaaaaaactgaattatttttaaaactatatagagtaaagtaaaaactgaagttattctgtattgcataggcagtacagattttctgtgaaaaccataaagctattttgtctactttgcatgaataattcagacttttctatatcaaggccaagtagtaactaaaaattggatcttgcttttcagagataagaattctcagctcatcataattatatgtctttatctaagtgtttccttctaggtctcccaccaagtattagatctttgaaatgtaagcaactgatcactgatatatattgtctggcaattcattcttctgccaaatgtacatacagagaattgtgaagatttttaaagaattaaatcacttgtgcaattgtgttcttatttgcagatacgccagtttatgactttaaacttatttttccaacactaatttccagtgcttcaacatcaactccctctcttttcaacataaaattgatgaagggatgtggcagagtttgatttttcaaaaatatgtaa

SEQ ID NO: 28328 - DNA, 1219 bp, Mus musculus
agataaacacgcacaagcacgcacacagacgtcgcctcggcccgcactcgcagccgcaggtccaggcgtcagggaagagcccgggggccccgcgatgggtcgccgccttcgcctcgtagccccgggcgcggccgctcgccctcgcctctcgcaggtggcgacagaagtgcccggcgcgacggcgcaacggccggtctgggcctgcagcctcggcggcccgggccggaggggagcggcctccggacaccggtaggcggggttgcggggcaggcggggagccggggagggacaggcggagtcggccacggacgactggctcccgctgcgctttcccgacccacggcccgcagccgcggcccttgagctgagcagcggcggttcccgggcggctgggcgctcgccggcctcgccgttaccgttggaggtgacctaggcgcggcgggtgggctccggcgacggaggcggccgcgatggtgtcggcccgggagcagggccgttgcctctagcttaatacggcagatgcgcggaacctccaacaggtggctccgtggcgcaatggatagcgcattggacttctagaggctgaaggcattcaaaggttccgggttcgagtcccggcggagtcggaacatttttcttttgtcaccgaggaaattatctttgatttctgtcttttactccttttctttgtattctaaacggcttaattcccagcacagccacacaccattcccgctgctctccgcaacccttacctggagttccgggagctttcagacccctttagcagacccggaccgatcccagtcgagagaacagggaggcagtagagaatccaggtgctcgaccttggcctaaatgagagcttgagataggcctgggtctcgagtgacattccacgtctggagcttgacagtgactgccagcagggtcaagaaaacaggatgcgcaagctagtccgaaggcattagaagtacaccacctcacctcaccccaccccgcctccggaatctcgagtggatcttgttttgtttttttgtttgtttgtttgttttgttttttaaaaaaggcagatctctgtggtcatttcatgattccatttcggtggatctggaatggggcccagaaatctgcatttctggggttgtctgctttcttcacgaaaggagacaggttggagttgacaggctttgcctgccagctagaggcaagagttact

SEQ ID NO: 28329 - DNA, 1183 bp, Mus musculus
cctcactcagttttatagtttatgatgtacattaagatcttcaaatatcatatataagaaacatttcgcatgcagtcactcaaagaaatccagacacattgcatcctcagccacagggctcgcaggtacttagttctttctttcctcgcactaaatgaacccgggccaacacactttctgatctagcgccttcctctctcctcggctcctgacaggttgctaggatactcgaagtctctgaagacaggaagaggagcatgggtgtgagctctgggttggagctcattactttacctcatggacggcagctgcgcctggacatcatcgagaggtgagcttgctgtctctgcgtcccgtgcagcaggataggggtggggatcgggggaggagggagaggagcagcatctgactgtgactctccctcaagcctgagctatgtctgggacatcacacctcccttgccccattcctgaacagtggctggagggtggcctcctttgaagccctggctggcgtggctgcagccagaacgctgcacctcctgctgccttcctcccctcaggagcatctcccggtgtctctgagcttaagacctcccgaagaattaggatctggaaagactgaggagaacgggttctgacctctttctttaagggatgctccagaggactggggttccccaggctgtgaaaccacactgccattttccagaaacagcagcccctgggtacttagtgtctttccttgtcgcagcactaaatcaccctggcaagagcatcccaagaaagggtttatctcagttcacagcccctcatggtggggaagccaagacagcaggaacgtgaaggatgtggtcatgctgtgtcctcggtcaggaatgcaagcttttgccccatgcccttagcagggtcccagctggggagcgctgctgcctacagggccctgtcttcctacctcagctaataaagcccccaggggcccatgtactggcagattctagattctctcaccaccacactaggtgttcattaaaacacacgggcatctgtaacctcaggacttgggggctggagcaggatgactaagtccagcccaggctataaataaagccttttcacaaacaataaacaaaccatgaagcaaagccaaagcatgcccttgaacatggatctttagagatgag

SEQ ID NO: 28330 - DNA, 1100 bp, Mus musculus
tctcttgttctgatacctgtgacatcttgaatcaagttcatattctccctatcccccctccccgtctccgtctctctctctcacactcacccctgtctctccttttctattcccactaagtggagctccagtcttcctgtatgttgggaaacctgctatctcctcgtgcctctcatggtaagagagagaacacgcacctctgaggtcctcctgcccttgtgggccacctcgtgctcccatgtccatgggtgagcctggttctgatcatggtacattctttacctggtgttggatggactttatcgaaatcagctttccaaactggctcccagccagtggcacacaaatagcccttctgatgattaaagccattttctcctcatcttgtcgatccgagcccgaccctttggtcttctccttaggcacaacaccatggccattggcattgctgtggacattctgggctgcacaggcacactggagaaccgagcgggtaccctcaataagatcatccaggtggcggtggaactgaaggatgccatgggagacctctatgctttctctgccatcatgaaagccctggagatgcctcaggtgagatgctggctttgtgcagcctcccacacaagcatgcattcaacactcgtcaaagagttctatacgtctccaccatgcacgtctgactgctctggccaacctctaaagataaacgttagtgaaagccacgccagggacaggcaaccgagagcactgtccttagcattttgattctgtttctaaaaacactggtaattgatcatagttcaatatctcatctttgatgcaaaataacaagagttagcctcactgctaacaagcagtattcctgaagaaccagtcagggcaagacaccatgctggagtctgtggtatgacagaggctgcatccacttgggtcaccagggatgtggctatttggggtaatgactggggaaaccgaggcatttaaggaacttgtatcagagattccctagaccagcggtcctcaatctgtgggtcccgacttctttgggcgtcaaaggggtcacatgccagacatgttacatatcagacatgtacatt

SEQ ID NO: 28331 - DNA, 1099 bp, Mus musculus
ttcatccccagactatgtcctgaaattccagatgatctcagggtcctgtatctcctgttttctactctgggacagaataaataaaaggcaggatcaagaagaatgtccaccattagtacctgggaaggcgtttttatctagagttcattgtgttcttgctccaagtgtccacacgtactagaaagtgctgtgtaaactgaactttaagctttgtagtaaaagcaagcagcttcttcagagtgatacattcatcccagtgtgtggtgtggtgtggtgtggtgtgtgctgcattaagtaagtggtgattcccacggtgcttagagagaggcatctcagcacacagtgggtaagtgtagtgtgtgatggaccacttaggaaaagtaactgatttgctcagagaggcagcctgtaaggatgacttccaaacaaaactccactgtttttagtaactgtgatactgattatgaggcagggtctcatagattaaaagctgatcttcaatttgatgtatagccgagggagaccttgaacttcttgatcctcctgctccacctcccaagtgccaggatcacaggtatgtcaccagcctgatttatgctggagagtgaacccagcgcttcatgcgtgctaggcagacattctactacgtgagttatgtccatagtccccttcgttgattcttaaaaagtcatttggcagaaagcaaagctgggctgacttgggaatgctactcagacagtaagcctggctgcctggaagtatgagggaagtaacctaggaccacagaaatttactaccataagtcagacttttcagctaagatagttgagtcatgtggtatgtagctgaatgatgtgacaggtaaattctgcatcagtcacactgttacaaacagctgcagacaaggagcaatcaccatgactcctcacagcaccacaagcccacagggacacaggcttagggggctgactgttggttctttgaagctgacaaatgccctacatcttcctttaagtggtctttttagagagaggacagagcccatctcaactcttctttaaagcaaactttcattcatgtttacctttgaattttgggc

SEQ ID NO: 28332 - DNA, 3077 bp, Mus musculus
gtttactggtaattttcaatgttgtacaaagttcattctaagctaatcttccacttgtaatacttcattagtgttcatttatttggttcctggcagttactcataggagaggttgagtctaactcagtggaggtaagggacagtctggagtggaggaagaaagtgtggcaggcgtgttcttagaggagaaacagaagacaggttttttactgagatgaaggaagatctctaccaccgttgagggcttcgttttagctgatcgtcgactgtcagagtaggtacctcttctaatgtattgccaaaagcatctgttggaatgtgtccagtcagctgtacagtgtagttgtcatgtgaccacatccttgttagttgagtgaggagataaagggaggaggcagtaacactggcctttgatcatcttgtgtttcagagttctctggtgtgtttagtagccaactataaaatgattttaggtacatttgggacagacactttaaactgaatgccccttttggtcttaccaaaggtcttcagtaattgtttttttctttttcctcctggactgcaggttcctgaagagggtttctgaggaaatgggcaagatgttgaaggaggttacatgcagctgctttgggggagggtattagagttgtcaggctgaaagagagagtgagagaagcaagttgcatgaatgcatgcagatttttttttactaacttcattagcatttccatacattaaaaagtcattctagtaccagtccttaaattcctagtccacagttgttcacatagaagaaggaaaagaaaagccagcaatggctgacctcttttttcatttactgataccaaatcagaaagaatacagagctgtcttaaagtttgtcttattttgggctgtccgttaggactgtcgtcatcagctctgttgaattggcttctagactcgtcgtctgtcaccatttgtcactgtccgcctgcaccacccctgcgcttgcttaacaccctgttgcatgtctcgcgtgatctgggcttagagttttcaggcatgtctctgtaatcccctgttcttgtcaaagctttgtttcattttgcatttgtagtgcaaatcactttgtcagacacctcagcactaatgtttccatcttagtatctgtgtatgctgctaaaacttccctactgcaaacgttccagttttgacatgaagacatagtctgtgaacctgaagtatttacgataagaaaaagaaaacatctctgctctagcctgcagcccagttaccgactctgaaatgtgacgcatcttcagcacctcagtctgggagaatctggtcagcactgaaggcctggcataataacaccgaagggactattgtcaaaagtcagctgcttccattcaaatgctgccttaaaatcgagtgcctaaatctgtttattgccaacactaccactacagtatcccacaaagggctttatgtgccagctcagtgctccgcctctaactgtggcacctcgcagctgtgatgtagcctcggtaggtggcttctagagctctaccatgtgcagtggtgcatcttcaaattcatggatcaaactaaagacctgtgtgagtccattttactttcatcggtgtatttatgagacgtttgatggaccttcccccttcaccttttaacggggtggtgacgatctcccttgattattttaatgatagtctgtttccaagtgatgcttttgtttgaaccagataaaattcagtgagactttgtaatgatctatgtgcacttttacttgtaaaatgggaatttctgtatgtttatacttgtaaatacgattgtcgttagtgccctcattgctcatgtgtcctgccgcgcgtttgtgattctgtgactgacttgtatgggaactaatttcttagtggtcttgtaacggggcggggggggggggggattgtttgtaccactgaagctccattcgtttggttctttactgttgtgaggggagaaagagaatgtgaaacgttctgtgtattattggatttcaagcaatattttagaaaccgtgtgactgctttaataattttttccaatgctatttgaatcatactaccagttacgctaaagctgaatgacaattgtgtgaacattaatgccttcataagatcaagtacaccactgttatgcagctgacatatagtatattacatttgaggctagtaaactatacagttttagatattaaatctcgttacagggttatttatataatgtgacattattctatactgacagactacatgaagtagttttaaaaagtagtgctatttttatttcaaaagttagcaatgagaaggaaatgtgacctggctgtgtttgtcttctgtacagagactgaagtgcttatgtttttctgactaacaatcacagagggcaaagttcaacgctttcttgtacagactgttcttttcaagctactgtgtgtttttctaaagctggtgtttgcttccatagtaggcaagttccttcatgtggagtagtgcaacctgtgtatgggttataacatttgaagacacttggacttgcacagtttttaagtcattcttaaaccattcttaaactttgaacatgtgagctgtctaaaagaaatctcttaatttcatagtaatttccactttgtgcacatattgatttcttaatggtaataagccttgtttatgatagtgttctctgttgagaatattttcatggaataaagcaatcttttcatggtcagttaagatgtgtacttatcttttactgctgctggaaccaaagagactcggagcaccttaaatgtgatagagtccaggtaataagggagatgctaagcttctaaaggacagtagcctttggggtgagccaatttattctggttttagtttcttccaaactttgccaaaggaaaaaatagatgcttaattagggcgaaagtcaatcagctgtaatcatttgcatttatttttactcagcagtagctatgtggcacagacatcccttggccttgtcgtcttcctgcatccatctgtaagagctgtccctgg

SEQ ID NO: 28333 - DNA, 1205 bp, Mus musculus
atagagcatgacaggttaaatgtgattatatctaaagtgatttgagtgttgtgcgcctgcttaaaatgcttagcccaaagcaagccttgtaaacttaacttgtccataacttatgcagataaacgcgtattatcttccagagtatccccagtcctacatctgtcaaagaatggagtatcttgggtttctttggctctcattttttcggttttgtggcaaattagaaggcagagaatggggggggggtttgaaaagataaacagttttttgataaaaactcgttaagtcattttggtatagacatttcaagaacagtgatttattatttagttatttttaatgatctcattttcacctctgggtagaaaattcatgacttaataatgtaggcctttagttttccttatcaatagtgtaaattatgtagggataggctagcagtatctatgttcagcgtcccactaaatgtcaaaataagcagatgaaggaaacaagtatttggtttttacagaccggtttgctgagtcaagaatggggcttctggagtgaatcttgaaaacgactatagactcttgaatgaagaggactccagcagctgacttcggcacctctatctaaccttttcttcagcccttgacctcactaaagtactatcatatgtttaaaacctgtttttcatggttgaagtaatgattgtagctaaatgatagataatatatatttttaataatgtctgtaacttaagtacttatgggaaataaatgtatgtaaaaaaaaaaagttatctttgtgaagcttactttctcaaatattgttttaaaactatgctattataaaataattatctagagttgaataggtagcacttactcagaaaggccacagtcccaaagcagctactagaaacattttggaagctgttccttgtcatcttaagacctgggtgattagaaattctttactgttggttttagtgctattcagtatatgagaactgtctaaaatactcagagggggtgttcttctcccttataattcacactatttggtgaactgtttacagttgtcttaagatactgttgcatttgcttgggtaatttttgtgcaaggtgtaactgaagtatgcgtattagcacacagggccgaggtgactcttgagttcaccacactctgggacctgcttactaattttctctaataaatgt

SEQ ID NO: 28334 - DNA, 1219 bp, Mus musculus
tggcctggaactcactaagtagaccaggctggctcaaactcacagagccctgcctacttcactttattaaacaatgtcaagtatcatgtgttgagtgaagtctttcagaaatgtgtctcatggctgcacaggagtcgtgttgtcgttctttgagtaaatgtgacaaatgatttttgttgttgttgctgctacataaaactataaatggcttcattgattttttttggacagagtctaataccaagctggctcagcctcccaaacacccaactagctattaacaaccttaagagattttgggttttattttctgccttttgttgttgttttcaggatgaatatttgttctaacacatctaaaagtaccaaatgagttaaaaataagatcttgcttaatcagtaaagacaaacagctgatcagaaatcaatttctaataaactgaaaaaacaaacttcagatacactttgattttcattgtataatataaggcatatatagtaactaatagtttaaaaacttgccttttttttgttgttgttgttcttctgtagagtaactgtggccaaaaaataaaaatccgccgtgttttaatgaattgcccagagattgttacaattggattagtgtgggactccgagcactcagacttgactgaagatgttgttcgaagtctagccacgcatctctaccttcctggggtatcacagttgctttcattcaaacgttaatatcaagatggtcttagttttgttcatctgaacctaaatcttttaagggaaatattgatatccagatgtgcttagatgaagataattttgcctaaatcagactaagtggaatacctttttccatagactagaaatgactttcaatcacagactaacccgtctcttgccctttcaccctggagtgatgattggtgataatgatggttaccacttgatggttctcacataaatgtgataaataataatctagagagggtttaaggtttaaacttaatctgtgtattgatttctctgatacatgtgctttttaaagttgattattactttctcaatttactttgagtttgttactgttataattacaaataaaaattatactttaagtgataatttaatgtttcttcaaatatgttatctaatcaagaatatataattcatcttacatttggaatataagtaaagtgtcaattgtatgttgctagagaaactt

SEQ ID NO: 28335 - DNA, 2372 bp, Mus musculus
atggcctccataggcttatatttttgaatatttggtccccagttagtggaactgtctgggaatgcttaggaggtctaaccttgttagtggatgtgtgtcattggcagcaggatttgaggtttcaaaaggccaggggcatttcctgtgcttctctttcttccttgtgctcagggatcgagatgtgagctcccagatactgttttagcaccgtgcctgcctgcctgcctgcctgccaccatgttctctgacatgatggctatgagctctactcctctgaaactgtaaatcctcagtaaaaacattctctaaattgccttggtcatggtgtcttatctaaggaggtggaggaggaagaagaggaggtggaggaggaaaaggagggggaagaggaagaggaagaggaagaggaagaggaagaggaagaggaggaggaggaggaggaggaagaagaagaagaagaagaagaagaagaagaagaagaagaagaagaagaagaagaagaagaagaagaagaagaagaaagttgcgtggcctagatcactcaccagggtcaggaatgggggctgtggcttgcttggggaccctctatgtctccctctttgcttcctggctactgtgacatgagcggctttactgtgtcagtcctcctgcctgtcacgatgctttgcatcttcagacacctatagcagttcagcaagatgacttaggactgaaaccttagagactgagacaatgcaaattattaccctttaaattggtttcttttttagtgataaacagttgacacagttgcctcaaaattcctaatactgtgggtgatggtggctcatgtccttaatcctagcacttgggaggcagaagcaggtggattgctgagtttgaggccagcctggtctagagagtgagttccaggacagcaaaggctacaaagagaaaccctgtctcaaacaacaacaacaacatgtcttgataatgataattctaaaagaagacctggcaggtctgagaggatctatattgagcatagatggattgagctgagaagacccgcccagtgtgtgggacatcattccctggactggcatcctggactgcataaaaagagccagacacaagcactgattgctctctgctttcctgactgtgcccgcatagtgatcagctgcctcaagctaccgcatcaagatggattactcccttgaactgtggaccaaaataaacattttctccttttagttgtggttgccagagtattttatcacagcaacaggaaaagttactcaggtagcttttgattagtcaagctttagggagcttttatttctggttcctcagaaggaggcacacagtgagggcaaaatcactaggctgcttttatttcataaaactttcatagattccccaaactcgcagctcggctgcggactgaactcatactttctctctgatagtgagacatttttggagtgtggcctattggtcctgattttagggccaaataggtgtttctcaactgtttctgtccaaaggtgagctaaaagttatctacctttgacacaggccagttcctgtttgtgggtggggcacacccagttaagtgggcaagcccacggaggtcctgcaaccctttgcttccttgaggacacctcagctgagcgtctcgtttcacacagaaccaggctgtcgtgggccttccttccttctgtggttgtgctggaagacgtcatcaaattgtctgtccacgcgccagattcctctggccactgagcactccccgacacgcgtcgcttccagtaaggcgagcgcagcgcagcgattcagtgccacctgttgaacccagagcgcgccctcctcaccccacccaagtcccctgccaccggctccggaggatctttgacaaattggaggaggcggggcctcgcgaaggaaaagcttagaggaaaagacccggaaagaggcgcgagaccgcagtgggaggtgcggccccgcccccgccagggcgcgccgcgggagcgagcgggtccagcacgcgcgcgcgcccgggcgcctgacgtggcactagcaacccagagcgactcggcggcggcggcgcggggcgcggagcgtgcagagcaggtacggcagacgcggggcgcagggcgcagggaggagggtggggaggaaggggagccacaggtacagcaggttcgggctgagggtgcggagcgtccacacgcggctgcaccgcgactccccatcaacttggctctctggttcccggaggaggagagggctggaaatattccgagggaaaatggcaactacagtgttcagctccgggacatcattagagggaaacgcgaacttgtcccgggtgacagtggaaggggaag

SEQ ID NO: 28336 - DNA, 1067 bp, Mus musculus
tcaaaatgtgaccatggaaaccaagatgcagagttgtaggaatactaatgagagactgttcaaagcaattcaggcatccaggggaaacgtggtagcaattactattcagatctgtgcctgtgaaatttcctgggacccccgaaatgacattactggattcctaagagatgtcttaagccatattcaggggataataactatgataagagtgttgtataaaatgaagattatttccagaatggacacacttacttttcttcaagacatctgatatgtttcttgattgcgtttctatttttagtagcatttgatatctaaaatcctcttgctaacttctcgcctttacttctgcagggttattctgcagtagctcttctttggaatgatattttcatcatgagccaacaaggctatgtggcgacacccccttattctcagtcccagcctggaatgggtatctctccccctcactacggacactatggggacccgtcccatgcatcctctccaccaggtaaattattctttttacttatatatgactattcaatcctcaggcttagagacgtgggatatcttagttggtagtcattgagtgaagccgtggtttgatataacagcatcatttggagagcctcgtacagcaaaacacgcacttatctcacagatctacttcttcaacgtagacttcttcatatctttcctgtgcctggaccagtgttttctctggttcacctccatgcttcagacatggcatgctcatttatagcaatttgttctctttcattgaagcctacattttactggtattccatgttacacgtgagcagcagttattagaatcaacacccaaacctttcattattacagaacaaaaacaaactagcagtgggggcacatgctataagcttagcactcaagagatagaaccaggagggtaaggagttcaaggccagctttggctagatagcaagttcaaggccagcctgggctatacgggaccctatctcaaggaaacaaacaagagctccaaaatcaagacagaagaagccctcttttttaaccta

SEQ ID NO: 28337 - DNA, 1136 bp, Mus musculus
atgaattgtttttagagaacaaaaacaaacaaccaactccagacgtactgcagtgttgcaaagcagtggcagacaccactgtgtatggagtgccctgctggattcaggatctaagacaagccacactttgtttgtttgttggtctgaatgatcacaaagatgcaaccgtaaaccaggggttcttggtaattgacactgttggtttttgttttcttctattgatcgagtttagggtatgtgaagtagccctgggttgatctttcctaactgacttccaaaggaggctttgtgttcacgttggaaacttttctctgctttgccataggaaacgtgcgaatggaaatgcaggctgctgccacatgggttattttgaactcatatcaagattaaatatatgatgcccaatatcagccatgttgcttaccacacagaggacttgttttaggacatattcgctattgcgtatgttgtttgcttaagatgctcagtgatgctatcaatgccgtttgtctcttagatttccaggacccccacctgtcaatagtgtggcaccctcttatgcgtcaggccagaccctgccacagtcatcttacccaggccctgggtccacttcctctgtcacccagctgggcagtcagttcagctccatgcagatcaacagctatggtaagtgtgaggagtcactgttccttcatggtgcctatttggtattttctgtgctgctggaggtgaacccagaaccgtagatgtgctaggctaccgctgaccactgagctacactcccacctcatcattgcttcttttttaaggcagacataactcgggcatgccatgttaaaatgctaccatgtacataaaccattgatactgtgtctggcgctggttccgtttcacctgagcctgttgccactatttcaatataattgaagaaccctcagagcactgtatgttcattgctggagcaataaacaacaaaaatgctgacgtcacaagtaagcattaaacagagtaattatctgaggagtggtgagggtagttttaaaattgtattgttataatgtgagacctcaaaattaaaaacacaatgcttattgtttcacagagagtattagtgctgtgtttaggtcacttgaaga

SEQ ID NO: 28338 - DNA, 1237 bp, Mus musculus
gctcaggggttaagagcactttctgctcttagagtgaagccaagttcggttaccccaacccacttggctgttcacaactgtctataattttaactctttctgaccttcattcaatgccaagcacacatgtacacacatgtgtgtacatctgcaggcactaagcacatgttcatacacaaatactaaatctttttaaaacagaaattccttactaaaactagaagtgttgcttttatgctcttctaaaacattctatttggaaaaaaagatggctccaagtaatatttatatcactttctgtgggataattttaatttgtggtcaccatatatacatgaatatgcaatccttaaacatgcccttttggtttgtgtatggaaattaaacatctctgtcatatgctttgtaggcatcagacctctgagaaacgtggctctgagccgtggtcttctctctcccacaggtgtgggcgcgactcctcagagccagggtccgcctggcccccagtcagcaggcgccttccaggggcctccacaacctgcacagccatctattctgcagccaggacatcaggttccgccgccaccccccactgccctgaacggccctggtgcctctcctatgtctccaccaactcacaggcaagatggccttcctgggccagctcctctgaacgcccagtatcagcccccacctccaccaggccagaccctgggtcctggctaccctccacagcaaggtaaggtggacagggtgaagccgggggtgggggtggaaatcacctgggggtgtgcttagaggaagtcagatttgtttctgtgtcaactgcaaagatagtaggctctggatagcatcagaagggcaagttaaacgggagtgtaagaactccctcttagcttcctgctttatttaacaagacaaacttggtggcaggcttgattcagcagtatgatattgtcagtgactcttacacctgggtctggacactgtcatttattcttttttttttttttcctttttctttctttctttctttttttcaagcaaccaactatggaccgcagatgggaggtgcacagatgtcttacccaggagggttccctggaggtcctgcccagatggctgggccggcaccacagctccagaggaagctggatccggactccatccccagccctgtgagtgtcctctgtgtcccacacagatgctctgctcttccatttgttagcattgagtc

SEQ ID NO: 28339 - DNA, 1153 bp, Mus musculus
gtctgagggggagagagagagatctgtgtcttccgagggcgctctgacatcattgcatgtcactgtggtacctctgagcccacacacgcaggtcacagcccagtcactgttggagtttttgcttattgtcccatttcggatgctgtttttcaagagtgtgcatttggggtaaaccaaaagctatttttaacggtggctagaactatttgatatgtcttatagtttcctgtgtcttattttgaggagatgtgggtttaattaataatgactatttataacattgtttctttggggacagggctttgccagtcataaacggatagtttgaaataaggtttgtgggactatggtctactgattagtgactgtgtaggttcagtgttccgggcacacgactgtgtcatgacagtggccaccttagactttgttggttgggatgattatgccaaatgctaacatttagtaatatacacgttactcttcctttgagtagcccaattagcctgtggttaaatacagaacttgattacagtgatttgatgtatctgcacacttcctttttgtgggagcatcttgtctgtgtcttgctgtggtagtgatgtctggaacacatcctatatctttgtgtttgtcactactcaaactctgaggatgccagacggcagacagatacaggtttaaattcaggcttggtcggttgccagtgttcttggaacccacgccgccgcctgcaccatctgtgctggttgagactggagcaggggaggaacacttcggcgttggttcaaagttggcgtttgtatcaacgatggggaactgtgtgtatctttttgttttttattccagcctagatgctctctgtggctgccttcttaggctcacctttgggtttatctctgttgttgctttctccgcccccccccacctcttttctctagggggtgagggatggaggacgacagtccccggggttacttcttggtaccctacattcattctgtttaattttgcttgtactttttttttttaaaccctggacagttattacaaaaagaaacaaaaattaaaaagaaatctgttctggtcttcatcagcagctgttattagtagagaagtaaatatgtttttatgttggatggcaatagacactcca

SEQ ID NO: 28340 - DNA, 1177 bp, Mus musculus
agggaaatggaggtgggggttgtatgaagtggagagggaagacaggtgccctgtgacctcactcaccagaggacgagacactcgtcatgaagcaaaggcacccagtgctgaaagaagcctttgctccaacctgagacaggacggccgccatgaacagcctctgacggaagatgcttctgactgaatgcacacacctctgtcacacaacaccatccaacctatagagctgcatgcaggacagtagattgacaacaggggtagggacagctccagtaaggctactggagtatcaaataacctgaaggcaagcaactgttttatttcatttgcccagtctacctatgcagagggaaaaaattccatatttttctcatttaaaattcctaattaaaaaaattaatagaaacttaaattttaatagaaaaaatattgtattaaatggtttttaatacattgttggcttttctttttattttctttcatcgttttctttagatacttttccagccccaaacagctgtctacgaatctctggccaaagactgtgtggccaacagctgctcagtgactctgttcctcttccccagtcagtttgtggatgtggcttccttgggtctggttcctctgctcacgggaggaactctttacaaatacaacgttttccaggtaagcggcaagccgcctgtccctctcagttcctttccggtttgagtcttgagtctgtctctgtctttctccctgtctttctctggtgctgtctctcacccagccccgtgtgtgtgtgtttgtgtggtggggcttgagtatatgtgtgcacacatgtgttgcttcagatgggcaaggcaggactttcaggagtcagttctctcctgcatctagctggggtcgaatcttgttgtttctattactcgggcactgggcactgacctaggctggcttgcctggcaagctttctggtggcttctgtctgtgcctcctgtcttaccctaggagtttgtggattactgctttgagctaccacacccaattgttgttgtgtgtctgtctcctgtttacatgagtctcaggaccaagctcaagtccataggcttccacagaagtgtttttaagggctgagccatctccccaacccagtttaagtttgatgcttagatcatggggtaagaaagttgtgtcc

SEQ ID NO: 28341 - DNA, 1163 bp, Mus musculus
ccagggcatcactggcccagtgttagccttctctccccctttctgagctctgtcctcttatatagtgacagccatacaggtctctttgcagatcctcaaacaccctagtcgggctcttacctcaggatctgcgcatacgtgtttctgtgtgtctggaatgttcttttcatttctccaggctcaactcctaacctcttctcacctccttaggtagtcttactcacgactacctttgtcagctgccttcatagccccgccccacagtgatacttatccttgttaccattcatttcctgcacagctcttaacagcgcctacaagtatgcatgttctattttatgcaacaggcctttctccctcaaaaagaccattaggtgcacaaggcagagattcttgtaggctttaattagctatgttcttaatgggggaggggggagagaaaggaaggaaggagaagaaagaggaacagaggaacaagttctgagtgtcttgactttgcccaaacagcacacgttagatgtgaagagtgcagcgctgccaccagccgtccgctgctccgagtcccgactctctgaagaaggaatattcctgctggctaacggtctgaacatgttcttatggtttggagtgggcagcccaccagagctgattcagggaatatttaatgtgccatcgtttgcacatatcaacacagatatggcaagtattcttcagtttttgtgataaccctcaaatataaattttgattttatgtgcagttttatgatacaaaggagaataacagtgtgtgtttatatagctcaatatgagaatcgtattttgatgaataaaaatgagaaagggtaaagtaatatactgaagttttaacttaaacatggcttcactagaaactgataatgcagagatggagagatggcttgtagttaagaatgtttgctgtccttgcagaggacctgacacacacacacacactcgcatgaacacacatgcatgaacatagccttgcacacatgcatgaacacacacacactcgcacaccctgctgttcaccagtggctgttctctgcatgcagtttaagcccgccatcctgcttcattttcctgacacatcagtgaggtagctgcggcagcagtgtgctcctgatgaactagtgaagccagag

SEQ ID NO: 28342 - DNA, 1117 bp, Mus musculus
aacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacgaatggacctgacagatatctacagaacattttatcctaaaacaaaaggatataccttcttctcagcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactggataacactcttctcaatgataccttggtcaaggaaggaataaagaaagaaattaaagactttttagagtttaatgaaaatgaagccacaatgtacccaaacctatgggacacaatgaaagcatttctaagagggaaactcatagctctgagtgcctccaagaagaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattgacaaaatcagaaatgaaaagggagacataacaacagatcctgaagaaatccaaatcaccatcagatccttctacaaaaggctatactcaacaaaactggaaaacctggacgaaatggacaaatttctggacagataccaggtaccaaagttgaa

SEQ ID NO: 28343 - DNA, 2085 bp, Mus musculus
tttttagttctaagaacaaaaggttttgaattaaagtcataaaggacactgctggggccttttcagcatcacagtgtttcttgtggaagaaagcaattggggatcttatagagattgctagggtaaaagtagcttacttttggtaaaggttttcctcgtgatatttttgagaatgaatgtaagcacttgacggaataacaccacctctgtttaaaaacatgtatatgataaattgtcatagatttctttggtttagctatatgatttgaaatattttggttctttttatgaatgtaaattattgctactactatataaaagtaattttaaagtgtcttaagattataaatggcattacattttgtttcttaaaagaggaacacactggctgctccgaaaagccatctttgcattgttcctgggtcgtgctccgcgctcgctgcagccaccttcgccgcccaccgcctcctccagccagagtcctcgaactcgactttaattccctcactcgcggcatcggaccaccggcgtgccccaccatgtcagacgcggcagtggataccagctccgagatcaccaccaaggacttgaaggagaagaaggaagttgtggaggaggcagagaatggaagagatgcacctgccaatgggaacgctcaaaatgaggaaaatggggagcaggaggctgacaatgaggtagatgaagaagaggaagaaggtggggaggaagaggaggaggaagaaggtgacggtgaggaggaggatggagatgaagatgaggaagctgaggctcctacgggcaagcgggtagctgaggatgatgaggatgacgatgtggacaccaagaagcagaagaccgaggaggatgactagacagcaaaaggaaaaataaccttacgcaccgtgacctattcaccctccacttcccgtctcagaatttaaacgtggtcaccttcgagtagagaagcaggccccgcccgcccacagcgggcaatgccacccacagatatgacatgcgctctccaccacccctccaaaactacaacatgaattggcaacatgggaggaaaaaagaaccagaacttcccaggccctactttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattataatctcaaaggagaaaaaaaaaaccttgtaaaaaaaagcaaaaacaacaacaaaaaaacaatcttattccgagcattccagtatgtacctagctgtactataagtagttggtttgtatgagatggttaaaaaggccaaagataaaaagattttttttttccttttctttctgtctatgaagttgctgtttattttttttttggcctgtttgatgtatgtgtgaaacaatgtccaacaataaaccggaattttattttgctgagttgttctaacaaaaaaaaaaaaaaaaaaaaaaaaaaagaggaacactcttttagtatacagttaaaacttaaagaaaaaaaaagaaaagaaaaaacccacaaaattatctcattataaaagtctttgacaaaatacaacaaccctttctgttagaagtattagagaaatccagaattcaaggtccatatctaaacataataaaagcaatatacagcaaaccagtagccaacatcaaactaaatggagagaaacttgaaggaattccactaaaatcagagacaagacaaggctgcccactgcttcctatctattcaatatagtactgtaagttctagccagaacaattaggcaacaaaaggagttcaaagggatacaaattggaaaggaacaagtcaagatatcattgtttgcaaatgacatgatagtgtacataagacccctccaaacaaacaaacaaacaaaacaaacaaacaaacaaaaaacaaaaaacaaaccagagaactactacagctgataaactgctccagaaaagtggctggatataaa

SEQ ID NO: 28344 - DNA, 1145 bp, Mus musculus
gggatgagatttgtgctttctccatgaacactcttcttcaaggccaagaaaccctaactggtttgaaatgcagcctagacttgggaaccagaaaaaacttcaaccacaagcctcctccaatgtatgggcttctggttccctcccatctggttcctcccctgggtcaccctttcttctttactatcctcatacctttctttctttcttcatttctttcttccttcctttctttccttctttctttctttctttctttctttctttctttctttctttctttctttctttctttctttctttcttcctctcctctttttttaattaggtattttctttatttacatttcaaatgctatcccaaaagtcccccataccctccccctaccaactcccctacccaccactcccacttcttggccctggtgctcccctttactgaggcatataaagtttgcaataccaaagggcctctcttcccaatgatggccgactaggccattttctgctacatatgtagctagagacatgagctctggggggtactggttagttcatattgttgttctacctatagggttgcagatccctttagctccttgggtactttctctagctcctccattgggagccctgtgatccatccaatagctgactgtgagcatccacttctgtgtttgccaggcaccggcatagcctcacaagagacagctatatcagggtcctttcagcaaaatcttgctggtgtatgcaatcatacctacattcttactctatctttaaaatattttacttactgaacttcaccctgttaccccccccccaaaaaaaaatgttctgtgaaagcttcccaatgcctctcactgtacaacagctccgcttgtccctgatacatcagcagaaagaccttttagatgctctggagagactggttaaaagagttcatccccttttccctgagttagataccattctttagtcctctatttcctacttttctctttctttaatgctttattgctccctgcttcttccattagctcattttggtgcaacagccctgagtcaacactttgtgactttctctcaccagcccactctgtttctcctgcctatgatcctccccctcccaaaccttctcaggaaat

SEQ ID NO: 28345 - DNA, 1231 bp, Mus musculus
aaaagcaggcagagatgccaggacggatccttgtggttaccctgtcagccagtgcttcttagcaaaagcaatttctaagtacctaaagtacaagaatgatccacgtttgactttcatgggaacctagccaacgtttttagaaatcctgcatttggaaattcccagatcttcttttcctttccctagaactaaagacaaaaacaccatttgacctgcctgacccacagaccaactgactcactgcccttagcacaagcctcttgcttaagagacatttaggtcacacaaaatagacttttgctaaggaggctctttctgtaccctcttcaaaacgtctgctgctgttcttgctggcttctctcaaaccctgccagtcagaagtggctctcctccgccagatcgccgccatcatggacacgagttgcgtgcagcctatcaagctggctagggtaaccaaagtgctgggcaggaccggttcgcagggacagtgcacgcaggtgcgagtggaattcatggatgacaccagccgctctatcatctgaaatgtcaaaggccccgttcgagagggtgacatgctcaccctattgtagtcagaaagagaagctcgaaggttgcgttaatcttgcagctggtggggttctggatatccactacttagcccatggaatgatctgcaactgttaaataaagcatttatatttaaaaaaaaaaagaagtggctctctcttctgtttcttctaggcaatcatgtttcaaaatccagtccttgtggtgcaggcatagaatcccagttctccggaggctaaggcaggatgattgccagggttcaaggccacctgaactatatacagcaagactttctcgatttagagagagagagagagagagagagagagagagagagagagagagagagaagaagaagaagaagaagaagaaggaggaggaggaggaggagcaggaaggaaggaggaagaggaggaggaagagcaagaggaggaggaggaggaaggcagcaagaaaagaataagagaacagaaaagggaatcatttcaaacaagctatcatgattgtcagcaaaatagatgagattttgatgcaaaaagaacttgaagtaatagagttgatgtcataaaaaaatttaccaataaacttgcttaagagacattaggtcacacaaagtagacttcctctaaggaggctctgcctctaaaataccccaaagataagc

SEQ ID NO: 28346 - DNA, 1163 bp, Mus musculus
agcagacttaacattgtcaaaagctttcagagtatctgaaaatgggagccaccattcatccagtcagagctgtcaggaagacaacagaaggcactgacatggaggtgaatgcactcaagtgcttggaccatttcttcattcaacaaatatgcatgatctaagcatctcttgcgcaaagtgttgcacatagtggttgaaggaaaggagaacacaatgttttttaaaggtatctttgctttttacctgcaacttcagtctccttacataattctgtatttctggagctatgctgctttgccacatgaccgtcatgctgaccatatttagagcacacagagacactgggttagcagtgtcttagcccatgttgttattcagggcaagggtgggaggttcctgttaacattttttttttttactaaataagaccagataggttcggtttttatctccaatatggcccattatgcatttcatggctgatagcaaatttgctggatattgtgttctgactttctttgtcatttttctctcctcagtctttgtgaactgcagttgacatatacacaaactccacagcacaaagtcctctgtgccctgtctcttgaggagccaatatagggctctcttcccggggagttctcaaggccagtgatccctggcattcccttccaaccttcttggaatttccagctctgtttgaaacacttgttttccttgtgtagtgtcagcatttccactacagttcttttctttctgcctgtcttccttccctccttcctttctccttttttttcctttaatgcctggcctaacaattcccacattcccgacatgcctgtggttcaggttttgtgtttccttataatcatctggaaaggaagatctgtgcccggtgaaaggaactgtggcaagtaggtctgtagaaatttcagagaaagctatgagaggcggcttctgtggccggtgattagatctcattgctgtgtgcggcttttgtccctgtcatcttctccatgctgagaatggagcagggtggtttggaatcttcacctgtcccagttgcttcagctgtggggactcctcagtaattcaggttcttctgaagcagtgtctcctgtgggcagaacgttccaagctcaacagaatgctttgccctgttt

SEQ ID NO: 28347 - DNA, 1102 bp, Mus musculus
aagggcttggtcccacgggatgtacttggtgagaataacagaacaatcacaagctcctgggctgtctcccaagcaaccatgagcaagaaagtcctttcacacggaggctacagaacggagtttgatttcttatcactgaaggcagattcctaaagaagacccacacttaccattttcagtaaaacacttaaatgtttgcatttttggcagaagaggcaggattttaattggctgtgtagtaagcaaagtaatgatagttctccagggaaaaatgatctgtgtgtgacttcaggttcaagaataaaatgagaagaagaaaaaaataaaggtatatgctcatagaagtgaatgattggcagccttgaaacagaacccgctttgaagagtatgcaacgggctacagcctcgtcatactctgcagcctggtttgagctcaatgaagtcactcagggaaggcagaacacccaaagcagccacagatgatcgcattcttccatcacacacagggtcctagtctgtgtgtgaccttcaggaactagacatgctcttcatttgtgtctttctcatccatctccaagggcttttgattctcatatctgtatttctgtataaacacactacttgtagacattggctaccaagaagactaaggcatctctgtttctattttctgcatatccacagataaacaacaaagccaacgtggtaaccagccccaaagaaaatattcctaccccggcgctggtatacctggactcttgcacccttcttaagttctgcactgtttgctgttgtttctctctttcactaaatcaatatctatgtatcaatacttcatttgttgttggttttgtttgtttgtttgtttgttttgctttcaaagatagaagaaaatctttatattgttttgttgttgttttcttttcttgagatagttgtccagcagtgtgtttctaacatgagccttctcatttcattgtggaacatcatgcttttctctgcagttggaattcttgcatgttggcttggaaacgcagtagaatgcgcttcagttactcttagctctttctggtgttgattgctactgatcgtgcaaacaatg

SEQ ID NO: 28348 - DNA, 1134 bp, Mus musculus
ttcactagctagccacgtgaggagtaatctccatcttcctagaggttgaacttgatctttgtgattcctgcagttctagcttctctcttgagtcacagtagtatccttctgccgggagttaaggcttgtctagcttaaaacaaagaggaaaaggaaatgccccagttttcttctcgtctctcgtttctcctttgtcgattcggtccctgggaggctgtttctctgcgctgaactgctttatggtgcatggaatatccatcagcgttacctccaccatagctgctcacactccttagaagccgatttttaaagcagaagcaaaaaaagcaaaaacttaaacacccccttctctttttcctcatttcaccttttggtgttgattgctaatcactttagatatattgttgctagtgaatgtatgatagatggttgaagcttttctgataattatcacatgatttaaaacaatatatatttaaaacgaatatatacagtaaatgtattgagccgtgtaacctgccaatgagatctgtgaaaaagtaatggcctcacttttcccttttggatttcttttacctttctgtgaagcagctctgcgtggcatacatgtatttaaaaacacaaatagtggtaggatggtttggtttttttgtttttttgtttttttttttttacacttttaacttagcatgtggtgttgaagaattaccatagatccagtttgtcttctgcactaagatgtgaggaaatcgtgatttgttctctccagcacagtgaaattacaccttcatcatcttctattgtttggaaaacactgcagtttaccatgggacactgtatatatttcttgccgtaatggtaaatgactgattgatatatttaagagttaataaatttgtgatttctgctgacaatgtgtccatttttatttcttaagaaatactctatgtgtggtgccggccactgccaaggacatgatgtcctgccctggtctccttcaataaacaacttgcagtctgtgatcatggcaagctgtttgttctcgctgcacgcagtggagctgtctgtcgttccacagaaaacttagctgaaaggaaaattagcggctgagtatcctaaaagcttgtagatgca

SEQ ID NO: 28349 - DNA, 1103 bp, Mus musculus
gggggcagatgcggatgcagcattggaaccggagtatagaccagtgtcacctttgccagaaataggacataaacaaactgaagttgaagcttctctaagtaccagctctaggatctctgacgacattgctgacatgggttctaaaagcaatgctgatagagaagatctgaaaactgttcataaagctgtgcaaccatttttggaggtttcttttaatctgagcaactttgagaccagtgacactgatgaggcgtcacaagaagacagcagactttcccaggattcagagcggtgggagaaggaagctgtgcttacagatgattcttgtgttcagaagagctgtgaggatataggctgccgagaaattgtaggaaaattgccactcctgtcatctaccgatgacgagcctaaagaggccctccctgctgatgggactctgttgtcagagttctgtgatagaacctgtgtgggtttcaattcaggacctcatggagatgtaaaaactggcaaagcactagagggacagtgtcatagtgacacagggagcagtttggactcgtcgctggagtggagtgaggatgtagcaggggacagcagagaagatgctagtcaatctatccaaggcaatgcaattaattgtggtggtgtttcaccctcaaagaaacccagaggtgtaaacagaagcttatacagtccttatcttctaaccgcagtcactgacccagcgcctgagaacagtgacctgctctcagaaggtacccagctttttattttgcaaagtcacagagacagaaatgatgagcaggtcttatcaccaatctctagcagtgacattagtggccagctcttgagtaccactcaggatcactttgagtgtcatgaactagaagaatccagcactcaaatttctagtcctttattttatcctatgggaatcaaacatcctatttatagagacagcgaagcatatatttctgagtctaaagaattaggaaggattagaagtttgccgtgtgatcattttgaagtggaaactacacagagaaaccagcaatcctgggctacttctaaaagttcttcagaactttctgaagtaataaata

SEQ ID NO: 28350 - DNA, 1191 bp, Mus musculus
ctagtgtcctccgctgtgggaaaaagaaggtctggttggatcccaatgagaccaatgaaatcgccaatgccaactttcatcagcagatcaggaagctgatcaaagatgggctgatcatccgcaagcctgtgactgtccattcccgggctcattgccggaaaaaaaccctggcccgacggaagggcaggcatatgggcatagggaagagggagggtactgccaatgctcggatgcctgagaaggtgacctggatgagaaggatgaggatcctgcgccagcttctcaggagataccgggaatccaagattgaccgccgtatgtatcacagcctgtacctgaaggtcaaagggaatgtgttaaaaaacaagcggatcctcatggagcacatccataaactgaaggcggacaaggcccacaagaagctcctggctgaccaggctgaggctcgcaggtctaagaccaaggaagcacgaaagcgccgggaggagcacctccaggccaagaaggaagagatcatcaagactctgtccaaggaggaggagaccaagaaataaagcttccctcatgtctgtacatagcggcctggctgtggcctcatgtggatcagtctttaaaataaaacaagcctttgtccattaaaaaaaaaaagagtcacagcattaggaaggttgagaaccactggtcaagagagctggtgaacccagaagatctccccatggatggactaggctgccagcatctcatggacgaggaggatgcccaacggctgagaactgttgctgaggtcatggcaagataagtgaagtaaaagggaaacatacctttaaaaacttaagtttcaaaagttatgcacttgctaggcaaatgacagtcaagtctttcagtctcctttcaatccattcataaaaaaatgagcagtgactggggctctagagcagtgctgcctgacttctatagaccctgcggatgtgatgaaatgacatcagatcagagttctgcctcggaaggtctagggttggtgctgcttactggaggagccagggaccatctgatatcacgtgcccactgtgcctccagggaccagctgacatcatgtgcttgctgtgcccccagggaccagctgacattatgtccctactgtgccccttgctgtgtaactggtaacagcctggaacggaagatgcagactcc

SEQ ID NO: 28351 - DNA, 1898 bp, Mus musculus
gtcagtacccctggcttagctggcaagtcttttaatacaactttttattcttactggggtttctttcaatgttcttgaaatgctaggaatgaacaggatgctgcccatgagggagcgctccaagacagaggaagacatcctgcgggcagcactgaagtacagcagcaagaagggcagcaaccccacgtccgcctcggatgactccaacgggctggagtgggagaacgactttgtcagtgccgagatggacgacaacggcaactctgagtactccgggtttgtgaaccctgtgttagaactgtcggattctgccatcaagcagtctgatacagaccagcagatccgatagggtgaaaccgtgaccttacttaccaaatgtttaaaaaccaactagaatgtacaggtggcatgccaaggctttttgttaaggcagcaaaaaaccatgtgacaaatgcttgttttcctaggagcaggagtggagggacagctgagcgcttcagtcaggtgtgatcttaacatctgccttcttcgtcccaggactgactcagtgaatctgacatatcacacattcatgcctttctgctcacctcgtcaagttctgcatcttaagtctgtattggttttactctgattgctttatagaactaaatctgaaagtattttttgttacttctcagcatatgtgcaggcagcatgaggagggatgggcgggttccccgggaaggcagaccattcccagcagcgtctccctggttacttttacctttcatgtctacttggcggcagtaattggagatggcccaagcattgtgctgatgtgcgggcttccttacacacacacacacacacacacacacatgcacacatcctaagtcctgcttcactcaatctgagcaagagatgacaggattaaagatgcttccaaagtttggatactttgagttggtaataattaaaactaatacataaaaatgcatatttaaaatttttacttcctttcacatgccattatattggctttgaatttagattttaagttttcactttcttttttaaaaattctatatttccagtgaatgatctttgaaagatttttacacagaacatattctgtgaatgatttaagaaaacactaaaatacgggtatttcaaagtacacacactcctttctgatttgaaaggtcccgttggctgtaccgccctttcctttgccttgtagtgcaaggcgctctgtggctggaacaaattatgttagcgtattgacgacctgtgtctgagtcttagagaaggccagggctgggaaatgtgtcctgactgcagtctttggctgggctgaggactgactgtcactttggcaagcacactgtattctgtctcccttgctgttcctctctcttcggcagcgatggtgcatgctttcaacagtccaggacggtccaggtagaaatagtagagttcttgctgtccgtgaaaacttatgtgggtggccctttcgatatctgaactgctatacaatgacatctgtaattttgtcatttttaaatctcatacaaataaatatactttgatatgtaaatatgcattaggttatgctattatttatatctatctcaagatttaaattgtaggtgtgtcatggaaataatttaaaggtactctatattcacattgcctgtgttaatgctttttaaggtttatattacatcagatgtatatttttggtttggcataagctactgttgtaattttcttggctttttgttcataaagaattttctgaaggaatggtaacttctcaaggattgtgaataaacatttttacatttaatgatatttgcatcatggcttcataatggtccaggtggtatgagtcttggtgttaattatttccttaaatc

SEQ ID NO: 28352 - DNA, 1145 bp, Mus musculus
gctctcattttctataatcaaagtaagccaattctgtcacacagaaattatattaaatttcttgagtttgttgagagaaatagaagaaatatcaatatttcttcattttaattaaaaaaaatgactaggttggattttgctgtcgttattggaactcattattcatactcccccaaaattatttttaatttcgcagaaatatttagaaagtgctaattttaatttcagagtacatgtcagatagttaattcaaaccttgcctattacctaagttttcacacttaaaatataacttctgtattgaatcagaacaaaaaaaaaacccttcaattacaaaaaaatactttataatcataccagttagtaaatggctgcttactttatgcctgaattttagcagattccaaatccacgcttattgcaacccagaagagatgccatgggtcacaggaaatattcccccaccccctgtgtagaccctggaagccatgctaatgtgaagcccagctcctgctaatgtctggtgctctgctgcacagtgtgagcccaggcacgcctgttggtgtggcagcccacggtcgtgcacaagtacttacagccgcagtgacatggtgctaagcatgttttaagactagtcccaatcgagcagcatcttatccaaccagaaacaagcccacaatccagctctttttaagtgatcatccttgtatcataacagattaaagccgcagctactctggattatgtttaatctaacctttatccatccacatcttcacctgaaacttacaaggaccaagagtcaattgccggggcataattcacaatgacactgatcttcccttccccgctctaattatctggattaagaataacacttttgagtaattattttcacattggataaacattaagctttcctggatttatctgagctttttcctaacatgaaatagatccagccaggcttataggaacataactgacaggagggacagcttaatcaaggcaaccctaaacaactaaaacaataaggaaatgttgatttctcattgtgtgggaaactcgggatcgggaagttagcaggttttgtggtactaagccccccaaccttccacagccaattgcagagcttggatgggttt

SEQ ID NO: 28353 - DNA, 1161 bp, Mus musculus
agagggggtgcttgctggctaaacctatacctctcagtcttagactttcttgcttctttaccctaaccctctgattccaagtctcctctcccccaccttatagtcctaaccaaaagccgaatagcctttggctgggcaggagcagaattcccaggagcgcgcctgtgtagaccgggtgggcacagcaaggaattagttgggcctcgcactgctgataggtgcagacagaaccatccctctgccgcggctcggggcctcgtgattggtgtggagccacgtcactccgacccgaagaagggtctgggaggaggcggaggcggggagagctggggagggccgccgcagagtgacgtcttgccaccaggaagcccgcctctggttttaagatgttaggccaacagggaagcgcggagccgcagatcttgccggtctctcgctggggtgtctggaactgagctgcggcagggtctggctccagctcgactgcccgagggggtgtgcgtgcgagccgcggagggtgtgctcggaggcccgcgccgtggctgtggccgtggccgtggcggctgcagccgcctcggggaatctaatatcagctacctgtccctgtcactcttgacacttcgctgtcagggctgcagcgcggggggcgggcaaagcgctctcgtagctgtccttattggaggggtatcaaggggagggagggaggcaagaaaagggtctttgcccattcttgtttcgctttggatcgtggaagtcggctccctaaagaggctcgcagcggttccctcctgcccacgtccccacgtctgcgttggcccccctgcctttcggctgccgaactctttttggctggagtctgaagctagaggagacagggctggaggattcggcagtttgcgttccctggctctttcaagtctcggctaacacggggacacttggcgcctagagcgctaccgagaaccggcggccaccggggctccactggcggtagccctggactcatagggctccgcactccctcgtccatgaactgcatgaaaggcccgctgcccttggagcaccgagcagccgggactaagctgtcggccgcctcctcacccttctgtcaccatccccaggcgttagccatggcttcggtcctagctcctggccagcccc

SEQ ID NO: 28354 - DNA, 1150 bp, Mus musculus
tctctggggtagctatcacccatgggttgatttctgcacggaaggagagggagggagggaaaaaagaggacactttgatggaatcctttcctgttcttccggatgaagaggcaggactttcacgggagtcccttcgcactgaagcctgcgtttgctggaccgcctgtctcccaagcagctggcttcacctcgctgcgtgcgggcacgggggagggggaggagaagtcttcggacagaggtggggatcctgcaggctgtcctcaggacacggctttgcctgccagagcccaaggctacagatctctttgaaaataaagtaatatcaaacaaaagaaagtgaaataaagtctctccgcgggctctgggccccaggtgagtcttcattcccagggcttcaccagccgcagcccctggggtccctgcttaaatccagaaatggaggcagttgatcttatctgacgaggtagtgttttatctgtttcaaaagggtggatcccggctgcgactgctgggccgcccttccagactccagcttccccgtccggaggttcccaagcttcgatccccttctccagcatagctgatctggtttgccagttaccaaacaccaggtcccgggtagctgggaaggaccttttggaccttggagttccgttccacccggcccacagagcttagcttctcggattgtccagataccgcggctccacctgagcgtgccctcaagccagcagctcctcctagggccgctagacctggtggctcggtacagcccagctctgtgactgcccaccgatccccgaagccgcttcacctgaatatcctgacttttttgttttaccgtttttggtttttgtctggaggttaatgggcggtggtaatgggtcggagctctcttcaatctaaccgtacttttctgatacagtagaagaatatggaagcccgcgggacacctacgcaagtccagggtctcagcatggtttttccgtgtctcacaaacaacataatctatcctaatcagcagctggacaaacccccctgcttcctgccagcgcctgcagccagtagccccgaatacggagtccaacacccttgggcggggcagtttggatggacgcagggcccagcagtgaagttgcgcggaacctag

SEQ ID NO: 28355 - DNA, 1212 bp, Mus musculus
ccccgtgtgggaggcgatccggtgtcaccttgcagtattttaagaagggagctccctccttcccgtagaccgtgctgtggttggagatgtttccctccggtttagtgcgagccccctcgatctccccacccccaccccaccccctctgcgccgcggccggccctcggggggcttccgggctccgggaggttccgctgccgcgtgcgagggcgctcgcgacctgccttccctccctccattcatcaatgggaaaccggagacgccggcgctcccgggctggagcgggtggtggcagccgccgggggttcgccttctccagcccgatcccgggcttgctgctcccgccccttctcgcccgcggggagcgcgcccacccttggccttcagcttgcgagctgggcccttgggcggtttacggcggcggccgggcggagccgagactccggggcgcgcgagttcgggccgcggcatggcggctgcctggaggccctgagccccagagccagcctggtgcggtcgccggcgtgctcctggacaccgaggacgcgggcctgggtcccgagcgcgattacacccccggggagtctggatcgccccgtaagggggaggccatagggaggcccgagcgctgcaggaagcccagccccctcgggctggcgttcggggggtcctagcggtgcacttcctcccgttaggggcttgggggggagggggggctgtgacccgagctcaacctgccaacctagggctccgatcttctctgagaccatttgtcaccgtcccttgcagggctctagcctgccttcctgccttcctcctccagtagcccgcagctcgcgtctctagcttgctgcatcccggttgggcctgtcattccggagcaggcattcctagcctctgcaggcgcatggcactcagtctgccctgctgctgcaccaccctagtgcatgctgtttgttgcccaccccaccccacccccttttcctaaggtaccccaggaccatttcccgcctctttctccagacactcagttaagtgactttcactctgtcagaactagacaggtccttggtcctcgtgggactgaaaatatcccaaatccatgaatttcttttcccttgttattctttggccactattaactcctgaacagtacttatgttcttcctgacaatgtattttcattatcttattttccttatttcttatttt

SEQ ID NO: 28356 - DNA, 1131 bp, Mus musculus
gctctaatgaaacagagagacgggagtgtatctcaccgtggatttcaggaagtcaccagtaggtgcaaggtgagacctgcctcaggactgagtttactctgtggaaggagctgagtttcttcccggtttgcagtctattctgtctgggtgtgttgtaacagatcttgcgttgcttttaggtagttaacagggtaacagctccatatgtcccgtatgtcttgttgatgtgcgatccctgggaagtttgcagtgcagccgtcctttgagacagacagagttagacgttatgtcttcattggtctctggccagaccatgaggagcttgcaagctgccttctttcaattaccttaaattactgtttgtttttttctttatgttaacatgacatgcattgcttaggttttcctgggctttcagctggcctaacccactcagtacatatacccaactttctaaaataaaaacttccaaatttatatctgtgactatactgttttactctggaattacagagctagatagacaacctttttttttttctgttttagtgcaaggggtactaagttttaaactggttgaacagagatgtgcgttattccagatgagtatttttacattaatttattttaatattacgtgttttgtctgtacgaatgtctgtgcaacatgtgtgtgccaggtgccctcagaccagtgagatcctttggaactgggattacccatagctggttgtaggttgagtgctggggatcctgcctggatcctctgctagagcagccaattccatctccccccccccccccccgacctattttcaccgatagatgggcgttttctgcaatgcaccaagttctaagagaagtcagagaacatgaagtatggacgtgacactggcatgaggtgacctgtggcgtgaggtgaggtgacctgtgaagggtatacctaatgacacaaccagagcccttaatcactgagccgccaatcattgtgcggtctcccggactaagcccttagagcatttaaataggattaactgctaccatttagtgcattttgcttgttatgaataggcctggaaacaagaactttataatacattttagaaaatttggaaaatacaattaaggaaa

SEQ ID NO: 28357 - DNA, 4982 bp, Mus musculus
gttttgttttgtttttctctaaggataaaggagtttccccttttcaaacgatgtgagcacacacacacacacacacacacacacacacacacacacacacgcaatcttttcaacacgaaaccagagctaaaagaaaagataaacatgggagagacagggtttctatctgggacagcaatgcttttgcaaaaggctaggccttttaaagaaaggtgagcttgtaactccttgataaaagatgtcttaattatttttactgcaactgaaagtaaagaggtagagcctttccccttctgcacagcctcagggcttgtatgttcgctacaaccaaacacaggacagtacttcccccatgatactttattactgggagaaagaaacccctgtagttgaaacaccacactgacaactgttatttctgctctccgacgagaattcaagcatccgttgttcagttgccccaaactttaggacggaggagtaaatgcagaactgaaagggaagaagctcagctggctggcttgaaaatggagtcttgtaccatgtgtaacaaatgccagcccatcgtccctggagctgaacagggaggaagggctatgggcagagactagagccggattcatccaatgtgcagacagcgtgttcgcctccctccctgttcgacctcacacataatcctggctttctaaatgaggccctgtgacacactctgtgctttctatatttttgtgactttcaaacacagatctgcagggctctgcctgatttggggtaaacactgtgtttctgcagcctctgcatttgctcccttcagcagtgcagaggcttgagaagtgccctctgctggcttagtgagaagcttcaacaaacacttcacagtaggttgaaataactgaccactaagggcctgcggagattaaaccctaagttctaagtgctgtcaaacacctgacatatatttgaccaaatcagaagagagagagaacctctatgcttcaagtaagcgtcataaattttttaagtgactttcacttgagaactcagaaagtcaatgtattaagagccatattctgaaagaaagaaagagaaagaaagaaagaaagaaagaaagaaagaaagaaagaaagaaagaaagaaagaaagaaagaaaaagaaagaaagaaagaagcaagctagacaatgttaactgtaatatttcagtcctctacaagccaaataaatgtgtcgatgttcctaatatttcaaagacgcaattacataaagttgttcaatgtgatataatagtattctaattggttaagtagtttaatgattaggcaaactagcagaaacaattagaggctgctacaccacgtagattatacacacatagccacgtacgtgaggtacacggagctataaagctcaaatcaatagtaacacgatttttggctagcagaaactatcacctatcttcctttacttgagagtgtacagtaaaagggattttttttcaaattatttttatattattttagctttaattgtgctgtcattcatggaacagctgctcagcagccttcctgtgagagatgacaggggtgttttcgtgtggcttgtttacgtgtggaattggaaaagaataaaatctgattcccttctgtgggaatgggatcaagggtagacaaaggacccatgtagatcaagtcataactgaacgaccagggaagggagccaggcgggggcgggagtcagctgtggctttcatgttaccattgtgtggtggctgatggacgggacgtggttggagggatgttttcttacttggggtagaagttaaccggagatgaaagtctagaagccactctgtccagtggaatcttagggtgtacttgttcctttgagctttgtaaatgcacaatagtgtacaataataagcctttcccttgccttatggaagaaagtgagcaagataatgaaaaccaagaagccacctatcagttgaattgagtctaatcaaaaggccagcctgaggctcctctggtcggttcagtttaatttagatatttaccatagaatacaggtacaatatggaaatctcataagcataaactttaaaacgactaagctatgcttccaaagcactttagtctcagtgttcttcgcttcatgctctctccacttgtaaaataacttagacttttcattcgcaggatgagtatataataattaagtttccaaaccagctaaactgtagctacaggcaattccagtgttcaccatgggaagaaaaagccacatgtttttttaaaaacacagaattctgatataggctcagcacacagtttttaacatatcagcttagctgctctaattgtatcaagatacgaggctggaccactggcctatgacacatctaaaacctgccagaattgactgccacgtagataatactgctgtcagtgaacattccgggcaagcaagtttttgtagctgccccactatgctgcaatagattatctttctattgaagatttctcgctgcattccaatcccagtgtggtgaaaacttaattcctggattgaatgaacacaaatccaaggtttcatataaacgcagtgcggtcactaggtctgagcatcaactcaaatgtgttgagtttgcaatgaaattctagtgagaatcactccattcacacagtaggagatttttatctggaccttctagtgtcaactgtgaggagaaacaacaactatcattattatttatttattgtatttatatccaatgccaggccaaagtattgatttagatcaagcagtgcccttccccccctcccaaccccccatctttctaatccttctgcactatagaaagtcaagactggaggggaaatccatattcattgctgcaggggaaagcaggtttattaatcctcccgctgtctttatgagaccgattgaccaatgtagctcaggcagaagtttcatgtgggtgggatatctacaggagcctaggaaaacacttccagagaagataaccacagactgttgtttttgttcatttgttttatatcttcatggtaagataagcctgtcacggagttacaaggcaccatgacactaaggtagaatgttccagaagtctggctaccttcccaggctgctcagttacctgggagtgtctagttactatcttgttctgacgagaggagcttttgctcaagaactgccagatacagacaccaagtcagccctggcacactctacaacctccgggcataggtaatgggtctttgactattggattgcctcagtgtcaagtgagttcctagaagaagagaccgagtaggctccaccccccagactccaccacactctgagttgcattggcaggatcggtgtctagacacagttctttgtgaagtgtcaatgctagagacagttgtgaggagatcatgatgacagcccagaactttctagccttcaaatgcatccttttccagtctttgttttgataacagctattttgctatcagtttgggacaacagtagagtctgtggccatgtgatctacagcttatgatcacacagctcccatttcctggtgcctgagatcccagccatcagaaagtgatttgggtgagaattcacaacatatatgtcacctctgcatattgaagtgacatctaataaaacaaggacgtcctattttgtctgaacccgctgaatgaagctctgttatcctagttagtcattgggccgccatcctctgtacccgatagtgacacaaaacagatgtcggtgcctgtacaagaattctcagtgcctgttgtgacagactgtgcttagaagaaacattcgtgagccataaagcaggaaccacagatgaaagggccagttaaaagtccacctgctccaagtatcatagaaaacccaaaagcctgttgtataatctggtattgtccccatccccagatgctttgaaaactaggattctcagagcatggatacccacgcttccatcttcccacaaacatttcctagagttgtactggtgggtgcagcgcctaggtggttggttgggggaagtcttggaagctgtactttgattgcaggtcaagcaaagccaaatccagatatttctgtgtcactcaccagttgtccatgtccacccacaaaacaattgtattatagtcaagttgtcctagctgattggtcctcaaataaggatgcaactatgtttgcaacccagttaggacacatttgaaagaacctgactcactagcatctaaacaatatcatttccccaatgcttggtggcacttcagacttttgttctcctggttgatcaaggtgttgcctggtggtgccgcctcctagtgtgaatatttcagttaagtgtgggtctgagcatgaccgggctgggcttagctcactgctacttggaaaatgactggcattctgcttcctaggccctaaacccatattcagagggaaaattcactatcaagcctcacagcgaaatcacagcagtgttggaattcttattttcaagtgcttatctcacaacattgaaaaatatttttggtgtattaagatttaaaataaagtcatcataacttttgatttaaaactgtttctagttctttgttgttttctggtctggagcggtccaaagaggacactgtaggccatccagaattctctggaaagtcattcctatatccatgtgctgatagaatacacgagtggctaagattgctcttgctttctctggcgacccaccaatgacatacaaggactatgaacatgtgggtgtcaattccacaaggtacctagctcctccagaacgcctttcatggttacagcatcttacagatgacactgttcacattgccttttggctcttcatgaagtctttctgagataaatgaaatagactccagttaaaaccgctgtggtggaggcaaatatagagataacatccccttagacattgc

SEQ ID NO: 28358 - DNA, 1824 bp, Mus musculus
actgagccatatcttgagccctgatgttaatgaaaaccaagggtgcagcctcactctgcagcaacagattacttcctgccatgtaagcatggtggttgtcagacatctttattgtcattgcatctttaagctaaaaggaaacttaacactgatgacacaatttgtgtttcataaagattatgtatctataaaaaattatttgaatagtcaaaactgagtgcatgcacgtacacacacatgcacacacacacacattgacctgctgcatgtttttgtgcctgctgccatatgtgtggccgtgtgctctggcaggtgatagaggagggagctgagtgatgcctgacacctgcccagtggtgacgacacatctttactctgcagcatgtgagacaacggtggagctcctctttgacagcgtcatccatttaggctgcaagccatacctggacagccagcgggctgcatgctggtgtcgttatgaagaaaaaacagatctataaagaccctgactgctggagagcaggcgagaatggaggaccatccttgccaaagatccgatgctttaacagcctaatgttgccttagttttgtgttgacgggtcattttgagacctttctatactgtgtctttttttagaacctcaaagtgaaaatggtggggggccaggcagaaacagagagcatgcttgggatggggagcgagcaggacatccaagagcatgccttcctgagactcgctgtcgtggtggctcccccaaactgggaagaaaagcttaagcccgtgtgacttggtgttcatagttgtacttaacaataaaaatgaaagcaaatgtaaaattcattgtaaggacttttcagcattattttattttgaaatacaggccaatcttcccttagaactattatttattttgaaatttcagatgtacatttatacctggaaaaactattaattctccatttttattatacataacgtgttgtttctctgaagcccactaagataggtataaatatgttactcacaactacaaggtttccaagtgtgcatctcttgtacagttggaatcacggttgatacttctctggagagacgccccaggacatctgagtgttgggatgtgcacagaattcagaagcccagcttcctcaaaccgcttagagcaaatgtccttcctctcctgctgtgagctctaggaatgacgggtttaacgggccaagccgagctctgaatctgtgcgctatctgctgctgaggttgtggttactccctcatccccgttttccatcttctatcctggagtagtgttaaaagtctgacattttctaatggaggtcttaataaacgctatttacttcttagtaatctcctgagagtgttttcaagtctttaattgtggaattgaagaagattcgaaaggtgaagtagaaagaaccgtcttttatggctctctcacttacactgagaattaacaagtgtgaaaacaaatcccagaaaaccgtggcaatctcttaaaacgatggacttggaaatgtttgatggtcagagtgctcgcctgcattggccactgactggtgatttccccatcccagacactaagctctgctgacctttgaagtaatgcatacagggtaagctgcctggagtgtcagaaaggagcatggaggcaagaggctctttgtcagttatcacaggtggcactgggcagaaggaagcgcgtgctgtgggaagggctgtgctcttggccttgacaacggaatctcttctcttgaaggtgagatgaaggcactctaatgacacttgtgtctccatcagacaagaaca

SEQ ID NO: 28359 - DNA, 1173 bp, Mus musculus
caaataagtaaataaatgtccgtggcaatggtggagacctttaaccccagcccctgagaggtggaaacaggcagacctgcaagctcagtgcaagcccagtcgctatagtgagtttcaggccagctagagctatacactaagactgtttcaaaaacaactacaaaaaaatacttctggaaatcttatttttaaaaaatgtaagttattgacatgaattaaatgataattcaacagttccaagatggggcctaaagagatagggtggctgagaactcgctgctcttccagaggacccaggttgatctcagcacccacacagcagctcacaaccatctgtaactccagttccaagggatccagcgccctctcctggcctcagtgtactgcacgcacatggtgcacacatgtgcatgcagggaaaatgcccatacacatacgtaaatcctttttttcctgctaggcacaaggaggaaacttttcctttttaaattaatttattgattttatgttgtgagtgttttgtctctgtgtatggctacctatgggtaagtctgcctggtgcccacagagaccagaacagggtgttggatcacctaggacttgtgtgctagacaattgtaaactgccaaatggctgctgggaattgaatctgggtcccctggaagagccagtgctcttaaccactgagccatctctccagcctccacctcacccccgccccaaataagtaaatcttttaaaatcaaagaaaaatgaaattcttggaatgtgactttttcccttaagttctgtgtggttttagggtgaggtaggagcttagtggcggccttcacttgagtattgcattagaagaaacgggaagttgtcagagtccccccagtctgtgtaggctttgctgggctgtctaacacagtacagtagtcatgtaaatagccatatacttaccaggaagcacacttctctacagctgaagttcccctcatgcggtcatgggcagagtgcaggcttgtagttggcggccctgagagacacagttccattgctaccctggtatctatgacatgggaaaggtttctaagacttttcttttttcttttttctttttcttttggtttttcgagacagggtttctctgtgtagctctggctgtcctggaactcactctgtagtcca

SEQ ID NO: 28360 - DNA, 1154 bp, Mus musculus
cttcctgttcgatccagcaaccctgtttgaaatacagttaggagtaatctttgaccacctccgtttaataactagaataaggggataaaagcaacattttggtttattgaagaaaagcaggaggaaagcacgtgacgaattgtttgagagtgacgtgacagtggggagaacaggaaagggcttagctgacgtttagctgatagtgtccttggggtaccaagtgtttgggggtaataatctctgggctctaatctctcactttacacccaacatagggaagcctcggtttcttcgttttgtgtattatatttatgtctgatctagacttgcatgtagactgtgatggtacgtctaggtataaatataggtggactacgtaggctccctttagagaacgggtgggtttgtttagttagagcatcggccagcggctcgggctgcggggagggtgttgctcgtgctgtctcaagcccatcccctttcccctcagggctctcaatgcacactttccacgggaacttctttgtccgctccaccgacttactgtctcttgccaacatcaatcctgatgctgggtttgcagtacagttgtcaatcgaagagagcctgacagatactgccttagtgtgctttcagacagccctgctgtacacatctagcaaaggtaatgttctccaaactgacatggcttgtggccatgggtcctctttccacttccgttttagtagagagaaaagcatgttgtgccgtgagggtgatggcatttgttgtaggtgactgtatgttgtttctttctcttcataactcacatttgaatccttacataatacaccttcaaaatagatttgttacttatgtatgcatgcccgagtgagtttatgtgtaccacatgcaaacagagactcaaggggggcccaaaagagagggttgcatctcctggtcctagagttgccagtgcttgtgagccagcgtatgggtgctgggagtcaccaggtcctctgcaagagctggaatcacttttaaccaccgagccacctctccagccttgtttacagcgcacttacacggatttttgttatgtttagttactctgtgtggtgtactcaggagcaggaatgccacagtgtgcacgtggaggtcagaaggcaacttgc

SEQ ID NO: 28361 - DNA, 1162 bp, Mus musculus
ggtgtgatggcactggagcgtgtgtggacatcagagccattgcatttggttagtaagcttgttttaacatgtttctagtttgttgctgtggtgaatgatttcctgtcttcaggtgcagattctctgtcttgttctatttcagaaaatgtccaacctcccaagtcaagctccgtagtatccacagttttgccaggaccctcatcaacaagaatgccacctgctccaagtcacccagttgggcctgtgccctctgctccaccccccccagagcagatgcagactaaaggtatgtgagtagctgctcattttatgcatatgcacactcatgtctcagtagctgatttaaaaatgccagtgtataaccataactaactgaaaacatggaaaaagtaatttataattcagacttaataatgacagctttagtcttgcatgttaatttataatttttattgttgattggatacaatctgtgatgttaaatttcctttcttaaaccattatagacttttttttaggctaaatcaaccatcatcgtgttatttagtgaatctttgtgtcttgtttgaagatttctgtgcttgtcatttgttgtcatccgcgacttggagggggttggggatgagcgatgtcatgggattgtaacttctacgtgtatcatcgacataccgtgcggttaatttagtacccttgaataagtcagtgacagatctgacatagactggtttgatcctgttttctccattatcctgtctttcagaagttttcttggttactttctatatggcaaaaattctaaaatcttgatgtttctggctaatctgttttcatttatcagactttgtatttccaactcactggaactgttttaaggatcatacttcatgtgcgtgacagcctctagccttgactgtgaaagctcttctagtacgttcttaatctcagaagaggccctggaaatccttaggccgctgtcactgcctctggttgttgagtgtttatgtggtcacttggttggagtgttgtaagttttcttatttgatttgaaaagaatcaatgctaaactatttatcagttccccaaagccagtgaaactaggaatagaatctagttcttctaagtgttggcttccagagggaacagtggtcggaagacttttctt

SEQ ID NO: 28362 - DNA, 1273 bp, Mus musculus
ttttctgcccttctgtgtctaattgtatgttagtttgcattgctttgtgatgttttgggaggaaggagaccaggaagcctggttatgtgttatcacgaaccaggggtgatgctgaggaagagctgtgacgtcatcagattcatagtcgccaggcactcttgaatggctgcttcctggtcgccttttctgatatgaattctctttctgcaggggctacctgatgggctagtgtcttttgagaggaaatcagtggatcccggatttgctcctgttaatgaagttttaaaggctgacccactccctcctgcaatgtggaaaagaaagaagagcagtgtaaacgctgcactgagcgacaccctagcaagcacagcagagctaggaccggaagtcacgggatcagagacaagttcattacagtatttcccttgatgacctaccccagtgtaccagctatgttaaacggcattttttcttagttttttatttcttaaagaaaatatactcctcctaaaactttggtattgaataaagtgattattttttacaaacccatcatcagcttttggacatgatatttctgattttcagaaattaacgcaaattgagaagtatattgtgagagctgagatatttggacgattggccagttcctgcagtggtgctttaaatggtgtgtgtgctactctgcaatttcagatgcatacgggagacttgtttcctgaacaacatgatgtatgaaaggagcagaaataaatgatttttctaattaacattttagagtgtggactttttgttgttttgtttctgagacaggctctcacaggccctgtctggtctggaatttgctatatagaccaggctggcctcaaactcttaagagatccacctgcctctgctttctgagtgcagggatcaagtatgccaccagaaccagcctaactgaattaacttgatctgtacgtcggtaagttccatcttgcgttgttcctcgggcacaaccagcatcttcaactacatcgttaggtgtcaggtccacaagtgccctcttctccctctcagatgggcagactcagcctggactgcagtcagagcaaagccagcattccgcaggaagtcgggaagcctgtcgccatcggccaggaggagccacttccctacactgacaaacctgttgctgcatagccaagcctgcgcccgactccagactccctcagccccacccctgacctggtgtcctgctccctactctactctcttctctgtctccattttc

SEQ ID NO: 28363 - DNA, 1169 bp, Mus musculus
tccccagcctgagttcctagtatctttatgtggtagcgaagaaagagggaaagggttctacctatttgtttatggtttaattttccccatcttatgtttaatacaaaaattttttgttagtgaaagctaaaattctgtatttgtttttctgactcaataggtaacaccctggagaaacaagtcctctgcttaatttgcccgcagtcaggtaaataagggcacaactactctaatcacatctgctggtcctccatgatgttagcccattaggaccacagcacagtcagctgtcatgatggaggaggctggtggacagccctacccatgaagtgcagtttggaggagcagcatgtccctcaatgaaaagagtgccatgtccacaatgaaaggagacaatgaacgggaccatggaggaaagcactcggtggaggaccaataggaaaacatcgagtgtccatggaaggagatccgatgatggtgggttatccagtgaggtctgtggcctgggaggaaggtttgatgacctccattaacgcccagtctggaggtataaacattcctgcttagagaaaagtaggacactgataggccaggtaggaaaagaaagggatgatgggacttccggctataggacccaggaggaggaagcagtccgatccgcggatttgcttcaagcccctcgtccacctgaaggtgtcaaagaacatccattgtgtttctgactttccaaagatgcaaaagtcgtgggcttccgcagagagagtagcaaggccaaagtggttagcctcaccaaacgtatcacaagtcactggttgcacgagatccacagaggatccagagacctttcctcccaactgtttagatttagccagtgaggttgaagaatgaggtggagccggggagtggtaaagcatgaaataaccaaccatgactaaccgctgcgttcagcctcagtgaattcactctgcaaacagagctgtcatccagacatggctggtgcaagccttccaaatgtgctacatgtcacaacacagggctgcaaatccccgctttgtctccaaggtcataatcaactgtatcgggatgcaccctttggtatggttggttgacgtggaatggtagcctccggtgatgttagttttgatgaaagtcgaagagagtacacgagt

SEQ ID NO: 28364 - DNA, 1134 bp, Mus musculus
acaactggggcgcctggcagaagttcacggctagtgcgggcatccaggtggtgggtgatgacctcacagtgaccaaccctaagcggattgccaaggccgagagcgagaagttctgcaactgcctcctgcacaaagtgaaccagatcggctccgtgaccgagtccctgcaggcgtgtaagctggcccaatccaatggctggggcgtcatggtgtcccaccgatctggggaaactgaggacactttcatcgcagacctggtggtggggctctgcactgggtagatcaagactggtgccccttgccgatctgagcgcctggccaagtacagtcagatccttagaatcgaggaagagctgggcagcaaagccgagtttgctggcaggtccttcaggaaccccctggccaaataaagcatggactggagatccctggagccaccagctgcgaggtcctctgtccctgatgtcatccaggcagctcaaggccagcccagtgcgtgcccctcccatgtcactgcttccttaggcatccacacctgaccaccagaatccctgctggagacccaatttgcaatcatgtgattggtctgaatcattgtttctgtcacctgacttcccagctagtgtctggagccctcggaactccagtgtaatctctagggtgcccaccatcaagaaccccccctcccccagtggtttacatgcaaaaataaaagccgcagaagtcaaaaaaaaaaaaaaaaaaaagatgttgggggaaagaaggaaacagggcaagtgggtgggttttactgcccgtgccagtgcccaggttatgggcatggggactagggtgggtctaaacagagagtgcacgctagtctcagttccagagaatggtgtcaatcacctaaacacttgatccccaggtgagcggaggcaggcgatgcctcacagggccaactggagctggaagagaatccactgataaagaaatgtctacgcagagcaaggtcattagcgtggataattaccatacccactcggcttttatttgcgtccatgcagtatcttcagaaaaggaattttaaagcagttgaacttccaggcattcctcccgtgcacattttaaaactgcctgaggtttctatctttt

SEQ ID NO: 28365 - DNA, 1160 bp, Mus musculus
agtttgcctacctacgtttgacctggaggaagcttttgttttaaagtgcttctgtccataaaagcagactcaccagatgaaattgtcgttactagtatgtgtgtgtggggggggggggcagtgagtgtgtgtttgtgcaaaatactgtttctagctcttaactgtgtcttgcacagctacacttaaaacttagaatgatcaattagggcagagaattcagaaggctgaagctgccaatacaaatagtttagactacagcactgtaaattggctcgagtaagcatttatttggcagaataaatctaaatggccttatctgaatttgacttaagaggtcctgaagtcccactctgccaattccagatcccaagcccacttcccttaggttgaattggcagaaagcaaagcagagagattaattactcccctatcaagctaggcagtaaaattcttactgccagttcagataactctccagactcccaaatgtgttttaaggcttgacttaaacagatagcgtgggtctttgttctttagcctttagactgcttgactttgcaggatggggagcaaaaaaaaaaaaaaaaaaaaaaaaaaaaatctgtcctctatacaacttctactcctagggcaaactctgccttgcacacctgtagtgggcaccccgctagtcttccgggcttccactctgctgggttccacgcttgtccctccacgcttcacaataaagccctttgtttcatgctccccagtgctaggcttcccaagtgttatgttaactagttcgtggatgcctctaaatactgttgtccggaaccacgggttctccagctgtgcagagcacgcgtgcacgtcaccagctacacgtctgacctgctcctgcaacctctggggagaagcttgcagctgggtagatacttcaggccttcctctccagtttcatccagcctcctgttctgatgacatcttcggccttgtctaaaaaaacagccacaccaacctgccttcacccagattacaattccggtgactttatattcttttatgagccgtatccagtagttctcaaccttcctaatgctgcaacccttaaatacagttccttctgcctccagccataaaaccacttgtgttgctacttcagaactgtaactttgcta

SEQ ID NO: 28366 - DNA, 1551 bp, Mus musculus
acctaggacttagcttggatgtggaaaactcttttcagtttctgtttgtgctcttaggtctttgccttggtttgcagggagtcctgtgtgacagggagccctccagtggagctaggcttctagtagcaagcctgctatagagtcaatgttggctgtacccgtgcagcctgcctggtgcctctgccatgttggcctgcatggattctgtgccccaggcatgccctgagaagatcagaacctaagtgaacctgtgccctttctctcaacagggtggcatgaaatggagccagagaaccccttatttcagcccagtccttccatgaataatctggtggcccagaagaagctgggcaagaagaccggagaaggattttacaaatacaagtgacacttcccccagcaacacctccagccagccatgggacaaggatgagcaagccctgggcaggtggtaccgaggcttgccaggggcggctcagtgggccctcccttgcagtctctctgaagtaatcttttgactagttgcagtcatggggttcttccactgaaatggaattctctagtttagtctgttctctgactttttctgaaaaaaaattacacccttggtgccttggagcaacatctttttttttttttttcctgaaccttgccactttttgtaaaaagcgttgcttagactcattccctcaggtcttctgaaaatgagtattctatgtttatcggtgttgaaccccaggggcaggagccacggggcctacagatgcacccaagggcagcagccagtaggacgtgaggtcttgcctgcctgggaacatttgcagcctgcagcctcgagccttagcctacattctgggcctgacaggaaatgttctgtctttctttaccccacaccaggactcctggagtggtgggcaaatacctgtgagcttgttttttgggggaaaggcctatctttgaggccattcagatcttaaccatcactgtccgtccttcttgtttcttccggtgaaatctgtgctaccaagtgcctatgaattgactctactaaaatgaaatcttttaatttgtaaacattggaatcggaataaataaacttatataacttaaaagcataaaatccttaagtaattataaacatgggcctgtcttctctgaactctggctggtactgaagtgacagcacgggagggagagaaaggtggggggcgtgtgtgtgtgtgtgtgtgtgtgtgtgtgtgtgtgtgtgtgtgtgtgtgtgtgagagagagacagatctgtgtttggcccttccacgttccttaccagtaaaatagtcataagggcacaaagagcggtttttaagaacatctgtttcttctttgccaacaaagtcaaacaacgtaacataagattcttttaatcattgggttgacagagtgtcttccatgatagaatgtggaattggaaagacatctgaagccctgatgtccagtggcttcattagcagagagcttaagggatgagtccaaggtcatcagatattcagtaccaggttccggattagatcta

SEQ ID NO: 28367 - DNA, 1142 bp, Mus musculus
gctggttttgtttgtttttgttttggagattcagtataatactgaagtcaaacttcagaatactttagaaagcaaacgagcgacatcaaccacaacggtgagatgtcacgatgacctatttgtcaagctccggacagtgcagtgctcgtgagcacagaaaggctgtgaggtcaggctaactagctgggcatctctgccctgtggagatagtggcaggccctgtcttaggtatgctgaagtgaagggccatttggaccctgttgccacggtggccagtttgtgtgtcgtgcggttgggttagcttaaaggtacccagagatgtcccaagggtggctccggggagcctggcagtgccactccttggtggagtgcgtaagactggagcgactcctgacagggaagaggagggcaggagagggaagatgccttacaagacagagtaaagagacttcagaacacatttcagagatggggatgacagaagcggggccgcggaatccggggtaagaaggagaggttcataccgaacaaaaggtagagctcagtgaagccccttactgtctttctctgccctgcaacaggacactcctggattcatcgtgaaccgactcttggtgccatacctcattgaggccgtcaggctacacgagcgaggtacctgtcccaggccaggcgaaggcctgcagctcttgggctatgcacaggaggtgtgggctgtgcagagcctgggaaggggcttctgccttctagctctgaaggactaagctcagctttgccctggctttaggaatttttatcactgggttcccagggtcccagacctccctgtgagcctctgacacagtccagcagcaacttcatcgatgatgcagatcttcacccctgcacttctgccattagttaacagtttactatggggagggtggatggggaggtgactcggctgttgagatgtgcactgctcttccatagggcccaggattgcttcccagggttcatgttgggcagctctcagcttatgcacacacatacaagatgcatgttacacacacacacacacacacacacacacacacacacacactactaatagtaagtgtttcttgcttttgaaatagatagtaatggaaaagttaccagga

SEQ ID NO: 28368 - DNA, 1198 bp, Mus musculus
agacagcaggaagagggagccacgaggcgtggcttgaccatttgaaacctcagagccccctcctcccagtgagctttgacacaccttttcctctaaggccacacctccaataatccactctctttgagtgtataggggctgtttgcattcaaacctctgccattctggatcctgagaggggcaggagcaaaagggacctcaggctgcggtaggcacaatgagaacagactctctggaggcagctttcgtgagacagctcatttaatgtggggaacaaaggctacttaaacctttggacagtgggtagccgcttttggggtgggcctgggccagaactctagagatgtctcttttaaataaggaggaattccaggtgccattggacgtgaccttataaggcaagaggcagttcaacctggctactgggctgtgtgacctccaccagggggcaaactgtgagggcacagggctatgtgcacggggacagacacaggcaggacagagaggaggagatttccaggcttggactcgcctcaaccccactcttgctctgggccggctcaccacagctccatggctccctggaccccccagcctccgtcacctctttgcagaactactgggtttcatcctgtgttccttgtgcacatgaggggtataactgcccatgtccagtgtcacacctgtgtgtttcctgcagtcattgtgggacacggggaaagtcttttttttttaaaaacagatttatttatttattatatgtaagtacactgtagctgtcctcagacactccaggagagagcatcagatctcgttacggatggttgtgagccaccatgtggttgctgggattttgaactcaggacctttggaagagcagtcggtgctcttaaccgctgagccatctcaccagccccgggggaaagtcttaaataaatgcctgctggggagttcagagcggaccagacagaaggcaaagcgcctttgtgccattttgaacacttttctgttttcaattttatttgggtttaattggaacccgcttgagggcattcagtgaacaccaggcttcctgggaaggacagcaggaaaggcagccatagcagggtcatggaggagttgccaggcttgtaaaatggtacataggtaacactgtagggtcacactctaggaccgcctcttagtgtttgactcttag

SEQ ID NO: 28369 - DNA, 1222 bp, Mus musculus
acctaagagaaaagaagagagaagggcagccaggtaggcctgagagtcatggctgctcctttccgtccatttcctctctgtgacaaatagtgcgcccgccatgctgcgcaggatgtccctgctgggaaggatgttgtaaaacattaattgatctcaataatttcagtttctgtttgtccgtttttcctagctctaaagctgaagaattgtgcggtggtttagctcagtgacacattagacctaagcgatgctttttctcactggtctagtcacccaacatgaactgaagggacaaattccccttgtggtttcctgttagctttgtaaaatagtgaagtaactggcctttttctctttcagccacgaagacttcgagtttatttcaggaacgaggatgcgcaagctggcacgcgaaggccagaaacctccagagggcttcatggcccccaaggcctggactgtgctggtagagtactacaagtccttagagaaagcctaactgctgagctgggcactctgcctgggacgcatggctgagtaacagaggggaccacgcagccaccgacagcccttctctgcggttgtctgactggacacacttcctgaaatcaggccgtttccctccgcgtgcattggttttggtctgtctttcagttctgtttcaaactagtgtaacaccacgctggctctaatgtatcttttccacttattgttaatattcttataatacgattttaaaaatctcgcctttttatattgtatttatgcttctgtcttacaatttttccaagctgatttattagttataaccagtaatacacacatcatctagcttttcattctttaagtaagggggaaaaaatcactaaacaataaagttggctagaccttgtttggggaattttacaaattttataaactatctgtagcaattagggtttttattttacattaaaaatgtaaactgctccccctctcccttgcagccctacgtgttgaggttctcttgcaatctgtgttaagtactgaatgaatgccttgattcaataaaattaattttttgacttatttatggtttgtgtgcatatgcccccttggttgtgaaaaaatttcaatgcgaagaattcctggcagaggtggattatgaaagcatctttaacttctgggtctggtacccagctcccagtaccttgatgtttgctgaagttctgtgtagcaagaa

SEQ ID NO: 28370 - DNA, 1150 bp, Mus musculus
gcatcctgcccttccctctccttgtaatccactaaggctttaaagttttccagccttaaatctggttaaatagcatttattttctgcacttaagaacaaagtagattttctcttccaaacagatacagaaatttgttcttttaacatttctgcccaacttgcttttctttatcttctttttgtgtgtgtatgtgtggttgtgtgcatgtgggtgcttgctatcaggtaaggtagtgctggcctgctttctaagggtatctcctgtctcctttcaagatggcagtcatgctacaaggcatatacataggttatgtgacaagcaactcacccactgaaccatctcctcagacgctgcttgcttctctgttctctaatgaaaagcatttaaggtattgctcagttgtaggagaaagggttttttcctcaggttgctttctcagcatcctgtaaaaagctcgttttctttccgtttccatagtaaggtcattactttcctttatatttaggtttctctgccgattctggggaaagatggcaacgaatgatgctgttctgaagaggctggagcagaagggtgcagaggcggatcagatcatcgaatatctcaagcagcaggttgctcttcttaaggagaaagcaagtaaggatgtttaaacggtctaaggaaatactgaccggaaaatgtttactgtataaattataacttgattattttaattatggcttttagattcccttaattttgagtataaaaatattctaggattatgataacttagaattgatctatagtgaatgttgtatttgcgttttgatacgataaaataccaaaaacaacttgaagaggaatgggtttatttcaatttatagcatagtctatgttatgggaaatcaaagcaggaacttggagacgggaactaaagcataggccatggaggagcgctggttgctggcttgcttaggtgctttctcttttttttttttttttattattatgctatttactaaacatagacaaagcaacccagtaaggaaagtggtcccaaatgcaggaaagaaactcaaagacagcttctgctcccatttttaggagctatacaaatgtattttgttccaatttctttttttttttttttttttttttctttcc

SEQ ID NO: 28371 - DNA, 1197 bp, Mus musculus
tagaacttaatgataaagtataattcaactatttcagcaactcaatcaatttatgttgtcttagccagaatagtgttatctagttttttattacaagtatactattaaataatttttcatgcatttactcaagattatttttaaatcataaaatatttaatgtttaagtaaacttatattaaactaacaaaaattacttaccatgagcctttatgactttggaattttctacttcagctctctgaacctgtggagttctcaaacttagtggcaagggacagaggagggtacacaacgaaaaaccccaaactatcctgaggtcaaggtcacttattatttcaaagaaagaaacaccaaataccaaggtggtcaacctgaagtttcttttagtgggattgctcagagtgctgcagcagagagtgagaagttctaggtgctcaggttagacgcttcctgctctgtgttctgattgccagcagcctggcgcttagcagacagtgaaaagctcagctctaaacagcagcaacagcaggaggaggaggaggaggagaaagaaggggggggggggttgcggagctcctggctggacctcatatgttggactctgaagctcctctcatgaataacgttggagctcttggcctaggtgtagggatcagttacagatctccagtgcctagcaaggcttggctgctctctcagttggttctactagccactggggccacactcttgtttgtggtccttcatagccttccctgtattccatctctgccacctttgtcccctgatgtctctgcctcagcagctctctgggtctctttagtcttcctcttggtgctgctgcttttatttggtctgttagctctctcatccccatgttcccagctcaatttgcttatagcaatcaaaagtaggcaaagtaaaaaccaaaagcaaagaaacaaaattgagataagccttttgttgggcttaatgttgcgttactaggagccaggcaggaggtgtccatcccctagctgattccagagctgagccaagctgacttaccaccagaatcagtgtgatatggcaaaggtgtttgtattactcaaggtacagtcctttatgcaaataaaagattgtacttctcgcaattacaggcctttttgctaggccactagcaaagctgcttccttctgaagtggctgaaaatag

SEQ ID NO: 28372 - DNA, 1106 bp, Mus musculus
tttgtttctgtgtccttgagtttgacctattcagaaaaccattcaagggaagcaaggacctgcagttaatatataaaacccctatgcttccggttatactttaaactgacagccttcaccactgttacatgcctccaccagtaagaagctttgtaaagattctgggggggggagcggaggaccagaggacagcccataagacaggtgctttaaatcagcaaggtttccacgagtgcagctaatgtgttacctgaggctgggctaggaagcaggcctgtgcacagaggtgacgctgccgatgatggagcaacactagcactgtcgaggaggacaagattggaattttaatatcgacagagccccaacttcgtctcctccctgtcagaccgctgttttaaaaaaacacatagctttagagagtcaacttttctccttagcatttctcacccttctgattaagtaatcaaaatattttctgctgtttttgccaggagacacaaagatgattaaagggttggaaaaaaagatctatggtgacaaactaaaggaactgggagtgttctgcctggagaagagaagactgaggggcaggccgtgggggctcctccaggctgcgaagggttggcaccaagagcttggggagcggctgttctccatgtgtcctgagaataggaccagagggaacaggcttaggctagagtgtgagggggactttcctggcagggacagttgctaagcccaatcctttacaaaaaagaagtgtgatcatattcattctcctcctactccctccttccctccctcccttccttccttctttcctccctcccttccttctttcctcccccccttacttctaccttcatctctctctctccctttctgttctcttctcttcctctctatcttctttgtcccttccctccattaaaaaaaaaaaaaaaactacataaaatgttaggtatttaaggtgtacgtacttcaaggtaaagtccctgatcatggacactagaagacactttggtctccaaagtagtccatgataatgaccatcttcagaactgagcagtttggactgagctccaaggtagactttctgctcttgg

SEQ ID NO: 28373 - DNA, 1148 bp, Mus musculus
tagcagttactcaacgaccccagagatgtgacagcaatattgggtcatgttttgagtgtgatgtacctctgtgcactatcttgaagggacaataaaaatctctcagatcagtgaccctcaagaggcctttatttactgagttgaaaccgtataagtatggcaggagcagtacaccatcaaatgtggcctgtctctcttgttcctggtccatacagagatcagagaacccacgtaagcctccctgattacctggagtatatttcctccaggctccatgcactatctcctgttgacagtttggaagattactacaagataaaaacagatcagtctcttcagtcaggcagatgcctcaattcactgagtagcatagtttatgcatgcagtttttgcccatccctgaaagccacgttacaatggaataagttattactaggcaggccagtttacacaaaaatggggaaccaattttgcatagtttttaaaatagccatgcgctttctgattacttatatatatcaatgaagctctttgcatacttgcatgagtatgtggcattgtagatacaaaaaacatggtgtgttctatttctatattagaagttactaataggacttccaactgtgtatccaaaaaaaaaaaaagcagaacaaaatccccttgtctgtcttgataagagcaggttgttaagttcgtattccggagcctagtgttcaagaccagtcggggtttgtatttagctgggtgcgacggtgccagaaggaatggggctgatgttatgaatccttctctatctttcttttcattctcagcatcactggttagaagtgagctgtaactctccattcccagcaggaacacagacaggtgtttttgtttttgtttttgtttttgtttttgtttttgtttttgttttgacaagctcccctaagtagcatcctaatggctccactcagtgacttctgtttatattagaaattagctagaattgggtcctttggttactcctatctgccaaggagaatagaaagtataattttccattgtaaacttaccgtgcatattttatatgaagtaaaagcagaaagacattctgtagtaaggcaacaaggaaatggaaaggcagggagccaaagcatgctgctggc

SEQ ID NO: 28374 - DNA, 1195 bp, Mus musculus
aatacagtccccacttacagatgcgaagctacagtaaactgtgttgctgctgcccaaataacactaaaatttagtaacgtagggaaaggaagtctaatagcattacaatgttttggaagaatagttcatttccataagctacttaaattcatacagaactttctctgaaagttacttttagtaatcatactcgttcttgatgatcatggctaattccatgatctcactgtgttcatgaaatgctaaaggtgggggaagaaggttcaggaaaagaaactgcaataacctaataacctccagttactgaagcctttgcttaaaaggcttggaatttggaataatttgataaaaaaaaaatatgtaaaatgaatctattaagaatttctcatttctgagacacatttagatctctgtttctggcatatggttacttcagataatttactgttttccagcattgtttttacgattctgtgaatattagcagatcatactatatcaagtaaattccgaattgttgattgtacctatgtaataactggcgaggactagagattgtggagtgtctcttgacacggctcatgttctggaaatacttaattgtagtgcttgctctacagttaaagtaagtttatgtattttttcaaataaatggtctcctttaattgtaggtctcccttccttctgtacagcttatattactagcaatagtaagtaaaccattaaaccaaaatagctctacatatgtagggtccatgttggatggttagttggttgttggttctttggtttttgagatggtgtctcactatatagcactgactaacatgaagtcactatgtagaccaggctggcctcaaacttgccagaattaaaggcctgtactgtaccacttaacctttaaactcttgctatgttagttggtttttgtttgtgtgtgtgcaggcctgtatatgagtgcacatgtttgtttccaggcgtagaaatgattgctactacttgagcttctgtgtgcgcctgtgaaccctttgttacgtgtaaaggcttcattctgtcctgctgcacttaggtatccagttactctgaacttctcaatgccgtccacagtggtaccatgaaaacagcctgaatgtgattcttctatgtgttggtagttcctcagtaggctcaaatgcaaatatttttgcttgtacat

SEQ ID NO: 28375 - DNA, 1100 bp, Mus musculus
agtgccaaggttgctcattgtaagcgtatccctaaaagtatgtaaccatgcagagtggggaaagtttcctcttgaaagccattgttcagcctagaagtaaaaattcttacatataaattcttattgattttttttttttgaaaaacactcatctcttagcttctaaattgttgcgcttgaaggcctataaccatattgatctttgttctaggtgacccaatgacaacagaagatgaaaggcattaagaaaagtcctacggaggaatctctgtacctggagtactctcaccaaacagaaggctgcatctttcctctccacacgtctgtaactttgtttttactatcatactgtgaatgcaaggtctttaacgtttgcttagtcctcactgaagaaagtacagatacttcagacacttcgttcctaaaagaggcactgccccaggacctggaaatacaggttatttcaaagcaggcgctccctccgattgtccagaattgctgtttgcctgcagtggtagatcaacctgacgttttctgtagggcaggccttgctgttgtcctgagacacataatccaaaaatcctatgaagctgagccctcaagaaaggaaattttggaacttctgggttttaaaaagacttgtttgaaagcttgtgctgaagtaagtataaggtctcttcctctatttaaagtagaagtaataacagttactccaacatgagtttaagttgccattggcaattattggatagttgagttcttttcatggcatcattacagggcaatccgaaaaagagtttaacatgtgctttatgaagtctggaaacatattttaaaataataataataataacaaaggttttcctccttcattatttttaggacctttaaaagaaatgttcataaatgagtagtaaggccttgtaagccctgaggagtgtttaaaggccttggggatgtcttgatggcatggtgctgaaacagtagccgaaagctcctatcttgagacataaccatgaggcagagaacttacagggaatagcttgagtcctttggaatctcaaaactgtcacagtgccacacctccaccaacaaggcca

SEQ ID NO: 28376 - DNA, 3040 bp, Mus musculus
agccaaaatggctgaaaaggcccggaaagaggaagagtgcggaaagaatggatcagaccacgtgtctcagaaaaatcatggcaaacaggaaaagcgtgagcccacagggccacaggaacccagttacctgcgtttcatccagtctcttgctgagaacacagggtctgtgactacggattctaccgtgactacatcaccatatgctttcactcaggtcacagggccttacaacacatttgtatgacgctggccattaggccagaccaccaaggacgacctgtgagcagtatgtctttcatggcatgggccgtagggacaggtcacagcatctgtgacaaatgcagtgtgtgtttgtgtgtatgtttattgggggggggctgtcagctcaccagcaaaatagtttattttatcattatatttaatctctcccgtggtccatggtggcattcaggaagagcatcctatgcaagggcacagtgggaaggaagcgctggacatttgtcttgaaaaccactggttctcttattggctgaggtcatgcgtgtgccatgcccctcagcactctacacgtaactgcttctagtactcagcgtgtgtaaccgtgggacacagcgctgtagtagagcagttgcaggatcatctggtgctgacgtatgatgtactgaagaaatactggaactaagactttttaacatgcaggttttttactgtaatcttaataacttatttatcaaagtagctacagaaagcttaagtgaataatggcaaaacactgaatctgtttgggtgttaacattaaatggtgctacaaatggtgtttttaatagctgaaaaatcaatgccttctatcatctagccagtgtggtcgagggccctggaggcactggggtacctctgattttacatttctatcttaattattcagcttagtttttaaaatgtggacatttcaaaggcctctggattgtagttatccaccgatgtccttgtaggactataatgtatagatatgcacacttacacatgtgtactgaaatattttaagttgtgtcttagaaaagcactttgcctacctaagctttggcaacttgggcaatgctaaggtactaaaacataaaaacaaaacaaaaaaaagtttactttcatttaggattaaaagtggttttgttttgtttccttttaaggaaacatttgctttgctcttagccactatcggctgatgagcagtatcaggcctgttacaatccaaaccgaagctgaatggatatgctagtccacagaaaacaaataacagtttttggtgctcaccttacttgctatcctgtaaaacggtggtagggcaagctcatccctcctgcgtatacagcttaagaacgtctgttaattgcaggtgataattagccttggtgctgcagacagagcaaagcttgcccacttaagtccatgttgtcccacacacagacctgtatgttcttcagaacagcaggctgcctttgtgttcattacatgctttgtggtgtcttttcttagctaagtgttatatataccaggaaggttgagtggactgaaacccgcagaagttgagaagacatggttaagtccataggactctactggttacagagcaaccaacaaaaaccgaaagagaataggcagctggtttatggtgattttaaacattaatttgtattaaaaggtaaaaaagagttgtatagtaaattaaattgtaaaacaaccttttttaatgcaatgctttagtattttagtactgtaaaaaattaaatatatacatatgtgtatatatatattatatatatatatataatatatgagattgaagaaaaattcacatcacgatggtgctacccagattgctccacatagatcttaatgtgagctaagaatccattcaaagttggagtggtgttcctacttgtcgtcatacctcaacactagctaggcaatgggatactgagctaacagtggaggcttagagcattgtagaccaccatttttctttttttttttttttttaaatctttgtattaagacataccatttttaaatacttgatttcttagcaagtataacttgaatctcaaactttttgttctaaaaattcagggatatttcagctcattctccttatgctaacatgtcatctgtttatgcaaagttgtcggttaatatattcgctttcagaggattgcaatccctcgtagtttgcttgtatatgtactgataactgaaaactaattttataaattttgtcacctttcaattgtaaattttggagagttggcattcagcagagtaaaaagtgtaaaataggaagccctgagctggcagagggagatggggggtacaagacatcgccggtaatggcttctgatctagtgacgaggacagctttggactgcagctggacagtcctagaagctggtggtgtgctgtgcaataggactgttgttacattgtggcctaaatacagtgttgcttactagctttgcaaatagctttgcgtcagtggagacctttgtaatttaccatcagtcacatttgtcactaaaaactttcagaatgtctgccttgcacacacacacacacacacacacacacacaaaaacaaaaaccacaaggtttccaaaccatgatgttgagtccacatcaggttcctgcaaggtgtgcttggcaattttttttttttttttttgagccagccatccctaaggaatatttgctttacatgtcacccactgtcatttgtcaaactgctggccaacaggagtagtaagtgtggtttgagaggatgggtggtgtagggaggaaggcagtgacatcccacctctgtccattagatcaagtgggaggcagatctgtgatttgcttctataggaacagcttgactacatagccatactcgatacaagtgcttctgcttggtgtcaacattacttgaatgaatttttcatcttgattgacgcacagtgatgtatagttcactttacaaggtagtttggttaacttgttagggtttttt

SEQ ID NO: 28377 - DNA, 1206 bp, Mus musculus
atttgtagtgccacttaagccgcttaaagaaagccttcagctaagaccttgcatgtctttcctgtagttcttactataggaggttacatttaactgtccactgtaccaggtatggtctgctaaaccattgatgagtaattttgtacccttccttctttccttccttcctctctctctctctctctctctctctctctctctctctctctctctctcttctttcttctttttcctttctttcttttccttccttccttccttccttccttctttccttcctttcttcctttctttctttctttctttctttctttctttctttatttctctctctctttttcttttttcttctttctttcttctttttttcacagttggttaggttcccactctatagctgggcaataaaagaggaattgcagttggtaattttgatccagatatgaaagctatgcatatgcccgtattggctccgattgacccttgttctgtttgggtgggtggggctgtttgggtggattgttgatccacacaggtatatcggagatcgagtgaggaggagaaactactgtgtttggtacgagtgcgacctaatcacacatgtgagacggcggtgatggtaattgccatcatgttgtgggacggaatcccaaagctactcgcatcagaactctactcagaacttacagatatcttgggcaagtgtggcatatgcaccaaccgtcgctgttctcagaatgaaacgtaagtgggtttagacctttcccgttctccagaggggcttgaatttgtatattgataaagcaggggtcacgtgtttatttcatagtcaggactgtgaatgcttattaaggtccacttcaaccatagggagtcatgttccggagccatttctggtaagatctaggtggatttggttttaccatttctattctagttcttatgccaacttggaaactccatactaatgtggctaccattttagtaagataccattttgggattcgagtcattgactttttttaagatttattcatttatcttatgtatatgagtacactgtagctgtacaaatggttgtgagccatcatgtggttgctgggaattgaattcaggacttcagctcactctggccctgcttgctcggcccaaagatttattattatatctaagtacactgttgctgtcttcagacacatcagaaga

SEQ ID NO: 28378 - DNA, 1161 bp, Mus musculus
cagtatttcccgaataatgtgaccccaaatcaggacgttcaccggtgctttcaggaacaagcgcagaagcctcagcaagcttcgtctctacaggggcttaaggacagaagccagggtgagtctccagccccaccagctgaggcagctcaacagaggtatttggtgcataatgaagcaaaggcactccctgtgcctgagcaaggaggaagtcagacacagacccctcctcagaaggacactcagaagcacgctgccttaaggtggcttctcttacagaagcaagaacagcagcaaacacagcaatcccagcctggtcataaccagatgcttaggccaatcaagactgagcctgtatccaaaccttcttcctatagataccccttgtcaccgccacaagaaaatatgtccagcaggataaagcaagagatctcctctccaagccgtgacaatgggcagccaaagagcatcattgagaccatggaacagcacctgaagcagtttcagctcaagtcactctgtgactataaggctctgactctcaagtcacagaaacacgtgaaagtgccaacagatatccaggctgcagaatcggagaaccacgcccgagctgcagagcctcaagcaaccaaaagcacagattgttctgttctcgacgatgtttcagaatcagatactcctggtgaacaaagtcagaatggcaaatgtgaaggatgcaatccaggtacatgccagtaacatacatggtgtttgccagagttagctagtcatcttcatgtgtgttgcttctttcttaagctggagtctgggatccatttttctttttttttttttaatcttttaatctttttacagtccagtcatcaccctacaaaagtacactcccatctaactccacacaccaccaggcctccccacccccctgaggaatcaagtcattcaaggcctcagaaggcagccaggcaaggttcctgtctgtaagcactccatagcatcagggaggtcttggagcctcccattgatatggatcacaatttgggcctgtcattggatctcctttacctcaggttcttctccattcctgtctctgcagtcctttgagacaggaacaattctgtgtcagagttttttgacagggatggcaaccccatccctccacttgct

SEQ ID NO: 28379 - DNA, 1147 bp, Mus musculus
ggcaaagctcgaagttccctaaagattccatctctcccactactgtgaccccaccgtcacaatcacttcttgctccccgtcttgttcttcagcctcctttagaaggaaaaggcgctctaaatgatgtagctttggaagaacaccatgactaccccaaccgaagcaaccgaactcttttaagggaagggaaaatagaccatcaacccaagacatcatctagccagagtctgaatccatctgtacatacacccaacccccccttgatgcttccagaacagcatcagaatgattgtggctcaccgagccctgaaaagtcaagaaaaatgtcagaatatctcatgtattacctgccaaatcatggccacagtggaggtttacaagaacatagccaatacctgatggggcacagggagcaagagattccgaaggatgcaaacgggaaacaaacgcaaggctctgtacaggcagcacctggctggatagaactgaaagccccgaatttgcatgaagcactccatcagacaaaacgcaaggatatatccttgcactcagtcctccactctcagaccggccctgtcaatcagatgagctccaaacagtccactggcaatgtcaacatgccaggaggattccaaaggctaccttacctccagaaaacagcccagccagagcagaaggcacaaatgtaccaagtgcaagtgaaccaaggaccgtctccaggtatgggggaccaacatcttcagttccagaaagctttataccaggagtgcatccccaggacagatccgtcatctgaggctcacccgcaagcaccgagcgttcctcagtatcatttccagcaaagagtaaatccctccagtgataagcatttgagtcaacaggccacagagactcaacggttatcaggctttttacaacatactcctcagacgcaggcatcacaaacaccagcatcccagaactcaaatttccctcaaatctgccagcagcagcagcagcagcagttacagaggaagaataaagagcaaatgcctcagactttctctcatctccaaggtagcaatgataagcaaagagaaggctcgtgctttggccagattaaagtggaagaaagcttttgtgtcggaaatcagtactccaaatcaag

SEQ ID NO: 28380 - DNA, 1235 bp, Mus musculus
acatggtggcttatgttgggaatcccagtactcaggaggctgaagaagggcgatcaaggcaagcctgacccgcatagtaagttccaggccagcctgggatatagaatgaggcagtgccttaaaataaaataataaagaatttcaatagaaagatgttattcacagtgtacattacttgtatgtatgtatagtttgagtgactggcttttagagatttctttttctttgttaaaggcctgctttggctggagacatggcttggtggatgaaatgcttactgcacaagtgggaggactccccaaatccatataaaagctagaagcttcctggaattccagcaccggagacgcagggatcctcagggcaagctggctagctagatttgcagagctgctggttcagtgggagatcctgcttcactgcatggagagcaatgaaggttgatgtgtatatacacacacacacacatacacacacacacacacacacacacacacacacgcacgtgcacacacacctcccatacataagaaaaaggaagaaaggaaagaaaatgcacttgtaaggtttgaaataggctctgacacaataacatggttgatcctagtagaggctctgggactctgccacctacctacaggagacactgtgttgaacctaaatgagtccaaaggccttcagtagatcatagctttttaatttactattttaattttaccttttagaaaatatagcagaaaatctgttttaaaacgctggtttgatcatagctttttaacttatttaaaattttatctcctagaaaatctgtttttaaaacagcgaataactaataagaataaaattagagtagatttcaattcaaggagaaaaatctgtctaggaactacattagtttcagaacaattgcacgttatagaatacagttgctagtagttccgttgttagccgtgtaagttgtgtgctgagacattgtttggggcatggaaaactggaacctcatagctctctttgacagtttgccagctggaatcccagccaaccagataacaagctgtagcaacactcggccctctaggactcctgaacctgtgccaggccttagagggaagactctttgaacacgctcttccgtccatctgagagtagagggcaccagagccccatggtgtacaaagaagtattccacctcaagaagtttacaattggaggcctggtaatatttagtatagttt

SEQ ID NO: 28381 - DNA, 1185 bp, Mus musculus
ttgctatatgttacttattgattttgtgtattgaactatcttagttggagttttactgctgtgaacagacaccaagaccaaggcaattcttataaggacaacattcaattggggctggctttcagattcagagatttagtccagtattgtcaaggtgggaacatggcagcatccagacaggcatggtgcaggagaagctatgtcttcatctgccagcctctaaaagaagactgactttcaggtagctaggaagtgggtcttaaaggtcacatgtcctaatagtgcctgccacttcttgggccaagaatatacaagccatcacatgaaccatccttgtgtgccttgaacataatctactattatagtgttttaaggagttttcaaatttgatttgcatgttttttttgtttgtttgtgttatgttccttaggtctataggttgtttgtgtgtttgtcttggtttttgagatagggtcttactatatggtctaggctaccttagaactcacagttgttgactctggctatcccaccaatagttttgaaagaagtgaagaacattttccttgaaagcataaatgctataaaattaaatagacttttttttctgatcagcaaagccttctgtcactgtattacactttcaactccagttatgtaaatttttgtttgtctttaactatttgggggaattccagcttcagagaatgaattgagtaattttctttctctttctattttcagagttgcttacagaacattggtattagctcttttttaaaggtctagcagaatttgatagtgcatctaaccagttctggccatttctttactgggagattattattatttttttacatatgtttaaggagtacacaaagtcctaaggtaccatttatttaaacggattcccctccatcttccccttcctcccatgcattttccctagactcctttccttttcaggttgcatgtgcctcacctcttcccctcacccatcctcagagtctccttttgttttcctttgttctcctttctaggtttgtaggctccatccacatttattcttacttacaaacataaacacattgcaagccaggattcatatatgacagaatatttatgacttcagccactgtatcatctctgcaacctgaaaaggtctcacaatataatattctcaag

SEQ ID NO: 28382 - DNA, 1105 bp, Mus musculus
gatggtgtagcctggagtggcacacacctcagctggatataagatgaaggtaaccctcactttggtgacgagaatggactcatcagtgggcatagtcaaggcagtttacttggtacttagagaaaaggtcaaatcacaaagttgagggttggtgctataacttagaaaattgtccccaatgttctgataatcctctaaaagatcctgacagtcagatacgcaaaatttatgaggacaagggaacatgatagcattaaaactatcattaccttcaagccagacctctaactatgcttgacaaggaattcctgaagcatgtgacatttgggggccagtcaaacaagaatgttacaatattttgaaaatctaaaatgggttggagaggtggctttgcaactaagagtatttatatttactgtttgtacagagagcccaggtcagctcctaacaccctggtcaaggcagcttaccacctgtagctgcagctctcagcttctgctgctctcctcagcctatggacccctgaactcagatgacacccacacatagctttatataaaatgaaataggataccatttttactaatctcagatgtgtgatggtaggattggcagtttaaccaaaatttatataatagggctgcaaagatgctcagtggctaagattcctggctgctcttctaggggacttgaggttcaccctcagcatgatactgtgactccagttctatgagatccaatgctctcttttctggcccccccatgaacaccatacacacatgtggaatgtaaatatacatataagcaaaacaccctcacacgtaattaaaaatctgagataatagaaaagggaacttatagaaaggatcgtgtttcatttgaaacccaccagatacgagctctatgcagtaggaagtcacttgggaaagcagcatctggcggggttactttcccaaggagcgccctcctttaccatctgtcatgctgtaagtcagcaagacctcaccatctcagacgccgagctagctcctaaatacaatgctcacttttggtttctctttttcctcaagtacgtgttaagctccattgcgaggataaaggaaga

SEQ ID NO: 28383 - DNA, 1128 bp, Mus musculus
cgtgcaacaaagggaaagcagatgaggttcgtagtcgtgcacattaaaccacgagttaactgactgagtatacctagtccttagctttatgcacagtatccttcctaacaccttgacagagtggggcctggagttctgaagggaaggactgctgctttaccgaacacacgagccagtcacccttctcctgaaacgctgcaccctcatgaccctgctcccgtgtgtgtgtgtgaattagggttgatttgctttctattttctttctcaaaagaaccagatgacgtagagaatgtggagcctaagacagacctctgccaagcctccttggaaaaagatgtgtcccagtgcaagacgcagtagatgcccctgtcccgtcagagcagagcgcccttggatggatgcccccgtcagccgagcgctcttggatgcctttcctcgtgtgtccacactgacaaagatgatgcaatccaacttagtttcagtctaatttccactttagaagatggaggaacaagaaacggattgattgcagtgacttagaacgctggtggcagttctttctgcttgcatctgtgacattccacacgctgaactgttaattatttatttttatacattgcgaagaataaaggtcttgaaggaaaattttaatctttccagatgggtataacatgtatacatttctttaaagttacttatatatgacttaaaaaattctggaacatagcacataagataagccttgttgtgtgacaaaacttttcctgggaagacaaaacacacttgtctgctcagcccagacagggagcccatggcagacgaaagtacaaatgacacccgtgacttcccagccacaaggttggttctggcttacagtgtcaggcgtggtagacaagccactggtacataagcaggtccatcctgctgctatggtgttattctttcttttttttttttttaatattttttattaggtattttcctcatttacatttccaatgctatccccaaaagtcccccataccctcccccccactcccctacccacccactcccctacccacccactcccactttttggccctggcattcccctgtactggggcatataaagtttgcaagtccaat

SEQ ID NO: 28384 - DNA, 1159 bp, Mus musculus
tcctgagagcaggaaagagttttctattttccttcattgcctggtgcatggggtgggggtggggtctgtcaggaagctctgtgatgaacttcttttgtagtaagtggcacactggctccaagagcatttcacagatgtccctacttcatgaatcttgctgtaaaataacatttacaattctctttccttttagtttcctgcctgtgatggatcccataataagcataatgaattgacaggcgataacgtgggtcctctcatcctgaagaagaaagaagtatagcagtggccatttgagatgaaactctgacagagtgtttccatgtgtgttgtgcatagaaaagtctttggaagttttaactctcagtactggttgaataattatttctgccagttattttcttgctacactactgcttatatttggtactttatatagtcagtcatttctatagaaatcagatggtcaagtctcattctgaaattaagtttaatgtgtctttcaacaataaagtcagcacttcagattttaattaattgggaatttaaagtttgactgtgggccaaaagttatttctttgtatatcagtatttcaacagaatacatagttttaaaaaaattatcctttgttctgttaaatgtatctttatattgtcttgttttgctcatttgaagtcatttgccatttttttggccttttgtggaactctgctgcttttagaagaattatgaaaaataattgccatcaacaatattttgaggcagtaaaaccccttgttttatagagactttcatcttattaccatgattatcccaatttctaaaaagtaaatcagatataaaaatttccaattagaaacaattattttcatcataaaaatggttcaccttacaaaagccttgttgtgtgtgtgagggtgtgagggtgtatatgtgtgtgtgagtatgtgtgtgtgtgtgagagagagagagtatgtgtgtgtgtgtgtggtgcttaacttggagactgctgggtggcaagagcactcatgaactagagtttgaagatcagttagatattaaataactgaatttgcattaaaatgatgcatagttcattgctcaaaattatgttttatcttttctgttgtaaattatagagaaacggcaacaggatat

SEQ ID NO: 28385 - DNA, 2962 bp, Mus musculus
cttatttgtttgtttacaggtacaacagaatatctcgggaatggactcagaagtatgccatgtgatgctaccttacagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacacgagaacagttgcccaagattcagaaatttttttaaaaactggagcatgtgtattatgtggccaatgtcttcactctaacttggttatgagactaaaccaatcctcactgctctaacatgctgaagaagccatctgagggggagggagatggatgctcagctgtcacatcaaaggaagcagcattattctagcagcatccgttcttgtttaaaccttccactgttagaggtttgaggttacatgatatactttatgctcataactgatgtggctggagaattggtattgaattatagcatcagcagaacagaaaatgtgatgtattttatgcatgtcaataaaggaatgacctgttcttgttctacagagaatggaaattggaagtcaaacaccctttgtattccaaaatagggtctcaaaacattttgtaattttcatttaaattgttaggaggcttggagctattagttaatctatcttccaatactgtttaatatagcactgaataaatgatgcgagttgtcaatggatgagtgatcaactaatagctctcctagtaattgatttatttttcttcaataaagttgcataaaccaatgagttagctgcctggattaatcagtatgggaaacaatcctttgtaaatgcaaagctgtttttgtatatactgttgggatttgcttcattgtttgacatcaaatgatgatgtaaagttcaaaagagtgaatatattgccatgttcagttaaaatgcacagtctgttacaggttgacacattgcttgacctgatttatgcagaattaataagctattcaaatagtgtagctttaatacgctgcacatgattctggcagccctagagttcataaatggacttgggactcagcagttttgaaacgtgtatatggagtttaagaaatttattttccaggtgcatccccttctaactaaaattttcttcatcttgtacacttaacagctgaaaaagatatatatatatataaaacttgggagtaataatgggtcaaaatttacaaaataaagtactgttttggtgtgggagttgtcatgaggctgtgttgaagtgacttaactgtgggatattgactatccattgagatggatttgttcagccatttacattaatgagcatttaaatgcaacagatcatttcgggtgacttaacatgaatgaataaaaaagtcaatgctattggattgtttgacaagtgctatctgtgccactaaatcttatgtagtaataagggcattaccatttttcacccaagttctgaacctgtagtttgacacctttttctagctttgatttctccattgctttcttagtcttgtatttgatttctagcacatgtgatgttcacttccatattttgcactgcttatatttacgtgcaatcttattccttgtccgcacacagatgtggaaagctagaaataaatgtaaaagcttaattttttataaacatttaaatatgtaatttggacatgatttgttacttaaggttctttaaactggaagtgaagtgcatgccttctgaagatgttctggctttattctgtaataagtatttacattggaaaataccaatttcgctatacagttttttttccacacacccattttaccttttgcttaaattgtgggttcttcagggttaatgtcacgctaattaataaaacttttgggttcaaatcaagtgttcccacaagggtaagaacagtattctttgactcttaaaaagtcctttctgagacctgtactcaaaacagctttattaggcctgtgtcgtgaaagccagatatgacaaacatttttacaaagcagtggatctctagttggctttcaaattcctcccatctaccacctttggtatttacagagatgacgtccttaaaccattgtcagaattaatgggtatgtccagttctctttatctttgacttgatgctttatacaacatttcatatgtcgcttctaagggaataagccatagaggcttctccaggtttaagagaacagagtacctggaaaaccaacattctgaatgtatagacactggactggacttgaggtcacctatgatgaggtttttaaaagaatctaagaatttgctctctacccttcccagtagtgtgtggcatcactagtgctgggtataggactaaagtgagtattaggttgaatattgttgtagagtatttgtgtgtcctatacctcttaatgcataaattcctaaatttaaacatgtctttagagtccagttggcctgtcaatggtgaatttccttttgattttttcttgggcaggtttgcaatgtgataatcagatttttttttaactgattatagattgtttccttgtgtgggtgtactcacatttaaaagtatgaaccacggttaactagtggtctcaggggtagtgaaacactcactttttatttactgggttagttgaagtattcttaagacactgatcatgctgtgttcgtgatttggggggtgggtaatactaaaattagtcatgttttgtgttcacataacaaaactgttcaatgactgttggttacacttttaagtgaatttgtctcctattttatgaggaacccaatgcaagtcactaaatgtcttaatagtgacatctgcataagacttgt

SEQ ID NO: 28386 - DNA, 1154 bp, Mus musculus
tgtgtgtctgttactgtgtatttatgtatctgcaaactcacaaatggtgcaggtgcggaggtcagagagccacctgtagaaatgggtctccttcccatgaatcccaggggtcaagctctcatggtcaggtgcagcagccagaacctttgttcactgagtcaccttgctggccctccctgttttgtttttccaagcagggtttcactcgggagatcaggtgagcctcttgctttaggctcctaagagctgggattccaggtgcttgcctgcctgcacacctggctggagtggccgtgggtgcacagattacgtgtcgaaccagcagttggggttgtttacagactgaatgtgagcggtaggacaaagaggagcctgacagggcaccaagtcacttctacccgagccagtgaccaacttgtagtcacagagaggctctgtgaccaaccttggctgtctcacagctgactctctgaggtgcctgcatagaatcaccaacccctaggtgtataggagtaaaggaacttttcctaatttttatctaaataaagaccgatggggtcggtgagctggctcagtggacttagttctctgtgggctctaggagggaacttgagctgttgggctagcacagccagcacctttgcccactgagtcatctcccagacccaatgccatcctttttgtgcctgtcttctagatcactgctttattcttcagaaacagccacaatgaacaatttcttgtgaatcttatttgtagaaagatgtaggtatataccttatacagacttgcctgtccacctacccccccacccccacaaataataacgttctatgataacgttctatgaccattattttacactaacctgtaagctgacaaaacttagaaagtttttcaggtcactgtgcatttagaaatgctagctgtcatgaccggatgctagctttgggttgagaacagctccaacaatttttatctccccagtgtttgtgatcctgagaaacaattgtcttctccatcccagcgtgggataggagcgtatgtgtggaaatggcaatatagggtcagggaagagtcaggtctgcacagatagatgatatctgtgggacgcccgacttgccagcaagtaagacgccacaacaggatccttc

SEQ ID NO: 28387 - DNA, 1104 bp, Mus musculus
tcccattggctggtgcacgaggaaagacaaagggagccatctatctgcaaacacatttcagtgggtgaagccccaccccctccagtctagcgttttgctatggcatcattagtaaactgctgtacgcgtgtatatataatattttaaagatagaatcttgccttttttactaacttttcttttttttttatttaaaaggtttatttattattattatatataagtacattgtaggtgtcttcagacacaccagaagagggtgtcagatctcaatacagatggttgtgagccaccatgtggttgctgggatttgaactcaggaccttcggaagaacagtcagtgctcttacccgctgagctatctctcctgcccccttttactaacttttcatttagcatgtatcatagtgtcttcgtacacacatatcttatcctttgcctacttctccttttctcccctgaaattccaggcacagtgttccttcagctgggactggggcccttccttcccctctcagggaatctggaaagatgttagaatcgaagcctataacattgctcatctggattacctcacgtttttgccagtatatggtaagtcaagatttgcgatttcttgaaaaaaaatttttgagtcttctttttattacaaaaagtctgtttataatttgaaatataagtatattcttcaggatcttcttaaaataatgcagaatagccaatttataaaagtctgaaatacatgcaaatggtttgtcatgaaaacttacagcataaaccaggcctgtagatagatacctgctaaagtatttattttggggggagggagggaacccaacaggaaaggaaggaaagaaggggcgtcaggcaggaatggtgcatgcctttaatcccagcacttgggaggcagaggcaagcggatttctgagttcgagcccagcctggtttaccgagtgagttccaggacagccagggctatacagagaaaccctgtctcgaaaaaccaaaaagaaagaaaggaagaaagaaagagagagggaaagaaagaaagaaagaaagaaagaaagaaagaaagaaagaaaggaaggaaggaaggaaggaagg

SEQ ID NO: 28388 - DNA, 1600 bp, Mus musculus
aacatctctcagaagggcaatgtttttgtttttgatctggaaacgtctgcggtcgctccctttgtttggttggatgtaggaagtatccccgggagatttagtgataacggcttcctcatgattcggaagaaactctcggtactgttttacccttggaagcccaccagcaagagtgagctgcagcaggccttcagcgtcacctccctgacggatacctactgaagggacatggcttgtaattcagtggacactggggacaaaggctttctaaagcatggctggagaagaaggcagcctgagataaaaccgtcaagaagtatctgctgcctggggtgctatgacttcccagtgaatactgttcatcctggtgatgtctttagacaaggtcatgcccggggattcttgaatctcccaggattgtggttttgtcccacagctaaagcacggccagaagactcataccacccaatgacctttttgggagaccactagactgtgacatgattgtgtggaaccaaatgtggaggttctgaagtaatgtaggcctttcatagcaccaggaattctacccactgtaggtgaagtgtgtggctaggattgccagaggaaatgggaactcagatcctacaatagagattgcttgatggcagccatattgattgttggtagacagctgaggggcctgaatgttgtatctgattactatctttaggtaggattccctttttcatatagtttggcaataactctctttctgaaaagaccaagagatctttgcagcctaggctgattgtgctgtcacctgtgtagtctcagactctggaggcagaggcaggaggaccacaaattcaaagttggccccgactatactgttgaatttttcacttctcctcgtcctgagtgttcttgtgagctttaggcttaccactgattctgatggactctcgaatccaaagttaggagctacatttaaactcattggctctgctgtggaagtggcaaaaaatgttaataagtagctattttgggcactggtttgtgggctttttggtatgacttttatactttttctatatactatatatatatataaataaaaacccacagattatataaattgcactgacaacttgaaagtttatttgcgctctgtttaaccatgtaataaacatttcattgcatacaaagctgcattgaacaccatgtctgcttgacaaatgagggaatttgaagactataactgaagattactggaaagcattcttaattacttagtggaatggactggtgatgagtattttatttaaaaccaagactcattaactaatggctttatttttaaccctgagaatctctaggctgaggaactctgtaaagaagataaatagtacgggctgtttagtctttttcttcagtacctgaggtggaattttcccctaatgaataaaaatcacaagggaccaatcacggggcgagtaggcgggacttccgggtctcggggagaaagaggacgagtaatggtccttttggactgcgggagcaaaggaggcagtcataatataggaagccggaggctgtccgttcgagtgaggatttataa

SEQ ID NO: 28389 - DNA, 1211 bp, Mus musculus
aagtcgttggtgttcatatcattgcgcttcgggaatcttcttttccatagtgttagagaatccttcagaattgcatggaagatgcattcttttcctgttgtaatggctccttgcttgcactagctctccggctctgtttcagtgcgttgtcctgtttttatagtccaagatggatgggacattttgttcagattttaaaggactagaaaggctatctgtgacagtgtttgcttgtaattttcatgtggattttttttcaatcttctcaacttcttaaaatctcaacgtattagtatttctaaccctgtgttgggaactctctaacaagggacagctgataggtctgtgtcattttgctgtgatttaattttctttttacaatggaagatcattttttttctggcacagaaatgtagccaacagaatattagccttaaaacaagtatctgtgtatcagctccagtgttctacttctcttacccttgggtgtgctcttctaagggtaatgattgccccctctccgcatggaacttcacatatgtaaggaaaacctaaaaccaatcctgtgagtgtttcagacgggctgttaagaaggaagagacttggagcctaacacgaggatgtctcctctgcctccatatttcagcagcatcttatccaaatgctaccaccttcctggcctggcttctcagtaggctcttttggatgcctagaggaaatgtatatttttaatattgttatacaagctgtctgatatgcctagcatgaaatctttttctaatcagttttatttcctcataaaagttaaattcgagcaattttctttttgaaatttaaagttaacagttacctttctaaaagtttaaagtgtcaagagatgaatcccatgagacagaagaaggtaatttgctacattactgaccccagtaaccacccatctgtctttcttatttggcttcaaattaggtttccaattgctttcctggtacagtgtttaggcttccgtgttatctgatcagtcataatattgagaaggtaaaatgtattctctttgaagttacagtttattaaaaattacaacctgaacttttatctcacctcaaatttacatatgcaaaataaggcttaagcttcagccgagaaagtgaattttcaaatgagcacagaagtgttcttctagactgtcttcagcttcaagtcttaattttcac

SEQ ID NO: 28390 - DNA, 1191 bp, Mus musculus
atgctcgcaaacggtcatcagtgggaggcctctccagaaaaataacctcccttgagccggataaggatttatgagctgtgaaccaacactgcgggtctcactgtcgctctaattccatccacagcgatgatcacacaggccggacaatgcgctgtggctgaaataatcgagcggattgaagacttcatccagacccaatataaattcatggttctctggagagaacctcagctacgatctcgaaattcctgtccgctctatggagcgatctgagtgtagccgagacccccagaggagggaacaagcagatgagattgacttttgtgcccagcgcgtggggaccaggccggtctcccgtggcctccagctgtccgggcctgcccttgggctgcgggcgcctcccgggggcgtcgcggccgccgcggggcttggggttcggggcgccgggtcggggcgcgcgggcttcccccacccccggaggcgaccccacctcccgcccccgctgtgcgcgcgcgcgtgggtccgtccgtctgtctgctctctctcgacgtcagtgggaatttccagccaggaagtgagagagtgagcgagagaggacgagagagaagtaccgaggcgagccgggcaggaagaggaggtttcgccacccgagcagcccggctgcgcgctgacggcttcccgtgccctgcgcgcccccggcctgccgccgccgccgccgccgccgccgccctcggcctgctcgcgggccggctctagcagcgcaggccggagctcagggccccgccgcgcccggcccgccccgcgcttctccgcccgcgccgcagccatggcgcgccgctgagccgcccgcccgcccgcccgcgccccgacccggctcgggctcccgccggtccgcgccgctccgcagcgggagcccgcaggcgaggagaggccgcgccgcatctccagggtaagccccggggcaggtagaggaacggagccgccagctctccgcaccacggtgcagcgggtcccactggctcgaagctcccggggttcggggggggactaggggagagccccaagcaggagtcgcggatcgagcggccccggctgcggggaaagggcacatccgcactgggcggccccgaggccttgcgggccggctggcggggccctcggcgtctccgcgggcgggaacgggaagcggag

SEQ ID NO: 28391 - DNA, 2370 bp, Mus musculus
ttgtctggtaatatgtacttaattaaaatgtgataaataagaaatcccctttaagatcttattcttgaaaatcaacatgtgttgaaatgtcaacgctaatctctgccaaaattagtgttgaagatcacagactctggcaaatgtctgattaccttcactttctggattgcgtcacagttttgcatatagaatcgaggatgcattcttgggcatttaatacatctaaaagtacagatatgttctgctttctctcccagtgaatccaggtctctaactagtgtttctctggcaccctcaccctagtgtcccacccagatgcagtgttcacagaagacaatggttgggaccaggctctgccctcattctcacacactcgtttgtcagctgggttggtatcgtgttatctgaccctcttttctcattagagccactcacaagatgtttgctaatgtcttaacgcacccaggcaacgcggaggacttctgattttgctcctaacagattagcattttgctaataatagatcgttcttctagaggtgtttacttagtggcttctgcggaggaagctgtgtagtccgctcacgtgagactgagagggttgatggccaccaccacagagcaggaaatagaaagtggaacacggaggagcagaaagaattctgggatagagccaggcacctgaagatgtaaggagacaaatgcatggtacctgagcacaggtagtcagccatgtggcaggatgtagattagaataaatgggttattttaagttgtgatatagtcagagaagaacctagctatctggccaaggtactggtaaatctatcttgagtctgagtcttatttctgggagcatggggctgggaggagagccagatgtaccttctacactttgtcatcaaaggcttctcaggaccgcaaccagctgtgtatttttggactccattttgggtgatgcttgtgtattccttggatctcttatggtcacatggttcccatgccaaagatgctgcatctcctgtatccaggttcaggcatctgtggtgcatccgcagggctgggatggcttaagatctctcatttcctgccgcgactcttgtctaacccatcatcctatgatgaccatttgtctcctatagccctgaagtcaggtagtttctttttaaaattagtagttgagtctcattcagatgttttaaacataggatgaccttcattttttattaattattttatttatttacattttaagtgttgttcctcttccggaccccctctccgtgagcacgtccccctccctcttccctcctcccctttgcctctaagagggtgtttccactcccacctcacccctctagtatccccttctctggggcatcaagcctccacaggaccaaaagcatcccctcccaccgaggccagacaaagcagtcctctgctacatatgtagtgggagtcatggaccttgtttggtggtttagttcctgggaactctgacgggtctggttagttggtactgttgttcttcctatgggatggcaatccccttcagctctttcaattcttctcttcaattcttcccataggggtccctgggttcagtccaatggctggctttaagtatctgcatctgtctcagtcaggtcctggtagaattgagtgtagacagctctaaggagactttctgtgtgttatcaagcccatctgcagtggaaagggaaccctggaagtccacatggcctagctggctcggatgaggtaggagtgtactcagaacctaagtttcaccatcagcacaaacgtcctgaagcaggggcattccatggttgcggttgccttggaatggagacatgtagcgtgaactggggaccagacacctcataaatggctctgtgactgcaggtggcttccattcctagaatgattaaatacttctttaaatggctaaggttaagctctgaagcagataagcatccttataaagaccaagggagaccataacattctacttagtgtcctttcacataggaacactcaacaaaactggcttctcttcctcagggacacagaagagaaagcttatgtctgtgttgggaacatgctagaagcacaaagcagaggatgtgacactgtggtctcagaagttacaaaaaaacataacatgttctgttggaattatacctgtacgtgggctataaggaagataggaattcatgaagtgataaggtatttattttattgctgtgactaattaagataatagttttcactgttccatttgttaaaatcttaagatgttgaatttcaaataatctgctgatatttaaattttatcttgtcaagaatatctgattttttctataagatt

SEQ ID NO: 28392 - DNA, 1198 bp, Mus musculus
cttaaccactgagccatctgtccaacccccacccctcttttttataaatgaaagcaccacagaggtaatactgtcagccacttacagtctatgacggatgggtaggttaaggacggagtgcctgggccccagagattgtctgtctctgcctccccagcactggattttaacctttttgtttatggctggcttatttagaccagttctagacattgaactcatgatactttcctgacaatagctgtctccctgtcccttagataacccttctttatcaaggtcgtttggaaaggaaattgtgataggctcacctcctcagctatgcagctgaccctgagatactgagagcaagatctgactcgggaatgaaagaggagatgaactgatctgaaggtccccaactgtagagataaggtggttacgcctatcatgtgtacacctattcatacattcactcttagcactgtcagggccaaagagctagttgttggtgttggtgttggtgtttgtttgttttctttaaagaataacatatctattgctctgtatgggatagttacgtttggcatcctggcagagtatggaagatgcataaactgtcactcccaggagtaaccaaatggcttagtcagcccagttcttccttactactggggaaagcacctcagcgtgcttgcctgtggtgagtcagcagctttggagtcacagtctgatagctctgcttgctttttaggaatcacccccacccctctgagccgaaacccatgctgctgtgatcaagtcaggtgtcagacgtccaaagaactggtgcccatgcctttttttagaattattaaatttcaaatatctatcagcaccttaagtgtgaggtccatttggtaagagtctgggtcctgggagcttttgatgtcaggttgaatgggaaatacagtaaagtgactttcttcagcacagactattgagtgactaggaagtaaacaatgtgtgtgtgtgtgtgtgtgtgtgtgtgtgtgtcgtggggggcccaaatggggaagaagtacttacaagtaagtagtaggaaatgatgccctggtgggtccaggactggagaaagtacttaaggttgagagggtttctcagtttattaagctctctggagatttaactaatgtagagtctatgggttgggatgtctattgctctttctgttctctct

SEQ ID NO: 28393 - DNA, 1117 bp, Mus musculus
tgagatctcagatttgaggtatttgaggagaactgaaaactggaaatattgtttgcataatgcaggatcctccattttagtctctctaaagtaatttttaaaagattttcttttgtttcctggtggtcggagagatggttcagcagtcaagagggctctgtattagtccagaggacctgagttgggttcctagcaaccgctttgaatttttcacagctgctgccagtaactcctgcttcaagggaactgacacaatcttttggccttttgcagagacttgcatgcatgtacccaaacataaggacacacacacaaacccatacaaaggaaatatgatttctttttgttttttcttttgattcaaaattaattatgaaacttttctgtatttggagtatattattttctttaacctttctatattacttttggaggatttaaaacaacaacaacaacaacaaaaaaaaaacctatcctcagccaggtgtggtggtgcacgcctttgatcccagcacttgggaggcggaggcaggtggatttctgagtttgatccagcctggtctacaaagtgagttccaggacagccagggctatacagagaaaccctgtctcgaaaaaccaaaaaacaaaacaaaacaaaacactatcctcaaaactttttgacagatgatttgatttcctctgatatttaatttttttctattcaactattgatggatacccaaaatatagtagggtccaacttggaaaacgtagatatattttttcatgttattttaacatgtgttctcactgtgaccaatagcaacacataaattgggggattttttttttctagtcatttccagataaatacggtgtggtgagaccctagtgtgggttgtgattatctgcactgtctcatcatataaatgttctatacatgtacattttctgtaattttgaattagaacatagacatcagttatttttttttccctcagtggataaggggagacatccataatttagtacagggccagacagatatcaaggttgtttaggaagaaaaattgctagttatgcatatttttatacatctgcaggaaaacacagaacacataaaaactgtggattg

SEQ ID NO: 28394 - DNA, 1724 bp, Mus musculus
tgattgacagctagcagctagagcagtgattgacagctagcagctagagcggtgattgacagcaagcagctagagtggtgattgacagcaagcagctagagtggtgattgacagcaagctgctagagtggtgattgacagcaagcagctagagtggtgattgacagcaagcagctagagcggtgattgacagcaagctattagagcatgctgcgctccaccaaccaggccactcatcaggtctttagaataagctctttgtagcgaaatctgtaatgtaaagtgggaaaatacagcggggacttgaagctttgctgctcattgagtttgatgtaatttctggtcttgtatgtttaatgatagtattggcttaagggttttgcttcatacagttaaagaattacaaaatgtttttggtattttttttcatatctcctgtccccaaccccttgcttaaaaataagaatgtcagacagagtggctttgtgcctttgcttaaggatttttccctaaatattattgatttgtgtcatctgttgaactcaagcggtctcttgcgttctgccatcagactcttcagtagaaaaacctgattataatagtgggttgaattatacacattgcccttggggtctggagaactcaaccatccttctggaaacatgacctttagaactaggagagctacaaagaacctaaaagttcactttaatttttcacataatacatcatgcgaaacttttaaaatgctatatatctactcaactttagtgaaaacctttccctgacaatttacatatttttgttactccctaaagtagaatcttgagaggaataacttcaaaggaccacgttccacagcagggacttccttcctctccacggtgtctgtcacttttggctgcctctagcacaggttctgttgtgtgctttcacaagggtggagggctcgatgtaaaatcactgctctttgcttagaataaacctgcggctgagtttcacattagcgtcacgctcacaggtccggggcactcctggcctcattctcagagccttctgatctgttgtgcttccttcagcaaacttcctgtctaaccgttagcctaaagcagtgctgcttagtccatgtaaatggttttcctaaggttgcgtgcctctgaacacagctcgttgtggttttcaactctgtcattagaatctcctccctcaactgtcatttcactgtccactttgcagatttctgaatcccatcaagccagtattcttcttttgatttgtttgtatcttcgtcacctgctgatcatgttccctggtacaagatgatgaggcttggagcttctcctagtatcctctggtcctccaggagaccgacatgctgcttctatggtggttttagtgtgtgctcatggtatctttgttgtcatcattgttttaatattgagtccagggtctcactgtgtagctctggctggctccaactctcaatggagacctggctggcctggatctcacagcgattggcttgccctccatcctaccccgactccccacccccacccatgctgggtttattggctcccacacctggtaatactattttcattcataggaacacataagtttctatttgccattcagatcgtggatctcatgtttaacctacccattgaaatacgtatttctaattctctagtttttaagggtctgtggcaactaaattctcca

SEQ ID NO: 28395 - DNA, 1211 bp, Mus musculus
ctttttactatggttgaatgtagggacataggtcagggttatttacaggaacataggcaccagtgcctgcaaccctgaagaaagtgtatctcctctcatcaaccactaactgccatagatcatcagggagggctgggggagagggctcatgagccccttcccgttcagggcaggatgtggacaggctccatcttatagagaccttgtgcagagtcacaaaggctgatgactgtggcatggccaggaaacagtgttccacagacacttcactcttcttacatcatttacccccactgttccataatgttcttagatccttgaagtgggtactgttagaagtcccacttagactgagcacttagtggtcatgtcttcttactatgactgttttaagctctagttacttctgcccacttaaaagaaggaggaggaggagtttctttgacaaaagctgactgtagcattcacctatgggcccaaaacataacaggcagtttgttgtctttttattttaatggagatttgaagttgcaaagttctgtctcctcttcaatgtggcctgtggcccccacggtttacatttgatagtgttgatgtgcactggcctcatttcccactttccctcttttccttcaagtagttcgctgtgtctgtttttaatttctatttgcctttcgttcattgaattgaacaatatagaagcttattgaattttttgtgtcatccttgtacatgggtcatgctaatctctgtactgttttgtcagtacgggttgtaaacatgagcacatgtcagaagatgtgagatatttcttgagcctgtagaataagtcactttaaaatgtagcactctaatgaactgtgaaggctcttagctgtcagaaaacgtgtagaaattgttggtgtacttttccagttttagtgggatagagagggtgggtcaggttatcaggttgagagaagttagcacagcatgaagtcacacaggactttgtacagtattaagcttgaggtttgttgctgcacccatcatgtttataccatgtgtgggttagagtaaacagtacttgggagtagccatgagagatgttggctgagtgcaggatcttaaactacatagaaatttcgtcagtaatcactgagtcctttgtgcttcctgtcttgtggaaaggaccagttatatctttgaatttaattttatgtgtatttatg

SEQ ID NO: 28396 - DNA, 1214 bp, Mus musculus
gataatcctgtctcaccacagaaagacgagcagggccagcagagcagcccggttctgcagtgagccccgtcccacagtaaccttcccctgtcctcctctcgcttaagagaaaccaggcagtgcggtgctttacagaatgctcagactgcaagaaaactttctctagtctatgttgtggaattttaaatctgttttaagagttaaataataatgaaaaaaaccctttaaacactaagaaaggatcgtttggttttgtgtaagaagacttaaagatatgatttcaaaattgctttaagcctcaaatcagtcatggaggacgtggaatacgagtctgcctcggttcgtcactcactggagcatatccttcaggacgtgtcttctgacccttgagcttggttctttaagttcctacctgtatctttttagtccgatgtctatttggtggagcagatattcataactgacctgtgtgtcttctagaatgttgaactttggaagctatgcttttttctgtagctttggtgttttgtctaagaaatacattaattctaggagaactaccagttgtttgctgggctctacaattcattccttttggacaatggagtctattcctgtgcctcccttgtgataccttgttatgcttctgaaatagtcacaagaataatcttaaatcctgtaatgacaataacttattcaattacacagctaagttttgctggctagattattatataagctttttttgaaggatcaatttgtctttacctcagtttaaaacaaaacaaaaaagttatccttctcatatattttccatatatatatataccatatatttccataatgttatcttttaatgtgaatattatacatctgcctccaactaatataaatgtttctgtaaatagcatatgcatgtaggaaaatgagcatgtaataatgtttacatctgtccatatcacatttagccttcatgccttaatccacaatgacaggactgatgcattctttgcggaatgggtgtgttgaattcactagtttgaattcgttaaatggaattgaacagtggtttggaaaccgatggagacagagcagagggcactgcactgttgggcttctgcagagagtttgcagagtagtattcaggtcacaagcccttcgcacgagtgcagtggagctccaggggctctcattggtcttttctctttatgata

SEQ ID NO: 28397 - DNA, 1189 bp, Mus musculus
gcacaaggaagtgtatgaaagggtctcagcattaggacggttgagaaccactgctttggaagttttttgttttagaatacttttctgagtatttgctggtcgttatttttaaaactgatacagagttagggaaatgagcctgcccttccattttccttttcctctgtcttctctagggtcactcaggggaagggattaatgccagatgggactagcagatttacctgcaaaggaaagtctgtttttcacttcatggggactagcacattttccgagtacacagttgtggctgacatctctgttgctaaaatcgatccttcggcccctttggataaagtctgccttctcggctgtggtatttcaactggctacggggctgctgtgaacactgccaaggtaagagcctggccgcggcttccgcttctgtcctcattcagttcagtgagacattgctggcacaccatggccagcctgtgaggctgtgactcttagcgggcagctgacactgtctttgatgataggtggagcctggttctacttgtgccgtctttggcctgggaggagttggactggcagtgatcatgggctgtaaggtggctggtgcatcccggatcattggtatcgacatcaataaagataaattcgcaaaggccaaagaatttggagcctctgaatgtattagcccccaagacttcagtaaatccatccaggaagtcctcgttgagatgacagatgggggcgtggattactcctttgagtgcattggcaacgtgaaggtcatggtgagtacatgtgcccgcattctttttgggctttggtttcctcatgattaaagctttggttctgaaacagctttggtaggaattacttgttgagaaagcaggcgatggcaatagcgccttgaactacttggacctatcgaatggggaattacagaagggctcagggagagatgctcaccaaaatgaaaggcttagtgtgaagggcatgggctttggaactggacacacacctgagcgaaggatggagtgtgtatctagtagtgtgtcaccaacattacatagagtcctgcagtgacttctgacagcttcttgcacggaaatccttaattaggaaaaaagaaacttttagatttatttatgtgtatgaatgctttgcctgcctgatccacttcattgctctcttctcc

SEQ ID NO: 28398 - DNA, 1955 bp, Mus musculus
cgggaagcgatctgctcagtttgagcacaccctgctggtcacggacactggctgtgaaattctcacccggagactcgatagctctcggcctcatttcatgtcccagttttaatttctctcaagatgcctaacatacgaacaccatctcgtactgtgcattttattgaaagtatggaaatgaagttttttttttttaatcactcgttttgttttgactgtggataagaatggactacagcatttggtgtgtgtcctcaagagcttttgggtctgaaagctgagaagaataaaggaaacattgcttacttccttccaccactggcctcaccccctcagttttctgtactgtgttttcttctttgccccttgagcactttgacttcaacctgcactcactgctttgtcactgccagaccagccaccaagggccagctgcttcccaacagaaggttggagatgagaaatcttgaaactttagcaacatgttgctccagatttttactatatattgatatatatggaaatatatatatgcatacattttaaattccatatacacgattactgaacactatatgaccttcggtctgggttgattctgctttgacaggatatctgctctcagaaacggatccataactcgttagtgagtgactcctagttaggacctggtctcctctcacccccatgctgttcatttatcttgtctgtctgcagggaagactccgcgcagtgtggactgtgtgtcagtgagtgagacgttgtcagactttaaggtctggtgtgtgctgcaggaagtggccggcagctgcggggtggctttacagagcactgctgctttagacctctctttggtcaggtgtgaagcccccttttttcagacccttctgatgtgaggctgcacctctggagcactcaagagaagaggcagttgtcctgtggcagaggatgggggagttaaaaaatgtccccaggtgtgtgcacagtcacgggtggctgtggctttaccattagtaaacataacagaatgagaaaggagcctgttgcggtactgtaaacactcagtatgctgctgctatcctgtattgcaaatgcacctctcctcggtcgagttgagagtctcatcagaaatgactaggttgcccggaatctgtgctcctcggtggtggttcaaacaccagaggataaagttgtcacaagagtatccttgattgctgggtgtctcatgacttttatagtataatttgataccactgacacatacttcaagacatctttcccagagtgcctcagaccttattgctttaagagaatgatgataatgttttcatgactttattttaatgatttagtaaagtgattgaatctggtgtagacttctgggtgtgtgtgtgtttaaagtttttatcaaactgtaatatttgtgaatggaatgccttgtaatatgaatgttaatataatatgtaaagggagattaaacgtttgaatgattatcccactttttctagttgtatttgttgggatttcagagggaatcgacgggaataaggctaatgtcacagtctaacctcattgccattggagcaccttttcaggtctatcataccaggattgcatggcgtttagtccagcaaagtgccagcaccatttgtgatgtagctgtatcaggagagcttttaagaccaagaatgtggcatatttaggggaacatttcatattttgacagtagaattagtaatggaggtgggctgggtgttcagtttatatcatcagaaaatgaagctccatgaacaaacccctggtgtggttttgtgaacagatggccagacatgctggtgggaatgcttcccttggtattttaaagctctgcgctctagtctaatcttgaattaatacgggactaaaagtattagatttagtttacaaaacatctacttcattcttgtacaaccaca

SEQ ID NO: 28399 - DNA, 1194 bp, Mus musculus
ggatttactaggctaattttttgggggggggaattatctatttctagtcttttagatattaattttagttagaaggtgttatttttcttctcctctttttgtcctttgaatatttttgttttgtgttgtatagttctggctgtcctaggacttgctccgtagaccaggctggccttgaacacagagatctgcctgcctctgtcttccaagggttagggttaaaggtgtgcaccactgccacctggctgaatgatctttttcatatagcttcctgtaattgttttatgtccatgtacaatcataacatctcgggggggggggggcagtgtggagggtggctgcaggagagagcaagcctgaacacacttctctgcctgtttcctctaagattttttttatttttgaactcaggatagcagttccagtagcttgaagtagggaaggaaattgaggaatctagcttctttaatctttaacttacctcctctttaccacagttctaatgaatgccagcttgatctgcattgattcagatactatttggccatctgtattctcgtgtctctttgttccttttatactagtgtattttgatcactttgtactatagttttaaataatttaataaatttaaatgtgtgtgtacagacatgagtgcagctgactacagaagctagaagagggctttgaatcccctgaagctggaattacaggtggttgtaaaccaccccatgtaggtgctgggtaccaaatttcagtcctttggaaggtagtaaatgctcttatttgctggccacctcttcagcattgtgaaggtcgaatataaagagataaaacacatggagatagcacattgtctggtagtaactgcttaataatgattaagtaaaaagttttcgggaggctagatatggtgggttatatttgtaattctagcattccagaggctgaggcaggtacacagtgaggccctatttcaaacaagaaacaacagaaagtgaaaagtcatagttttcatgagatgtgtggtttctttggctggtgttcacctgtcctcattcgcctgttgggatgttgaatttgtaacttaggtgtgcacttctgtctgttgtaatagtgcttcctttctatcatggcacttgaagtagagaatgaagaggggatgggatgcaggggggatgggagctaggctgt

SEQ ID NO: 28400 - DNA, 1540 bp, Mus musculus
acattggtgaaggatccaggaatatgacagaaaggtggaataaacattaaatttgtgcattctttggtaatttttttgttttttgtaactacaaagctttgctacaaatttatgcatttcattcaaatcagtgatctatgtctgtgtgatccctaaacataattgtggactataaaaatgtaacaccataattacattcctaactagaattagtatgtctgcctttgtatctctatgctgtactttaacactttgtattcttaggttattttgctttggttacaatggctcaagtagaaaagcggtcccatccatattaagacagtgtacaaaactgtaaataaaatgtgtacagtgaattgtcttttagacaactagatttgtcctttatttctccatctctagaaggaatctgtacttcgtattgcaaggcagtctcttgtgtcttcttagagtgtcttccccatgcacagcctcagtttggagcactagtttattatgtttattacaatttttaataaattgactaggtagtatcacatgtaattacactgatgtggctatctttttaataaagttaaggcacagttgctcagtcctaggttgagtgatggactttgactatgttacagttgatgaggattggggttttggtgcatcaccattcggtaggaacagcggctagaaactgattgttgggtttaagatgtttttacttaatggccagaaaattagcgtaaggaaagtatatagagaaacatgcgttagggacattagtgttactatctgaataaaacacaataaacaagtattaagaactacttatattggtcaattgttgcagtatggttttctgtaaacttgaaaccttgatctattctttgtatcatttaaagcaaacatgaagacattttgtctgcagtacgtaattgtatagttcagatcctgtgagatgaggtgtggctgttaacgccgaagggtaagctgaactgtgggtagcagagtggaaaccattggctgagagaaaaatgctctttaagtggtggttgttatgaattcacactgataacttgataaagatccttataaaatacatacggaattaatagcattgctcttattatgtacgtcaagaatgtataaccgcctgctcttgttgtcacagataactccctgttcagtgctttggaaatagcgatgctcacgatctcagcattctgtaccctacatctactgtgtggatcattgagagatcttttgacattgcaacatgatatggtctatgttgggctgcattcctggctgtcttgtatgagaccccggttggctccctgaagctgattgatacagtgtacaggcatgaaggtggctgatgaggctttcttaccaacatgtgggattctagtagttgtatctattagagattaattctcatattccttttcattcatttgtaagaagtatcaactttagaagtgaaaaaagaatcataaaatacagtttttaaagttaaaaactttgagtaggatgtatctttgtt

SEQ ID NO: 28401 - DNA, 1560 bp, Mus musculus
gttaggcagtgttttattcttgtcacgtgttcataatatatgtaggtatttctcccttttataaatgaatgagaattgggatttggtgtatcaccatttgatacattaagatttaaataatttcatagcttctgtcagatacagagtatgaacttgtgaataattcttaatcacataaatcacacactccctgaagatgtaataaataggttgtagtacattagattctaaattccagttagactcagctacaagctaggcatataaacagccagcaaagctagtcacaaataaccatggagactaaggtacagggttaaagtatgaatgtttttattggtgctctaaatcaccatctaagatagatggtagtgttcaacttgacagaaatagacgttcttgaatgctgctggagttgcatttaaaaggttaaatttagtaaatggcctgtatggtgggtacatatctgtaatcacagtgctgagatggaatgaccataaggccaacctgggttacgtaaaccctttatcaaaaagacaaggaccaggaatgtgcttcattgagagtgcttgccaagcatgtactatgttctgtgtgtgattgccagcactgtcaggaagatgaggtgtagtgttgggtctctgtgtatcacgtttctcatgacacccagctttgtattctcagtgtggagtattatggggcaagtggatagatattctcatttggcaccagccctctaaatacacatcaaattgatgagtataccttgaggccagcctggtccataatgctagttctaggacaactaaggctacacaaaccctgtctcgaaacattgaatccaaatgaatcccactgtgggaggatgcctgaaagccagtgcatacaaatgccactttgtaacatcccctcccctccagctgtggtcatgccagtcgtgggtttggtttggtttggttttttaatgtgtatgcatgcatgttttgtatcgtgtggtgcctgaggtggtcagcagagggcatgaaatccctgcaactgaagttaattacttagcacagttgtgagccaccatgtgagtgctgggagtcaactggatcttacacaaaaccaacgactctgcttactgcagagccattactccagccccatggctcttgtttatgtgatggtatgttcatttgtttttcatgacaggctttctataagcccaggctgtcctggaactcactgtagactaggctgggcaccagaataagtgctgggattaaaggttgtgcccccaacactgcccggtagtactttgattttctttctttgggggagaggggagcttggtgtagtggtgcctgcctttaatcccagcactcaggaggtagaaacaggcacagcctgatctacagaggctagcctgatctacagagctatatctaggacagccagggctatacacagattatataaattttgttattttgagacaggttttctctgtagccttggctgttctggaactcattctgtagaccaggctgagcaactgcctctgcctccagagtgctg

SEQ ID NO: 28402 - DNA, 1176 bp, Mus musculus
taagcttctttctgggtcctgtagtatacagaactgtactgcagctattgcaggagtgatggctcttcattgagtaaataacctagagatgatttcaagtctaccaggggatatgtagagcttatatgcaaaccatgacgttccgttcaaaggacttgaacactagagggtcctggagtcagaccctcacagctgtccagggacgattgacccgagggtttcaggctggtgtaacttactcaacagcagcctttcaaagattggtgagaaagtttcgacagtagctaggtttcaaggggcacagactgcccagcagggatgctgttgttgcagattgcacatggcaaaggataggagccttgagggtagctaaggataggaagggtggttcttggctaggtctcatggatactggactggcagatgtttctagatccacagcaatactgggaaatagtttatgactaataattgatcaaagtctctgccaagctgacggtgatgggccaggaaccatcatttctgtgtatgtggaacttgaggtacatggttacgggctgttgggcatcaaggtgtcgtctgcatatgcctgtggtcggagagaacaggtggaagtgggctgtggggaagctggagctcagacctcacgcccacgtgctttcccatgatcctcccgacatttagtcacagagacaagctggcaggatgaaacgaatggtagcattcatcatccaaatttaaatttgtttctcattaacagacattctgcctgtagtgcaccatgaattaatatgttttataactcttgtaactgtctcgtggagggcataattagtcatgagtgtttgggtgttagaaatgttaatctgttcaatgtaggcattgaaatattgcgtcgtttctttatttttaacatctctgagcgctctaagaagatgaaagtggccgtggcctctcttgacctctgggcggcctgctgagccgcctctgcaattggctggcccgggtcatgtgctcacttgtggtccaatcagctgggatggaggcatcagtgtatagaaacctttgacccgggggtgtgaatcagcttctgccttccggaaatgctacccaagagcacaggggtgtggagagggagggagggagagagggagggagggagggagggagggaggg

SEQ ID NO: 28403 - DNA, 1099 bp, Mus musculus
gcgaagaaattgccagaagcatccttttaacatcctccgtgagcaaagctcggcctgtggagtggactggtacctagactccaaatcacggaggagtggctacagctggaatcgggattgtctttccttggccacctctcttgtctccagctgtccaccattgctactgaaaaatggattttgaagacacccatgttgggtgactgtgtgtacccggaaggaccagtggaaaggggtacacagagaccacatcttagtttgcctccacagctgaacgggccctgcctgctttagtctggattgtttttctcttctgcagctccaagtggagtgagcaggactgctttcatgtcctgtagcctgaacctgccctgctatgtcccactctgcgtggtggtcatctgtggggcttgatcagctgcatttctaactaaatggttttttttttttagttgaagtcattgtggcacctggacttgaacatcttgctcttgtgttcattgttgttttttttctccctctccattcctgtcaccagcctgtagaccaccttgaattcactccaacttgctgtataaacccctctagcattccagtgatagagaactttcttaaaaacagaaatacacacagtttatcaatatctgtgttttttctccctggaggagcaaaaaaaatcaaatcaccaccaccaccacctccaagaaaccaaaaccaaccaaccaagcaccaaaccaaaccaaaaaccaatttagattcaggagcgggagaaaggaaagaaaatgtttttgatgatgttaaagttttggacttagaggcaaaagtcctcgaactattagaaccagaaaacactgcatactgaataatgtacaccctgaatgcatacctgtggttcaaaggtgtgggtctaaatggctagtttcctctctagcagcccggaggtgttgcattcattccttttggagagagacatatcacttttaaaaagtggctaaaaattgctggagacccatttggagacaggatatttggacttcatttggctgttgtcgccagccagtgttgggacctggtaataaagcctgggcttttagcggat

SEQ ID NO: 28404 - DNA, 1203 bp, Mus musculus
ccgaggacttgtgctgtcttcattgattatcatattcacagtttctgaagaaattaccccaatatgctgtagctcttccttacaagttaaagccagccaccaaagcacagtgggtgctgagcagtgaaaaagtatcttctctggagtctgagtcccgcatccttttcgtcgactgcacgtccttcaaccctcaccttctcttttagaacattgaacaactctagtgtgagacgcgtgcttcctgtgtcagtaactaaacacgacttggcaactacggtaggtagtaccaagtaccacagaccctgctactcccgcacagatgcgggtgatgtagaaaaggtatgcttcttctgagcgctgagagcggggagccagcatcctgactgtcctgaccttttctaaaactctgttgtgaaactgcagctctgcagagcctcatgtttgtatgatggtttgcatcatgtctgcacacaggtttgtatcatgacacacatacattcatacttacataccggaacatgcatccctgccccctcaccccccccactgggcggaggaaaaaaatcccagataaagtaccttttttttttgtcctttttatgacatttagttggcatgagttaccgccgtataatcatctgtctagtagaacctaacatgtttcttggctcgaagtccctcttttgtcctctcctcctttctgcactgtgttcttagagggaagtcactgtgcacacatagacttaatgaatgggaactgccccctaaccaacttggggttctcaataaattacttggaattctgttatattttatgtatgtggctttagcaataactttgatagcagaatgctgctgtaactgttgtagttataaactcactgcggtggccattttattctaatttgaagggaactagtagcagccagacagccctgagcagagaccgtggaagcagaacttctaccagggattgtcttactgtgccaaacatgccagatgctgtccacgcctgttctgggtcaagacccaggtctgtttgtgtgctctcttctgcttcagcaggctcactggcatttctggagaccacagcttgtgtgtcctatctgcatttcagcggctatgtatcctgtttagcaaatgctagtaggaaaacatatgccattttgacatgtttaggtattgcagggacatagttgttaa

SEQ ID NO: 28405 - DNA, 1221 bp, Mus musculus
tttacagttggctcacacgatagatctgtttctaatttctttaggaacctctgcactcatttccatattggtcaaaccagtttgcactgctatcagcaacggttaaatgcttcctgcccttcgcatccgctccagggtttgttttctacatacatgtgattctggccattctgactaagaggaaatctcaccagttgtaatttacatttctttaatagctaagaacactgaatgctttaagaatatttctcggcaatttgtatttcttcttgcccaaatttgtaattgttttttgtttatttgtttgtttgttttcttggccaaaaaatataatttgggaaaaaacacagcatctttacccaatggtgctgatcaaacggaatagctacacatggaagaatgaggctagctcctaataccaacctgcccaatgttcagctctgaacggatcaaggacctcaaagtaaaactgagtaccctgagtctccaggagaaggtggaaaatagtctttagcttagaggcataagaagggcataagagtcggtagtggtggcgcacgccggtaggatttgctgaaggaggcagaggcaggaggatcacaagaagggcataagaaggggctttctcaagaagatcccaatagcataggcattaaggtcaacaactgacaaatgggacctcacgatactaaaaaacttctagacagcaaaggatgccatcgtgatagatggcgaagaggcggcgtgctgagagcaaataaaaatctttaccagctacagctcgaacagagggttggtgtctaccatatataaagaactcaaacaaacaaacaaacaaacacaaagaaagtctctctccatccaagaaaggaagaggttaaggagtcatgagcctctcacaagtttccactggactgaatcccaaacaccccctgccatctctgaggcagagtgtggggtccctcaaaggacggatgaaggcaaaaccaaggtggacccagatccgctcattcactggactgccgctactctccgctttcctaggccgcactctttgtacaccacagacttcaaaggcaatcagaggcttctcagttctcaagcagaggacagcagtcaatagttccttggaggcccctaccacttatcactgtgttcccatcactgtgatctcctggtggacttttactgtttgcaaaactttgggaggaagaggggggg

SEQ ID NO: 28406 - DNA, 1145 bp, Mus musculus
ttaagaatcagagggggtggacctagtggccaaggaaaagccaatagcatttgaattctgctgtctaacttggtttcctttcccccttttttttttagatttttgggatatgcctggcacagaatttggtgagtgacattgaagctgtcagggctagctggtagacccctgcgaccactgctgtcagacactggactgatcccccctcactgactgaccctctgtgcgccggccggctgatggcgggctgtagaggcctggtcacaggcctacagtctcacctgatggagctgccaagaacttaactttctgtgggggtagaactgggaaatgctgctcacagacggaacttggaaaaagaaaaacaaaacaagtgcgcaacttgctgagtcaacgtgcagtgaatctctactgtagccgtggattggtggtcggatggatgctaccagaagggggaaggggggaggttgggcacggcatgtacttgaatttttggagaatacagtgctgtacacatcttggctaaaacttgggcccttagccgtcagggccaggtgtcttgaaatctctcaaaccctttgcatctgtcctccagagaagaaaccagctgccccctgtgttcagattctgagagaggtggagcgggtcacgatacagcatgcgcccttcatcctgagtttgcccttaagagaactgggcgtttgcagtaaactagggtgccagaggctgagctccacatttccacaggactgctctttcctctgagtggccagcccgagcctgagctctgtcaatgacatccaaggagaaaatgaggttaatgagagacattaattaaacactccctcaccccaccgcaccaaaccagttgggttcttctgatattctggaatactctgggctatgttttatgttttatttcttttttaatcggttgttattttggttctttttttttttctttctttcttttttctttttgtctcccaaaggaggctatgacacagttctcttggtttcttattcagcttgaatagtaagtttttgtagacttgtcacctgcatgtactgtaaccccacccccacccccaaatccaccatgttcttttcagagagacatttgagcgtgttccttagtgtttatg

SEQ ID NO: 28407 - DNA, 2334 bp, Mus musculus
atccagcaggaatgtatgcattgtcttgcttttctcttccagaatctctatacaaggaagtacaggatttggcctttctagatgttgtctccaaacttcgaagtcatgagaacaaaagtgttgcccaacaggcctcgcttacagagcagagacttacagtggaaagctgagaactggccctgctggcaccaggctcatcccagctccgcccactccactgttctccatccagctgcttcttcaactccattctctactacatcacttgtgcatgcgtgtaatgttccagtaccaatggaagaactgctataggtacctgcctaataagatttctaaacccatagttaatgtgaacatgactgtcagaacaagtctccacccataactgttaaatcctatactcctgatgcttgagctacattaagtagaatgtgcatgttgtagtcctatgatgatgtaaacttggtactccatgctgacttgctcctcacatgcagtaagctacataataatgtactggtaaactagaaacaaagaatgcagcaggacctgtctagcttatttaaagatgaaactgaatcgtcaaggtagcaccacgtattctggtctggttttgttttgttttgttttggtgctggggaagcacagcgatcaaaaagcctgtatggctgctcactcattaatcttctgccaacgtcaggcctgtaccacctaaacttgaataggtccaatattccttccttccctacggtttctcctttttctgaactatataggcagtttgccaagcaacacagcaaaccttcctgaggctcctgattccatctttaagcgacagtggtacaggggctcagtgctgaaacatggattttaatgtgagtggagcgtaggaaggagttaaaagaaaccctggcatactgaaccactttggatcttgcctgtactttagattccgatttgtgtgtggttacatctagaacttccatcagctagccagcattgtcagcatgtctctaaagcgtccttgatgtttgttcggtgaaggaaactgaggcggcttgtttggtggagaatggacttcccccccccccccccggttttcatcttttagggtgaaagcagggagattcatctttcatgctccctttcaatgtgctaattctaattggacataagaggaaacctgaagtaagcttgtctaaagagaggaaggccggttttaaaagccatagtagccagtccagtacattctgcagatggcctcatagcagtcattgttagagttcttcacctccactttcccactgagaaccacaataatctcccaggctgcaagccaggactcgccgcaaagactcttcttggcataatgtagtgtgctcgtcactgccactaaccaccaccaagtgagttcttagagctttgacacacagtctttataaattaatcgggattccctgtgacccgccttcctcctcacacccaaggttgagtcctgctgatgtctgagggaggctgagctccgttacaggagtggagggcagtgaggggctgctgagagggaccagctccttcctcccccgacaggagatacctgtatctctgcgttctctaaatcggactttgcttttcacacttttaaattcaagaaagatttacttcatgtaagtgaaaacctgactgacagttccctctgatgtccaaataagggaactgtggtgagcgcctgtgcttgctcactggagaaatgagtgctttattgtctttctcctgggctggataagtggactaatgttgcataatactgtccatattaataacttaataaataaatagtatatgaaactacagtgagattacttggtttctttgtgtgttgtctatatcttgacttccaagaacagggttcactcctaattggtactgggtgttgttgaatgaatgctcaaagttgcagatagccatcaaaaattttccagatagactgatagctgagatttggatagttctacttctagatccttcaaaataaaaacaaaacacttagagattgcttctgtactgaaaagcactataatataaaagggggaggggaggaaactcagaaacattccaagatcatagatttgaaagacagtaccttgtaactcggctaccagcagtcatttcagattaataggagctgctagctccagcaaaatcaagcacaatccagctgtgcccttcaaaacaaaggccaacaaattgggaaactcattgctaagcccaggtagttggtagacaaatgaagaccaaataacctttcatctgcaactaattaatctcagcttcaga

SEQ ID NO: 28408 - DNA, 1099 bp, Mus musculus
aacagagtcaactaacctggtcacatatcacttttttgcataacaaattaattagaaatgaaaaatgcctttatcattgttatttagtattgaagatttaaataagaaagatagttccttaaataacaagtatttcagccaacatttgaataggttatttatttacttattctttcttcctctctctctctctctctctctctctctctctctctctctctctctctctctttctttctttctcaactttacaacccactatcagccattcctttcctcccagtactccctcacacaaatttccccccaatcaagctttcctctggctgtcactctttccctacatacctacccagctcccctctccactccccagtacattcactcagcagccaatggaaagaggtccaaagactcacacccaaatattagatggagctcagggatttgggagaatgattgagggacctgaagaggacagggacgccataggaagaccaagagaatcaactaatgtggtcccttgggggctcccagagactgcatcaccagccaaagaatgagcatgggctagacccaggcccctgcacatataaatcagatgagcagcctgggtcttcatgagggtccccccaacaacaggagcaggggttgttcctgagactgctgcctgcctctatgtggatggtgtacccctaaatgaatgaatgggctttttaaaatacctgcttcactatcagatagcagaaaaattcagtgattccataaagcttactgataatattcaagattgtaaaagtagtaaaatttgaacacatggggtttttaccaagtctcgcttttgaaaagaagcaaaacaaaaacaacaacaacaaaaacccaaccattcttaacaataaaagaacttctgagggaaacaccattcctgacctcaagctgtattacacaacaatagtgataaaacctgcatggtattggtacagagacaggtaggtagatcaatgtaatagaattgaagacccagaaatgaacctatacaactatggtgacttaatatttacaaaggaactaaaagcatccagtggaaagaagacagcat

SEQ ID NO: 28409 - DNA, 3151 bp, Mus musculus
agaaagccacagacagtttggcatttgttatgaattgccagtattttctgcacatgaaatagcttttataaaaatcaatttcctggctattaagttcatcttagaataaattagcaaagtattacattttagaattaaaatccctagcctctatgctgaaataatactttgtggggcgggtagtagctatgagaatccacagaaggcaataaaagtgccttaaaccttattaataagaataattgtttaataaaaccattttatctttaaaatagtaagtagaaatctaaataaattttatgagtaggcagtaacttttctgtttagtgagtgtacttgctttgctcttatcattggtcttacctttcagtaagatgggccatggaaattcttgatcaaagtgtgtcgtgccagtaagagattgttgtgatctcttctgatgttctcccagatgctggccgccttcagatggggcagtttgtttgtgttgtgtatggctgcctggtccagaccgccatgcttttcatctcttatgctgacatgaagatatttcaatagcgttagactctaatagttttgtctcctttttagaaaagagtaggtggaagataaaggaattatggaaataaagtcattgtaagtagaaagttaaaaggaccacttcccactttcagataatgaactgactgatttttacatcttatgtctctaactgaaggttcaaaacctccttgcccggttcttggttcttttttctttttggttcgttttagattgaggattatgataagagccaactgtatattgttactgtgtttttgcttatttggagttgtttgggggattttgtttcttgttttttgtttgggattcttttctatcagtaagtaaatcccctccagctgtgtgatcgctgacttagacaactttgggtctcgggcctttggtagtaagggagaaccatgatgcagctctcccatgctcccgtcatctgttcgtcctgagagagcacagcatcatgcaggcaccgcctgtagtcaggaaagtgactttgagacagccgtgtagtttgcctcactacctagggagaaaagaaatgatggcgtttcgtgttttcttcgtttctataatgaataaaagcgtgtgatcctgctgagttacagcttaaatctgtggggacaaggtgctttcaaattccagatagagttcccaggttcctgctgccccatcacccaagtgtacttgtgcatcgtgtgtgtgtgtgtgtgtgtgtgtgtgtgtgcgcgtgtgcctgttaaaaaagacgtcttagactacagtatttgtttaacctccctaagaactttcaaggcatctgtcctgaaagctgctaatctatggtctagtgaatttatattatatgcagatagtaatgaactgggagatcaatgaacagcaagggtgataccacattgcaaaatggaagcttctccagtagcggcccaggttgcctcctcacctgtgcttgtagggaggcaggaaatgtcttcagaagtcaatgctggggctttgtccgttaggtctttgtgctgctgcagtgatcagtatcagacttgataactcatgttatcaagttagttatagtgttatttcagatctgaatgtcaggctttggcttatgcgacaaaataagttggggttttgttttgatgtggtagttttgttttgtcttttagatgatgtacaaagataatatttgaaaactcattggcatttgcatactcaaaggcttttctttgagttggagttcttataaaattttcttttaccaaggatatcaattttattaagcctttacttctatgtgttatttgtagagtataacgctgcattctataatgctggatttctctaaatttaatctgtaaaagctagtgtggcttggtaatttggcattgtgtctgtattctttgcctgttttatggcaagttgtatatccatacctaaaacagtgacctctgggaggtgagttctaaccatagccagaagctctgtctgcagtggggattgctatgttttgtttaccagcatgggtctgtagatacctggcactttacccttctggcgagctccctgggtatttattagaagtcttctgtgtcggtagcattgttttttcactagtaagttttcaccatagaaccccgagctttcctcctgctagatgtatgtttagaaggctgcactcgataaagcccagatggaaaccatagtgcatgactttaagtccctcctccaatttctcattgttcaggcttggatggtcctacattgatactgtctctctaattgttcggtctgactgctgcctgttgaagtagtaaagtgtttctcttccttgtgattccatgttttccaggggtcaggttaccttccccatgtaaaaccaaagcctaattctttggccatcgtattaaagcaaaagtaaccatttgtttacaagagatttgtaaacaaaatcctttgaatattgatataaaactatgttttaaattatctacagcaaaatgtactctttccaaggaactcgaggttagaggcacttccacggaaaagtgattcccgcagtgcaagttcagtggaacattaatgcttttgtgcatgtgcagctcagtcatctccattggagcagaggcaactcacacaaatgtacccttactccagtctgtccctcacctccattgtctaaggtattggacttagatgcttatgtgtaatatgttgaacctgtcagttgctgtctttttccttcttcgcattttaaagtttgtgtatagctgctcttttgcttttggatatatttttaattaaaaaaatcacatgagaaatgtaatctgtatagtgatactttaataagcacatactcaataaacaactgcaatgatgtcgacagcacgcctggcctttttttttccccctctctgggtgctctgtgctttcacttaactgagcatggggaaaagtcaaaagtcatgtttcatcatcacaggcctggaaacaacccctgacaagtctctgccatggtgttagccaatcctgctgccctaaacatttgaaaatactgcttttactgtactatctaccttctagcctttgcatgtccaatatgtat

SEQ ID NO: 28410 - DNA, 1184 bp, Mus musculus
aagccaatccattatagcattctaaaagaaatattcatttataatggctaaatcatagttcatattgttttatatgacccagtgtgaatatcacaagtaatttcaaattgttggatttttattgctgtaggctttccattttccgttttccttattctttttctttccttttcttcatgttgggactctttcttctgctgcctccttctgtcacttaaaaggaaaattccacctaaacggtaatctttgttttcagtataaccctttagcacagtttactctaacctatacatgtatttactactatgtttatttagaagggtattttaattaagtatattacacaaacaaattatgtatataaaaatattcagaataaaatatataattgatagtttaccaaagaatatgttttatcatcaatgcaacttaaattgtaattactgtttttcctttttttttttttttttttagcccaccaagaaaacacattgtggagcgcaacacggagttttatcacatacccactcacagtgatgccagcaagaaacggctgattgaggacactgaggactggcgcccccggactggaacgactcagtctcgttctttccggatccttgcccagatcactgggactgagcatcgtgagtgagcttctagagattgttggaggggaacgcttaggctctcaaagtagtatttagacttatcagcagttacagagaacagtcctggcaaaggttgcttttaaattatgttgtacaaaagaagattccagtccagggaatcgcactgaaaggaggggaatactagccttggtatatagccattgtaataatgatatggatttgttttagttgtctatgagggtataacatttggcattcatacagataattatgtaagggattttgaagttaaaaattttaaatgttaattttggatcttatttatgtcgcagtgacagaatctgaaaatgacaatacgaagaaggcaaagtaagttctctctttatgaattgaatgctttcttttcgtgaatggtctcggtttgttgtcttcaaactttcaagtgtaatattgcagttttgttgtttttgtaaatagaaactaaggatttaacccatagtccctttagtgtgacctaaatgtgtagcaacagatttgcaagttagttgagat

SEQ ID NO: 28411 - DNA, 1172 bp, Mus musculus
ttaaaaactagattaaaattgagttgttataacaacagcttagcatttttgtattaattgtgctgtgattattctgaatatatagagacatttcttttattaatacaccacagtaaagtctctttggaaacaggatatgtctatcgtaagacatattaaagagagttagctgttgaattgttagaacacctcctttctaattgcctataatctacttattaacctcagcacattagtaagatcctcagatatggtgaattattgtcaatttaaaattaactgattatacataaaaactggctagttaataggctgtagtgtagcacataatttgtttggaaaaaaaaaagaaacatggcacttgaaataaaaagaatggaaacatttatattaaatagataggctcagagctcagaattcagatccattaagttgtgggctattactctgtattttacagtgtttctaaatacttgataacaatccaattttagctgagtaaccaggaatatattttcttgtcacatgtcttctatggggcatagaagatttgatttgattgatcctgagccaactttggctgtgtgccctccccccccccccccccatgtcacctgttgttactaagatgtctttctgtcattttgatttggtgtctacttctggagaccgcagactcaagttgtgattctacctgcgagttaatatgcttaggctacacttcgaaagcactcttcttgagtacttgtggaatatttgctcctaccaaaaagtttttgtactgctttcaaatactttacacataagcacttgtaaaaagtctgaagggcaggcagattttactgttgaagaaaatgagccttttgtagacgtactcttcccataacattagaaatggaccttttagctaatacatgttatctgactttcccatggtcattgctacatatgaagcatgtctgtttgagcacattttataaaatatataaaagtatttgttgactattccaattgatctctttaggtttaaatcagtcaactacctgctcatggccttcaacacagaacattgcctccataacttcctgctaacacaaaacatttcctctaactcttaactgttggagtaaacaattatgtgtaggagatgatgttgcaaagcgatattcctg

SEQ ID NO: 28412 - DNA, 1215 bp, Mus musculus
actagaagagattggtttttattctgatagacgggcttagtcccttagttggcctctggtttttcacccttgctgttactgcaaggtccccttagttcctcaggctgtgagaataacagagatgaggaggatgacttccagctcctattttagccacaaattgtggtgttactaaggacataattcttgtctaggccttgctaaatctgaggttgacaattctcctttaggagctgcacaatactcagaattgtgcatactgtttcgtaatcatacgaatacagtatgggtatcgcttggtgcagagatttactgcaggggaaggtccagcttgaccatttctgagttccctgtgtgatacacctggtttggatggaggttggtatctatttccagttacaaccaaaaatatctaaggctctgcctcccctccccaaaagataccaagagccacaggtgtgggtcgtgatagcacccatgggaggaatcgggtcaatttccacccaagccaaggttaaaagcccactcatctacggatgagaaaaatcatttgatcacctcagttaggcatggccttattaaacttaattaataggggggagagaggttggagacgtactgttggaagggcaagcccttcactgcctcccaccctaaaaaagccaattggccgtgtactatggagccggtcataccccttctcccttttcccagactatcatccaaaaatgtggaggaatatccactcagtgttattcataataaagtgcatttcaaattcgtacagtcaaccttcaccagggttccaacgttctacttaaaattcaactaggaagttacctattcagtactaattagcattataaagtcagagcctccagctcagggctattctgttagttgtttactaggacagaaaggacagtcttatccagatacggtttaccataagaaaagttaggaaatcccatggagacaggtttttttctttagccctaagaattcaggcagaactattgagcataaatatttttttttttttgcctcaggccagccttttctttctttctttcttttttttttttttattaacaacagggaggagatgtagtcttggaataccttgttttctttatctatggtaattgggagtttttctgggtatagtagcctgagatggcatttttgttctcttagggtctatatgacatctgc

SEQ ID NO: 28413 - DNA, 2492 bp, Mus musculus
caaataaatacttttacatcaatactcttatttttaaaaagaagaagaaccacttttttatagtccccatgtttgccctaggcctgccttaagtggaaggaagattaatcacttaactatattttacaaaagaaaaaatagggctttggatgctattactcgtaatataaaaagtgtgattctatttcactaaggcaattatttttttaagaaatcactataatatgaaaaaatgtggcagtttgtacacctttggtggcttgatttaaagaaaagaatgagaatgtattgatgtctatttgatgaattttctatatttatcaggagaacactttattgccttaagtttaccaaccatgtagcagagcctcctagctttccagcagagctacctgccaaatgagtttgtgtattaaacaatgctgcaaaaagatagggacatcagcattcacttaacagtaacaatgaggacttctaagcagctggaaccaagataccatgctaactctatgcattcccaaagtcaaggcaccgtggaggatgttcagtcaggtcttccaaagtcagtgaacctgattaaccctttattgatatgcattctacacgtatttcaacctagacatcttgttcttgtgtctgctgtagaaggaaactctatctttgttaaaccatagagattatcatggtatacatgctgtgaacatgtatatgtacaagttgtaatgtattctgtgttgtaggcatattatttaatttcaccacgtcatcacttttgtacagtggccaagcagacacctccaactccagcatttccattaagtgcatttgtacattttaggccgctggatccagattttatattggcagttactgagggctaaagcaatatattgtaacagaatgtataaatatttttgataaaacagtctatattttataaaaagttattataacactaaagctgtacctcaaaagtctcacaaataatttgatcaaatgctctacgcatcctcagaggatccgttcctggctttgtatcgctcttaccatatgcctgtttgcaaatcatgatcttcactgggctggaattttattagatttttgttttgtttttcccttttttctcctaggctgtcactctgttgttctccctcagttcagtaatatcaataactctttgcttagcatgttagggccatgatacctcaggaacagcagaatggtaacaaccacactcgaattaaccatgtaatcacagtgagctcatctcttacaattttccaaatctgcgttattgagaagcaggaaagtacacaaataatgaagagttgagcttgaaacagctttgctgacatacattggcctgttgttattgtactctgagaatgattacaattgtccagagattctttatattaccttccaaattcattattatttttcacttaagatcctttggaagaaaattttctaaaaagagaagcaatatgttgctgtaaattgctttaaaatgccagttagttgccttggaagagaacaatagaaaaaaaaaaaatagcgtaattgtctagctttaattgaccagtgttaactcagtctgaaaataaaacactaactacttttgaggtacagtctgcatacctttgttggttctgaaatatgcatagaaagcaacttttcaaatgggcttttagcattaaaaactgacatagagttatatacacagtgtacaaaaatttttttaattgaagtcaatcattaaaaaatttagaggtcagggcatagtcacacaattatgctgaaaaaaaaagcactcatttttctgtagtttaaatatatatatatattttagccagattttaaattttcagagtgtaaatagattttgctattactgtatgtgtattgactgctcaagcactttgtaaggaaagtggatactttagaatggtaccctatgcatccaaatgaaatgtgcctttacatcattctaagaaaaagggggttttgcagtcataaattaccacaaatgcacaaattaaagtttaaaatagattgaaatttgtaattttggttttaagttttcattccttttagaattgtccttgtgttaaaatagttggctaaaaacgttagctctacttggaggtctcaagaaaattatttttagttagctttcttttcatcctggagaaggcacattgtccactttacttggaataatggggagatttcatctaggtctgtattctacagcttctttcatccatgcacagaatggccactgtcactagacaccaagaccaggaaagttgccaggaggagagaagcaatgatgtttccaagactaaaaagcaaatatgctaatgtaaagtgtaacatgggagcttcctcgtgttagagcagtggctctcatcctagggggtatgagaggggttagaatggccacttcataggagctgcatatcagatgcttatattgcaatttataa

SEQ ID NO: 28414 - DNA, 1440 bp, Mus musculus
aaccaaattggactttgatcttgaacctgaacctcctccagccccacctcgtgcttcttcccttggagagacagatgaatcttctgaattgagagttttggatatacctggacaggcaaggcattctaaacattccttgtataagttcttcttaaaataaaaccattatagtggctaacatgtacattgcaattaaaattatcagtatgaagtatgaatttatggttttctggttcctttatgtttgtgttttataagtgacttttctcaggtagatgaaattgataggagatagccgttcttcctgttggaggactgttatcatttgcctctgtattcaagagtccaaaaggaatgcaatgttttgcagacattagaagaagataatatgcttgagggaaggagagctgtttgtttaacaataagaacaaatgagccaatctgaaactttttctcatacttttggaattctctgacttttatctaacagtttgttttaatgagcatttgatattttacagggttcagaaactgttttcaatattgagaatgacagaaataacctgcgtccaaaatccaaatctgaatatgagctgagcattcctgactcaggtcgaagctgctggggtgttggagagcttgatgacaagaggtaagggatgagcaggcacgctgcttcgccgtctgtccgtctgtccgtcagccggctggtggctggagtggagttgatggcctcatctttaatcgttatgtttcagagctcagcagaggtttcagttcagtctacaggacttcaggtgctgtgctgtcttggggagaggacactttggaaaggtaatctgtcagcactgtagaaatagcgtataggatgagaaattcaaatagaactcagttatttattcttatttcaggtgctgttggcggaatataaacacacaaatgaaatgtttgcaataaaagccttaaagaaaggagacattgtggcacgagatgaagtagacaggtcagttttttaaaatgaagtttttccttgtggctagagattgagagagtagacagcaatggatctgagttcctagaaatatttgataatgctaaatttatcttctatggcaaaactagacattaattaaatgctgtttttcttttcagtcacctctttcccttaagccaggtttggtgataccaagtaaagacagggaaatgtttaaaataattctgttaaattttaataagttacagtattgataaagtattaaaatgtaactattactgatttgtgacttacttagtaaaactaatcacattttcacccgtgacgcagataaaatgtcatttcctgataatatataagtaactcaatggttaatatagtctgtgttttgaaatatacctttatgaattttcctttatgtattaaaaattatagttattggggaa

SEQ ID NO: 28415 - DNA, 1173 bp, Mus musculus
gtgtccctatttgctagtgtggatatccactatgtttctatctcattaagttatatatagcagtatcctcagatctaaagccttttgacagatgtgtgatttagatgtgtaatggctggctaaaacaacattctatattttaaccttttatttcttattactattgtggttatatcaatatttcatttctttctcctgatttttttaaccagtacattaaattatgattcaattaatagtaaattttctttcttttttctcctagcaaaacctgtgataagccctcttgagcttcggatggaagaattaagacatcattttaagatagaatttgcagtagccgaaggtgcaaagaatgtcatgaagttacttggctcaggaaaagtaacagacagaaaagcgctttcagaagtaattttaaaaacaatttttagccgtttattatgttatttgaagaatatcctggcttaaatgacaacaatatctcttttcctaacaaggcacaagcgagatttaatgaatcaagtcagaagttggaccttttaaagtattcactagagcaaaggttaaatgagctccccaggaatcaccccaaaagcagtgtcgtcattgaggagctttcactggttgcgtcaccaaccctgagtccacggcagagcatgctgtccacgcagaaccagtatagcacactgtccaagccagcggcgctaaccggtgcgtagaatgtaactgtcttggttttgattatataagagtatggattaatagttggagtcagaggcatatgtacaggaccttccttcaattatattttaggttcatatagtaaactttactatttgctggggctgatggcacagcatgtaaacttagctacgtgggacactgaagcaggaggttgcaggttcaaggcttgcctggacagcttagtaaaaccctgtctaaaaataaggattaattggtgggaacgtaacttggtagaacagtgcttgcttagcacacacaagggctcagctctgaaagaaagctttctaagaggcttgtaatataatacacaagcattattatcactgtcaagttctagaacattttcagcatccctaaagaaaaccagtgtccattcaatgcactctttttcctaggccccagcaccactacttaggttcttgtctt

SEQ ID NO: 28416 - DNA, 1196 bp, Mus musculus
atgtagtatttgaaaaccttgtaggcataactcatcttaccacagactggtttcaaattcaccaaatagcccacactggccttaatcatgtaatgatcctttgatcttagcctcctatgtgtagggattatactgtgccaggcgccaaatggtcacttctgtggggagtaagctgaattaaggtagttctgcaactcaagtagttcctttgtttgagttggttgaattctttattatctgtaagcacaaggagatttcatttaagtgacttgaaacttatttcaaactcttgttttttgaatacattaacttacacattatgttttcaatgataatttttattactatatatcaattgtatgatatcatgggttttattgtgccattttcacacattcagataacatattttggtcagattcaccctgacatcccagttttaagcaacagttgattctagtaacaatcatgtgatattttgtacacagattgtccgaggactccagatactccaaatagtgactctcgtagttctactagcaacaatagactgatggccttacagaaacaactggatatagaacttaaagtaaagcagggtgcagagaacatgatacagatgtactcaaatggctcttcaaaggtaaggaaatccctagtatttatatgttccgtatatatgagtttgcctaccccctaaaatttcatttgtcatcccaggatccgaaataggagtaatttgactgtcattgttagcctttcagggtgctggacttggtttgtctggcaatccgagctctctgctaatgtcagcaggtgattggtgccttccaaagctctcctggtgtaaatgggagtcgttttcattccatgtagtgctccatttttcacatgtttatggtttcagttggtaagtttagagttctagtgaccctgagacaattttagctgcacaattggaaaatatagacaaaaaatagaaatgtttttaaaacaatagtataaaaattgcatagtctctcaaaacctaattaatggataaggaacatggagttctctgtaacttttctataatcctaaaattataccaaaacaaaagttatttacaaaaaaaagtctaggctaaaatgggttttccgaccaagcaggctctgggaaagggcaaatgaaagctgacatcctagcatcacttgcgc

SEQ ID NO: 28417 - DNA, 1221 bp, Mus musculus
atggggtactttgttcttttttaagtgaactctgtccatgtggcacctctcactttccagggctccctgctcttgctagcagaagagcctaggatttttgtaacatttaataatcacaattttgatgataaatagctttgagtcttcttaaggccaaccttgaaatttccctgaatgtcatattgctgttgcttttaccgcatagctttagaaagagcaagtcaaaggctaccccagagacagaatgaaaggaaggagggtaactcagtgccatttgtattagtgtactgtcccttcaacatggcttccctgcatttttcttaacacagctctatcatttttgttgccaaattcttccctgaattttcatttaatcatagtaatagctaaagaattaaattgttagaagaggtcctcatgtgtgttttcctatagtcaaattagtatttataatgctggagaaaagaaaccatcataaattatttgtgtggagggatgtaaattaatgcatttgctgtgccaatcaatatgaatattgaaagtagaatagccatatgatgatgtgcctctctgagtacatatagccgaaggacttaggtcgacatatagcagagaatttgggcatcgtaaagacgtcttcacaaaagtcaatgtatagtcagcatagatgtttgtaagtagataaatggacaaagaaaatgcagaatatatacatagtagagttttactcaagctgcaaagaagaattaaattatgttatttgcaagaaagtggatagaagagtgttattttactttctcatgttaagtgaaataagccacatttcaaaaagacaaatctcgtattttctctcataataccaaatctagataaaataagcacacatgcacacatacacaccaaacatataagacatgaaacaagaggagggactatttagaagaggaaggggattgaggccaagggtagacagtgtaggaggtgtaacttttggttccttctaaataatattcttattaggcaggctagaagaatagaaaaaattatttccaaggcagagagaatatatacaatttggatgaacagactaaaaatacctgttaatactttgatccagagatagttgtgactatttcaatatctttttctcttcttatattaaacataacatttgaaataaagctatgtatacttagcaatatgccaagtcagatatactgt

SEQ ID NO: 28418 - DNA, 1171 bp, Mus musculus
aggggatccaaaggcaccagccagcaatgtgctgtgcagacatagatgcaggcaaaacacacacaaaataaaatgagtaaattaaaaaaaaaaccctcataaaccagaagaataaaatcccttatttctaaggatgatagtgattgtgtgaatgtgtgtgataactactttgtttttgttttttttaatagttaatatgagaaaattgaaccaatctcagtttttgtcgctctgatgagttttcccgtattttaacctgagagactgactttggatccatatgaacatatgccgaccttcagtgatttgtttgtttttaagagagactgaacccagtcctacaaatactggaaataatctaatagtgagctatttcaccatcccttctgagaacaattttaagaagcaaaatacatgcttttattctgtcctcagtatcccacattgaaaaactacataataaagggttattactttaaggaaaatttaaagagggatgataaaaataggaatagaagattaagcttttgttttcttgtatacttaccctgatggtggtggtggtcctctatgagtgtttgcgtgtgcacacgcgcacgtgtgtacgcatgcacttgtgtctgtgtgtctgtctgtgatatacttattataagcgtctctgtaggggcctctttggctaagtgtagtagttgagctaagaaagagtaccagtttacagaccagttctttatttgagtaaaagctttgtgtttttagtttcttagagtttcttagttcttaactacaactaaaattaatgagctaatatgaatactagtatagagagattgtaattagctattagtaatactagtgtgtagtagaggaaacatgatttttaaaatacaatatatatggatatgtagaaaagtcccttctataatgaagaaagatatatttaaatgaaaactgtccattctttgtaggtttttactatagatgcaccagaaaataagcctgttgcttttgcataaaaaaagaaagaagaaagaaagaaagaaaagaaaaaagaaataattgaaatagcaaattctttcatagttggctctttgaatattagcattttatctcattatacttgcagcagctttttctatataagcaagaatacaattcacttagtaatttagaa

SEQ ID NO: 28419 - DNA, 2248 bp, Mus musculus
ttattcttgagagttcgcactaaactcttaggtagttaaggcagcacttagaacactaactgggactttccctaaactgtcctcataaaagaccaggtaatgagtcaggtctctgtacagctcttactgttggaaagtcgctgtcacagacaggagaggcaaagggccgtggttagagcttagcaaaacctttatttacagaacagaaggcatactagatatgaaccatgagccgcaagccctcgctcaccctgtgagggattgtcatggagaagccctgtctgtgtccggaccacgttccccaaagagttcctctacctcccatgtctcccagatcgtgaccccaaggactgctttctgactcagtccctccccagcttccttctgtcttaccttgctgtcaggtgactcgttttcctagctcacctgtacagattcgggacatttcttttatcgctttttggagcgaatggattccaagtgtcctttctggagactaagaaaagggtgggcttgcttctctaagagtcctgggagcctgagtccttagaacatataactgtgtaatcaaatgaatagaaccactgagacaatgtgtattttttacatgtggcaaatgcttttctttttttggcctttgtgctttttcagtaatttgaccttagaaaaaaatggtttttatatgatagtaaagcaaaataaccactttgaattttaacgataatgtcaatgtgtgtgtgtgtctatgtttatttcctacagaagaagaggtagctttgtgtgttcagcttgtaccaaccgtcttcttattgctgagaaatggccactattgataaacctttctgttttaaaatgtagtggggaggttatgttttgatctcctctggctttaatttctagtgtcacttgaatatatctggtagcaaaccttgaagcaccgcataggagctgcttctgtgtcccctgatagtcacacagtccctaacatccgctgcttctggcctcctgagcattggatttaaatatccaaaaccctcaaaactccaagttgccagctttttaaacacttgcttttcccttctgtgctgaaaatccagatagcacctataatttggactctattgatcttcctcattatgtgtcctgttggaaacccctaaaattgtctgctccatcagggaacttaccagagtattttgatgttgtatttgcatagatggatatgaaatagtttatagatgacaattctcttttttgaataaaatgaaatttttgaaaaatctaaaagtactagagaacttatctaaagcccagttccctaatgcatagctagtgttttaatttatgttaaaattctgctcagagaccatctgtgtaagtcatcttgccagctttgccagccatcattttcaaacatagctatggtcccaggagcctttattatgggagtatctggaacctaagacttctatgaaacttgtgttttaggaactcaaatgcttctgcttcgtgacatactagtgccattgctgtcaagtcttcgcatcgttgtaccttggacagagttgctttgtgcagggggtgtgggctgggggagtacagacagactgctctgcgggcagtcttctgagaggaaagacattcaaggggctgggtggccatctggtcacattcatcctatactttaatgccatgtggcttgatgacctttgcagtgctatttctggaatggaccctgattgttatgacctgttaaaggtgaactctcgagccatgtagacatgctgttacagcctgtccagagtgaggtcatgggagcagctctaagtcagggtccaatgtagcttagagacacatacatggtgaatggcggctttagctaatcatgcccaccccttccctgccctctgtcccctttcccctctcctcccctctccctgccctctctacccaccgctgtcatttatgctacactgaccaacttaaaacgactttgtcacatcccttagagagacagtcaccccctttcctcagcattcttacaacgctgtgccgcttaagtgttcctgtctgatacctggaagaaaagctatacaatcaacactgcaggaagagggaatgtggctccacggctgcgtgtcctcgtggaacgttttcttctgctgctttgatgctaaggtgacttggtgtttggtgtcacctgagagctcagatactgtcaccagaaagccctgggtcatcacccatc

SEQ ID NO: 28420 - DNA, 1179 bp, Mus musculus
gaaagattcccaggtcgtaccaaaaaggtttgaaacatttgctactgctttatactgtaaagtctgtttcactgctaaagttgcatttaactacatctatcacctttcctagaaaactaactgctattgaaaaccatggtgctggataatgacaaagagccagaatgcttatttctctgctgtgccgtgctgaaccaagtcctaaacatttccatggtgcactgcctcatcagtgagtaccagtgagatgatgcccaccttttaaggatgttcattcaggcttttgagaaaaagtttagggtagtcttactagtagccaagtgaaactaaaaatcaaactactgtttgcaaagccatgtttaggatgtagcaatagcggcatttctcctggttacttttctgttactgtgataaaataccacaagcaaaagcaacttaaagaggaaaaggtttgcttggcttgtgattccccaggatagagtgcatcacagccaggaaggcggcaggaagcttccacacagcatccacgcacaggaagaaggaagagctggagtgagaattttggcttctttaaaaacacagaaatataaaaatattttgttttaatttcaggtgtgggatttggggctgcttcagattgtcaactgcagctgactctgatttgccttttgctctgtcaggggcacgattttgccagctgcagatagttttatgtgtatgtgatatttagaattctgggggcttttcagaggatatctaaatacaggagcccccaacagaggttggccggtttgttaagcagttgtgcacaaagaagagatgagaagaagttagataccctgatggcaaagatcaaacttgctgcaaggaacttgacacgccgaatcagcacaaagttgtctaaggttatcttcacacacacacccctccttttttcttttccactttgtgttaggggcttgaaagggtggaagaagaggtgcagagaaaggtggagaaagaagaacccacaaagtagccagaggtccggttacagagacctcaacccaggctgtgaaccctcagtcacacaccttcccaagcaggttcactaagtgggactaagtgttcacatacatgacccctgagggacaaatattcctattaataaacataaaatccttctgaacacacaaaaga

SEQ ID NO: 28421 - DNA, 1653 bp, Mus musculus
tacattgttctgtattgtctgtcactgccgttaagtttactggaactgagagagccatatccaacaatgggccttaagtcagcttaaatcttccctgtaccagcacatgctcttctctctgaagtaacatggcgttttcttcattgttgtcctttatgaaatcacatttgggtctttgctgaaaaagactgttgactgtaatatgtgtaaaaacttaaattattagcacaattaatctagtattttgatcttgggtaagagtgaaaatcctcgttctaagcagacagtgatgttgctatctctggtctttgtagtatgttcgaggctcagaccctgtactaaagcttttggacgacaacgggaacattgctgaagaactaagcatcctcaagtggaacacagacagtgtggaagagttcctgagcgagaagttggaacgcatataaacatgcttagtagtttttatactaatcaaatgaattatcacagcacctagacaataacttagttttgcatgcttacattggtcatcctttttatgtacatcattaatcttctgacaagaagctgaagtagcaccacagtccataatatatcaggatctggcaagcttaaggaacccagctcttagaaatttctcttcttctacacttgttgctctcaccagtgaaacgctttgtaaggaggcatctgggtaattatgcaaataagtttgtgataattgctccagttctacaaacaacagaattttaaatagaggaagtggataaaggagacacctcccttgctgtgtgctctttgaaagtaattgacagaaaactacaaacacgtaggatgccctgcgcctcagcagcacccaccccagagcctcttggcatgcccagctttcttttcagtacaagtatttgtagtttgtaatgaatgtgccacatacaggttttgtagcttattattatggaacagactgaagatctgcagtacgaatttaatacttataaaggtttgcattaatgaggattacacagaaaacctttgttaaggacttgtgtagatctgataattggcaaatttttattttaaaagtattcttacagaagagttccatttaagaatgttcacttataggaccaaaatataaataaaaactttcaaatatgtttgattttaaattagtctgctttgtcctttcgtgtttcttgatatgttcttcattttcatacaagctcttttttaagccaaaatacaaaaatggctgtactgtttggaacttaataccgtctgttataagcagaggttggttgttaattatcagctgtcctttgtcctgtgacatctaaaatcaagtctttataaagtcagtaagagagtgcatataaacctgcatgattacgctcctgagaagagagtaagaaattctggcagaagccgctccttttgatcagtgcggtaatgccgagggcggcgctttgacagctccagtcctggtgaatgtgccctctcctcggtggttattgctattttagaacaagagggagattaagccggttgtggacagagactttgccaccacagacagaagaatagaggtattgaagaatgaaacttcaaaaaagaacgtctggcattgacatagaaaataaattggactggttt

SEQ ID NO: 28422 - DNA, 1141 bp, Mus musculus
gcggtagtcagttgtaagaaccaccgcagggccgacagaagtggccattcaccctcaggcaccaacgattgacaacacttgaacatttccccttgcctctgttagccttaccgccaccctcactggttgaggtcctttcagacccgtctaagaagtgggtccgaaggtagaaggatacagtcagtgtcagtgaggagaggactgcgtagaagagcagggcctgggtgacaggagtctgggaatgtggacctacctctacagcagtgttctcacctgtgtcgtatgaccctttcacagggctcggctaaggtcatcggaaaacacagatatgtatttacattatgatttgtaacaggagcgaaatgacagttatgaagtaacagggaaaagaatgttacggttggggtcaccataacatgaggaactgtattagagggccacagcgttacacaggctgagaatcacagctctaaagaaagtgagctctaaccaccatacttccatacagtgcctttgaactggggtttagcttcaagacaccctgagaaaccagtgaagcagtattagactaatgtatgcacacctctgtacctcagtccctaagctgtaatctaactcctacgacagtagactttttaagaattgttaatgcttttttattaatacaagtcataatatgctgacaaaaagaaaaattttagaggttaaaaataaaacatggcctacagttccactatcagagaagtgctatgactgaggtggcctccaggctctctgcacacttacagatttttttaacgggatcaaattgtacatgctgttttgtaactttttcactcaacagtcccatgcctatcttgctgtgtcatgtgtgtctacatcttttttaatggatgcatgatatttcctcatatgtgccacattttgttaaactactgttgaatttttaggtttccagtttttcactaataaactgctttgaagagcactgtgctgctagctctttgtgttcctaactctttcctcaagtgctacatggcttacatgtgcctgggtccacagatgagcagtcctcccctccacctgctagtggggacgctgcaccatccatgtcagtccttccctgatgacctcaagtttc

SEQ ID NO: 28423 - DNA, 1176 bp, Mus musculus
ccattcaaaagacatttattgagggccaggtactttgttgatcaactaagtacacctctaacaggattgatattgtgatggaagaaataaaagtgttgtgtttaggaattacctggtttgggtctgagaagtcagaagtagaatcccacgtagaaggaaagacttgttttgggcctagaaccaacagaacataaaattgtccagagtaccttagtagcggagtacaaaggtgtagttcacttactcacagagtcttgtaaacttttgagccctaaagtactatttaaatagcactttaaagcatccatttgtgttaagagcttggtaaacatggaaaacttggttcttggtctcagcattaaaaacccctttctctgcagtcagataaattcctctgcagttttctagttctgtaagactctgacttacacttgagttacatacttgagggactccagagacaactgagatgctagtgttctagggaatcaagtgaatgaggtttgttgttctttttcttcctcagaaaggaagttttatagcctaaagcgccatctgttatatttgtccaaaattaggttttgagggactatagaaatttgggtgactttaaacagcagcttcagttcagcaaattcagtttatgggaaatagatcagtgcaggagaaaatataaatatggactgaattggttctggtttgtatcctcacatattgggctccctggagttcaactcagatttagagctgccattttttatcagtataatgggaataagcattgttacctagcaggagactattccacaagtattactttgtgttttgtgcttttaggcaaagacctggcatatagtacatatgctgtaagcccagatgtccttttcagtccctgacacatgggcagtgaggaacatgtctgacctctgtgctgtgcttgcccccttcagcccattctccacctcccggaaacccgagcagagcctcctcaccccgcccacactcctcaccccgcccacactcctcaccccgcccacacccctcaccctgccccacacgctcctctgtgtaagctctgtagcaggacccggtgcttccagcaggagtgctggttactgaagatgcgcttagacacaagaggacccacccaggctgtagtgctaagaggagcaaagg

SEQ ID NO: 28424 - DNA, 1143 bp, Mus musculus
cagagctgtagtaaatttagacaagagggaaagagtcagcttcctcagatcaagatggcggccaccagagtgagggcatagagagatggcgaagcctggggtggtgaagctggcttggtgtggcagaagagtgcaagtgcccgtgttgatggactgtgagaagaagcaggtaactgataaggaatggagttgtgaaagttcctctgagtttctggcctcggcatgatccttgagggctgcatggtctgctgctgcccagcaccctcttcctcacacggcagaagcagcttgttttccttgagagccaagcttcctccttccttcccactctcatctccaaaagcttcttcccctactcctgccctgctgaaattctgttcctctcaggtactttcctgttctttcatgactgacagttgttgatttgtgtggccatttgttcccacacttctctcttcactgctctggcggtatctgacagagcctggcctacagcatgaagcgcatacagggctactggctggacgagtcggtggatgtggagatgcccaagaaagtgggaaaactccagtgtgagagaatgattaactgtatgcccacaccaccccccgggcactcccagagatggtcagttctgccagggcttctcctctgactgccctccaagaatggtcagagtcaggggtggacacaggagtttatttgccaccaggagacaaaatcaaattgggaagtagaaatttgaatgggaaagtagcaacagaatccccaatgtaacagggttccaactgacagaagctacgagttactgccttgtgctcttgggagacatgctaagccctcacagggcctcaggaacagtcccttgcagaacaactgcagagggctggtcaccgtggagcatagcaagagagcagctattctgactcttgacaaatcctgaagactgattcgagtctccctgtttgctgctaaacagcaaattgcactcaggcctctctgctctcaggagcagtcttccttctggagcatcccagagccaggctgagagtcacactttagtcaggagcctgatgtgtggaaaagtgattcttggccctgtcttgcctagttttatgtcaggctgacccaagctgaagttat

SEQ ID NO: 28425 - DNA, 1113 bp, Mus musculus
attggagtggtgacatacagggcgcagtagatgcacaagtctcactgcctgggagcacagaagaaaaccaagaagagcagtgtgcatcatgaccacatccctgacaaggggcaggtgagggatctatggcacagctcatctcatcaggtagatcagatagagaaagacaggggcctagaagtggggccagactgtaatgctcaaggctggtaaccccagcatcccgttcttccagctgtacccacctcttaaggtgccatagcctccccaggctggaccaccggctagagagcatcttatttatttcatattctgacctcatcaaggtccaagactcatttaaaaggaaggggaacaggtttgtactctgctggtatgatagcagctccaaaggcctagggactttaagacagtggaggtagtttgtgtgtctagagggcagggtagtgagtcctggtgggctgcggacaagcctgccgtgctacaccagggatgagtcatggtgggctgcggacaagcctgccatgctacaccggggagtttattgaggtaaaccccttggacaggcgatctgtagtctgcccctcctgatttcctgctgattcctagggtgtctccctctttggcgtcccctcactatctgtgcacatgtacacacagctcatctgctctccatcctgtctctcgtgcctgagttcctgtagtactcattttctccacagttaacatgaaacagatgtcggcatttaataccactttttggtatgcatatatctgctcatcttcctgtctgtcatggtgtccccataggggcgtgtgagtattttgaaaggtatatttggtgtgtgtggaacctttgatactttttagaaaaacttgtattcctgaaccttccgtagtaaggaagtatgtatgtgcactcttggaggccaaaggaaagccctttggaactggagttttaggtagttgtgagctgtctgatgtgggtgctgggaactaaggctgggtcctctgggagagcagcaagtaccactgcgccttctttccaggcccagagactacgaagtcgtaagagaagcaagaaggcttcactggtgatcacatggggagaca

SEQ ID NO: 28426 - DNA, 1367 bp, Mus musculus
ctagggcccagcctgataggcaagctccaggttgagtgcaagaccttgtctcaagaattaaatggagaacaataggaaaacagtcccaacatccaccgctggctcccaccatgaggacacagaggtgtgtatacacttataaaacgtgcacacacgcatgcgcacgcatacacacatgaacaggctttggtgcgcacacaaatagaaagttatttaagaaagtaaatggtgaccatgcttgaactttgaagtttgctttcattctctctcattgtttccctcctatttctgaaaggcatcttctttctcctaaattacgaagagtttgaagctcagtaactctcagacaaaggtaacttgggcaacacgtggagagagtctccattgccgtagtgtgggggggaaagggcacccgaggatatgactgccgtgtagtgggcagaggttagatgagcaaactctatgatcgttaaatagtgaagtaaaattttaaatacatatttttaaagagtctagagaagaaggatggctcagccattaaaaacgcttctctcgctctttccgagctgctagcgctcctgcgaacatggtgaacgtgcctaaaacccgccggacattctgcaagaaatgtgggaagcaccaaccccacaaggtgacacagtacaagaagggcaaggattctttgtatgcccagggaaagcggcgttacgacaggaaacagagtggctatggtgggcagactaagcctattttccgcaaaaaggctaaaactacaaagaagattgtgctgagactggagtgcgttgagcccaactgcagatctaagaggatgctggctattaagagatgcaagcattttgaattgggaggcgacaagaagagaaagggccaagtgatccagttctaagcagattttgttatgaagacaataaaatcttgacctttcaaaaaaaaaaaaaaaaaaaacgcttctctcacagaggacctgaattcagttctcatgtcaggcagtgtataaccacctgtaactccagtccagaggacctgacaccttctggcctctgcgggtaccttcttgcatgtgcacatacacacatacacatgaaaaaaataaatactttcttaaaaacagctttggggactgggctgtcacccccatacctgtcaccccagcactgagaaagctatatagttttataatttaagaatcacgatttaaaagaactgtttgaaattatataattacactttaccacatttcactcaaatcactataaaaatacataaagactacaaattgttaagtagacataacagcggaaaggtgatgtaaagaagacaggagccaagttaaagaaggcatccct

SEQ ID NO: 28427 - DNA, 3193 bp, Mus musculus
ataggccaggatgtaacgccctctctcctcttccttcttgactcccactgtctcacaggtctatgagaaactcaaggaccatctactgatccctgtgagcaactcggagatggaaaaggtggacggcttgctcacctgctgctccgtttttattaacaagaagatagactcctgagccagagagtcccttccctgtggccagcaagtggccgaggccaggctgatggctctgtacctattcctcctttttcctttgacaatctactgggccactgtgctactaactcttgtttacaaaaaaagaaaagaaaaactaattccaattttaatcacctcattccccacaccctccttttcctcacggtggtacctaacctgtgcattcgctaaaagaattaagcaacctaggaaatacagaactaacgaatcattggaatgcaattgatagcgtggaagcccctcacttcagtgtttgtgtccttaatgtgggaatgatttagctgcagggcattctgaagactgtcttcccggccagccagataagcaagggactttctctgtatcatgaatcaagcttggctcctgtgaaattccctagaacgtggattttttttcccattcccctctcttctcgcccctaaaaacctttcttctgggtctttctgtggtcttctccgcttctttcgtaatcgccttgaccttggatttacccaagctcttgcgttctggatgtcatcccgaaggtccaacctgtgtgcactcctctctctctgccttacagccacctctccaccaccagcagcaagtcagagtggctggtcggggaacaggaacctcacagaggcacaccctgacaggctttcccattgccacacctaggaaggtaaatccagcctcaggtggttgatgcaggatgttagatacagatgcctagaaacaccccatgggtacatcttagagagactgagtcacatgccatgagtttgcctcatgactagtcctgtagtatggagggaagtctttctccactccaccacctccgcctttctgagcttccttctgactcgccttgtatctacccccttagaatcatcatgatcttgagaaagtcatttccttcaaaagaggcagagcatgtacaatgattgctgatggtccggggagagccagagggggctgcctccacccaggcctgggagcgcagtcaggaaatggttcctaaggtcagcctcaaacaatgtctgagtctcctgtgaaatatccatgattgtttactgtggaattcaagtgaaacttcaaattacacaatgctcagctggcacaggtcgctcacagagagccatgcatgccacagcaaagaaggagagcattccttttttttttttttttcttaaaagctgaaacagagcagggacatggtgctttacaatgcacagtgacccagccaggcatgtcatcaaagttctggtcacttctacctttgctgtacagtctgcagtttgtcattcagtatttaaagttcaggagacaaagactaagtcagatctatctctcctttgtgatcagtgtttctcataatgaagacaagagaggctggtctccattgcattccccccagtggatagaagtgagacaatcagggcatccttcatcactcttctcatatttggcaatctctctgaagacatctccatctcttccttgcttctctaactttagactcatagcacatgcaaatatctaactctgtgcaccctgcgaatgaaccatatcctgatcactgtcatatttcacaacatatcatgagtgaataattatgttttttccagggtaaatgaatgtgagccagttgcctaaattaataaagaaaacttgttctcagcaattatggttgcctttgggggttaaatttgaccatatactagtaaaaacaatttctccttgagagaggtgaccatctcaaaatccaccacaggaaaaacagcccactgtatatgtaccagcatgcaactgtcactgacgtcctttctctcatcctgttacgtgcagtcagttacgagtgagtagattttccatggcaacggtttcttctaccagaggtggttttccagttcccgtttcctttgcgctcctctttccttgtttgtcctgagaaattgactagagttgctgcctcttccccatcttactctgctcttcagaccccctgtgtgattcagagatgtgaacacgcaaaatacacgcagcattgccccttcgatgttctcatcacataacgttacctctaaaagggaaaatcattgccccagttcccctctcgtccgttgtgtctcacaaagatgggaagaccaacaaaaatgcttcttgatattacaacaatgtgaggagttacatttaactaagtctatagcttgggtaagaaggatcaggtcagtatgagttggtttagtgaagagatgagctagaaggattgcatagttagcactatgtctttaactggtgggttgctgtaccaattggttgcagatctccacagcgtgttcattgcactaaaatgctactaggaaccaaacactaaggccgtcatctctatatctctaagaagggaagttaggccaggctgtagtctcacagtgtggcctgtgtagggttgcatgctactctctaagacattcagacatagtttctgtgcggtgttaggtttgtgcttttttttttctatcttcttgcctgccatcttccagccaatgtgtggttatccagtctgtgtgccaaagtcagccatatctcccacgacctgttagtccagaggagttctgcaccgacgctagttgccagctgcctgctcctaatgtacaccagtcaagacagaataaaatgtgagttgtaccgtgcccagtagtgtctgtctcgtttcttcttttaccatgttgcccagttggcacgttatggcattccattcagctaagcggaatgacttttcttcctttgttcctgatgggaagtagtaagggagacggaggggaggaggggagagggcagaggacaaaggggaggcagggagaggacagaggagtgtgcgtacacgatacacttacaggaaaacgtctgtgaaacccatctctacgtacagtgaataaacagcagcaaaactgctttgaaatgagggttttttttaatttgttttacagta

SEQ ID NO: 28428 - DNA, 1200 bp, Mus musculus
acttttccataatgtcctttcttttttattatttttaggtgtttgcgtattttgaacttttcataagattaattttatcggaatatttctcaatttgagaaaacaacttgtggattgggaataatgtttttagcacatttatgctacaaattttcagtctgattgtttttcccactgatctggcagtatattttagcagtaagctgttgtgtttcaggaaagctggacacgggaaagctgccgacacactcagcagtgtcccactccttagttctgagaagccgtcgggttctgaggagacacctggtggcactgagcctggtgacctcagtgggccaaaatttgttttatactcaccctgccagcgtgagtgtcttactttcacaggccttgtgtcctcagtcttatcttaaaggatgttatcttggcagggcatcacttgtaattaatggatgatacttgtaattgactaaagtcctcgctctgagccgtttgttctggctccgagagcgctgacatgtgaagcatggtgagcagcgagggaactgacaggatgtggccgtggccagtgtggctttagtgtttgcatcaggcagccaccagctccatccgtgttcttactgctttacaaagtttgactaactttacacattttaaaaatgctgattgtcttcgtttaaattataattttacctatttcttgacatctaactcctattcatttctattatttaaaaattaagaaatgaaaatttgctattaacaataaagtttttttaatgtagtgatgtgtctgagtcagaaattcaaaatgtctgattttcaaatgtctaacgctttttaatatactggttttaaaaagaaaatatttcagagttaaatgtggttgtacatgtgtgtgagtctgcacttaggggttgaagccaaagcccatgagtttgcggccagccgtggttatggagtgagtccaggttggccagtgtctgagttagggtcttactgctgtgaacagacaccacgaccaaggcaactcttataaggacaacatttaattggggctggcttacaggttcagaggttcagcccattatcatcaaggcaggaacatggcagcatccaggcaggcatggggctggaggagctgagagttccacatcttcctctgaaggctgctagcagaatactgacttccaggcagct

SEQ ID NO: 28429 - DNA, 1148 bp, Mus musculus
ctttccctctctgcagccgcgcaggccccgcccccggagcgcccacctcgggaacgccgcgtgttggcccgcgcgccccgtcgcggctctagttccggggcatgcgcgctgcggcgcccgcgcccccctctaccgacccgccgctgccgagttatgccaagtatgtgaggagctggcgaggaccggccgtggtcatggagagccgccgcctccgcccgcgcgggactcggagcccgccccgcgccccgggcgagccgggctgctgagggcggcgctcatggcggagcccctgcggaggacgctcggccggctccgagagcggcacgctcccggcgcgctcgggctgcacgcggactccgtggcggcctcgctctccgagggacgctcgccgccccacgagctcgcgggccccggtatggagcggcccgcatgggggaccgagcagccgggcgcgcgggtgccatggtctcgcggggcgcaggaggccgccgctctgggccgcgcgcttgctcgcgcctccccaggcgcctggggcagcggcgacgacgacggggaggacgagggcgccgactactacgagaacctgccggcgggctgcgcgcccgagggggcggaggcgctgcgggcctcgccttcccgagcgccgggctcctccccggggatggagggcggccgcctggagacgggcaggctgcagacccagttgcgagaggcctattatctgctgatccaggccatgcacgacctaccccctgactcgggcacgcggcggggcggacccgcgggagcccgggctcagggccagcagccgcctctcccccgcggcgcagccgtgcgcccagcctgcagcctccgaggcggcgaccgccctccgcagcaggtgtccccgccccggtcgcctccgacggagtcgagagagggacggcctcccagtcctcggatacaactgtccagttgcagaagtctcgagagcctccgcgtgagccggcggccgcctctgctccagcggtgggcgagcgacagctgcatcaggtgcggtgcgcaccgggacagggacgagccccagccacgtggaggtgggatggacggctggagcccgggcagccacagggctgctacgtccgccgctctcctgcctcccatctgcc

SEQ ID NO: 28430 - DNA, 1278 bp, Mus musculus
tagcttgcatttttttccttagagtttcatgacacttaggtatccacttggatttctaaattgaaattaaatttcagtgggaaaaaaattagtttttgtggtttgactttgatctatgaatatgattaatgtcactcttttttgttttgttttgtttttcgagacagggtttctctgtgcagaccaggctggcctcgaactcagaaatccacctgcctctgcctcccaagtgctgggattacaggcgtgcgccaccactgcccggcaattaatgtcacttttatttttaaacatttaaatacccggtctgcagtgacatgcctctcctctgtgttctctcttttgttctttgaagcagacttatttgagaatgtctatggctctccactgaagaaacgagaacctgaagatgtaaggggtcccgccgagcttagaggtcaccagccccttaacaacatcacagtttcaaagaagcgcaattggctgtatcagagcaccctgaggtctcagagtctggacgagagcaagcgaagccaggacagacgctatttctccctctctcctgtgtctccacccaagcattgggtatcccacaggccgcactgcacacatgcggtgtgtaatgctgccagggctacgttgtccagaaacggctcttcagcctttagcgaggacaatgatgcggacgatgaaggagaaatatggtacaatcccatccctgaggatgacagcttgggcatagcacacgtcttgagtcttgaggaggcaaacaccgccgccctgaagcttcctgtgagcatgttgtctgccagagatctgatgaaggcggagcctcctagtgaagacagaggggacgtgcagacctcacagtcaaatggaattaattctgcagattccatgcattctacagaaattatgcagcactgcaaacaaaggttagggcacaggacacaagaaagcccgacggcagaggatagccctgtgttgaaatctgcttctacaggtaaaggtggctgttcacctgagatgtcttccttttcaggtttgacatttcctcaccctgcacacagatgatgagtgctgtatgtgtcttatactctgtccttataaagtgaaggtgtctcaggcctggagagagatggcttagcatgaagagagcttgttgctcctgcaggaaacctgagtttgagtcctaacacccacatcagttggctcacaatcacagccaccacctataactcccagaggatccaacacctatagctgggcatataattt

SEQ ID NO: 28431 - DNA, 1517 bp, Mus musculus
agtcagtcgtctaacttaagatgctcagagttgtttgtttggacttcgctgtcttcccccaaagagctgaaatgctaagctacttaaaaggatgcaaagctttggttgtgtgttagtaacagaagcccctggctctgtgactgcaggaatgcatggcgtttggatggaaacagaagcgctggaatgattgcctcgccaggtaccgagaagagcacttttagggactggttcctgtaaacattaaatattcgtcccaagtgtggttggcattggaagtgtagcctttacttgaatgtatactgtagatttttaacaaagcaggttctatatttattatgtttagtgtgattttgggattacctctttcatatgttttgtgtctgtacataaatatacatgactatgttaagaggctttaaggtttaaaaacttcacaccatgcttgagtatagcatttcatgccaattaaaatgttttcagtggcatggtgtttacagaggttaggaccactgccacatgacagttaagactttatttttaagccatctgggcaataaaaattcaaagccccttcataagctgagttcagataactagaactactaacgttacatttttgagatttttaaagcattgtattttattttatatatgtgaatgttataatttctaagaggaatattgattatggagtaatgggggaaagacaaacgtatctttgaataataatataagagcattgggttgagatatttggatgataaaggatatttaagatagctggatgctcatattttccttaccaaatgggtgccagtacagtcgtgtctgtaccggccagggctttatatcattgccaataattttgtaattaaaaaattttcaactagatccctctactaaagaaataagacaatgtgaagcattgacttttataaccgagacatggcactctgggcactgtgtcgtctcattttcagaacaatcttaggatctttctgtttctgctgcatgtttcctcgtaagaagtatggcactatgatagtaatgacagtaacataaacgtagacgtaggcccaggcttctcctggatgggttttcatccagcagcttttaagtgcctcaccctgcttgtctctacgctgccgacacaagccctcgcttgctgaggcaggtagtccatctgcctttctctttccttgttcctgctgtgactgttgcattaaattcatcatgctaccaaaagtgaagccttgtgttgtccattcactgcgtgactgtgggttccgcagctgccgccatctagctgggtctgtaagacagcccgacctgatgaggcactgccgcggagcaggtggccttaccacagcaaccatgttcagagtttcaggagctcgctcttaagtatgagctgcctggtacacgatcacttttttattctttaaagtttgacattgcagagttactatagtccagaagaggaaacccggctaggatggtgcaattatcttctggtg

SEQ ID NO: 28432 - DNA, 1518 bp, Mus musculus
ggtaagaaataaagaaaattttcatttgtacctgaaaaatacatacatatcttagatatccaggaatataaaaggaagaaacaagtcaatttactctattaaatattcctccatgtttcagaattataattagaaaacttgttttcaaaatttcatgctcaattttctctcctattattgaaatatactgttaaaaatcaatacagattttaaaaatgtgcaactggtagacaagtgaagataatggggaagggagtgcacatgaccacagtatgatacacacatgtatagaatattataataaagcccactatttttatattaatatatgctaataaaaggccaacaagaactatgtgtaacttgaaatggaaatcactggctttggacacagtctttaaaacttagcctttgagaagcagtttatgttgaatgagtaggcatggcttttctggttcctgatttcttacagtacatatgaatatttcaggacatacacacattagtgtcacttagacatttagacagcgtatgacataaagataggcatgcaaatggaatgcgagaggataactgagggatgcctggaccctggactagagctacctgaggagatccaggtgagagcttgctgccagggtcagctgctgctgagtctgaccctagtcactgttcaccctgcagtcgcccagggtccctcacgggctaacactcactgcttgcctacttttcacatttttcttccgcatttgcattttgcttttaagctatctaagaacattattctttcaacttgttcctttttctaaaagactatttttgggaaaataaatgtctagcataaagcagttcttgtttcctttctcaaagcaatcaacacagttactgggctggagcgctggctcgcaggtcagagcactggctctcctccagaggacttgggttcagttcccagaactacatggttggtcacaaccccagttccagaggatctgattcactcttcctgcacacacatggtacatggacatacgtccatgcatataaagttaagtaaaaataaaacaaatcattacattatatttacattatttcctgaaagaacatagattaaatgtttgtatcctttgaactccattacataaggcctatcttctttacatatgatccccttccaaattggaataagtgactaatcaactgtctgttatgacaatattatattttctatttacataactatttatgacagtaaaactatttacttctatggtgaataactttgtatttataaaaatcactttacatttctaaaattaatacaaattaaattatgagacacacatttgttgtgcatgtagttgcaattgtttttaatcaaaatgtgattaacaaaattgtatttactaaaatatatgttttactaatcatttattttgccatcatactggtaattattttgtaataagtaattataaaatatagtactaaaaaataagtaatagacaaaatctttaa

SEQ ID NO: 28433 - DNA, 1192 bp, Mus musculus
atatgtcattgtaaactactttgactttcccagaattttgcataagagtagacactatacacatataatatgcatataaaacacctacttttatggggctggtatctcaacatagtctgtaattttatgcatactactgtattactggttcattgctttttgtttggttgtttttgtgttttgctttgttttgttttgttggttgttttgaatcaaggtcttactatgtagcctttgtttgcctgggacttgttatgaaaaccaggctggtttcgaacccacagagatctgcccacctctgccagccctggctcccaagtgctaggattaaaggcatgcattaccgtatgcagcttggttcattgtagtacagagtgatattttgttagatgggcatagacctacttatccagctacatgatgccagggagtagaggtgtttccatttttgtagtattatccaaataaagtttctttgattgttcatgtccatgtctctatgtgaatgtgtgctttgtttcatttgtgaaagtacttaggaaggaattagagtgcttggctacaccataggtgtatgttaaactttttaaaaaccttttcccaacctcattactgtcaacagggcatcccatctcctcatgaaatctttgtcctattcgcaatagttggcgagggtttagttctcatttccctaacgccctctgatcttaactgccttcgatgatgctgatttgatgtccatagagcttccggcgtgcactgtccttcaaatttttcattggcttttattcatatttgttgtgtagaatttttatgtgctatggatataatattttattgggttagggttttttttcttcatatttgtgccatagaatttctgagtattctcagtacaagttctttgccatggcttgaaactttctcatagttcatggtttctcttgtccttctctctttaatgtctttggcttttaattttgctgtcgttgcattaattaatttatttttttatggagaatgctttgggtgccaaatttaaggattcatagaccaaagtcttgataactttcttctaaaagcttggtaactttaggtttcgggatgtaggacgatgatgtttaagtatgttgggcttttgtaaagatttattttactttcatgtatatgtttgagtctctgtgcgggtctg

SEQ ID NO: 28434 - DNA, 1207 bp, Mus musculus
gggaaagcattgttcttggtgtttggaagtgtctgaggagttcattctctcacttgcctcctgatgtcgattacaggttgaggctccattcataccaaagttcagaggctctggcgataccagcaacttcgatgactatgaagaagaagaaatccgtgtgtctataacagaaaaatgtggaaaggaattttgtgaattttagggaggagaaagatagcctggagctcacactcagcccttgcacgctgtggaggtggaaggtggagccgagacctgcttgttggagcgggttccaatcccttcattccagcaactgcgtgaggtctttcctgcgtcatcagtgtgcgctcgctctgcaaccacctgtgtccccaggcacggctccgcagcatcgtctgccataacacggtgtgcaccacgtcctcctggtttggtttttctccaccctcctatatccttctcattcacttctctgaccagtgctccctttattttcctggtgtttcagatgggcagtgttatggctgtgtgatatttaaaaggaaagctacatgttgctttttgtagttttgagcaatatttttgctgaccagtggcttgaagataaactctctaatgattatttttattttgagtagcttgaattcagttttgccaaaactcttagtaattttgaagatggaatgtcttgtcagcatgggaatttgcataagtaaagataacttttcaggggtcactgatgcagcagtgagtcagagcgcctagagagcagtgaggactcctggacgagaggctacgttcccctgggccttctagtgctcttcactccgtgagatagtaagtgaccagacagataagtgaggggcatggctcctcgccgcagctgtctcccttggtaccgacctctctgtgggctggagagaggcctaaggtttctgagccttggctcttccatgggggcttcagccagtatttgaggaaagtgtgactgagaaatgacactttgggaggtttctccgtcctcatcggtgggctcttaagggaaaagagcaaacgtgcatttggataaatgctaagtcagcagaagccttgatacctgcttgcagcttagaggttctctcctttaagggaacttgtctgtttgctttggttcgtaccaggtaagaaaacaagcaaagcagtagcttattgcgtcctcttctgaggg

SEQ ID NO: 28435 - DNA, 1199 bp, Mus musculus
ccaggacagtcagggatacacagagaaaccctgtctcgaaaaaccaaaagaaaaaggagtatgatcaagtaaaatatccaatatcaactttgggcctccacccacacatacctactcttaacacatgtgagcatgcgtacatacatgcatgacactttaaaaattaaggatagttgatttctattagaaattaaagaagtgctcttcctgttctccaccatggcgcaagatcaaggggaaaaggagaaccccatgcgggaactgcgcatccgcaagctctgcctcaatatctgcgtcggggagaacggagacagactgacccgggcagccaaggtgttggagcagctcacaggccagaccccggtgttctccaaagctagatacactgtcaggtcctttggcatccggagaaatgagaagattgctgttcactgcacagtccgcggagccaaggcagaggaaattctggagaaaggcctgaaggtgcgggagtatgagttgcggaaaaataacttctcggatactggaaactttggttttggaattcaagaacacattgacctgggcatcaaatacgacccaagcattgggatctacggcctggacttctatgtggtgctgggtaggccagggttcagcatcgcagacaagaagcgcagaacaggctgcattggggccaaacacagaatcagcaaggaggaggccatgcgctggttccagcagaagtacgatggaatcatccttcctggaaaataaacttgatccaaaaagctaataaaattttctcagaaaaaaaaaaaaaagaaattaaagaagtgctaggcagatttcctgagtttaatccttagaattcatagaaaatccaggcactgcagcacacctgtctgtaatctcagcaaagacaggaagatgcccagagttcattagccagtcaacctagccaatccagcaagctatgagttcactatgagactcgatctcaaagaaaatgatggaaaaagatgctatatagtctgacctctctgtcctatactcacaaatgtgtacaaacacatacactaccacaaaaccaacactcaataaaataaaatgagattaagttaaagggaaattaaagagagcgaaaagatccagagggataaacatgtgtgaaacaaaacagaacttgggtttcctcggccaaggtgaaacaccatgac

SEQ ID NO: 28436 - DNA, 1187 bp, Mus musculus
atcccaaagagacatagcagaaaaccagggaaacatccttcctattggcaaatgtatgaaagtaccacttactagctttcttctagtgccaaacgcgccatgtctgtgcaatctagaaggacaggtattgactcctgaggaaggctaagctcataaaagacggggatggacttccgaattggttatgtacagacaagcattgatgatgacaagtcttttggatcaatattttgctgaaataatagtcaccaactattcagatagagcacacctttgctgtatcacttttaataggaatttgcataatagtagcaggctgcaaagaacctctagatgagatcttaaagctaccaccagcctgtcttcaggacggacagagcttacctcggtgactaatatttcagcaccttgcattgaacctgagtcgagttcatcctatcttctccttggaagtttagtctctcacagttgtcttcattgctcatttaatgagacagagccggagaagccagcgcgctcacatcaatcccctgtcttgtgcttattcaatccaggtacgaaaagagtatggcaagtgcttcagacactggtactgctgtggcggcctcccgaccgagagcccgcacagctctgtgaaggcatccaccacccgcaccagtgctcggtactcctctggcacacaggtaaccgagagcttgacagcgtctttaattaaccttatttatagaaagcccgcagagaggtgttctgtttagacacactaattgtttcctccttgtcctcatgtagatagttaggactgccctcttttaggatcttgatttcagtgtcttcttaaatatgtagtctgggtgttgaggtacgagcatcctttttgaggaacccacttcattgtgctccaaggtcatctagggacagtgtttagtagacatcacaagtcattgaataattctccactttaaagaaggccataaaataccatgtaagaaaggaagctgaaagctaggtgtggtgatacaggcccataatcccagccctagcgagatggaggcagaaaattcatgagcgtccatggctacagagtgagttgaggccagatcggcctccataaaccctgtcacaataagtaaataaacagacccaccaaggtgattagattaaagatcacacagcctgtggaagaggaa

SEQ ID NO: 28437 - DNA, 1765 bp, Mus musculus
cacatttgtgaattatccttaatgtgatgagttaaagaaaaccctattaagatatttttattatcacagtaaattctattgactaaaaatagactaaataatttacttgtaaaaagaaagaaagaaagaaagaaagaaagaaagaaagaaagaaagaaagaaagaaagacacagctctgacttcattgttttttttctccttttcaaaattaaaaactaaaattttgagaatgttagaaatgatagctatagctttccgcgctacccggggacgggtccatacggcgttgttcttgattcccatcgtaacttaaagggaaacttacacaatgtccggagcccttgacgtcctgaagatgaaggaggaggatgtcctcaaattccttgctgcgggaacccacttaggtggcaccaaccttgactttcagatggagcagtacatctacaaaaggaaaagtgacggtatctacatcataaacctgaagaggacctgggagaagctgttgctcgcagctcgagctattgttgccatcgagaaccctgctgatgtcagcgtcatctcctccaggaacactggccagcgagctgtgctgaagtttgctgctgccacaggagccactccgatcgctggccgcttcacacctgggaccttcactaaccagatccaagcagcgttcagggagccacggcttctagtggtgaccgatcccagggctgaccatcagccactcacagaggcctcttatgtcaacctgcccaccattgctctgtgtaacacagattctcccctgcgctatgtggacattgccatcccatgcaacaacaagggagctcactcagtgggtctgatgtggtggatgctggccagggaagtactccgcatgcgaggtactatctcccgtgagcacccctgggaggtcatgcctgatctttacttctacagagacccagaggagattgagaaggaggagcaggctgctgctgagaaggctgtgaccaaggaggaattccagggtgaatggactgcaccagctcctgagttcactgctgctcagcctgaggtggccgactggtctgagggtgtgcaggttccctctgtgcccatccagcagttccccacggaagactggagtgcacagccagccactgaggattggtcagcagctcccacagcgcaggccactgaatgggttggagccaccactgagtggtcctgagctgctgtgcaggtgcctgagcaaagggaaaaaagatggaaggaaaataaagttgctaaaagctgaaaaaaaaaaaaaaaaagaaatgatagctataatatcataatttccacctgtattccctcctcctttctcccatgccctacccccattccaagccccaccctgccccacccctgtcccacccctgtcccacccctgtcccaccccagtccctattatctctttatctccatttctactatcacagggccacctgctcccagctggacggcaaccacttattgcctgagcattttcttgcacccagtctttctccatataaacttctgctgcagtagactgctaatctgaggttctgaaatgtggcctgttaatgcccttgctgattacaacttgaccttacctcccatgaccaagtccactgttagttttccaaaacagacccatgtgattattttaggtttttccagtgatggtttataaaccattttgcacaatctgtccctccattgttcgttcccttttaagtcatcacaatctgcctt

SEQ ID NO: 28438 - DNA, 1098 bp, Mus musculus
tttcagtttgctttctttggaaaagtttttatcatacctgaatgaaaaaaatgcccctccaggttatattagaatctgttggcagtgttaaaatgactaacgttaaattgctttaaggtaaacattttagggtagatttgcataaatgttctgccttatttcccccagtgcatgtgaacttttatttctatgggtatatgtgccttggcaattgtgcctatggaagccaaaggaaatttttctgaagttggttctctattatgtgggtcctagaaattaaacccaggtcattttgcatgtatgggtagtctcccaatatattttaaaagtggaagttattacttagttgactatttttgtttgacgtcatctcttaatttcattgtttagaaatacgagagttggggataataagctaatagttttattacagagtttattttgttctctcctttcttaggctggcaatcctggtggaccgggacctggtggtcgaggacgaggtagaggtcaaggaaactggaatatggggcccccgggtggactccaggagtttaatttcattgtgccaactgggaaaactggactgatcattggaaaaggcaatgtattttaaactctttgttttgatatactggatatttgtaaacaaaagatgctatttatatttttttaggaaaggggtcttaacatggcagctaaaataagaatactctttaatgtatgctaaaaatgggattgtgtctcaactgcttctagggaaaggggaccaaaagtctgtcagttacaaaacttgatcctaattcaaatgggttttgttggtgttttttgttttgttttgcatttaacttctttgttacttacaaaacctgttgattgaaatatttttctgttctgacccatatcagggtgtatgtttagtaaggtgtgtataaaatagactttagtgtgttttgcattagttctagatggaagaacaggctaaatagaaaatcctaacattattgtccagtggaatgctacaaaactgtttaatgggcaaagtaataggtgtttggggttttttttggttttttttaaatagtatttctgccagac

SEQ ID NO: 28439 - DNA, 1139 bp, Mus musculus
ccacaacttctattcatttaagaaacaacttgagccgggcggcagtggtgaacgccattagtcccagcacacaggagacagaagcaggcagatctctgagttcgaggacagcctgatctacagagcatgttcaaggatagccagggacacacaggaaaaatcctatctcaaaaaagagagagagagaaaaaaaaagaaaaagaaataacttgaattgtgatggcatctgaatatgaaagatgagtgtcgattagcaaaagagtgcattcccagggcagacaagaagcatcagttatgacttcctttgtaagggttttaaaagtgaatcttctccttctaacaagcatttagacgtggcatgatcaaatagagttggaacaggttatattgaaggttttatatggctaattcaatttcataggattgctcaaatgagtgatgtttgatattagcactgtaaggtctggtcagtgaatatgacttccagcattacctggaagactgactcggcaatatgttgcttaaatttgacttggaagtatacagtattttattgtctgcattttcaagaaactgctgctgtgaggttgagatttatatagatgtcaagaatttaatcttcaatcttaaatggataatatgcgaattcatcctatgtaaaagaatagtgagctcttagtacctgctagttgcaagtcacaaaaaaaaagtttgggttttggtttggtttttgagttacaaaggtgagcttagtgcagaggatgctggttgtggtgacttgggaatagggcagcagctaaaacttgagtattgggggatgctaaaagaattaatagaaaggataagccacagtgctggggataagcattagaacctgagttctatccctcccacctgttgtaaagaaaaataaataaagcgctttaataaagttcgtaaaaaggatccgtaaagtttcctggcctgctcttgtaaccaaatctaggagctctgggttcagagagaaatcctatctcaaaaaaaattaggaaggaaggctggagagagggctcagtggataagaaaagcaataactgctcttccagaggtctgagttcaattcccagcaaccacatggtagttcacaaccatctgcaatg

SEQ ID NO: 28440 - DNA, 1167 bp, Mus musculus
acatttccttttatacatgagcactatttcagacctgtaccgctgctacaacagttaaccttcctgttcttcacttatttccgagactgtttcagcataactaattttgaacagtttgcagacagtgatttgaggagtttataagaaacattgtttttttcatgtaaagcaactctttccatgtatatatatatattataatagtgtgtttctctctaaattcaggatagaaaagtaatagaatgtgaaagtatagctacattgcatctgccattgaaacatttggggtatgaaaatgttcaagctttttttttctttttgcagtatagataagctttgtcttgtaattgcacaagtccagtcattgaatcaaattaatttttttatgtactgaatcattttattaatctttaacattcatgctgaagttctgatattttgttgaaaaccattgttttactctgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagagtgacaaattgatgaactgcaacagtgtctttttgtcgatgttccacataatgcaattgctatattttgtgtgactattatgttggaatacagtgctgtcatgggaaaccataactgcttcttaacatagaataatacatagttctgtattttttttaagtgagcttaatgggtaagtatttttgatatgctttagctaatagctaaagaaaattgatcagtaacaaagttgaatagtattatcagtgctcctaaaatgctgtttttcagtgtaaaatatgcctatcttttatagtgatatgaaaaacttgaaatgtttaagacagaagtgcttttcagtttgcaaagtttaaggacttaacgccttttcattaaatgttagttctatcatctgtggggagcaccatttgtatgaggacaaaaatgttgaggttatagggcagaaaatagtacagctcattgtggatgttttgaaatgttttttgattgttttatgtaacttagtgacttcc

SEQ ID NO: 28441 - DNA, 2061 bp, Mus musculus
tagtatgaagtttaatagtaatagttaaggccttacctgttaagatcttaagtgtagggtattgacatgaacagtttcagtattttgcatgatattgttgcatagatgacctaggaaagtgttgtggtgcatttagtaattaaactgaaggaaatagttggattcagtatcataattcacaaattggaggctgttgattttgattcgtttaaaatttaaaatctttattaattgcaaacagtgcaattatttatacttcacagtgccttcccagaccttccaccttaggttctgctgcaaaaagcaacaggtaagcacaacctaaggccatctctatataaatatatcagtacatacatgttgtccctgtgaggtttgtggttgtgtactcactcaagcaatctgctgctgccgctgccccaaatgtactttgttatttatggtaccattctagtggaaagtctgttaagttgttcaagcaactgtttacaattttgggtgatgttttgtttttggtttttttgggttttttttttccccattaaaatgagtagattgctgcaataactgaaaaacatccaaatctttttgtgcacccctcctctcccagagttatagaaatgtttaagaacacttcagtagttgagacataggaaatcatttggtcagaaatttcaacagccttcacagcccgtttgtatgagtaacaggaaattctctttgccctccaaatctgatctttttatagttttatttttattatttttcccctgtattagtactgctttaaagtacagtaattcagtgagatcgttttggttcagtttcatagacagttctattttcatgacttgtatttgctgacaaggaagaataaagaatactggcagtaagttttgggaaaggcatgtgcatcagtgaaatgttacttgtataacaaataacctttcataatctgcataaccagtagtttctgatttataatattttaataactgactgcatttatttttgccagtttaaaatgttttgtgttcttaggattgatgtttagtgcatattttgagttaaatgactatcttaaagcagcaccatatcagttgtttttattcattttctaaaatgtgctgatcctattaaaaactcctgcttatcttttacaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgactgtgttcccatacataatatggtatagggtgtaatgtacctgctcttgatcactttcattttaaagtgctattcacttaaatgttccatgaattgtttattgcaccacagtttgtgtgtgtgtgtgtgtgtgagagagagagagagagagagagaaataggtcagatcagtatgttgcaagcagatctttagagcctgtcaagttttggttagttgtagtttccatttggaaatgtagatgaatgcttgtagatattggagattgtttctatcttgtaagaacttttcactggtgctgtaagcatttcaaatagcaccagtcttaacctttaaatgggaagtagaaaaggtgagcccaaagtttacagatgattttaatgctatacatgttagtgtagtgatacttagaatgctttgtttgatgtttatttcagaaatgcgtatactagaaaatcattttaatattaaaactggtgacttaatactagttgtaaagtgttttcttaaagaaggatcttggtacttaattgataaagtgggtttagataggagtagcaagtgctctcgatagagaaagtttttgttcacttcaatactttgtcattacaaccagttcttcctgaaaatagttacatgtctagtaaattgatgtagaattaactcgctggagataatctcatttt

SEQ ID NO: 28442 - DNA, 3175 bp, Mus musculus
gagtctacagggctgacagcgtggcctcagggagaggacagtctcaaggatgggcggggattgtcctgcacgtatgcaggaggtttgtcgctgaagccatgcgatggatccagagagactttttaataatccttaggtaataatttaagttgtgaagtgatgcgtattatgttgtgactgtcgcttgaattgaagccagtgctctaggagttcattgtcttcccacaatctgcagtgtcatctcaaaacacgtcttgatgctttgctccttgagaatacactagcccaaggtgactgtatttatgtaataatctacggcttctagcgtcaacgtacttaaccttgcctgaaatgtattcttaaccttaggtactgcttctttaatagaatgtagacaatagacgtgtttacctacagcttgtctgtttgctaatgtatttgagtcaaagaaggcatcctcaccgaggtctggtgtgcgagagcacctgaatgaagcgagcggtttacagcgcacacttggggtgcatcacctgcagtccacaggatattactgttgtcctggaagttatgagaccctgaagtagtttatctcatcttccctcagatgaatattaaacttgaaaatataatttatttaccaaaaaaagaattaaaaatgtatcctctcttagatgtgacttagaggctggattacagtttccgactttagcgtaagataatttcctctctcctttcacaaaacagacttttaatcactcacatagagtttatcacattaaaagtttgtcatgttatgcataaattttaaaaatactcatactttgagcttaggttttaaaggaatttttctcttagatataaaacacaaatattttaaatgctatgggagtgtattttatgtccttatgataaatgagcaaccgggttattataagtaaccttccaagtacactatatattttcaaggtctcattaattttgctttaagaccatgtaccatgttttcaccagtggattggattcactgactctttatcctgaagtgggctgcgttgattttaagagtgaagtgtacaaaaggatgtgaaatgggtttttaaataatgcatttttagattaaagtgcctagagtaaggttaatgatgagaaaataaaaagtgaaaagaagtttacttttttaagattgtaactgtgtagatacatcacagttatgtaaatcgttattagatgtaggatgtagacccgtgccattagtgtgtcaggctcaggccgtacccctgtcctcagtgcatgtggcctggccttctcctctcgccctttgtttcctgaccaccaggcagcagtctgcctgaggacaaagccctgagcccgactttccttatgctttcacagcagatgtttttacctatgagatgtcaccgatgtgagtgacacacgtgtgcgtgccttcctgttaccacatgagcaagacagttgtggattatagtcacttattcattggagatctaagtattttgtcctgtggttttgtaaacagagatattggggggatcctccttgaaatagtttggaagaattgcactgtatagcagtaatcccgcagtggtgtgagatgatcctgtgggtgactcttccaaaaagtatttgatttctttctgtttttagattgcagttaaaaaataaatagattgcccatcttcaagaaagggttggtttgtcaaactcagtgcttaagttttgatgggctaactaactagaatataaacaagatcgtttgtggcctttgataaaagagataagaatgaccaaataaaattttgggagcaataaatgtaggagaaaaatctttggtgggggtttgggaaagcttaactttttaaaggataatgtctttttaaaaagaacatctctggctctgactgttgaaaatacttaagatatacataccagttttatttgccttaaaatcaaacagagaagcaatgctttaacagataaaaacagaaggtcaaactaggctagagcctgttagggaaagaagaaaaggctaacctagtggactcatggtgttaactgaagatagctaccacatgcaagatgtgcacgggcagagagttgatcctgaaaaaatagccagttcctcttttctggaagaaaaactgataaaaattcagtcgattgattttgctttgtcttgctatgttcttgttcaactaaaaatgtagttatttcttcccgaaggttaacaatactacgttcatggaataacaaagcagaattctcttcttttacaagaagccaagtttttaattctataaaagtcagctccaaagagctgtctctgtctcctgaaatagtttgcaccaggagtctgttgattgtgaagctgactattgtaagtacttacaagtgttcctttgctttaaggtgtaggctttcctacttgctttgcagaagttagcctagaaatgaggaaggccagaggaagggtgagaaagtggtagtgaactactccgcggcctgtcgtgaccagactggaagctatgttataacactggtttttattttttatatgaacattattaataattaacataattaattggactgtaattttaaagtatgagaattagcctgaattaaaatctgtgaatttttaaattaaggaatatgtatgtgaaagtaagtgtttatgtgccctgtaataaatgcgaatatgaactgctttgttcttaatgactgtcactttgttcttaatcatgtcacagtctccttgactgacctcagcgtatctgtttcttcactgtaaggacggagctcactaatctgtataaaagtgaatccctgcagtggcagacaacagcaccgtccctcacaggcactgcagtgagcgtgttttctgtcccagccaaataaaccagtgatggtgtcttagtgactagtgacgtgctggctgcattagtaacgctttctatgatgtgtgatcacagacgccttcgtaggcctgccctttcacatgaggcacagagggaggcaaagagagaagaacactgaaatcaagtgtagaataaatgctaccatgggaataaagacagcattgcgattaataaagtttcaggcttcttgctttaattgaaaggtttcagtgaataaggtcatcaggcagggtaagctg

SEQ ID NO: 28443 - DNA, 1156 bp, Mus musculus
ggaggcttcatagaaggaataacctgaaaacacacagtaggcctgccaggaagatcacagacagagcatctcgagcagagagtgccatggaatcaagctacagaagacacatgcatagcataacagtacacatagcagtaaacctagaagggagggcagagaagtcacgcaagaactttgtttctttaagcaaaaatgagccacagaaaagtatttagatgtcaagtgagatgcatgtgttgtaggagattagggaagggtggctggtgcacatgatgtcagtgttctttcctggagctcctttctatagacctgcttgtgtctcttggggttttgtattttgctttgagtcaatgagagttcctctaaggggactctctggcagacagagaacaagaaaaactgtgaaaaagcacctgctatccaggggagagacatttctcaggtttggtaagtagccagatagaacatccagagaccctgagtaagcttggctgtgagcagaagtccctcagcctctcctctcagccagcatcccagacttggtgctgtgagactggtctcctcttctgcagagtcactgtcacaggagagtagcctcgctggggctgtttttggggagtgagctgaactgcaggcttaagtaatgccctcaggtctctaaatagacagggtacgagttacacagcagctgagagatgtgcaaggtgattccgctccagtatgaaccctcgcaattttcatttcagagggtatactaacaccacaagatgcagctgagctggcctcatttctgcagctcaagacaggttcagtgctggccaatacagtacagtgctgagggctccagggacagagggacctgatgtttgcctttgctgagatttatctgtggaggacttactcagccatgtaaggcctttgtggtattagggaaaggcctacagtcagctccctccaggaagaagttgacctgatatttggactagttttctgccctcatttgtcctttaaccagggcctttgtagcatatagaccagttgtacctactaggttgttatcgctataactctttttttttttaagattttatttgttttatgtatatgattacagcgtatctgtcttcagacacaccagaaaagggcatcagat

SEQ ID NO: 28444 - DNA, 1113 bp, Mus musculus
accttccctcataatcaacctaggacccccctcctgtttccctgctaatgtggtaattttaagaaatgggaaatatcctagcttttgaaacactgtgtgcaatgaaggaggaatcattacaattttgcctctcctttagatttaaaatatcatatgaaatggaagaggttgaacaaaacgtgatacacatgaagacaagttaaggacgagagagggatacgtatctcctaatgaaattttatatgcatatcacagaaacctatcccttaatccaggggactctttttctctctctctctctctctctctctctctctctctctctctctctctctctctctctctctctctgttaagactgtccatttcctaactcaggaagtattgctattttttccaccaccttttagatattagctaaaatgctaaatctctctatatgatactctggacatattctctcttctccctccctccctctctccctccctctctccctccttccctcagattccttctcctgacacagctgctcacagacttccaactcaggacacatgcctgctctccttgtatttctctccccattgctgggcattccagcctgcctgccttgttctctcatattcatatgctagcaaaactgacccacccctccttccttccctccttccttccttccttccttccttccttccttccttcctttctctctctcttcctttcttcctttctttctttcttccttcctttctctctctctctctctctctctccctctctctctctctctctctttctttctttctttctttctttcttaagaatttagtggctcacacattaactggttcatttctcctggctcttgaatggtatcaatgtttttaaacttctttctttataagctgcactaattggacaatgtggtgaggcttcctataacttcctcttggagtggaggttggaagagagaaaattcctcctagccttacctatgcaactcttggacccctgactccgagtctagaccaggaaagtaagttcaggttgtgcgcagcagtgatgagcttgcaagtcctggaatgcaaccagagctgtgactagttagtt

SEQ ID NO: 28445 - DNA, 1177 bp, Mus musculus
aatttctttttttttttagatttatttattatatgtaagtacactgtagctgtcttcagacacaccagaagagggcgtcagatctcattacagatggttgtgagccaccatgtggttgctgggatttgaacttcagacctttggaagagcagtcgggtgctcttacccactgagccatctctccagcccccgtaattctttttaagttaacaaagtaatggttttcctcgtggaatcctcatagacacgtgtacttataggatgttctcattcattctgcttgctggcagaacctatagctttctaaggaaatgtatgagtgaatctgaaggtgaactctcccctcctttcgtcagctagctggctaattttggtcaggactgagtataaacacacctcaagttctcctttgctgacttggtaatcacagctccagctccgttacggtgtcctgcatgcataattagctgcaaacgttttatttttagtttaagtatttagtttcatttaaacatcttttattatatttatgtatcggctgctcttgtgggcacccgaggaatcgaatcagttctctcattttactttttttttttttctttccagacagggtctcagtatgtatctctgtctggcctggaactccccgtgtagaccacactgacctcaaactcacggagatctgcctcccaaaaactggaagcaaaggcatacagcaccatactcagcaagacttcaactttgcatctttcatggataaagcacccagaaatccctgtggctgattaattcctgtttcattgatttaagattggacagaggcgacatgtcagacgagacagtcagcagatcacagttctccttgaagacgtacgcagttagagtgtttgctctccctgtgtcttggtattattctctctcccaggtaaacgtcaaagtgagctgaatttgaataatacctctatattgttcggtaatgtttgttcacttgaggctgttgttttgtggtgctacggatttaaacccagagtttgctaagcaggcttactgctacttagctacatttcccagcccctgaggttttcacacagcacaggggactgcagtactttaaatagtttcctttcttaggcaggtatggtgacgtatgttgggttattgggtgttccgtgtctgc

SEQ ID NO: 28446 - DNA, 1200 bp, Mus musculus
tggctccagctccgagacctgctgcctcggccttctgcagccgtgcacacatgtatctttacatagatccacatagccaaaactaccaaaacctaaatgtaaactttataataattgccaatggcacacattctttatgtgtaagtgcaggcgccttaggaacccagggagccttcagacccctatgcgccggggtggcagcagctgagaaagaacaacctgatgtaggtgctggagtagaattcgggtccccgcatgctctcggcactaagccagcgtcctagccctgctgttacggttgttttctgagcagagtttcatgtagctcaggctgccctctaaccttttaccaaccaggactggacttgagctgatctttttgcctgagtgctggggttacaaacacgtgccactatgctggccagtttctgttgttacggtaatatctttcaatattcaatatgtggtgtaaatgttatgtaagttaaaattaaagtgtgttttgatagcataaggatttattcgagtttgttttctttttattattaaggattttaaaattcccagtaatccagcattgaaaacccccatggttgctgtgtctgaagatctggatatagaagtggaagaggaagacgagctgaaggctagaggtgggctcttctgtcagtgctcctctctgcggccctgcccatttgactaggaagctgcataatgagtagttcaaaacagatgagagatgataattaaggacagagcccacagacgtgatcttgtagaccagcgtttgcagtaattgcaaacttgatttgtctggtgtcactttgtcacagctggactctcccttgtcttctgggagcctttagccgttgacctatttttgggttctcacctgccagggaagggttgctagggtgatgtgaagtcggtaccttggcagactgcacgtcttacccagcgctgaggaggctgaggtcagaggttagcttacactgctcttattttacctgcatctataaaaagaaacgaaaagaaaggaagacaagagtaagggggcggcattatttggaaaaggagccaggcggttccagggctcctcttgacctagtcactcagaactttgaacttccacactaggaggcagtgggacaggatttcctggttttttttttttttttttttttttttggttggtttttc

SEQ ID NO: 28447 - DNA, 1204 bp, Mus musculus
ggtgagccctaggaaaagaagactttcttcttcggaaaaggatgacctggaaaggcaggccctagagagttgtgagaggaggcaggcagagccagcaccaccagtctttaagaacattaaacgctgtcttagagctgaagccacaaatagttcagaagaagattcgcctgtaaaaccagacaaggagccaggagaacacaggaggatagtagtggaccatgatgcagactttcaaggggctaaacgagcttgtcgatgtcttatattggatgattgtgagaaaagggaagttaaaaaggtgaatgtcagtgaggaagggccacttaatgctgcagtagtagaagaaatcacaggctatttgactgtcaatggtgttgatgacagtgactcagctgttataaactgtgatgactgtcagcctgacgggaacactaaacaaaataaccctggttcctgtgtgctgcaggaagaatcagtagctggagatggggattcggaaacccagacctcagtgttctgtggtagtaggaaggaggacagttgtatagaccatttcgtgccttgcacaaagtctgatgtgcaggtcaagttggaggaccacaaactagtaactgcctgcctacctgtggaacgacgaaatcagctgactgccgagtcagcttcaggccctgtttctgaaattcagtcatccttaagagattctgaggaagaagtagatgtggtgggagatagcagtgcctccaaagagcagtgtaatgagaacagcagtaaccccctggacacgggttctgaacgcatgccagtctctggagagccagagctgtcctctatcctagactgtgtttcagctcagatgacatctttatcagaacctcaggaacatcggtacaccctgagaacttcacctcggagggcggccctggccagaagtagtcctactaaaaccacatctccttacagagaaaatggacagttggaggagactaatctcagtccccaggaaacaaacacgaccgttagtgatcatgtgagtgagtctcccacagatcctgccgaagttcctcaagatggaaaggttctatgttgtgactctgaaaactatggaagtgaaggactaagtaagccaccctcagaggccagagtgaatattggacatttgccatctgccaaagagagtgccagtcagcacactgccgaggaggaa

SEQ ID NO: 28448 - DNA, 1167 bp, Mus musculus
gagtgtaattgtttatgcattagattttattctaagcagttaaaatcttccttaaatcacaccagatctcaagcaactttctgttaaaactttctgagagattaagtgggaagattttttaatgggtaaatcaaaatgcatctggagtcgtgtaataatgaaatgggtctggagtcatgtaataatgagatgcatgtctgtgtgttttttacttgcagcccacatgaaacagatattcacaaggaagaccaccagttagaacctgtttataagtcagagacgttcttagacagagattactgtgtgtcccagggcaccagttatagttatctggaccccaactacttcccagccaacagatgacatgggagagtgtcgtccgcactagtcctcgtcaacacgcagcagtggcatcatggttaatggtgtgcacggtttggacactcacagcatgagagctccccgagtgttctcgtccagtacagctctgcactgtgtggctgtagatcagcagctgaacattcctggtgagccgagaggttccctggtgagattttcaccactaacctaaagccttgtaggtggtggtgttaaatgggtgaggtggaaacaagagcacgtattaatgccagagtcaattccaaaggtttaaaagacctcggtcataaatatgataatgaaagacaaagtatttatattaaatcagtttagtagctttcagttttgtgaagatagttttcagcgcagaaacagacttatagatgaagttttaaccagtgatggtgtttgcttctaggatgtgtactctaaaagaactcactgtctggtggtcactgatggcctgtagtagactggagctgcttaacggtttgatacctaacttctaatcacgatgacctgtccttaccaagagcaaagcaagacatagctgtggctttgcttctgtaaccagctcatggggtgtgaatgtcatgaagttgtctcgctgatatatttttaatgtcatgttatatgagatgatcatgtgatgtgtacagactatgttgagaagtgccagtggtagtaactgtaaagtctgactcacaccattaatccctctaaagtacacagccttctgcctctgtgtggagttgtcagtacagctcgtcaaagaaaactgcctaatat

SEQ ID NO: 28449 - DNA, 1315 bp, Mus musculus
taaaacccactagtctttgtgcactggaggaaaccggtagtttccagtgcattgtcctctttacctctagagtcaaagaggaaaggttactgcccagcttcaagggtttatgtgtctgttaaatggattgatttctgagaattgtgtcgtgttttgcctcatgagaacagttcacgtctgtgtctctattctctgactttttttaacgaattctctatatttgttggttatgtgacccagtattctggtaagttacactctttcttgtttagagaggactggggtccagtaggtcactaggtgctagtgactctacaggtggtcctgtgacatgccctggaggacagcctttgcacccagctttacatgtagggtgtgattagccaatcagatcatgtattgtgggtatgactctgtcatgcttgctgtgacattttgggtcttatttccagttggggaagttaagtccccttgattgagttccaggaactagttactgacctgaagccttcccaatcgtatctgtgacgaaagcgaaggcactgagaatgaaaacagaagtgacagatgtgaggactccagtaagacgaaagccaggctttgtggagcttggaaacaaccgtgtgcaaataaaccatgtgaaagaaaatgctatttgaagaaaagtagtgccgtggagctctgttgctttagattgaatggctaagcaaccgtcactggcagttgtgggaggtagcagtgtgggtcagctttcgagaggactcaagagctctgacgccattggtaaggacctggagccagggaccacctaggtttccctgggcagctttgaagacaggcagtgtgtgtgtgtgtgtgtgtgtgtgtgtgtgtgtgtgtgtcatgcatcaactagggggcgggacgaggcagcacagccttgaatgcaggagtttacacttgtgttctgaggttgtctgcacacataaccttttgctaggcagaaaccgctacagtccattcatattttaaagtgtaactttatgatgtcacttggagccattcatgtgggcgttgtgtgtcttagctgttctgtagaaaactgacttgcattcccgggtactgattcctgctgaagttttccaggctgcttgcctgcatgtctgctgcctcgtccagagctgtgggtgcagagctgccagtgtgtgctgtgtgttgggttgtcatcctctagtaccactttccattcttgctctaatgtccgtgctccctgtcggttacctttggggcagtgtacgcatttcacagccatgtgagtgggggcgtgatgtgccct

SEQ ID NO: 28450 - DNA, 1406 bp, Mus musculus
tggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttactcgcacaggaagatggagacacagctttaatcgcacaggaagatggagacacagctttggtagctgtttatctagggaagtcatgcctctgagaatttttagtggtaacccctcagagaaacatgccctattactttttatttttaagcatactgtgaacttctagaattgattgtatctcttcagtttttgtcctgaaagagacagattgctgacagctggatctatgctgtccctgaggacagccccataaactggatgacatacatggagcacacacactgaaggccccgccttcatgtctgatggatcagtaagacacatccaatactgactcttctaggatgtcagtcacctccacatcttcctgcggtgaaaagatggccaagcttgtgttttgtgaccattctcagacactcttttctctttcagactttggcatcagagagccgtgctggggtgggctgtgcctatagatttactattcatgtctgaggagaatcttaggtgtttcatccaagaatctatatgttcatctgttttctttacaaatactgttttctaattgtaggtaacaattaagaagtcttctaatcccctggcaataggcagatacaccttgtttgtgatattgctcttttgtcagtcaggggcagagcacatggcagtccttgttcatcctagcttgttgcctgccctggtggccaaagttgtgtcatgcctaggacacataaaaatcaaatcatcaaatcaaattgaggcaccttgggaggaagacagtagacagaggcctgtggaccatggaccacgtgccacccacagacctgctctctgatgtatgacacaggtgggctgtatatacccacccactgtgcatagacaggatttcatccaggggcccaccagcttcatggcagcctgctctgcaggagtcaccacgatgtgttagttagtatgtgctagtcaggtgggagactcaagggtggagaggagtagcctgtggttggtggccaatgctgccacctcaga

SEQ ID NO: 28451 - DNA, 1205 bp, Mus musculus
ttttgattgcttagtatccattactcatgatattcttcccaagaattaattgtccacatgactgaggcttcaagtccttatgtcacctgcttcttctcctctgtcaccagttttggaaagagttctgtcagatcgccagatgtacactgttagctgctgaaggatctctgggctgtctctttagctgctctgtgaatacgcgcatttatctcctcgtttgtttttaaggcagtgctgtctgggtaatcatgtgtgaatctttattgaacacttatggatgagccacctgttcttacaaattagctgagttctcgagaaggcccaaattagtgaattagttgatgaaggaaatttgttgcagagacagcaggcagctaaggactttttcagcttgtcaaaggtattgttggtctctgaaactggcgaggaatcacggagatatcaaatgaacaattctcggcactgacctaataccttaaactcactaggagaaagtgaaatagccagtcacatcatgtgaagagagtctgctgatctcagccatcatacagaaagttaactaacttttgtagaagtgagcatctttccccactgatcaatgtggagagatcaggagggaattacagggaactcgtggggaaataggctttcttgttcgtttgtgcttctggccactttagacatcgaacaaacctcagaattgcccagcccagtcatagtccaggagctcatgaaatcttcgcttcccacaatcgcttaagtggcaaacagatctggtgagtggaactgccctctaggtccttgctagggctttgagccctatgctagaaccttggacaaaggtaatataatcccaccaacagaaccctggctgccttcctgttccttcgatgcccggagctggttgttcaccacccctacccccaacagtgtcatattctgtgtcaacacggcactcatttctgagggagcagggctctgtgaacacagcactgtaaagggagaaccaagatgggacttaaacgtctcctctgcccagtcctttgggtgaggttataaattgtgtcatattgtcatggttttattcactcaggaagaaggaatgataacccttcattccatctttacagagacactgcgctgttgctatggagatgctgccagagtttcttcccctctctttatgtttgtataatgtgggttat

SEQ ID NO: 28452 - DNA, 1229 bp, Mus musculus
ggctgtctacatgtgctctagctagctaacagtatttaatctgagataggggattgactctaattgggtggtagagcacttatcttgagcttttgcaaacatgcacttttctgggtttttataaccccacggtttactttctgacgaaatggcattaattgccccagatgaacagagctggccctctgttgggggcagtattcgttactctcctgcggttgttgtgataaaataccatgatgaagacaactcacaaacggaggatttctgtggcttggaacagaaggctaaggagtgaactgggcatggctctggtgtttaaacctttgactggtgacatactcctccaacaaggccacacctcctaagacgccacaagtgacaccaccaactggggaccaggtattcagatacagaagcctgtgggggccattctcactcagaccaccataggcgtatccaggtatcttctgactgccttgacgaagctgtttctgagagcatttgatgtttcttcagtgaagctgggttccttggcattcagtacttctaactcctgttttaaagagaaacactttggttttccagtccaaatttcccgacggccatagtgttattttctctagtcacacagttctaaatatttatcatggactgggcttcctcgtggccaggtttgcacctgtggcctgtgcccatcatatacatccttggcatcatccccagaatggtatcagcacactgaaatagtgtggtgttctggggacactgcagcactaagatactgtttataccacactggaaatgacagctttcttttagaaattaactttattttaaattatttctgtgtctatgactgcatgtatgtgggcatgtagaagccagaagagggcattggatcctctggagttgaagttgcaggcagaagggagtctcttggcatgggcaggaaccaaactctagttctcttcaagagtactacatactcttaatggctgagctatgactcaagcctatttcttcttttttctttctatgtggagcctcatcatacagtctcacacttacagtcttcttgcctctgttttctaactactgagatactagtctatgatgtcacagccagccaagacagaggatttgggactggactgtgatgcacttggagagattcctcaggaagtaagctggcgggcctcatgcaatgtagaaactgacaagctctc

SEQ ID NO: 28453 - DNA, 1099 bp, Mus musculus
gtcctgagtccctgtacacagtgcttcacaccatgccccataccgtgtgtgccactcatgcacaaggcttcacaccttgccatatgcacactgtgccatacacagtgtttcacaccttgccccacactgtgcctcagaccaccctgtacttgagtacccatttagacaactttcacatgctgctcgctctggacgcagcccacagggagctgcaagcctggtaagggcaagtttgtaagtctctgaggaccttagtccagtctgcctcatttgtgtccttatggaacagtttacagatgagatctaaacccagagaccccagagggcaagctgatgttcccttagcaccatcaatgcctgggatgccccagcaaggtagacaattgggcacatggaccagtgttagactctggtcaggagcctcagtgttgattttctccacttctcacgcttgccttcctctgtagaaagaaatcaagggtcagcagcatccatgaaacagagcacctctggctttcttttgagcagctggcaaatctgtgacctggactcagaaatgactaccttcttgtgatcatcagggactccaaacttactcttgatgtcccctctaaaactacagattttgtgtgtgtgtgtgtgtgtgtatgagagagagagagagagagagagagagagagagagagagttgtgtttatgtatatgtatatgcacatgcacacaagtttctgcaagattcactattgaatagaaaactggtgtgtcaagagctgagaggttggtctgttagtggaagacttgccatgtgatcaaacatgaaaacccaagttccagaacccacctttacaaaagagctgctcatactgacccacagctagattccagagtcagtgaggcagagacaggaggtctcttcaggccagtgatggacctttccttgaaaacaaagaaagaatggaaggaaaggaggaaagagagaaggaagggagggagggagggaggtagggagggaaaggggaggggagttacaactaagtatttgattccacatacatgcatatacctgtgcacacatatgcctcttcacataatggagatg

SEQ ID NO: 28454 - DNA, 1607 bp, Mus musculus
tttgcttcctttttgaatgattggtatgcatacataacagtagcatgctggcagccagcatttaccctaatacatcttaagatgaaatccccctggaggtgctcctgcgccgacggtggcacatggtgcctctctcccgaatgatgagagtatgcgcgtggcgtgcatagacacagggggaatattaagttctcagaaggccacaggcacaccacgagcactatgctctaacctctggcaggtgggcaattgcagcttgcttcccacttcagaaacatgtcggcagatgtaggcacattatttaattaactaataattgagaaagctatagtcactattaaaagagcaaagctaattctgggctgataaaggactcttagctgccctaaataggtcgtaattagctggcagcggtgtagctccaccttcagggatgggtgaaattaatgaaagctggcagtgaatgaaactgcatttcatgctcctgcctcaggtaaagagggtgaggagagagtgagtcgctttttagggccatttaggaagcagaggacatgacagccactgccaggaagtacagagagcatgggacattggtttgtatatatcaagttctctgctgcctttctgccagagaactccatcattggtactcagtctccaggagagagagataagccagagatgtgccagccctcattgacatccagtggtgacagtcccctttgtctagccagggtcttaaaggtagcatgagtctcactctttctactgggtcatttttgaaagtttcttctattcactctagggattaaattgactcacacctcttgggttttcaaactctaggttgaggtgtattacatctcctctgagtatccgaggtccctgtgagctccccctaccactgtaccaaggcaaacagcttcaaagaccacagtgtaggaagaagagtcaaaaacaagtcatacaagctaccttagttagccaaagccaaagaagtgttattgttgtatgctgactccagagacagagctgtctagctgatcctaactttcagtaaatagctcctaacctcagaaaaacctggaccaagagaaacacgaaaagtggagcaagccttggagggaacagacagtattaaaaacagtgtttcctctttttgttcttttgaagactgtcattgaaaatacaccgaagcaccttttcctctgtaagtggaattaatggcccttctccagctgatttatttggcaggaacacagagttcatacaacagttgtgggcagacctgttggactcccaagtcacaaaagtattataaggcacctaggactgtggctttgtgctaacaagcatccaggcacagggaacttccatcttcccattattaagtggccggtataggtacctctgtaacgtgcagatactggagattaaaaatcctaggagaaagccaggcatggtggtgcacgcactcgggaggcagaagcaggtggatttctgagttcgaggccagcctggtctgcaaagtgagttctaggacagccaggactacacagagaaaccctgtctcgaaaaaaaaaaaaaatcctagaagaagacagcat

SEQ ID NO: 28455 - DNA, 1106 bp, Mus musculus
aactctcaagtcagggaataccaaacttcgtgttgggtgatttggacctggcagaagaccattactagactggaaagctcctgctctgagcccacagtgcggaaagctctgccgtgtgtggagtgggggaattggctgagggagtctctcaaggctgactatgctccaaggagactgcttttacaatactgttgagggcaagcctaacttctcagctcgtgacaggtttctttcaggagtgtttcttgttcaaagagaaagattcattgcatagcttcagtatactaagatacattatttattaattaataagggcagtatgtagcagattgtatttgaacctttatgtcatgaaagctttcttcatagaggtagcccgctttgggaaatttaatggtagagcttttcctgtgtcacagattggaatcttggcctgttttgtgcagatttgcaagaggtagtactggtgtttggatatgtctttgagtgtgtatgtgtctgcacatgcatgtatgtgcacgtatatggaagtcagaggtcaaccttggtgccatttctctggatatcatccatctcatttctttgtctcttgcttgatgctcaatgagtcaacaaggctggctggaccatgagccttagggatctgcttgtttccatctccttaggactggtgttgcaagctggtgccagcacgtccagcttttaaaactggtttctaaaggtgtaattcaagtctttctatgaacactttgtcttagctttgcagcctcgagaaatcgcatgcttcatagttttgaactatacatttttatttcattattgcctctagccttcccaagtggtagaggaaacccaaccccagtctttcacagcacaccgactcctcctactagtagtcattgctcatttctctgcagtcacctccatgccaagatccaccctgatgtcctgccttgggatgcttgtgggtaacacttgcatatgtttttcacttttgattttttaccattaaattattttcctgcctttgttttgagtatgtgtggcattcagttctactgttgagcttgcttttcaaccaatggctttctctgtctctacgaaac

SEQ ID NO: 28456 - DNA, 1119 bp, Mus musculus
cagggccacttctgtgtcagttttttttttttttttttttttctgtgcctggttttctggaaatatggcggaatttaaatgtgtatcaggctcaaaacttacacttttgcatgggagaaaaccagcaatttctgaggcacagaagtagcggagagtgaagttcaccaagctgaagcagaggctgtgagattatctgaaaaggaggaaagccacttgtcagaggaaggctggcagtcctgccctgacagactggctggaacccactgcagcctgaggctccttctattaggtgaaaatgcgcctgttgctggagatttaagatgctaatgagatgtgatgcttaaagttttatgagaacccattgtaacagagcattcgcaagaaagctgatcctgtgtaaatgacaaaataatgaaaaccacatccaaacaacagcacacgcatatgcatgagtgtgaatacacacacacacacacacacacacacacacacacacgccaaaccaaggagtgcatctgacagttcctacaaagccttttctcaactcaggctttttcttcccctggaaggaaatttatcttctccaataaacgttctctgtttctcctgctctcgctgagtctccagcttcctgatatagagcccaagaacttggacccctccgggggtggagtggccagcgaaccccatatccaccaaaagcagtttcttctgctaccctcagggtactgttgaaagaaaatttcgagaattgaattcccactcacctgctagggctgatgaatgtgtttcagtctatgtgggaattcagagtttgtagtcttgggagtacgggcaggccttgaccgtagagaacattgtcattagtagaggagggtttccacagtcaactctctgtccccttccctgggtttcctgtttgtgaatgagccacattgatgctggttaattattatggagtaatgctacttagcagagaggtgcgctcttagcttctcagagtgctttccctggtagttttcctgtcagacaagcccaggaggagggactggcctgagacaggctatcacaggctcctgcagcttctcccatctctctgagggcagcggcttcctttgc

SEQ ID NO: 28457 - DNA, 1193 bp, Mus musculus
tcttctgctatgggccttagagagccgagaccggtgtcttagttctctaggctacagagggcaggaggaacgccagaaggagtctggtagtaagcattatgtctgaatttaagacctgacctgaactcttggtgaggtggctcaaatctgtaatctctgctcctgagagactgaagcaggaggactggcataaatctgaggtcactctgggatgcatagacagttccaggccagcttgggctgcagagtattgaccctaaagtgaaataccaaatcctgcctccagtgggagtgggggtggtctctgacgcgtgcatgctttggggacacctttcctcctactttgttgccttgttcaaccttaagaggagagacggtgtctcatcttactgcaactcgatatgccatgtttggttgatatccattgtagggtatttgtgctgatttgttgttgttgttgttgttaacttgatccacgcctagagatatctagaattattaaaggcatcacttgagaaaatgcgtcctccatcagattagtctctggacagattagtctgtggagcatttttcttggttaatgattgatggggtagggcagagtgcattgtgggtggtgcctcttcagggcaggtggttctgggttataaacgaacgcaagccaagcagagcaggggaggcaggctagtaagcagcacaccaccatggctttgcttcagttcctgcctccaggtccctgtctgggttcctgtcctggcttctctgcgtgatggagcgtcctcaggctgcttttggtcatggtgtcttatcacagcgtagtgatttgaggcagcattagagctgggtgtggtggcacacacctttagtcccaacactcaggaggcagagacaatcggatatctgagttcaaggccagcctggtctacagagtgagttccaggacagccaaggctacacagagaaaccctgtctcaaaaaacaaacagaccaaaaaaaaattctttaaaatgggtcagcattaaggaagtttgtatttctgagaaaaattccgtctgtacctctcagaagtgggaaaggactatcacttaaaaggctctcataggtgacaggtaataaggtaggtacttcctataggccaacgaagtccaccagagtggtgttggtctccctgttctgtattggtcattgaaacc

SEQ ID NO: 28458 - DNA, 1175 bp, Mus musculus
cgcctgagttatcctcttgtaggttgttgatatttgtactaatttgtaggtagagacaaatactggctacattgttagtcctttatgtctgggtatcctgccattgtgggttcagccagctgtggctcaaaaatattttaattaattaattaattaattaactttatatcccaatatcaccccatcctcctcacagtatccccttacacagatcctccctccttttctcctataagaaagggaccccccccccccacagtattactctccctggcacatcaagcccctgtatccttgcttactgaggccagacaaggcagccctgttaagagaaaaggatgtatagacaggcaacagatttagggaccagttactgggagatcctcatgaagtccaagctgtagttctgctacatatgtggaagggcctaggtccagcccatgctcactctttggctggtagttcagtttcgggaagctcccaagggtccaggttagttgactttattgaccttcctgtggaatctctattatcttttggccctttaatacttctcacaactcttccacaagactctgtgaggtctgtctaatgtttggctgtgagttctctgcatctgtttccatcagctgctggatggagcctctcagaggccagtaatgctaggctacgatctgcaagcataacagagtatcattaatatttcgctaataattggttcttgcccatggggtgggtctcgagttgagacagtcattggttggccattccctctgtctctgctcttttccctgcacatcttgtaggcaggacacattttgggtcaaaggttttgtggatgggttgctgtacttatctgtccaccaggaggcctgcctgaaatgttcgacatccttagtcatcagggaaatataaatcaaagcaactctaagattctaccttcagaatagctaaggtcgaaaactcgagggacatcacatgctgatgagaatgtggagcaaaggaagtgccccaccattgctggtgggagtgaaaatcgtccaagtgctctggaaatcaatttggcggtttctcagaaaattggagatagttctacctcaagacctagctgtactaaagatgctccaccattccataaggacgtttgttcaactatgttcatagcaactttattc

SEQ ID NO: 28459 - DNA, 1108 bp, Mus musculus
caatataattggcttaattttagttttctgattccaggagtgcacgcttcccctgtctgtctcttgtcttattgattttgatggcaagagattaatctggtgctctgaggagctgggcatcaagagctctccagcaaggagcaattttgccctctggctgcctggtgctcacatatctctcatcagcaatttgtaggactcacccccctgtgccccacaaaccccgatccccaccccttggcttagaactgtctttgcagtgcccctgaagggaggaggaggaaggccagcctttctttagccacatgaagcctgcatggagcctggtaggattggtctgctcctgctactttgtatgcaagatagctcctgcttaccactcaccccagttttagctgttcgtgtccgtggatccttgggctagctttagcatatagatttcagattacattggaattgcctatgtctttctgtgtttcttacttcacaattagaccctgaaaaacagagtttagccttgtttctcatgcacgtggtaacttgaatagctagctatccacaacatatttcctgaagtagtcaatgacttgagttaatcaggatgatgtcattgactttattaattaacccagtgactttatttaatccagatgagaacatttgggggtactgatagcttgaaaacatggtttccaactggacagtgggtacttaacagtaccggctggcatgtgtccaaagcgtggtgattagctgtctcccatgtgtttcatggtgctagctacagcattatctaaccatttccatggtgagggaagctccaaggctgtcccttcccctggattatagaggtgttctctgtaacccatggaggaggtgagcccatctgtgctatgctgagttggcagatgccttcacacactgccgtgctagacttagggtttaacatagtccttccgacagtgccttaggccctctgtgcatcgggtccttacagagggcctatgctctgctctttagccatctgagcttgtacagcatcaccgtcagagtaggggagtcaagacctgacgagatggaatgcactttttacaaaaagggaaaagca

SEQ ID NO: 28460 - DNA, 1056 bp, Mus musculus
atctcagagaagggggaaggcagagcagaagcgttcccctggcgtccatatctatgccatctgcatacacacatgtacatgcatatgtacacttgcaaaataaaccaaccaagaaagccccagagaccagaggggaagaagtctggaatgtcaaccaagcccccagagagccacagcgaggtgcactaccttgctagtcatgtttctcgatgcccatggtttatggtttagccttctgttccatcatgactgccacctcaggaattctatctgatggtcttttgctgtgagaactgaatgagtgactgaccgtattccacaccacaagctgtcgccatgtcccgtctcccatgtaaaatccttagtagtctagtcatttggttatcaatatcctgtcaatcgagattctatatgtcgataccacactcagtttttaagaaattaattttatttatttgttttgtgtgtgtgtatgcctctcctgcatgaatgtctaccatttgcatacagggagcctaaagaactggagtcccaggcaactgtgggctgttatgtgggtgctgggaattgaacctgggtcctctgcaagatcgctattggctttttactactgatgcctctctttagctccaacaaagccttttaactttctttttaatttttatttactttttcctgtgggtgaaaagggtcaaactcagtactccacgcttccgtggcaaacgctttgccgactatgcccctcctcggcactctcttacgacttaacacattttaacagctctcaatcattcccatccaaacagaccatactgtaaactgaacatcagggagggacttgagtcatagcacactgtcaccccaaagaatccctctccttctgggcggttctgtctagcaggtgcaggccagcggaatgtgccagtaacgtggcagatgctcctctcaacagtttccacgcgtgggcctccactcctggcttgggatcacatgactggtttccagccatcccctgtggccctccatggagcagagtgcacagaggagatcttagaa

SEQ ID NO: 28461 - DNA, 1173 bp, Mus musculus
ctttgctttgagatatgtttttttttagaagtctatctcgagagtcttgctgataagttacttctagtctttcaagagaaactaaagcagagaagtctgttttctcagtcatccccttcctccccatgtgctcctccttagttcccttccgtctcttcccgcctcttcctcttcgttctcttcctcttgggtgtatatctaccttgggccctgtttcaactggaatgaatgactaatcacaaaacttgccaagtaattaccttaatggaaaggtctttctccttctcctgcctcccgcaccgtgattcctataagtaaatagcttcgttataaagtacacccccagtcttgtgagagccctttgtacatagaagcttccttataaatgtgtctctgaggaacagcatgtaatggggacaagtggggaccttgggtcaggacctgggtcagacctcagtcatcactgctgtgacacagtgcctggcaacaggatggtggagaaggaaggggggttgggtcatggttggatatagtccattgtggaaggagcgggaggcagcaggtgactctgtccacagtcagcagagagatgagctgtggtgctccgttcttctttctctctttaaaccagcccgtgagtggttgccggtcacatttagagcgagtctttccacctcagccgacgctcacaggcacgcccagaagtgtgtttcctaggcggcttcagagacgcccagctctccgcttacactggacagaggctgccaggctccgtgttcctgtgaatttgtgtgacaccctccaccctgtatgtgtgagaaaagaaagaggagtggacgttccacgggtgctcagtcacaaacggctgccatgggaaggttgatgactacttcatcagtgtcttctcaagtccaacaagccctgctccttccgatctgcagtcagcctgactctgcacttctaaaaccgtcctccagggaccgtggggcactgcagactccctaggtgcgcactggggatctgcaaaggcagatccaggggaggaaggagcacgggactcatcttcaagagttttctgtgttccttgcaatgcgctgtatgaaatgtgtatcctctgagacgtgcatggctctggaggcgtgagagtgctccagtatgggacctaaggggcat

SEQ ID NO: 28462 - DNA, 1199 bp, Mus musculus
tttttttttcccttggaaaaattttgcttttggttatctttgttattctttaattagtaatctaattagtttagtgtgaagatgtttgtgtgcttcttaggggtcagaggacaaacttgtgggagtcagctctctcctgccaccatgccggtctcagagatcaaactcaggtcatcaggcctggtggcaagtgtctctaccccttgagtcacctcactgacttttccttgttattgtttatatacagtggccagcataatgcacaacttatatgacatagttttatgtggcgcttgtagggatttgcgggccctttgaagccccactgaggccaaccaggtgggatcctagctctgtgttgtcaagtttgtggggtttcacagaccgtttgaagctcctctgaggtccaccagttgggatcgtgtttctgggatgtaacccctttctgggttaattgtatcctgatgtatatcaaggcttccccattgtaattggaggtagaaactgaccttgtgctgcgacagctgagctcagctgaggttggcctgctgatggctgctgccttgtaagacagataagagagaagcaagtgactctgtagggttgctcaagataaaaaacatgtctgtgccaaaagcactgcctttgtgctggtggtttcctgacgtttggtgggaagggggaaggggagggtctaaaatgctttatgacaaatttaaatccctcagttgaaacaaactagaatgaagggaagggatccctctgtgatggataagctcagttcattagatacttgcacacgtccctgtcatcttggaaaaggcaatacaagcacagtgagttgtgtgtgtgcacgagtgtgtatgtgtgtgcacatatatgtatgaatatatgtgtgtggtatgtgtgtttgagtatatatgtatgttgtatgagtacaggtatatgcgtatagtgtatatgtgcacatatgtttatatgtgtgtgtatacatacgtatatatatacacacatatgtatatatacacatatatatgtgtgcatgattatatttgtacatatgtgtatatatatgtgtgtgtgggatggtgtgtgcatttgtatgtgttgtatgaatgtatattcatgggtatatatgtctgtgtaatgtatgtatatatgtttgtacatatatgtatatggtgtgtatatatgtattg

SEQ ID NO: 28463 - DNA, 1231 bp, Mus musculus
tgtgtagccctggctgtcctggaactcactctgtagaccaggctggcctcgaactcagaagtccgcctgcctctgcctccctagtgctgggattaaaggcatgtgccaccacgcccagccttggtgaaaccattctgagtgaaaagaacctacaggtacttactttgctttttctcatggctcctgcagcttgccgtagcgaatcatttcatggctggggaagtctaggaagccagtggctaattaggtattttaggaaaattgccaactcgttgcaaaggtcaacaagagtgtgggcgggagaaaaaaaattggtctgtttatggaagccctcctgagattgctgagtttggagcgctcacatattccaccaactatctgcctcctctccttctctccctttctcccatcttcccttctcccttcatctctccctccctgcatcccaccccctttcctgactttttaagacagtcttactccatagtagcccaagtggccctagcactcactaggcagctctagctggcttcagactctctgcagtctttctgccctggctcctcaagtattggcaccagagatatgagccagcactccggactcattgctaaacctcaggttccacttgggaagtgaagacaaagctgtctcctagcaagcactattgtgtgatgaagactgacagaccccctctcgagcacgtgccctgtggcagatgcttactggctgcttcctcctgtgccagatgggaaggcactggtcctccagggttgagtggaggagaagcaggctgaatgtatttggtctctcctctcagtgttttcctctccacccacccttgcttccaatctttcattctcctccaggctgaatgaaattgagcgtattgtaaatgtattagcctttgccacagcaccctgagatttgccctggtgacactctgacacaatcaaaccatggctggccttggttgagttgtctgacgtttcacctactctcctgcggtagtgatgcccaacagtccatagagtcagggccagatgggagttgctggggctgctgatggagggcttgtttctctaggtaaccatcacctaggctggcggacagtgggatgtccctttttcctgactcatgcctgaggctaccaacttgcagagacaatggaaggaaggcaacagttttctctggagggaagcggatagagttgttaatgtctgctgagggc

SEQ ID NO: 28464 - DNA, 1212 bp, Mus musculus
gagctgacagttgagattcacagtattttattccacgtgtgctctaatacacacatacgtgatattaaaaggatacacgcatgacttttttccacatggatgagaggagagaagagcagagaagtaggagacgagagagcatgagagagcatgctgtctgggggaagttatttcccttggcacacccactgtctgcttgcatggtgttgggcttcaatatttgtgcttctgtagaaacataaggtaggcacagtggtgaatcccatgtggatggagacattgaggctaggagaggtcagctctgctaaggcagttttaccagtaaaataggagctagggtctgaatccaaattaggagataattttgcaaagttggggtgagagcacacctgtcatctcagctcttaggaggcagaggcaggagaattgctataagtttgaggcagcctgggttgcccattgagttctaggataatctgtgcaacataacaagactttgttaggaaggaaggaagggaggaaggaaggaaggaagggagggaggaaaaaaaaagtaagaagatagttttaaggttacagagacaagcctatttgtaacttcctacaataaaatgataacattcaccatcagcaagcactttctgaccacgcagtacagggtggtcgtcacacgtaagacatgcatatcatagattctaatgtccaactattaggaaaaaactgtttctcataactattttatatgtgccgagagaccaagtcttagagaatgcttgccttctttgccctatgcactttgccaggtagctgagaacctggaatgacacggtgtttttaaaggcattactgtgtgcaggaaggccaggcattattttcagttcttggaattgttatttagtaacaataacagtattgttacattgttacatttttatttgtattggacttctgttttacagagaaggaaacacgagacatagtggataaggtcacagtggtgagactataatgcaggtgtctgaatgtaacccaggtacacatatgcacacattctctgtctgtctctctgtgtgtatgcgtgtgtctgtgtctctgtttccctctctgtctgtctgtctgtctgtctgtctcttattctctcactctgaagatttacctttctagagttctagagtttctagatgctaacatcagttcaagctgcttcagaga

SEQ ID NO: 28465 - DNA, 1185 bp, Mus musculus
atgcgtttagcaaattgtatcttatatcttgggtatcctaagtttctgggctaatatccgcttatcagtgagtacatattgtgtgagttcctttgtgatattgggttacctcactcaggatgatgccctccaggtccatccatttgcctaggaatttcataaatccattctttttaatagctgagtagtactccattgtgtaaatgtatcacattttctgtatccattcctctgttgaggggcatctgggttctttccagcttctggctattataaataaggctgctatgaacatagtggagcatgtgtccttcttactggttggaacatcttttggatatatgcccaggagaggtattgcgggatcctccggtagtactatgtccaattttctgaggaaccgccagactgatttccagagtggttgtacaagcctgcaatcccgccaacaatggaggagtgttcctttttctccacatcctcgtttatggctcattttgctgatgagcccttgcccctctggctcctgtgccccttctcaatccagatgttgcaggtatcactagctcaaggttgaaaggaacacttgcagtgctggggtagggatggtcttgggactctattaagaggtagataagacaatcttccaaagttcaagggtgttggctaagaaatgcaggctactcctgtgcgtgcctggagtaattggtcttgtgtgcgtgacactgcaagatgccactttttctcacagctgttccctgtaggaggctgacttggctttgcttgctgcccttctcagccctgttctcccctgaggtgggtggtcctgaggcatcaccaccagacctctttcccttctgctctctcaccagtgctgaggaccacctctctccgttcctgtggttcctgtggcttccctgtggttctttggctggtttgatgcctgttcaattccaccaggctggttaacctccgcagcagcctggctgttggcctgatctgatctaagatttctacgtgtgatgcctggcattttggtggacttgcggtttgctctttttctcttccatttttgaccaagggcatcaaaactgttattaaaagaaacagcctttactttgtatgctaacctgaaaaaggttaatttaagaaggaaatagcatgcaaaggtcacccctttaggtt

SEQ ID NO: 28466 - DNA, 1094 bp, Mus musculus
tgggacatgtacagatactcaaaagcgatactgaggttgggggtggccctgcttttagtttaacctaatcgcctgggaggcacaggcaagaagtcttagtttgaagctagccagctctattagggggacctagtcaattaataaattaaaatggattgtgaacacttcaaatgttgctagtctgagctccagatctataattagttactgtgtggagcttgctttgtgagaaaggcagagagaattattagtatgtgctggaattattagtgtagctagctacagtgctgaggtggtgtgagagacaaatgggaggtagtctcagtttgccctacaatcatgtctgggaacacgggattagacattaaaaaaaaaagaatccatcaaatctgagagaatacaatggtgcagtagaggcagctgtcttactggctcccccttccccttctctagttaccagatgtgtgctattcatggtgggtgttggcctccctaaagatcatcgggagacttcattggattgacagagaaaagcttcgaagtttcatcttagcgtgtcaagatgaagagacgggaggatttgcagacagaccaggagatatggtcagtacaattctggctttgcagtttttcattgttgattgactttcatggttataggcatttctaatgcactaaaaatagtgccctgtaagaaatagtccaaaggttgtcttgggggtttaccttgggtgtttttttaaaatgtgttagttacaaaggctagagctgatagaaatatcttgtagtgataattgtttatgtctagtattagaaatacttgtcttcagaaaacttttaaagtggtattcaagatacacttcactgtggacagatagataattgagccttttccatgtttgtgaacttcccacaggtggatccctttcataccttatttggcattgctgggttgtcacttctgggagaagagcagatcaagcctgttagccctgtcttctgtatgccagaagaggtgcttcagagggtgaatgtccagcctgagctagtgagctagtcagatgggagagatgctgtagtgtgcaatatgaatt

SEQ ID NO: 28467 - DNA, 1023 bp, Mus musculus
agaccagctgctttgtgggatgtgaaccttttttaaagcagggctttgattatgttactaaattactagcccgaatggggggcgaggcatatactcctgccattttataggttcctttcttttctgggcccttgcaagctactaggctattgctttctatttgcctagctggtttcctcagaagttgggggactgcctcctagtgagcatagtcagtcttgactttggggagtttaatgggttttgttcttaggtgacttggtagcacttacatgtctgccttggctctttttgtcttttaggagaaattgatacaagattctcattttgtgcggtggcaactttggctcttttggtaagctttgactgttgcattaaaggaccgaattaaacacttgagtactaggtagctgtaataggctgcttcctttctcgtcatagggcaagcttgatgctattaatgtggaaaaggcgattgagtttgttttgtcctgcatgaactttgatggtggatttgggtgcagaccaggctctgaatctcacgctgggcaggtaattttgcaattaaagtttataggggttttgtgttgtgaatggccacaccttctcactgagttttgtgtatatgctgggtctacacaacttcaccctaagtaaacaccagtgctccttattggcatttgtctgtttatgtggggtctgcattctgtgctgttaactgacctcgaggcttactgtgtgtgtagtccaggctgtcctcggggcttgctacgtgctgggattggaggcatgaccctgaccttattcgtacagatgaactaaccttacccagtgcagagaacattgtgcataagtatagcattccactgtcgcattgaacctactaatacaacctgagataacaaagatggagctttagtaattttggtagtgtctgtcatttactgttaaactatacctgtgtactttatgtctgtaattttagatctattgttgcacaggattcctggccataactagtca

SEQ ID NO: 28468 - DNA, 1156 bp, Mus musculus
ggccatacttggactgccgcttgagctgtgtatggctcagcgttttctgcacttctcgaggcctgggatcttatccgcggaccgtgggcgagccttcctggattgggccgcctgatattttttcttaacatcggggacttgtacgtgcctgtattttgaaggttacatgatcatttacgaatgttgtttcatagttaaacattttaactgggatggaaggaagtcggccttggcccacgccttttaatcctaacactcttggattaaagaagtgaggcagaagcaggtggcctggtctacacagggagttccagaccagacagggcttcatagccgagactctgaataaagtaggaaatttattttggcaatcgctttgacctacttattgggtgagtcttagaatcgaaggtggaatttggagctaatgggtctgattatttagcaaaggggttagcatgtgaagactgtagaaaggtgcgctgaagcctcaaacttgttaagcaagagtgtgtatttctggcataactcaaaagataagcgtcaagattcgggtcaatgatgagctggcatgtattctgaatctaaagttgattataaaccactttagctctagaattactctgagacctgaaagaaaaaaagtactgagatctggctatgtgtgagtctgagatgtcacgatttccggatggtgaatgggatctctgcttttttcttggaagggcacacagcagaaagacgttactatcaagtcagatgcgcctgacaccctgttgctggagaagcatgccgattatattgcttcctatggctcaaagaaagatgattatgtgcgtatgattcttttttctgttgaaaggtttctaagactaacagcaataagtataatacttacttgtataatactaattgagaggcctgatttaaaatgtattataggtgtaccttgtatatcagaggttggtatttgaccacatcagtcatgtgctggtacataaagggcggaagtgcagggctgcaggtagaaggggtttgctcatttctgtctggggtaaaaccttgaaggtcaatgatgtgttggcatgtattatctgaattcgctgatgtgtcataacactttagctctagaattacgctgagaccttgaaaaggt

SEQ ID NO: 28469 - DNA, 1156 bp, Mus musculus; identical to SEQ ID NO: 28468

SEQ ID NO: 28470 - DNA, 1430 bp, Mus musculus
tttatatttaatatataacatatatgactatattaatataatatataacacattattatatcttatataatttatatggtacatgatatgcatatatacaatatattatgcataatatattagcactatatatacagtataaataaatatattttagaatatattaatatgttatattaatatgatatataatattactagtgtgtaatgctatgtattaatttttattgattgattgttattagttataaattatatatagtatgtgtagtattaatattatatagtacgtaattatatatcatatattcatatatatgaaataacatttcaatttggtgctacagtagagctgagacatcaaatgaatccagatgtttaaactccattgtgtttatctttcagatttatgaaggtactgcacaaattcagaggctgatcatagctcgtgagcacattgaaaagtataaaaattaacaggaattactattgaacgatgcatcaccctcgtgtaactaagctccaagcactgttgctgcttcaggggaaaagggctttactgtcttcccaaggaaatgagatcaaagacgagtttggatctgtgcagcggattcccatggcggaggaacctgtcttcagctctatggtgaccctttctagataggtttggcttttggacaatgattggtccttagccccgaattgtgttagtttgctctttgatcacttaaaatggaaaaacaccctggacttttaatgttcattcaagtgacaggaaaggcggcttgtcaaggaagaactcatgattctaacataaacactgaaaatttgtggtagattggacacgtcagactgtgacatagcagcatttctgtgctgaactgttaattttataattttgattatatttgctttgttttgcacaaaagagtaaaaagtttatattcatattctcccattataaaactaaaacttttctgggaatcttagtactgaacgagaattttatttgtcttgtttaaaataattcaataaagctaaccttaacttatttttctctgactctccaggtttgtacaaacccttgggctgctgtacccatttgtgttttacacataggacttttaaaaggaactgaagtaaaacaagcagtgtgctgttgtaggctgtgtgtgtgctgttgtacgctgtgtctgtgtgcagtgtgtgtgctgttgtacgctgtgtctgtgtgtagtgtgtgtgctgttgtaggctgtgtgtgtgcagtgtgtgtgctcttgtaggctgtgtctgtgtgtagtgtgtgtgctgttgtaggctgtgtctgtgtgtagtgtgtgtgctgttgtaggatgtgtctgtgtgtagtgtgtgtgctgttgtaggctgtgtctgtgtgtagtgtgtgtgctgttgtaggctgtgtc

SEQ ID NO: 28471 - DNA, 2086 bp, Mus musculus
aagccctggtgctgtgtggcgtgtgccttgcacaacttgcactcttgtaactgcagctgcacgttacgtataagcatatacagcttgctgccaggtagggaactggggtagggaaaggaaacttacagtcttagaatgtcttgagcatggcttctgaattactgaataaaatctaaatgatctgccaggtaagcagtcagaaggagtgacaacatgtaaacagaacagccagcatggtggtagtggtggtggtggggggaccctaggtagaaccaccacagggaagggacctgagctgcagtgaccaccctgggttttagcctctgaactagaaggcattctctgcttctccctggggcaaccattcactgcccaggtttgactcctccaggttccacaagctttgtttctggagttcttggaccagacatcaaccaagttatggccaagcagatacgtttcatgtggctcacatgagggtggttttcctaattgggtcatgattttaaagtacaattagctcacagtgggagtaaaactgcatctctagggtttgttttgtttgttccctttaattggaaaacttgggttgttggaggcacacatcccacatgacactcagccagccacattctggctgtaacatttgaaaagagtcatccagttcccctcagacccttcccattgctagctctctgacagacacctcattagttggtccctatgggtgtcagtctgtggtggcaagccccggataaacactggagagaaacaaacctgttaactgtattagtgtatcgtaggacaaaaagataaactgctacaattcctacggatgcaagatcaaaatgccaagccctttgtataacgatgtttaggaatttgaagatagctaccaccaagaatgaaatcaaggttgagacttctctctctctctctctctctctctctctctctctctctctctctctctctctctcacacacacacacacacacacacacactctctctccttttgagatggtatttggtatatttagcattgtctctagttcatgcaggcatgagccactacatccaatgtatgtgctaagaaccaatcaaacccaaggctttggtatacaccaggcaagcactctaccaacagagccacctctaacaccatagagcaagatactctgagcataggcaactgcacagctcacacactcagaaagccaactctacatagtaagtaggtgtgttgagttaacagagaacaggtgccttgcccctaacatggcaatttagctgtcctgtcctcattaggaaaagagggagggcactggttcctggaataaatgctggggggctctgaaaaatgaccactgcctccctcctgtgatggaggccagaagtgactttaatcgaattggagatggggaaatagatctgacactgctatgcaaggaatacaataaaaatatattcctaccccaccatggtgctttgcacatgtgggtgggtcctaacagggattcaaataggcacaaatgttaatgtgctaaaacccaataaagtagtttaatttcctagaattttgtctgttctgttgcagtaaatattacttggggtttgtattgcactttcgatcatttaactctcaaataaaagacacaaaacctttattataagccttaaaagcactagagctgggcatataccaaccctctgtgctgttttgtctactcgactgtcagtagtcccaagatgtcacttgccacatttcgccttggccgctcctgctccaactggccgcccctgacagccatgctctcaggatccacctaccccatggtgccttcttcctttttccaaccctccccatgccaaggaactgaagccccagtacccctcttctgcccagctacaggctgtaggcatctttattcaaccaatagttttaaattaaggtacaaggtttgcacaacaaaatctggtataagtgagaattgaggcactagacttgtcttgaggcaaccagaccttggaatacagaaattagcatttcattacatagctacaaaccaaacctcaacattgtt

SEQ ID NO: 28472 - DNA, 1174 bp, Mus musculus
ggggtctgcgtgcatcacaaaactcttttcttcctttttcttcattttcttagtttggttggatgtttttgttttgtgcttgagacaggatcattctctgtagttcatgctggccgtgaactcacagtgatctttctgcctcagccgtctaaatgctgggataatcagtagtgatgcacactaccacacacagcttcatctcagaccttcttgtctgattaagttcagacctttgaataaaatgtacaagttcaaaatggtcctctactgaccttcctgggctcccaagcctgctactctttagggagtcacctgccccctcagccatggctgtcttgggccctgaagactttctgggctgaaaaatatccttttaaaactaatgtcatctcagtctgtaagcctctggaaagcttcggcaaaaatgagcaatacttgggagacctcccagtcagctttcctaacatttttgagaatatcagaatactgcatgccggtcaccagccacctgtagtctggggggtcagcagccacctgtagtctgggaggtcaccagctacctgtagtctgggaggtcagcagccttatcctgggtctgtggtcttcagtatggtcacccatcaaatgcttcatggtcacttatagtttgctgtatatgtgacatgagtctcatagtttcacttaaaattgtaagttcacaaatttaacatgttaagacctgtctgctttggttttcatagtatcttaacctggagtaaattctgtagaacactgaagcccttgtctgtctcgtgtgtttaacacaaacctcatttctgcatagctcctgaccctgtggccttattacacctgctctatcctggaattcttttagactaaatggaaggacagccttttagaaatctcacaccagcattatgtccaaggagatgatggtcggctattcacttttagtagtggttggttactcacttttggtgtgtttttcttcaaacgaacacatcctcccatttctacaccccgccccccacccccacccgtttccacatccttctctttcacatcgtgtggcggattgtcttgttccatttgttctgtagatagagtagcaggttgtagtctgaagatggacccttgccaagtagtgagtagacatcattcctcatgtatttga

SEQ ID NO: 28473 - DNA, 1231 bp, Mus musculus
ggtcttctcggtcgcaccgcgggttgtcagacacggtaaggcaggaacccagagctccgcacaacccgaccccgctaggtgcccgcccatctgccccacagatcgttgcccaggaaacgccgcttgcgcacgctcacgccatcctagcttttcaagtctcagggcgcttccagggccgcggtgacgtggagagcatggaggaggcggggcggggcggggcggggcggggtttggagtgcgcgtgcgtgctaagtgtgctcccggaagtcggccatggcgtctctccgcgaagccaccctgcggaaactgcgcagattttctgagctgagaggtaccaaggcggaactgagttctctgcccccctgcacggagagcgccttcccaaggaccccgcgcagcttcctgtccgataccccttcctgtccgctccgtcctggccaggccagccagacttttccctttttcccttttcctcctctctgtgcgagcctaaacttagatgtcaggaaggagcagtaagagaattaccaacgggaagtaacactggcttaactcagtggtagaagaccttttgcttagagtctgcagtagtcgttaccttgtttcttttcttttcccaagccccgctgcttaactccactttattccaatgtaaaccccaatacggaggcaatcatggctttaaatttgataatgtaagtttggggtacagctgtctggtaaaattgatatttatgagtgcctaaaatgtacggtcttatatttggataccagaatgattggaactattaaatccaagctaacatgtctgtctctctcctctccttctccctccccttccccctcctttcctacctattcctccttcttatctcagtccctccctccctctttatctttcccctccctctcattctctctcaacttgttaaaaaccttattaatatttttgctgattagagggttccactgattcttgaaagtgcaatttgtcatttaatgagttcattgagaagtttagtcctggggtttgtgttgtattctgattgcttatataaagtgtagtttgatcatcgttaataaaaatattagaagctaggactggtgtcgcaagtctgtactgtcatctacttgagacgctaaggcagtaggaacgaggttcaagacctacctggattgcacagacaaatagacgatgataattgatagacagatagataataggtagatc

SEQ ID NO: 28474 - DNA, 1138 bp, Mus musculus
aaactgacagccagtgtctattctatcttatatgctttgtgggtacatcgacactgtgtgttcaaacaggaaaaaaaaaaaaggagaaagaaatcaaagaagctaacgttcttttatttctccagtctgcttccaagcaatagacttctttatctctagctcagaagttggggtaacactttaattaagcttcatttataaacttggaaagttgatgcatcagagatgaacttatataaaccaacaacacagagccacagagcttggagggaagcctcacctcagaactacatggaacccttggcatttcattaaaaatattaaatgagctcctgtcaaggtttatttaaattttaccttatccagaaagctaaattaaaatcagctgtggctttgagaagttggaaaaaaatgaaaagatgcaaagatttcagattaaaggaaggttttatacagaaacaagaagaaacagacacattaaaaacacttgaatttgtgctgttgactttatagatttggaggtattgggagaaattctaatatatgctaaaccaacatgtatgtcatattgaagttatagcagtataagggtcactggaacagagaaagctgaaggtaggaaggaaactatgagggactctaggggctggagaaggagctgggcagaaggactatgggtggaaaagtgccacaccagacacatgtgcaatgaaaaatacatatgcaaccaaccagtgctgtaacatgagctcatcatcagagtagagctctcaaaaaagtctctaaacacttgcattgagaaaatacacagagggtaaaaatgtcaattctggtatctagtaataaatttaaaatgtatccctgatctccaggatagcttcacatctcagtctaccatgagtacttctccaccatttctacattgatccttttctcttttacatctgtgagctcagctttttcatatacatgatgagttaagattgtgtgggaatttttctctgcctggcttgtttcccttagctcaagactctcaagtttcacctgttattttgaaataactcaagttccttaggtacgtcagtgtaccacatgcctgtagtgcccgtggagacataaagagggcatcagattatct

SEQ ID NO: 28475 - DNA, 1174 bp, Mus musculus
agttgttgtggtcatgatgtctcatcacagcaataagactttaactaagagaaacaggaagctgaatgacatacccattccttgtttgataccacaaggcaccagataaaagctcttctcctttagggcagaaacagctttgccccttttccttatgatgtccctcaggtagaggagctcatgtgctgtttgctcacctgtgctttgcttcctgcagcttctctggtcattttgtttccagagccttttacccattgccatgctaaacccttgagcagttatttacgctgtgtccctggctttcaggcatctgtgtgttcatgcacttggtccacactgtccccatttctgtcacatcaaccaaattgactcaaaatgaaaataatgaagagtattatggacttatgaatggcaaggtttggatcagaaactggaagtctgagtacttcactgtgaactacgcacacagcacacattaggaaatgcgttgtggtgagactgagcaaaggtttcctttttaagcgtaagaaaactttccccgagattcaggagattgtgttcattcatgtgcattcttcatgagaaggtaagtgtgcggcgactgtttctctattctttgcactagaaataagcattttgataaaatacattcacatttaaggtgcagcatatacatgctagcttatttgacatattatctaacatttctgaagtttttctagcttggcagtcactggagaatttaaaaaaatagatagcattcccctactttcttgcagtcgtgtttctgggcatggttgataggagttcatatacgattcaaactctggacataaaaggcagggaggcaggcattgtgtggtccttgtggtcatgggatagtacggggttcataaggtgggttaccttttgctgtcttaagattcaaattaaggcagattttttttctagagaaaagttttaatgatgagatttctgaatcctggagcatcctgttgttggccaagggatgcactggtttgcttggtgggaagctggcactgtagaatggagtccttcctggtccattgtagtacctgccgccatcgacctagcagattgccagccccagtcctctgtaaatcatctctttctgcttgggagaccagagcaattttgtagtgattttgctcta

SEQ ID NO: 28476 - DNA, 1099 bp, Mus musculus
cctccctccctccctcccttcctccctcctccccatccctcttcctttttaaaccaccgagtacattagtgctggctctatgtgtgtaggtataggaccatctgtctactagaacatgggtagctttcatgggcatgaagcttacattgactcctgatagccttcaattctcgatgatatcccagcttgaatgggacttcatagaccctccccagtttatgctggaactttggtggcttgatcttgttagactgtctttgtacacatagtcacagccactataagttcatatgcttactgtggtccagctaataaccattttactaccatgtaccttgccccaccccacccccgtccccgtcccccagcttttaaaatttttccgtgcccttttgatgatcaccagccttagaggaaaggatatggtatagatgtgccattcagagctaagcactccacacgttgctggcttctgtattgatctccaacttataggaaaagaagcttctctgatgatggttaatagagaactggtctatgggtataaagataagaacacaggtgcatgtgtcccttaactgtgtccatttaccggtaacattgtctcagctccctcagggcctgtgacctacctgccatgggattttttttgccctattaatggtgccatgcttgagtctgtcttctgtagagagctaaatctgatcaggatttggttatttccataacatggtgttgctgttgcactgtgggcttttctggaaaggtagggtttgcaactgagtgaagactgttgattacctttcttcccttggtagaaccttctagcactatgagattatccagtaaggataaagctttcagatcagtaccagcttaatggttccgtgtcctgtgactcaagtgtatagtacttcttgtaagagcttcatattgtcaaagaactatgaaagggtcaactcttgggcttgcttgagagtgggtcccaaaacctagtaattgtgtggatgatatttggtaattgttgacttaagtaattacaaacttgtttctgtatgtcaatggagaacctcagcagaatatagttttcccattgcca

SEQ ID NO: 28477 - DNA, 1111 bp, Mus musculus
cctagcttcttgaagagatctgtgtcttgtgattagtactgtccacatcaggatttgcccctcagttgtatgcttcctggcactttgttcatcttaaccctaccttcaaagtctcagttagctacctaatgaatacaagtttagcccatggtacttagttaatagttcaaatctagaagaattttaatggagaggaaattccttttaaaactttgtcatagtagaaaaagatgttttacatatatatttcatgaatgacctgccatgagaaatttttaagttgtaaacatctgtaggtatgctgtgctttacaactaaagcagatcctacttgttttctatcgtagattttaacttgtaaaagactagtaattagttacgtgaatgaccaccatttattagatcttcattttatattagctgggaaaagtgagcataattttgatatttgagttgttacagcaatttatactctctttttaaaggatatggaggtggttttaatgaaagagagaatgttgaatacatagaaagagaagaatctgatggggaatatgatgaggtaagctctcagatatgtatattttgagtagagaaatgttaatacctggagtttagaaaagctgtatgtgcatggatgtatgcatgtacggtatagggggtacatgtgcccttgtgtgtatctgtagaggatgttggatgatagttctcattgagcctataattcaaccattggctggactggtggaccagtgggaaaatcctccatctctacctgcaagtacagagattacatgctcacatttccacatctgcttttccacaagggtacaaataggctttgaaaataaaatatttttatgtgttttcagcctgtctattttgggttttttttttccccctctagtttggacgtaaaaagaaaaaatacagggggaaagcagttggccctgcatctatattaaaggaagttgaagataaagagtcagagggagaagaagaggatgaggatgaagatctatctaagtataagctagatgaggtaatggtccctgtcctctcccctcacctttatttactggaactattctgaagcaaaagatgcttttgac

SEQ ID NO: 28478 - DNA, 1202 bp, Mus musculus
tgtgatagtctctgtgggaacaaactaaaaatggtgtcagggatgtcatttgtggttttcagagtgtgagggctagattttccctcggctctacagtctgttagtaatgtaattcatgtagagcactgggttgttgaatctttagttctctaaaaatgaaggctagacatcaaaatgtgatatagcagttagggttttctgcttactagactggaaataggttttcaaatgaaaatgaaaagtgaactggagaatctaaatgtaaatgtgacgttgtctgcagtgagctgtgaggtgacattgtctgcagtgagctatggtgcttgttacttcccttttggcagtttaattgggcttggaaagtggtcactgaaacttttaatttttttttccttgtaaacttagtctttattacagtaagaagctttgttttaagtatttttgcttggaaaatgcatctcttgcatagacatctttttatgtgaaaaatgcactcttaatatatgtctttctttcagtgttcatatcacaaacctcaaaaatgtggtcctaggggaaaaaaatgcttccgtgttgttccaggtcccgttcaagaagctcttccagttcgcagtccaggtctcactccggttccagagaacattccagatcccgtggttcgaaatcaaggtgaatgaggtagcgcctctgtagagcagaggagagtgctcacaggcttcagacggctccgctgcttctctcattgccctgcttctgtttgtccgttctgttgtagccctgggaatctaacgcacctacctcagcttaatctcaccacacagtgttcccaccgcacagcgtgccacacattcccacggttgattaaagggggtggggcttgcacatatagctaagatacgtgtgatgtaggaaggtgaaggcaagttactccacctggtatattaagtttatgtttacagttaatttaaatttgacatacaagtgagaagttatttctgagaggaagaccaaccattccatcatctagcttcgaaacattttatatttcaggcaaatgtttacaatagctttgcctggtttttctcagtttctagtgagtgctctatgtatttactacatctccctgacattaaagaatattataaattacctgtataacaaacacccctcttaaaaccaagtcatgtaggatgttggcttaa

SEQ ID NO: 28479 - DNA, 2359 bp, Mus musculus
tctgggcttatatcaaaaaagtttataagctatcttaggttttaagttctcctgggagcatcaaggtacctagtgtgtgctctgctcttctctggtgtttgcagtcttaggaacagacacctggtctagtgctgtttacagattgttctgctctcttatgtcttacaggcaccacaggtcgtcctccggatcaacacattctggttcccgttcaagttcaaaaaagaaataatgtattaaaatttacatctttaaaaaacattgagtacagtgcatgaagcatattttttaggaagttgatgtctcatttggtcagaagtactacatctgctagtagaggtgcatgcctttattgcttttcaaaacaatacaactgtgtttatttgtgaaactgaaagtaaattgcattttaagccatatactgttccccagataaatgctctgttcattatttacaaccatttgcttcatttaaaaccatcctagcaataacagagtacttttgtttcctactttaaatccttgtccttttcatttctaaatgttctattgacagagacagggttgcctgggcttgcctggacttcagacacatgggcaaagctaataagctagttggaattaccaatttatgttcatatggggttagtagtcaacctggttatgttatttacctctgccagtaatttcttaccagcagttaactacgttgcaaagctgacaactgggaacaagctgagggtgccttagaatcattgtctcttaacagctttacacctcttaatgcaagaggattgtagaaattatagaagaaaaaggttaatcacatcatttcagaatgtttctcaaagtttaagaaatgcggatatccttttaccaaatcctagttaccaaatattgtacttgatcgataaaggatttttaaaaaaggctaaatcatagttaatgagcaaattgaagaaagcttttgaaacctgtttctcagtggcaggctgacagggacatgaatttaagtgaacatttgccttgtgatgtctgattttgaacattgcagatacctaagtaacagaagaattcttatttctgcacaatttaagcaaaatcatttttctccacatctgaaaaagaaaaccatatggcttaaaatgcttttggagttttatttctcaaattaaaatctggtcacttgagatccattttgttctctggtttaaaagttaaaaggtttctctttaacagtctcttcagcagcaaaagcaaggtaagtatataagggacaacagttgtgctggggctccttgtgagggaattatttttcctgtttctcctttagtatttgtctgctgcagtttaaataagtaaagccttctaagatgtttagtagacagatcaaacaaaatgtttttattttaaagtgagtgtttctcttctcaactgatctaaagatgaaaacaaagtatcgtacgtagaaatattttggtaatatttttacaagctttcctgtgtttttttgtcttattttccttgctgcatttactgtaggttgcacacgaactcttactctcttgtaattgtgcctcagacttctcgaaagtcgactttctgagttgcccagatcttctagatccaacgtgttagccttggtttgtttttgtgctttctgtatttaaaacttgaactgtactaggcaaatgcaagattataaatttagctaataggagtttacaaacagttcagatgattatgatttgatttggtttaattgagctgtactagttcatttcataaggaaatgatactgtagacaaatgtaaataaaatccgtgagtcaactatcaagtgttgtttattagaaataaaatagaaagttgtaagctctgactgaatgttctaaactcataatagcttttttttttgtcactgttcactttatcgtgctgactttcaaacataacaaacaagaaggcaacaacttgggataccaagtacttttcatttatgtatgcttgctaccaagacattacatacctcgaccctatggccagttagaatatcagtgtgctcctagaatcactcaagagctaatagttattgtcattcagtgataacaataagtttcttatgtttccactggaatctaaaacaaattgtcaatacaaggccacgtataggcacagttggaaagacaggcatttactgtcattctgtgtccccttcctgatgcctggtgctcagggccaccattgaagattctggtaggggataaggagggctctgctgcctgcttttttttttttttttttttttttttttgacctaggtgttaaaagtgccatcatggctttcttaacttggaagt

SEQ ID NO: 28480 - DNA, 1172 bp, Mus musculus
acgtcgttctgagggaggttgacaaacagggtttcagcctttaagctagagttcgtaactgccgttgacctcctcctttacgaaggcccagagcaccaggtcagagctctgagtctgggtctgaattcagccgcagggcccggcccagggtggaaccctgtgcgagaggagcgcgggcgctgcccggaccctgacccaagcgcagaagcggccctctaacactccgcggcggcgtttcctccgaagctctcgcgagaggagccggggaaagatggctgcgccgggtctttccgagtgaggaggaggcggcggcggcggcgccgggcgtcgtgcggtcgtggtctcttgagctgcggctttcctcgtccgagacgagggccgccgcctccgggagatgcgcgtgtcgcggacccgcggtcgccccgggagttcatgctgcgtgctaggctcgcggccgccgctctaatcgcccggcgccgccgccgcgccggctcggcccgcggtgagcctcccggagcctgtcccgcgcgccgcggcggctatgaccggggagaagatccgctccctgcggagggaccacaagcccagcaaagaggacggggacgtgctggagccctgcgaggaggaggcgacagccgcgctcggcggcgccttcaccgggggcagaagcggaccgggcggcagcggcaagggcggcaaggcctgccataagatcttcagccaccaccaccggctgcagctgaaggcgcccgccgttccgggccccggcgttccggccccgccgcagcacaacgcagtgactgccacctgccctgccccggcctgcctgggcggcagcaaccccgctttagtcgctgacggaggcggctgcccctcgctctacccggtccacgagtgcgtctttaagggggacgtgaggagactgtcctcgctcatccgcacgcacaatatcggacagaaagataatcatggtgagctttgcctaatttccgtcccctcggaggtggggtgggggtgaccgttggcctccgggttcccggtcccttctcccgcaccgtgttttcctctggcggaaaacctcgagtcttttcaggtgcagcgagcgtgccaggggtcagggtgcagcaaggatgttttcttcttttccacctgagcatttcgggacaggttgc

SEQ ID NO: 28481 - DNA, 2432 bp, Mus musculus
gtctgtaatagtttgacacccagtgaccctgagaccttcctatgtaaagcagctgtgagtgctgtgatttgtttttaaagatttttacacttcttgttgaaatatatatcaaataaatatatctatagctatatctaaaacactcctggaccattaacgtaaattctgtgtcttaagagatatgaaaccctttgaaatgcgtcacctctattcagggtggcatgtataaatgttcctttaagctttgttttcatcattatgtatagttctgtaatttgaatgtttaaccaactagaaggaatgcagttttctgaggtgaacagagcaatggtaaccatcagtttcatttacagcctgttgcaatacattccgagggaacgctccctgcagggaatgtggtgcccccccccccccccagcaccttgataacagttgcatttatagctgcaatgcattccaagggagtgctccctgcagggaatgcggtgccccccagcacctccatgcagctcatcgtggtgctctttgtttcacctgaatcctttttcagtggaaactgtttgttactgatcttcctttcatagagcttctatttttttttttttttttcctaaacttgagtttaaaggtccttgttctgttgataggtacggtaacatgcttacagctagccctctcctaagtatcagcactttaaacaaattccaaatttttaaacttgcttcctagtaagtgcatgtaagtcagattatttttaatggaatatggatgcattggtgtcaattttaaaaaataaatatgtattttggacaattatgtattaatgatttcaaaataaggtaaaaacattttatatgtaacaatatatttgttataggctaaacgtccagaaacacacaagattgaaagttctttttttttaagtcataggaaaataattattgatttgtctccaaagtgttaaaatcatgcattactcacttttacacctaaatttttttcatatttattaaaaaatagtttaaagatccaagaaagaaaagtagggagaataatgttcaaatcacaatagtatcatgttttattaaagacttagctaaatgtttgtgtcctgatgagatgtgtcaagatacatttgtcaggttgttacagtgtgactagtagtttaaactttgaccaagacttttattgaaagatgacttatttaaaaatccaaagtgttagccataagatagttctctctctctctctcttttttttttaaatttatttaatgtgggtacactgtagctgtcttcagacacaccagaatagggcatcagattccattacaggtggttgtgagccaccatgtggttgctgggaattgaactcaggacctctggaagaacaggtagtgctcttaaccactgagccatctctccagtccccgatatttatctctttacagttgcatctcacatagtgataccacctggcatatgttgacattttactttttctaagaaaaataattgagttaaaaaaatcaaagccctcaccactccagtaagtgatctatttagttttaagaactgagaagcccaaagctagcatgatgaaatggaggcagtggctgatccagtgacttagctatttagttctgttgtcaatcatgattccaaggttctgaaaggcagtgacactgttgctttaggctcattggcttgaacatgtaggaagaaatgataaatttgcagcttgggatttagaatttcttaaacatgtgaatattttgctgggtaacactggagataggactactgaaaattgttgcactggattgtactactgaaaatggttgcactggattgttttgagacttcaatttacctttaatgagtagtagaatcagattgtccattccaaaatgttttttctctgatcacaaagaacaagtgtatctcttatgatggtggaaaaaaaaggagttaattaatgcaaataaacttttcacaatattagacttttcatgatgtgcctattaatcctgttaacatcagtgtttttgtatactcttacatgcatatcactgttttgaaatgtagataatgtaagattctgtatggtaaatcttaaattttaagctggtattaggggtcccatttagaaaggtgtgcaatacttcaccactcatgtgacctatgtagataggattcccatctccaagaaaacatgagacttgtcctcagtagacattcttgggcagaggagctgcagttcataaaaggagtgtatagcaggtgtcgtggctgagttaaagtatgtttatggtttgaaagctatattagtagctaatagcaagcagttcatcacaaaattacagcttcacaggaactgggctttcaagttaggcatagtggcactgtatgccagctcttggaggctgaggc

SEQ ID NO: 28482 - DNA, 2002 bp, Mus musculus
tgctcacttaggaattaaactgtcaggagtttttgcaaagcaactttataaacagattttaactattctttctagacataaaaaagagaagaagaaagataaggacaaagaaagaagcagagatgaaagggaacgatcaacaagtaaaaagaagaggagcaaagacaaggagaaggagcgagaaaggaagtctgagagtgacaaagacgtcaaagtaagtatacaggctggggtgctgacaccatggtgctgctgctgctgtttgactaagaagtgtttttcctttgaagaagcttattttcccattctccttgtcaaagcaggtgactcgggattatgatgaagaggagcaaggctatgacagtgagaaggaaaagaaagaggagaagagaccaacagaagcagtgtcccctaaaacaaaggagtgctctgtggagaagggggtgggcgaccttcgagagtccaaagtgaacggggatgatcaccacgaagaagacatggatatgagtgactgagcccaaggctggctgcagatggtcctcagtgtcattccttgtgatctctaatgctgtgtgtgttcatctcacctaggtgtatacagctgcacattaccaatggcttcagaacacctgattgtgacctctagtgctttatagcaaaagctataaagtggtacccgggtgaccagcattgccatggttacatccatttgcgtgatcaagcagctgtgcaactgctgctttaacacagatgaacagctgcatgcatctccagcaggcatggattgtctctgtctatgatcctcagtgcgttcacttagaatatttctagagtttgagtccttgccgtgatagagccatgtagggaatgcactgattgcatgttaccccaaacgtcatgaaactttctgacacggtgacctatttaatggtcttgtttgttgacatgacaaattaacattcttagagttacatctgaaaaaaaacatttgtgatagataagccttttgagccttgtggctaaatttttgtggctttgtttaactttcaaaggttatatatgcactaaccttttttgatggctaagtaggctttaaattacagtaaaaatttttcaaagaaaactggctgtaaaatatgatgttttgaattagttgttcactttttcatagctacttatgtttttcccccaataatttatttcacatctctaccagtgaacgcagcccatcactagaaaatgaccttgtcctgattttcagttttcaacttttagtttttaaagctcactgttgaacaagaagtggtggtgcattttaaattgaccttcatgtgcttttaaaatacgacagctctccttgataatgtacttttatttgatctcaagttgtataaaaccaataaacttgtgttactttgattgcagtagtatcttatgcacagtgattccatgttatatgcagactaggtaggcaactgttttcttagttacaagctttacttttgtgcagttaaaacaaaagtaggctacagtctgtgccatgttgatgtacagtttctgaaattgttttacaagactttgataataaaacccttaaactcacaagtcatgcttctgtagagctgggttgtgtttattcacaggttgaacatatgtcagctgcatcattccctgtctacatattcaaacaataactggagtctacccccttgttgtagatgcctgcagaatcgtcaccagtaccttctgtctaaattatggtttaacctgtgttttagtacagaactaagttcatccaacagtgtcttaggaataaatatgatctcacctatacctagcaaatttatattttcactgaaattacagaaatttgcctttctaaaatcgcatgtcgttggtcacatttgtactgtattacaatattaaacaggtagatggctagtgttgggtggcttagagaaaggaagattgagacaagtttatagtctaaaaggtttggata

SEQ ID NO: 28483 - DNA, 1147 bp, Mus musculus
aactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaataatttgtcttaggacctttagattttatctgaatacacagattaggctttaaaagcaggcatacatgtggttttgggcttaaggagttttgaacaagttagatgttgaactgacactatatagcaacatttttttgatatggttagcatggcacatattggaacctaaagcattttactgtacaggtaaggaatgtgccatgttttacctactctcactctctctctctctctctctctttctctctcttttccccctcccttcctcttccctccttcctctctgcgtccccttctctttctctctacctccctctccctccctctcccctttactccccttacacacatttcccctgtgtattcagagaccttcagaaacattcatattcatgtcatgagtcagcaaaagccctactcttgattccaacagaatatttcctttacatactttccttcttttaatttttacaaaatttgtatggtaggtgtaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaacagtagtgtgtattgtgctatttttttttactctagaaacttaaccattgtagagaaaaaggaaacaaattttcacacattgaagtttcattctgacataaaattaatgataaataatcatagagatcaaactttatattttagcgaacat

SEQ ID NO: 28484 - DNA, 1173 bp, Mus musculus
ttttttttttttttctgaatctgtttcctattttatacatgtgtgtgtgtgtgtgtgtgtgtgtgtgtgtgtgtgtgtgtttcattgtggagtgcaaataggattttacaggtctatacagtgtttaggagtgagcttggcatgaactcttctggatggtcatcctcttcagaaacagcatcagaactttgtctgccaaaaatcatgcttttaaaccacaagttcttaaacttgagtgtccatgaatagggggatcttaagaatgtccctcctgggaaagatattctgattctgtggactcttggtaaacaccagaattcacaattttctatgtacttcttagaagatactttgaaattctttcagcagtagaagcataagggaactgtttttcttatcttgcttccttacacagaataaaatgtatttggtaagtgggacatagttaacttgaaggcagttttttctgactttctaaaaaattgttttatatatacttcaataatggtctctctttatttaagattccttttctgtatataaatgctttgcatgcttgtatttctgtgccttgtgtatgcctaatgtgaggccagaagagtgcactgcatcccctcgaacttgaattattgactgttgtaagtgcccatctggatgctgggaatcgaacatgggtccttcacaagaagtgctcttaaccatctcttcattctaagaattagtttgagtttcgctgttattgtggtggtgggttggggttgttttcaccgaaaattgggccaacagttaccggtgttaaagaatgcctataatttcctaaggtgctgttctgtgggttttaaaaacagaaggtaacttcgttttgaagaactttgtaaatgtaatggttaaaatttaaaacaaaaatgacaggaaaaaacaaaacaaaacaggtgtcctagcactcatgctagaacattcttttcactgtttctgatcgaaattttttctcaaattctagacacattttttaaaaatgtgttcattgagccacataatctcagcaggtaggtgtaggtagaaggatcaggagtcttgcaaggcttgaacttacataacaccctgtcttaaaagaaagcctatccttttagaaacattgagctttcagctttatggatgcagtttgttctgcac

SEQ ID NO: 28485 - DNA, 1840 bp, Mus musculus
tgagctgtgacttcaatgttcttggcatgacccacatccgtttgttcactctcttgcttaaatctattgtattacctagagtgtgcttgtagcaaatcgagaggagactcaaatcacagtgccaccattcagcagctgtttattttgaatgggcttttgtctctccagatttgtatttctctttaaattagaaatattaatgatacctataccataagtctttttaaacaaaacctacagagtcagagactataaacaccttaatgtgactttcatgtgatagttagccagtgctgttggacattgtcataattctagctgtttgcatgcttagttggacttttaaaagacacataagaaaatacacactttatttataaaattgcaaacaatagttttatttcatgaaaagaaaatcactaatgggaaatgtttgattttcctgtttcttctgtttaggacactactgctagatggaaatccattccgagttcctcgagcggccatattaatgaaaggcacagctgctgtgctggagtatttgagagatcgaatccctgcctgagtaccgctggtttcttactctgggcatggtcactcgggataggacagagccagcctccagtgtccaggtgtcactagacagtcactgtttgggctatggtcgttcctactaaatgtctacagtttgtgaagtgatgtgaacatttataatgtcaactgctacagattttaaatgttttataaattcattcctttatgacactgcaagaacttttcatatgatttttataatgaaaaagcaaccatctttgtaaatctgggttccccctggtatcttttcattttccatcttatatgaactgagcaagactatataaggtgtaaagtcagcgaacttttactaaatattattttttggcatttaaaagaaaatcggacttttcgttgtccaggataggacttgctatgtggtcagtgtcagtgcgtgtttatgtttagggttttggttttgactttacatttttttttttaatgttttcagtgtcctttattccaatgtgatacatcttattatttccacaacgttgattctgaaatctccttacagtctgattaaaactagactggtagttttacagtaattttctaaaaaggagttagatatagccaagcttgatttaataaaagtccaaatataaacattgttgtttacactgaaattatcagatgcagcttttcagccgtcctggttcatcatgtgattgagtcgagagtagccagctcagtagaagcatgtgtcagctcagtgtcagcctgcgtgcggagggtggaggtagagaacctataggcggttgaggttgttgatcttaggaaaatcagtgctaataaagatacatgcttcgtgttcataataaaagctacatttttaaggtattggtatagtgtttttgttttaaaaagaaacatatttttaccatgtcacagttcctaagttcagaatctgcttccatagtaaaccagacatcatgtaataaggtgacattttattatttatacaatagacttttatgttattcaaaacacttttttaaattctgaaaaaattgagtacaacagaacctaaaaatggctctgctatacaccacacagcgctattatctgtacaaagcgcatctgcagatgcttccaggctacaccctacccctaacccatagtgtcagaacgtaagacacagctggagagtacagatcacacttgcaaagtcattggcttggcagagttgaaatacaggttagtgggactttgcacataaaattaaacagctttctttcaaggt

SEQ ID NO: 28486 - DNA, 1223 bp, Mus musculus
atccttcccctcctttttaagtttcagaaggaataccccttgatatatcagaaaagatttccaaccactgagagtgaagcagcactttttgatgataaacctacaatcaagcaaccgatgctgaatttaagaaaccccaagcttcacagtctgcgttactgacttaaaacttcaacaaatgaagccgtacatgagactatttctacttaaaagaacactgttgatattataggttcccttcaaaggacattatacaaggaggtgacaaaacagtctttatctgtgcgaggctgctaaagctactggatctgccctaagtgcctaacgaaaggtgataccaaatattttaatcagaaactattttttaatataatgatctggtaagactatcagaattgtaccatccagataaaattgtggtgcttttaaagaagaaaacacgtctgtgtctatatgtatattagctaaagaactggttgtttaagattgcttctttatttataagtatcagatcatgaaaaatattgtacacttttatataatctttttacacttatggtctatttaactttatataaacacacttgtagtttagcttttttaattggactttggtttattggggggcaaaaggaggtagtttttgagataaagtctctctatgtaacctattctaacctcaaactcatattcctcctgccttattctcttgagtagttggaatatatatgtatgtgccaccattcctggcttatatgtgtgttttaaagatatgtttctgtgagatttttgttttcccctaaacattttcttaattatttcagtcttttttccagaaatatattttgaatccttacattcattatctatcctaatactgaaatagatatataattgttatttaacaacagaaatttgtctttcattgtttcttaaatgtaaagaccatgatgaataaagcaaaaattcctgtcttaagacatttatttttttcaatcaaggaaactaaatttttcaggcctgtaaaataatgatatacttgctgacatcaagatatagcgattccttcagctgaagactggcctctctgaaaattctttaagctaatgttttgtttatttttattctttttaattaatttatttattttacttattcactttacatcctgctcactgccctccttcctgtcactccttcccacaatccttcctctatccttt

SEQ ID NO: 28487 - DNA, 1188 bp, Mus musculus
tccacttattagtgagtacacaccatgcatgtccttttgtatctgcgttacctcactcaggatgatattttctagttccatccatttgcctgcaaaactcaggatgtcctcattcttaatagctaagtagtattccattgtgtaaatgaaccacaatttctgtatccattcttctgtggtgggacatctggattgtttccagcttctgactatcacaaataaggcccctatgaacatagtggaacaacatgcccctgtggcatggtggggcatattttgatatgctcaggagtggtattggtggatcttcaggtcaatctatttccagttttctgaggaatctccagatttattcccagaatggttataccagtttgcaatcccacccgcaatgaaggagtgttcctctttctccacatcctctccaatatgtgttgtcacctgaggttttgatcttagccattctgattggtgtaaggtagaatctaagggtcattttgatttgcatttctctgatcattaaggacttggaacatttctttaagtgcttctcagccatttgagatttcaaggatgtgaattctaggtttagttctataccccattttttgattgggttgtttggttttgttggtgattaacttcttgaaatctttatatattttgaatattagccttctattggatgtggggttagtgaagatttttttccccagtttgtaaattgacagtttgtccttctcacagtgtaattgggttaccaaagctttccagttcgatgaggtcccatttatcaattctttatcttagggcatgagccattggagttctgtttaggaaatttctccctgtgccaatgagttcaaggctctttcccactttctcttctattaaactcagtgtgtctcattttatgttgaggtccttcatctacttggacttgagttttgtgcaaggtgacaaaaatagaactatgtagggatattggggtcccccatctgctccatcataaggcatagccactggggaggcaggacgtgggagttttgactgcacttaccctatactgttgatgggtggttgttggcccatagggaagccctgggacaccgatccaagggtgggaaagaacagtctgaagtgaaggacagccagagctggtttggaggtccctgggtctgtgacaag

SEQ ID NO: 28488 - DNA, 1096 bp, Mus musculus
taaagtggatgagtaaaaccataccccctttctcaggataggcctcaggttaaataccttttgcaggaaggagtgtctgggaaggaaagcgtattggcaaagctctccaggcttttaggtacctcattaaaatggagatctgtttgtcccctacatgtggaggggcttagaacattgcccatatgtgattgatgacctcaaatctatggagggctacagctaatgtcagtggcctgatgcccaggaccaagcaaaatgcctactgtcccttcagggtttctggggtttctagccttagctcaaccaggaaccaggctacctttcaggatcccacagatctattttcatttttctacaaaaggactgccagttagaccagaaccatttattgaagatagtttttaccactgatatttttggcttctttgtcaaagatcaagtgtctattcatgtatggttttatttctggttcttcagttctattcctttgatcaacatgtctgtctctgtaccaataccatgcaggggttgttttgtcttgttttgttttgttttatcactgttgctctgtagtggagcttgatgtcagggattatgattcccccaacagttctttgttaagaattgtttttgagattctaggcttattttgcctttccaaatgaatttaagaattgctcattctgtgtctttgaagaattgtgtttgtattttgatgggcattgcgttgaatctgtaaattgcctttggtaggatagccatttttactatgttaattctgccaatccatgagaatgggagatctctccattttctgagatcttctatttctttcttgggagacttgaagttattgctgtacagatctttcacttgtttggttagagttaccacaagatattttatgttatttgtggctattatgtttccctaatttctttctcagcctgtttatcatttgtataaaggaaggctactgatttatttgagttaattttatatctggccactttgctaaagttgtttatcagctggagaagttctatggtagaatttttgaggcacttatgtattctatcataccatctgcaaatag

SEQ ID NO: 28489 - DNA, 1104 bp, Mus musculus
tcctattcctattattcttaggttttggtctttttatggtgtcccaaatttcctgggtattttgtgttaaaactttttagatttaatactttctttgactaatttatttatttattatataatatcttcagtgcctaacattctctttcatttctcatattttgttggtgaagcttgcttctgtagatcctgtaagctttattagatttttcatttctagaattccctaagtttgtgctttttttccccttctatttccattttcaggccttgaacagttttattcctttccttaaactttcttttgatgggggtgggctttctttaaggaatttatttatttcttctttaagacctctatctttataacattaattttaaggtaatttgtgtgtgtgtgtgtgtgtgtgtgtgtgtgtgtgtgtgtgtgtgcttcagctgtattggaatattcagcatttgctgtagtaggatagctgggcttttgtggagacatattgccttggctgatgttgattgtgttcttaagctggtctctgggcatctgagttctaggtgattatggatttaggcaccaatttctgatttagactttgttggataggtgttttgtttcttggtttctgcttcctctcatcttctggtctgtgtgtcctctgattggcaggaattctctgccaggcttgggggctggaacatgccaatgaggagaggagaggagactagagatagtattgagtggagtacttaaaaggtacactgatttgattattacatactgattaaattaattgtaatactatgacataaacatgcacaattgatgcatgtgaattaaataaataaaagcttcatataatccaagagataactgagaaatactgttttagactgactacttacctgagaactgctgctaacttcctctggccactccttgggctcattgtcttaagtaatgatcttatggcctagttggccatcattgggaggagaggcccttggtcttgcaaagattatatgcccccagtacagggaaatgctagggccaggaagtgggagtgggtgggttagggagcagggggggggatataggggactttc

SEQ ID NO: 28490 - DNA, 1214 bp, Mus musculus
ccccgtgctctttccctcgcccgcccccctttccctctcggttcccttccaatcagcaccgggagggcaacgtaatcgactttattaggaataacaggggagtcgggagctaagccctgtgccagccgcgagctgttactggctgtggcttgtgtaaatgcattaggttgtctcggcgagggactagagctggttttagggtctcaacctttaagcccttggcttccatgccgccaccccacccatctctggcggtggacttgtttgaactgaggactcatagagtggtttgggagagtcctggccctctcagcacgaacttggagagggcgtaggagaaagcctgtctgaaaggtgttgcttttgcctcttgtcccctctgccatctcccctccccctctgctttgagccccaagatccagtgagtctgaagcctgaggtcctcccctggcgccaggaggatgtttcctgctccctcctgggctgccctcaggtgacagctcccaggcgccagggagactttctcagtgcgcaccaaaaaaaaaaaaaaaaaaaaaggcttcgaacgtaactgaccttctgccttaggatccactcggaaaactcaacttactcctactgtcttttccacctcatgtccctttctcctcaaggttccggacatccttggacaaacttcagtgccaacttcggagcgggcgctgctgggcagcttagcttccttggggctggctgttgctcttggctgggtggaagagctcaagcaggggtctgtgcttcttgagggagtccctgggcagcgcaggagctcccttgagggggtgagagtagtgggtacggtgtttttcctatagactagggtgtgttgggttagcattccagagtgtctggtaatggcaatctttgtaacaccaggctaagtgttttaaacaaaggagaggagaagcttcaagaagggagttctgaggaggtcgagtacacatttctaagcctctgtcctccatatgggcaaagcacacagaaacacacacacacacacacacacacacacacacacacacacacacacacacacagcttttgtttcgttacgccatgtacaatctctttttctctgaattggattttccaggctcttaatacttctctgctgggagctgtaggcagaagcagtctcagtgattacaccgcggttacaattacacctcttgttt

SEQ ID NO: 28491 - DNA, 1128 bp, Mus musculus
ttgtcccacatttaagttttcttctgttgagtacttgtaacagtcactttttttgtattaaaaacccatgctgggagttggggtgtggtttttggttgtgataatcttcaaataggctcaagcttgttaccatttatctgatgtagatgtctatgaatgcaagaaataaagctaaagtaaagcaaaaaagaagaaaacaccagaagcggtatttagatgaaatggttcgggaatcctggagaaatgactatgaagaagatgaccttgtagtgtcagatgacccatcttcagttgaacactgtgagaacaacagaacatgtgaaattcaaagcaaagcaggttctgaagtagaaaaccttcctgttgaaaatacactggcaccaaagctagaggtcccagagaattgggaaaagtactggaatgaatatggagaagggctgttgtggcaaagctggcaggagaagtatccagaccagacactgtcttctgagccttggaacctccctgatacaaaggaagaatgggaacaacattacagtcagctttattggtattatttggaacaatttcagtattgggaagctcagggctggacttttactgcctcacaaaactgtgataaagatgtttacacatctcacacagaagtagaccagaatgctgagagcagcctgaaagcagatgtaatgactttttcatcttcacctaatatagttgaggatgaaatccctggctcaaatgataatgaccacaatgaaattattactgcgattaacaacataactgtgagtgcagagaaagtagaacagagccagttagattcctctcaacactgtgacgagccgctcagtgaaatcactgggaaagagtgccctgcctctggaggaagtgactcctgtaatggaacacccaaagaaaatgatatatctgagaacagaagctcagaccaaccagctaaaggtaggattatccagacttagtctgacaggtgtccttggagacctcagtctgcttaacacattaaccttaatgaatgtttttatcccatacccatctcataaatactccttccttctgtacctctgtagccagtaaaggcaagcctgaaactctcttggaaaatttaat

SEQ ID NO: 28492 - DNA, 1142 bp, Mus musculus
aagttaacacatgtgtcttaagagcccagtatttccctatattcatccataaacatacacgagcttacaatgtttacttacaatgaacttctacatatacactcttaccttttaaaagacccttgaacacatctcccctctcaaatacaaaacactcacatatctgtgtgcatttatcatcctatacacactgtgacctacatacacatacctttacacacatacccacatgcactcacatgtatttgtacacatactaccctgcacacacacattattagggtcaaaatctgcaaactcatgaaaggtctaaaactaagtctaaattttatcatttagcaatttcagtgattggactgaaggacattttctttctttgcaaaagtatttcttttcacaaatgatgtgacctgatggcactatttgctctcacctgtaattccagcagttgggaagctgggctaggtggatgactgcaagtttgagaccagcttgagctatggagtgaattccaggtgagtttgaactacagagtgtgatcctgtcttagatacagaacaacacaacaatgtagttcagttgtcatcctatactgaaagtagacaccaagattctctgacacaatgtaatcaaggagtgtctgtgtacagcagacattttaggctcctataaaaaagcacaccattttaaaaagaggaagaacactcctccaccatgagctcttcattcagtttcatttctcaaaggattgtagaattgactgcatgaaattcatttttacatcttcacaatgagaaaatatgttggtccctttttatgattatgtgaatggttattatttttcaacttacatttgtgattattattattcaactactggtgagttttaaaagtatatccctcttgtgcttgggattgaacccagagccttgagcatgctaggcaagcactgccactgaggtacacgcccacccacagcatagccttctactgtgggtgaacggctggaggctttgtagttgggcaaacaccatcccagctttggaagacaacagtgaaatgcacagaactacctttttacaccatttattactctcgccttcagaaggggagctgcaggaacgtggggatgcttcaaaggc

SEQ ID NO: 28493 - DNA, 1233 bp, Mus musculus
ctatctcaaaaaagaaagatcaaagaaacaaagaaaagaaagggaaggaagaaaagtctttttaaaagttttttctttaataaaacactggcaatcaaattataaaaggaagtcttaaaaaaatcaataataagaaaacaagtaagactagcaaacaatacagttaggatggttaaaggtgaccccaagaaaccaaagggcaagatgtctgcttatgccttctttgttcagacatgcaggaaaaaacaaaagaagaaaaacccagaggttccagtcaattttgcgaagttttgcaagaagtgctctgagaggtggaagaccatgtctagcaaagagaaatccaagtctgatgaaatggtaaaggcagacaaagtaagctatgattgggagatgaaagattatggaccagccaaaggaggcaagaagaagaaggacccaaatgcccccaaaagacctccatctggaattttcttattctgctctgaattcttcctcaagatcaaatccacaaaccctggcatctccaacggagatgtggcaaaaaagctgggtgagatgtggaataacttcagtgactgtgaaaagcagccttacatcaccaaggcagcaaagctgaaggagaagtatgagaaggatgttgctgactataagtctaaagggaagtttgatggtgccaagggtcctgctaaagttgcccggaaaaaggtggaagaagaggaagaggaagaagaggaggaggagaaggagaaggaggaggaggaagatgaattaaaaactctgtctccttgtgaataccttggagtaggagagagctgtgattgacacatctcttatttgagtcgtgtctattgcccttgttaggtttaataacaaaattttatcacgatcatattttagtttttcaaagtgtcagtggtttacatgaagtggccgtgggtgtccggagcaccgtgaaactgtatgaaagttgtaaatagttccaaacatttttaaaatgaaaaggcactctcacatcctcctcagtgcactttgctgttggtgtgacaaggcaattgaagatgtttctggcattttgttctcaactagtaaggtagtgctaactatatggttattggctagaaatcccgagttgtcaactgtacatatctatagtttgtaaagagaacaaaacgacccagacagattcttgatgctccttgtttggtgtggaggctgtgaggggaagatgccttt

SEQ ID NO: 28494 - DNA, 2206 bp, Mus musculus
ggtgtgtgtgtgtgtggggggggtgccacagctctcgtcagaagacaagtttccgaaaaccactatctccttctacaaggattcacaagattgaactcagggtgtcagctcatggatggagtgcgttttcctgctaagccctgacttctgtcttcagcaccaagtaaataaatgccctgtcacgatcattcttccccaaggtccgtgtcagctaacctcaaaacaactcttcccttgtcagacaaaagcaagctgatcgagtatgcatgcgaagcatatttcgcactgtaaagaccgtaggtgcttgtgcagagagcacctggcatgagttttctccgctccagcttcgtctgtcctccgagtcaggacagggactccgccgagaggccagagggcgcgcgcgcgtcctcgcctttcccgccaactaggcggggacgcagcccggcctcccccacggcgacctcttcgcgggcggggcggttcctgttccgggtcacaaagcacccggatgcgcacgtgctttataagcgcccggcgccgtccggcccctcctttctgagccccggcggtgcgcgctacggagctcggccagcctgctccgtcctgactcaccgctgttcgctcctgctgaggaacaagtcggtcaggaagccgcgcctcagccatggtgaggtggggggcgtcgccacgcggcctggggcgtcggcggggctcgacttgctggggcgccgggagcgcagagcccgggagagggctcccgccgcggcgagggcccgggagagggtcctcatggcggttgtgtaggagtgggcctccacttacgggtcgctgtttgtttttcccgcctgggtgataacaggcatttaaagataccggaaagacgcccgtggagcccgaagtggcgattcaccgaattcgaatcacgctcaccagccgcaacgtgaagtcgctggagaagggtcagtacgatgctcggggtggcttggtgatcgctggggcgcggtcggcgatgaggagataccaaccgtattgagttatagtgatatttcttatacgctattctgagccgataggcgaacttgtttaaaacgcctcgagtcattctgagttaactgaaagaccatgctttcttaacccgcagtttgtgcggacttgatcagaggcgccaaggaaaagaatctgaaagtgaaaggaccggtgcgcatgcctaccaaggtaagggacaggtagactcgagtactggtagactggtggggagggggaaggtcagagtttgattgccaaataaattcagagattaaatttacattcctaagaatacaagttattaggggccaaatgtctggtggcgattgagtatgatacctttcttaaagcaaactccaaaactctctagtaaaggttgctgaaacctgttaacatacagagaaaatggttcagaaatggactaattttgttttattgcagactttgagaatcactaccagaaaaacaccttgtggtgaaggttccaagacctgggatcgattccagatgaggatccacaagcgactcattgatttacatagtccttctgagattgttaagcagattacttccatcagtattgagccgggagttgaggttgaagtcaccattgcagatgcctaagacaactgaataaatcgtcttaatggtcaaattttgctggcttttgttcaggttttttttttttaattcatgtttatgagtgtaaatgtgtgtgtcacaggggtgtcagatgttctttgaaccaccatgtaggtgctggaaacccaacctgcatcctcggagagaacaggttccttaaccactgagcaagtactgaagcattaaactgcttttaaaaatgaaggtgtgctaacagattggtcaggtgaaaaagagacgttaggtttcctgcagggggcgctaagccaatttaaagactaagttgggttagaaaagagcagattgcatccttgatcttttaagcctggggattttgttttgttttgggatagggtcccaacacagaacaggctgacctcattaaatatcaatcttatttgattgcctctgctcccagagtactggaattaaaggcagggaccactgtattagccattctgagttatttgaaatggactctgcaggccatacttggtcaaaattctgccttctcaattacaggcatgagccactatgc

SEQ ID NO: 28495 - DNA, 1156 bp, Mus musculus
ctcattttattcatgctgtcagcagccaggtctacaatacaatgtagctcgatttttgtagacctacataaatacctaaattgtgttgtactcacagagcactcctttgagattatgcaagataatgtcttcgtagcagacacagatcaccaataagcctttctacaatgttagcagcccctggggatggaaggcagtgtcttttgatgagttatcgatctctaaagatggcgaggaattgttactgatgtataagacatttcattacataagcttcagtggtacagatgaaccagaatgaatgtctgtcttctcagaaatcctccttcaacattatatgggatcatgctgctactgtcacttgggatacaactcttcatggtgctacaaacttctgtctcattcagttgtattttttattcataggaaaaggactatatataggtgtaaaggtgtacaatatatttttatactgtgactttaaattgtcattagcaaacttttacaccaccacagtgtattcatgtgcgcttgcaaaaggagatcttggatgtgcaaatgttaccagaacaaacccagcttttgtccacaaagtgactgtaactcagaatggaaagtgggcttgacatagggtgtggagtgaagaacatgctgtgagttactaacagccctttgaatttaacaaaaactgggaatccattagagaaatggattgcatcatgcctgaacataagctgactgctgttttttttgttgttgttggtttttttttttttttttttttttttttttttttagctaatgaaaaagtgtttggactagtactctaaaaatgttctaatggtaaagtttttgagtcaaatagaaatgaaaaaatctgcattccagactgaattttgtatatttttattgcattttaaattgctactctgtgatattgggaaagcaagtggcttatcatgtatatcatgtacttaaaatgtattcacaaactactgttgtatttgtataaaatatagacaaagattatctgtgtgtgtaacctctgtacagttgcttcacgccatgaaacgtcaataatcccatagctgagaaacatacaaccaaacaaggaggatgcttattgtccacacaccaagctgcacacagtcacttg

SEQ ID NO: 28496 - DNA, 1233 bp, Mus musculus
tatttcttctagctgatactttgtgaaatcttttgttttcccagactcaagtcatgctttcagccaattcttgttttgcttttcttttgtttgtatagattctgtatgcaatgagatcatgttgtgaatctgctttaatgataagaagactcaaagcaactcaagctcacccaaactcatacatctaataaattcttgaaattccaaggctggtctctttcatcttaaactcccctttatctccacgtgcacaggctgacttgtaaagggaagaaagcagaaaatctagacaaggaaaaatacccttgggtaaccagccccaagggaagagcccgtgtcagggtgagcacgtggagttgaaggagtcctcaccaaatgggcactgcagcctccctaaggcagattttcgaggagtgtgcacagcaatgctaattcatcacagtgtccatggaaaagaatgctgctggttcaggtggctttgcgagacgctacctctcatcttctcttaggcaccactctgcttttgtatgtgaaaagcccagagccaagaaaattctctttaaattgctttatccactcttcaacgaggcggccgagcggcagacgccaacatgcagatcttcgtgaagaccctgacgggcaagaccatcactcttgaggtcgagcccagtgacaccatcgagaatgtcaaggccaagatccaagacaaggaaggcatcccacctgaccagcagaggctgatattcgcgggcaaacagctggaggatggccgcaccctgtccgactacaacatccagaaagagtccaccttgcacctggtgctgcgtctgcgcggtggcatcattgagccatcccttcgtcagcttgcccagaagtacaactgtgacaagatgatctgccgcaagtgctacgcacgcctgcaccctcgtgcagtcaactgccgcaagaagaagtgcggccataccaacaacctgcgccccaagaagaaggtcaaataaagctgtggtcatacctggcatgtgaccccgggaccaaataaagtccccttccatccaaaaaaaaaaaaaaaaaaaaaaaattgctttatccaaggctacatcttggattttcttatgatatatttaatagcctggtgaatggcagttagaaacgctggctgggaagactcactggaagactgtgaggagggagttgtggttcaacctgcatcattcacactggattcttgtatgt

SEQ ID NO: 28497 - DNA, 1256 bp, Mus musculus
atacttaacctgaaagaaatctcatgtcctcacatatggtcttcagcctttatagtgtggagacatttagagaaggacccttcgtgtcctgtacttgcagtgaccagcaccggcctttgtagtgtaacagggtgttgagagtgatggactacatgttcataggacttgttcacattgacagtgctgccttgaccagcctatgcctgtgtcaccagaactgtgtcctttccctaatattttaaactatttttttatcctctcttcctgttaatgcatttcttaaaatgggtcaacggtgagagaaatttaaatatttacctttgaatacttctctcttttcatatatataaagccatggaagaaataagctgttttcctttggcagagatgccacattttcttaacaggctctgacctgccaacccacttcaccagattgaagtggaggtcagtggtgttacctgaagaaacatctccatccatggccttagaagagtgctttatgcctcaccacaccacttttataaatgctattagtgttcttgctaaggagatggaggatgtctggttttgtgtgtgcgttttcaccatatccccagtacctagagtcttgcacaaactcagtccagactgtgtgttgagttgaactaaagggtcactactagtgttagcatgcttcatacctcagtagtataagctagttgtttcctttgctgatatttgtaattattacccatacacactacattgtttttgttgttgttttaaaagttaggccttttcgctagatactacaccatggtcaattaactgtaaaaaaaataaaaatgtgattgcttctaatgaaataatttccccaaaccctgcccctgaatatactttgacaagtgaaatttgaattcatcaaataaatcagtcatgtctgaaaaggttcctatgctgtgttggtgtttctctattcagtttgcatctttttattttaatgtataattttgtagcattaagagtatctacaatattgggcagtctttagtaactatttccacagccacatgtccagtctgagaaatgttactaaatagtggcttccattctacctttgtacagtcactgaaaacttttgtctccaaatgtatctgcttattctctgttctctcaacatacacaagaagcaatgtttgagaatgggtaacaaagaaaagaaaggaaaaacatctagttgaattttgacccattttgaaatgtgaggcaggaaa

SEQ ID NO: 28498 - DNA, 1253 bp, Mus musculus
gtttacaaggctgtacaaacagtcatatttgtctttgtggtttttctcctttccccaattttatgttttgttttgttttgttttgttttgtttactaaaatacttaatgagatattagtgataactaatgaactgtcaagaacatctagatttatgtttatatgacagttatggggcttgtttcctgaggctcctttggactgtctacagattatgtcagaagaaataggtagggccaaggttaggaagagatggaagattcagaagcccagggcagagagatcagtgagggtgagaggctagcatttgccctggctcctgtcctcaccctgctcttagatccgagttcaaaaataagataaaactctacctatgatggcagtgctcaggtaactcaggcagaagtacagtcaagtgccaaccattttaactttcttgatcatagctgatggccttcctgggacaacctggaaggtcaaagcaagaactcttgagattattctagctgcaactaccagtggtggctgtgtatattactgctgtgtagaaacattagtagtgttttcattttaggtccaagtaagatgtttttagtgatatacctgcagaatggctctgtcttaaaactgtgtagaaaaaccctaatctttaggagctttccctaaggaaaaaaaaaaaaaagttgtgccttacatagggcgttgtgtgttaattatattaataagtgggggtagcttgttcccattaaatgtaagttctgttaatgtgtttttatcagagttgggggaaagtcattaaaattaaataaaactgatggattatttttgcataatgtagcatttatagttgaagtacatttttctaagaattggatcatgatgtatataagtctgaaatgatgtttcatcatttggtttttaattaaatgtaagaccaggatagattggattttaaaaatcttacttttcaataaattatttcagacaacttcatatttctctaattctctggagtaactttggttaaaaaatagctgttagtggtacaaatttggtggtctcttagttaaatgatattgtgtgttgttcctaatgagggaaggattctaatcttgaccagcaatggttgtgagggctgcttcttcacagtagtgaagttcagcaacaacatggttctgtgaggtgctgatatgcatgtaaattgttcttttctttcattatcaaagcccagcaggtatatgtattctgacttcc

SEQ ID NO: 28499 - DNA, 2485 bp, Mus musculus
atgccatcttaaaagcccttggtggccatatgaccactctgaatggagaagagatcagttacactgggtctgatggcattgaagggggacttcttgctagcatcagaatgaaccaccaagctctggtcagaaaacttccggatttagaaaagtcaggacattagtaagcattcctgaccacaagatgcacctcttccagatgtgaattattcggcctgagctgttggaactgttgaagtgctggtggagatgatgcatggttaaggccgccctgaagtactttggaagtacttatgaagcagcagagacttactttccctgtaataggatacaaaatcagggaaattagattgcttcatttctcaagtattgtctttatttttgagactattttcatacagttgtcatatacaaggtgcatatatatatatgtatgtatgtatatatatacatatatatatatttgtgaattaatatctagaactgagtctacactgttatgagtcaccattttcacacaacaaatgatgagtctgcattgttgatacttccatatagaatgggatttgagaaagggaaggttttgttttatgtagagtttagtgtaacttctaggttgtatattattaaaaataaaatcattggtgatttttactcctcagatggaaagcacaagaagtctcatattcattaatatgcaacaagtgctctgttcatctgcctttctatggatttcatagaaatggcttaagtcggttattttctttgaaattgtactaacagattgaccagctggtagaaggtagacagatgactgaattatactggaattgtctgagtgttgcagttgattttcatttccctatgaaaggggccattgttcatcctttctccactgatcaggatttagtcttcaccaggaaagttggttcaagtttcagtattagtctcatgatatgcatattttctcttcagagatgaactatgttgtaagatgctctaagaatataaatgattctatgattgttgaaagttacttgacatatagattgaatagttttagctatttttcaagaattatgttttgtttatgtaataatgtttcttaatttttgaaaccttgccaggtttatctctagacattctcttatcatcaagaatggctatgacttttttcttagctattaatagacttaaaagaaccaaattatcagaggaattacttttgacataattctagttttctcattgataaaattttttttcccactcagttgacagaatgtggttaaaaaaagatatggtagcatttgtcgtgttgctataactcagaacttgtttttttgagctgtatttgttggtgtgagtagtttttcttagtatggcctagaaaattggtataaataataaatcatggtttttttcatgtggctttgatgcccttgtaaacgttaatgaggaatttctcattttttcttttttaaaaatgtaagcctaaagaaaatttctatttattttcctatttcagagctaaaattgagcaaaggatggacattctagtctggtatattgtgcatactttaggtttgcatgtcatagagcccaaagcctggcactcctcagcaggggactgaatcttaatgcagcacaagtgcttttccccgtacttaacagtatgtaacagtatgttacagtatgtaacggcactaaattggcctttgtgtgatgaaaattcagttttggtgtttggaaacttggtattaatttaataggagttgttagtttttaaaacagtttcagacaactagtctaatcaccagataatatgacaggagaaaggaaatcctgctttctctggcgagatgccagagcagatcgtctcaccagaatcctgtattaggaacctctgtgtcactgtaacatgtcaacgcagaaaatagaacttaattgggtaattttttaatgtgcagaaactttatcatttattacaagtaaaactagttcatattttgtaagcacaattgcttttgtttttagtttcattaacagttatcactaagaataggaacattgtgtgttgggctcagaagcaaagatgctggctgagaggtggaagtagtttttataatttgttcgtgttatctaatgattttacgtacttttatagacagttcattttttaatataattttgtttcaaagccaatatacattacaaggaaaacagtatttatttatatgaggtattattgtgccagaacatatctgctgtggagtatgtaatatctctcagaattaatgttaaattgttttatttctaaaacataccaaaacaagtttctatttagaaacttacctgtttttcctttagtagaagcagagacatccacagcctcaacagatcacaccagctgtctcctcctcactcacgatatcccagctccatttttttttctttttttggctctctttcttagctagtatgc

SEQ ID NO: 28500 - DNA, 1346 bp, Mus musculus
ttgaggctgggaagattgcttggtggttaaggacactggctactctgccagaggacctaagttcaatccttagcacacagagtggctgacagtcatctgtaagtccggttctaaaggatctaatgcccttttctggtctctgaaatctctacatccatgtggtgcacacatgtccatgctgaaaaataatacccacccatacttttaaaagaaaaaaatgaatatctaatctattcgggctgatataataaagcacattagactaagtaaattaaaaccagtgggagtttattgtttccagttttggaaggtggaaacaactggatgtcatcagcaggctctgaactgtcaagggctccttcctcaagcaagcagctcctgtggtctcacatggcagcatggaagaagcagctgggctccttcataggcacactctgccctcaggattgggcaggaaagaacactcagaggctttcccagtgccattgccttgctcactggatttcaacctatgtatcgtaaggggaacatacacaattggatactacagaaaaatgattcttccagctaagactattttaacataaggggattaaatgagctattcattgagcagattggctatagtttaatttctatattttgtgtaattaaattatcacaacagttctagcctggtgcctcctacttaggaggctgaggcatgaggatagcaagttcaactgggttatgtagtaaaatattgcttttaaatgaattactagcttaatagaattgtcaaaaccagttcttttctaaatattcatataaaatacagaaatgtgaaaaaatcatcataatccattcagaaattagttcattgtataacttgggtcattctgagaagtgctcattttatagttgaggacaataagatacaatattttaatctgttttaatttttaatatccaggcattaatcattaaaaatgaatgtctgagttctggttccacatactgtagctgttttggttttgttttgttgttgttttgtagtgtacagtgtataatgaaatttctctttagagcacagtctcctgtcaatttaactgaaatgaccagaaagcctttaccatatctgtatactctatatgcatataattgctttcttgctcacttagatcagggatccaaagaaggagacctttgtccagatctcaccccaggacaaaaagcagtccattctttctcttcttttgttcctgtggtgctatagggtatggaagcaggtcctatacatgctaggcagctgcactgctggtccccacacccagcaggtcagtgttcctgtcagcaggcaccacctc

SEQ ID NO: 28501 - DNA, 1198 bp, Mus musculus
ttaagattttatatatatgagtagatatataaatgtttatgtctacatataagtatatagaatctagaaagggggtggtgaaagggaagaagagattattaaagtcggaaaaagagagcttgaccagtacacgtgagatgagagaagggaggctgtctgtggcagtaaagaacagaagggcagagaggagcgtgttgggggagagacatcaggaggaacatgtgtgtatgcagatgacgtgtgtgtctgcagatgacgtgtgtgtatgcagatgacgtgtgagtatgcagatgacatgtgtgtatgcacatgccatcatgagatccagttcgttcctggattcccatggtgggtgctttatggccatctgtaactccagtcccaggagctttatccctcagggacaccaggtatgcatagacaaacaaagaaaacactcagacaaatatgttctcaaagttagaaaagtgtgacaaaatctatgtgaaccccaaaatcaccatgaagcattttatgttagcatgtagctcatgatgtaattattcttatctctgtggactcttaactgaagccttccttctctcctttgcagagagactcccctggagcttcagcgactggtccatggcgcccaagtgaacctggatatggaggatcatcaagaccaagagtacataaaacccaggttgcgattcaaggcttttagtggagaagggcaaaaacttggaaggtaaaattcctctagtgagaaaaccacttctttgctccaaatgacatttcttagaaaataagaaatcaaaatagcttgtaaagtaaaaactgcattctgagttatgacgactttgctgctgtaagtgggcgtacagcccgcatagtactagtagccagtacccagaggtcagtacttctcgcatacgttaaggtctcttgttaacagctctttaaacacacactgctcttacagagggcctgacgttggttccccatgcccatggcatgcagttcacagctacctgtaacgcatgcagttccagtcatccatgggtgtctatacgtgtgtacacatagccacataggcacacacacatgatgaaaagcaaatttttaaattcatgaaaatttaaattaatatgtggcaacttattactccattttgaaatgacagtaattttcacacggaatgatggagctaaagaat

SEQ ID NO: 28502 - DNA, 1157 bp, Mus musculus
caaaactttgctctaatttgaagagaacaggcctctagtgtctgcctcagcagctgtcacgccacttaacactcgctgactttctagaaccctgccatggtgttactgtaagattttaaggccatctgttctgtttacaatatgaaattctgtagctgtaccttcctactggcccaaatcttttggaaaaaaaattaccaaaaaaattcattcaaaataaccttttgaattatttaagaatatatctagtcaacgatgtgaaaggcctgtctatacagtgacagcctctcccaatgcagaagatgctgggaaggaaatctcagaagacagttgatgacgcaaagtccatgcaactggattggcagaattactataaaaatacctatactacatacaacaaaattaacttatagatttaatgcaatacctatcaaaattttaatattggattttacaggttagaaaaaacaaaccaacaattcctttggaaccttaaaagagcacacacagcgaaagccatgctaaggaggagcaagcactgctgggcttcacacgtgcagcagggcacccactgctgcagccctgaacaaagcctgcagtggccataaagacaggatcactgcaacagcgcagagagccagacagatgctaatgctgtggccacagaatttttggcaatgaagtcaaatcatataacaagggggaaaaaacatcaattcaaaaaataacactagtaaaactgagtttctactgtggatgagggaaattagatgaacttggtacaaaaataaaaataaaaagggaccagaattgcaaaacctaacgtagaggaagccacaggaagaccatcaagcagctggggtcagcaatccctccctctcggtagagcagcggtagtaaaggaaggagccccaggcaggcatcagcagctgggaccgcacggaaacaaagtatttccgtgcaccagaggaaccaatcagcaaagcaaaaggccatggcatggacagccttcaccacacttcaggcaagcagctaataggcagacttataaataatcgcagaagttaaatactaaggagataaaactaccaatcgacaaatggccaaatgaactaataattttttttcaaaataacttaaaatgtccagtaaccatt

SEQ ID NO: 28503 - DNA, 1195 bp, Mus musculus
ccacactactttttaaattcacaaatcagaaatggagttattttttagttaagcattttaggagtagaaaaggcatctttgagtggttttatatggagaaatgaaactgacctaaaagcaattgtaattatgtgttctaaccctgataaaggaagtgtgctaagggtagggtctttctctgtggcccaagctcctgtctcagcttcctcctagtgctggcataaaacgtagcaccgctgctctttatgtaggctctaaaagtcggtcttaacaatataaaagtaggaagtcacatgatggagaaagagcttcaggactgatcagttaggagacatttgtttctgtgatatgtaagctcttcaattaataaacaagccaggcctccattgtgccatttgaaagcatgtcaaccttatttaagcagccacttgatgactgtagtgtttcggcaggtaagcaagctcactcacactgaggttaagccgaggcagtggattggttcctaacttttcttacttttgctggaaacatctttgcaggttccaaagtgtttctgaaaagctgcacatggagtgcaaagcagagatggtaacacctctagtgacgaaccctgggcatgtgtgcattacagacaccagcctgtatttccagcctctcaatgggtacccggtacgtagatctcggggccatgttcagtgcttgcttctgtctttcagctaaattttccaggaacctgatgttatagttactatgccctcacatcttggggaaggtcaaagtcgtttgacaaccctgtgtagcagtgtggcttcctagtgccctgtgtagttggagtagatgcacactcccccgtatttcagccattctgaaggaccttgtacccagtagtgcgtaaagaaagtccgcccctcctgactatggatgagacttctcctcctgctgggaagctcggggtaagacacccagaaaaggctgtggtgaatgagaagctgatggtgagagggggactgcttgcttctccttcactgcagacagtgggtctctggcttccgtgagtgctggtgtaaggttctcacagctagtgtggcatcatgtatgatgccacagtcagcagctgtaggaccgtcccctcccaccatctaggaaatcatcttctctttgagaacactagacctaaaactatgccaggaagtga

SEQ ID NO: 28504 - DNA, 1176 bp, Mus musculus
gcaccacccacagtggactatgctctgccacatcaatcactaatcaagaaaacagcttggcatgcccacagcccattgaatggtggcaattcctgaaacaggcttccctctttccaggaaattctagtttttgtcaagttgataaatactaaatatggcagttcttttaaatactaaatatggcagttctttaaaaaaaaaaaagtctcttttctcccaacccctgccctttgttgctgtagattatatgtcaagaaggtgaagggagctgacatataaaagccagtattcttatttgtaagatcaaatttccttcccaggttctattattttcattgaattttaagattttatacagatagatagatagatagatagatagatagatagatagatagatagaaagaaaatatgtgattcaaagaagtaacaatcaccaaaagatgtaactgtagcacacaaactatatataaaaattcagtaacttttaactgtattggaaggctgtggatcaggtttagcctttgacaaaaaaatgtaacatattcccgaggcggcggtcgtatggggggtggatgtcttggagccccctctaggcgcccatgggggggaaaatgtaacatagaagatcaattaaacatcagtgcctaggggacctgagaaatgactcagtggctaaatatctgggaatatgtaaattttggatctgagaagctacatgaaaaaccagatgtagacacgtgagcctataactccatcgaagagtggatgaagcaggatgtttggaagagcttgcttttcagctagcccagttccagggtcagtgatgatctctaatatccccttctagtctctatgtatatgggtatgtttagatacccccccctctctctctctctcaaacacacacacacacatataccagggtctttgtttgaaatgatgtgcaaagctattgtagaatggtccaaaggctaaaaatattttcccaacttgagtgcctctgaacaacaggcagataaaaacagaggccctagtctaataaaacatttagaacctgccaaaagaaagttttttctgaactaaccattaggtataaagagtcctgtgctgggaaagcagagatcgaaccacacagacttcttcaagcttgtagctatgctggcagtcacagca

SEQ ID NO: 28505 - DNA, 1134 bp, Mus musculus
gcctgactgcagcaggagtaaagccttgcctccaacagtgcaggtggcagttattaatcttcatcaagaagcattttaagtacatattgtggttttggtatgaattgggagtaaggcatgctaatgagggcctgacagtcaatgatgggcacccagatctcggaatcataccaatctaagacaggggtacatgccaagagtccgtggctgttaataatacaccacagagccatgttttgtgtaaaataaacacaaacaagctgcaggtacgctcctatgacagataaggatgattcgggaagatctaagattttctaagacaagtgaggccgccagccaccataactcctgggctggactatggagcataaataaattttatgcctcagtccagttgttttttttttttttttaatattatataaagggggtaagatgtacccttcttcagcctaggcaggttggttcaaatggtctgaaccacatgctatgctttttttcatcactctcctttgatgttacactgcctgccacctgccctgaggccgaaccggttttccaagattttctggagttaactgcaaactgtgaatttggtgagtttctgctaaaaggctgttctgacaacttcacatctctacatcaggaaacttggtgtgactggagatgggcttccctctttataagccctctttattattaaacatttgaaccttgagcagactagcttgtcttggttccattatttctctacctgcctagattccctcttctttttcagctctggttgcctcccaggctcaaacccggacatgagagccacaggctagccccaacaagctgtttctaattttccatcagaaggccttcctgtgctttagtcaaggccaggaataaggactctcacctgtgtgggaacctctctccctctgccccctctcccataacccgaggccaagggtgtcaccccaggggccctggtttcaggggctgccaattgtccaccccctgttgagtggggtcagtggcttagatgcccacctgggtccaagtggaaagcatctgacagtcctcccacattggcctgcccagagcataggaggaactctggccagacgtgggctccttccttcc

SEQ ID NO: 28506 - DNA, 1152 bp, Mus musculus
gtgttctccccagaagccaaataatgaaccacttagccagaaagtgtccatattttacaaattagaaagcgttactcattttatggataccgtcatagaacatgtggttctgaagacttaaggacaaggtaaggtctcacacacacacacacaaacacacacacacacacacactaactgcagtaatgaaaatctgaggcaggagattacaatttgggactaaacatggcccatccagtaaaatcctatttcaaaagtaaaaataattttttgtttgtttgttttttcaagacagggtttctctgtatagccctggctgtcctggaactcactttgtagaccaggctggcctccaactcagaaatccgcctgcctctgcctcccaagtgctgggattaaaggcgtgcaccaccacgcctggccgtaaaaatagttttaatgtacaaagatcaactatgtaagtgatattggcagaggggcacatagacgttcatttgaagctccctgcttacctcatttctcttccttgattgcattctagaagtattcccatgttctgtgatccttacagaaggtagatggtttgcatggcagggctgagttctttatgacatcttatatccccaccctccaaaaaacaacatttttgagatataggaacttggctgtaaagcccagatttgcctaagactatgtaacacaggctggcttcaaactcacagcaattctcctgcttgagcctcccgtgcactgggattacaggcatcagcagcacagtgttttattggttctttagcagtctttcagctttgtcagtgtacttgcttttcatgctttacatttcttacattgttcaaactacaggtttttgtttttttggttttttggttttttttggtttttttttttttttttttttttttttttttttttggtaatgtggcattaatggcattaatttctatatttctgtgaccaagtagtgaagtagtacctagaacatagcaggtgagcattcagtaaatagtttttatcttttggaggggctattatattttcagggtgtttagttgttggttgttttttaaaaaaatttttaaagatttgtttattttacatatatgagcacaccattgctctcttcagacacaa

SEQ ID NO: 28507 - DNA, 1868 bp, Mus musculus
gctgtctaaaagaaagattttaaatccagttagagtagcgaaggctttggatagctttactctttgataagcatcccatatactaattgttacaagtcctctcctcgctgtgaacctctgacaagcagcactatctgatttctgctgaccagttctaaaacgacctctttccaacacatctcctctgtgttgtttttaaaagaagcaacaaccccatttcaaaaaacctacttaaaatattttttagagttgtttggcaaaattaaatcactaagaattatgtgaatttttttaaaaaaaataataatctagtctactgcctggttgagtctgctttatttacagtcctgttctcttgtacttcaggcaaacggcattaaaattggccctcagcacgctgctaccaacgcatctcatggaagcaaccaaggcggacagcaggcagggggaggctgctgttgagtctggtgttaccggctagctgcccagtggagccacgcactctgtcaccctctttcctcatgctcagctgagacatgaaactattgaaatggctttatgtcacaggagactttaatccttcagattcttgtataactttgaataaatggttaatgttcacttaaaaagacagattttggagattgtattcatatctatttgcatttgatttctaggtcaattgatgtgattatttttgttaaatgttgtcttgtgcccttaactacgagctgaattgtattaaacactacaaagtcatggtgagtattttaaatcagtttgtgtagttaggtttcccaacacctgtggttacctaatgtttaatattataggactgtcctcaaaaagtttgtcaactttcaaggatataaggaaaaccagaactctttgacttctgtatttatcatttgctttctgtatatatagtttaataacctgcttgggtgtgatttgccaagcttgaactctaatgcatttgcataaattctaccactgttcggagcttgaagctacagaagcattgttaggaattgcttggacactgacttttcaactttttgacatcgttaacgagcatgttcatcttttcttgtcactagtccaagaaaactacgcttcctgtgtattactaaaggctgtgtgtgtgttaacctgttttaatgccaaaagctatttgtccacaagttcttgagaccgcttcacaaaaggatttgtttgccttaatgagtgctgttgggtaaaacacagtgtaatgagtgggacgggcagaaacagaaactccaacactacacaactcccaagagcaaggcccactcggagaaggcacgccatgccacttactcttcccttagacacaataatggtcccttttcttcacacagtttctaagtatattttcttgcagggcagtttgtcaaccttgatgtacagtgactgtgtaaaatttttttctttcagtggcaacctatctataatctttaaaatatggtaagcttactgtctgttttgagggggatatgaaaataaatctaccagatggaaaatcctgttcaaagtagaaaagttttagttgtttactcactgtggtggttttatcctctcgtttttctcccttggtctagaatgaagttgttatagcagtgcaaaataaactcctatgtacaaaagtgtccttctcatgatgagcacattcactgtcctgtcagaggagacgcagcaccagtaccccggtgaatcgtactgtaatggctgccttttatggatcttgcatcaatttttgtatcatatgtggtcatattttaataacaaccagtcatggaaacaaatacaactccagtggtcagcatgcagccttcagtgaagaccct

SEQ ID NO: 28508 - DNA, 1171 bp, Mus musculus
agcctaggtcctctggaagagcagcaattactcttaaccactgggccatttttccagctccttctgtgtgtgtgtgtgtgtgtgtgtgtgtgtgtgtgtgtgtgtgtgtgtgtatatttaaatccattctggtttgtagaatcatccattgcttgtttggaaaatactagttcccgtgaattgtataaaccatccaagcccagacatttcattatgctgtattttaaaaccagaaaagtctttaaaaagctattggaaaactgtcaggttcatggcagtagatgctggttttccaaaattttgatttttgcttgaatgctcaaattttatcattggcaaacagagctgtcaattgttttccttgaagtgacagattatttcgttcgtttctgtaacgcctgccaaatacttaagtctgcaggcccatagtttgtcagtcactttccttccagtgacaatggtgtactcagaagagaggttgccctcagtcatgcggtctacttctcagtctgctttgaaccaaatggcttctgacagccactagaaggttgcaagtctagaggcgggcaggtctggagcacccctgggttactcaaggacgcgagtgcgttgcaggttaaagagaaagttctccgagcacggcagacttaacactgcagaagttattagaatggatgctgcttctgggcagcagtgctgctggagactggcactgcatctggtctctgccaatgggcagaaggttgtccgaatacccctttgcttggtagcctgctgcaaagagtgccttcctgtgcactcctttaagatcggatggcctcaaaatgtcagcctttttgcaattgtgtgtaaatatgcttgttcagtatgagaagctctgattgccaaagtgtgaaaagtgtggctatatgctttagcagctctgggaagttacctcagtgtgtccctgtggtagcgaactctgatccctgtgtcaggactgggctcttttcgcgactgatgggtgaccttgaacacagcactctcccaccttgtcttcataaggtcatggatggagttcttcatcgtccatgttctgtgtacaggtttgagaggcattggatccccttcacaagggtggtaatagtggttccctgtgtgggggaggatgccttgccccgcagcttcttgt

SEQ ID NO: 28509 - DNA, 1179 bp, Mus musculus
tagagggaacagtgtcatcttcctgacatgcagcatcataaacctaatgagacaggttcgctggcctgccttccatacacgggcattttcagccgcccatgtgagttcctgcaggaccaaacctactgaaggtggggggagggggggcctggagaacccctgcagaggtcataaagaaacgttaggaagccttttaaatgtcaagcaaaattagatgttggggaagaatagggtcagaacccctccctggcatcctgcagttatcctgagccctctctgtctgtgtttgtggtgagtcagtggcacagccagggtataggggccacaaaagctgtcctaaagtgctgcaccaaagcaaggtctgtttagctcgccacaaatgatgtctgggagacaagctggctgtgctgtggcaggggctgtggctgtgttctgacagtgacgggtcttcctttgttgtcacgcgtgtcctctgtgtgctggtggctgtggcccaggctatgagaagtacaattccatgcgagctgaccctgcactgtgcttcctggaacgagtcggaatgcccgatgccaaggccatcgctgccgagcagagagggacagacatgctagcagatggtggtgacgggtaagaaggacattctaaaattttaataaactttatgtcagcatcacatctactggcaagagttggttcttatgctgaacggggccctctcttacatctggtttgaatttgatgctaccagtaggttctgcctatataccataggaactattctaaacaaagttcacacacacacaaataaatgaaattgtctcgtgatcaccccctcgccaccccgtgtaactgctttctgaatactggtagagtccatttgcagtgcagacccagacttggtattggggaggttgtccctcttccactctctctccctacagactgatgtgatttaaaactatctttcttttttttttttttaattttatacagtggagaatttgatagagaagatgaagatcctgaatataaaccaacgagagcaccattcaaagatgaaatagatgtaagaccttaggtgtattggcttttacagtgccagtaacaaattatattcccatatagaacttgttaaactttatagataatggccttcctctaaaagacaaagtaaaatcc

SEQ ID NO: 28510 - DNA, 1223 bp, Mus musculus
ctctatactacatatacatagcgaaatgcaaaccatgtgttctcattgttaaactatcaccttacatccatggaataaaatggaggaaatgagtgaaaattagctgttaacttagtaaatataacatgttttttaaaatatggtcattacagtaggattctaaatcttgccttgtgaaaagccagcagtaccgttacttttgcaagtgttggcagtggtgcactccaacagcattttaagtacttggatcccacgttgatcttataaacacaagcaataaaagattttctaattcactttaatttttcctcgctcttacttgtgtcataagaaaagaatttccatccatgtcttggtaaacatttttcaaggttattattttacaattctaaaggtctatacaaaatgaattggtagggttttttttttaatatactatgatgcaattgtttgggaaatattttaaaattctgtttcaattttgcttcttcaaggttggaacataaaaatagcttctgttactattctctgccagtagaaaaaaataataaaacagtagatcaactgaggagtatacatctagtttgtagctcagggctcaggggttaggccctgggtttgatcttcagcattggagggagacagagaagagagggtaacagggagacagagaaagaaagacaaaggaaaaggagaggagtgtaaggaggagagaagtgggaaggaacagggaaagagagagatggagagagggaagtggccatagtcagtaatgttttgtgtttatggcgggaagtaagttgaattggtttcctcttttctttaggctgttcagctagtaaatcactctaccaagtgcttaaaatgtaaagtattttaataagtgttagcaattaaaaattttgacattatcactctggtcatattagtaagtgtctgtgtcgtacagatgctagagaataaggtatctacacatactcagctggtctcaggaaacatggcacagataaaatatcctcccctttgctgttctctgtctgacttcctatgcatgggggctgggatccatttctaaggagaatggataaggaagtaggctggtctttggcatttcatcttgcattcttggtcctctttagcttggtacttacatgctgatccatccttaagggtctttctgtgagatttgaatgcctgccccctcagggcctttctccacaggt

SEQ ID NO: 28511 - DNA, 1179 bp, Mus musculus
caagtaccatgactcttcatccccgtgccatgcagctggagacctctaaggttccttctggattagaactcactggagggaacatttgccttcctgcgattcatttaggaggcctcttgcttcatgtcacccatgacagcacagaactagtgcctgcatttaaggggcagaaaacttggttgtgttgtctacatggctggccaaagatatttttctacatagaatagtgtctacatcaatgcacatggaggatatactatatagagaaactgtgaatgaatcactttagtttgtaatttttctatgcagttatatttttctaagtagctaaactgttctgtcaccatctacccccatgttttcgttgactttaatgacaagaagtataaattctttacgtctgttaaatagtaattttcctggtaaattcagacatttctttttttagaaagaaaaaaatcacgtgtgaaagaaaagaactttgttttcctaacataaattggaagtcatgctaggatgcatgaactgtgccaacacttgcccttgggtctacctgtgtatcctcatttagactcagtgtctccccctttctctgtgctaatagtacaaagttgttatttctaagagcaacatttctttttaaattacactgagcaaagccatagaaacattttatgtgataggaaaataccacagataatggagcttggagagaaaatatcacatggaagtgaaatttcctgctcagggtcagggacccaggtagcctggcctctttgccttctatacccaaggcctggagtctgcagttcctgcctgctgtagatccacttacgtgtcaaaaagaaggcctcttagtctctgagagtctcttcactattttatccatgtaggaatagcagcatagaaagtgcccagggatgctagcatcctaggtggtcaagcatccttgattatgaatttgcagtgcttttccatcttcctcccctcagaataatgtcagccatctcattttatactgaaccagcgttgacaggcatgtttgatttgagtgctatccatggctgagaaagagcagtagaaagccatcttgctcctcaagatgatcattagtaaagcattgctgcattttattttctattttaaaattaaagataactcaagccctagaatgtaatg

SEQ ID NO: 28512 - DNA, 1586 bp, Mus musculus
catgtggacatgttatagcactggctttgatttttttttttttggtagtgtttagatgttttatttgaaaacttaatattttggttcatgatacaaatgatcagtaatatgcttttcaaagtaaggagaaaattaaactccttgtggggacacagggtaaacagtagtctgcaatacatacacgacctcatgcttcagctaaatcaattatataacaactatagtctggtcagtatctatttacatcctgacagcgctgtagattactgtcctatagcttaagggctgccctgcattggtctaaatgagtaccactcgcttagccctgttgtctgctcagggctctcactagggggaagtccatgatcccctcaggttgagggaattcagggtgtatgagaaacagtcactaagcccagagtttgctgctgggtccaagggatgagcctcttcctttatacactggtgtttttattatattattagtgtggtttgtggctaagaaatagtgttgtgatgaaaatttgatttgttagcaaagaagacagctagctgacatgtggtttgaggagagccaccggccatttaaacaacgtcataaggctatttcttttgtgggccaggggcagctcttgattatggtaacactgttttaaggtaaagtgatttttttcccctttctcaaggataaaatcagagtaagttttatgattgaacattgtgaccacagtgcactgatgtccacctgctggcacctcagttaagtcaataagcaataatttttaaagctgtgatatgtatgctatagggcctaaactgaattatattaaagctcttcatattgcaagttgtagaacactactttttataaagccatatttttttagtgtgacttagaagtgacatattactggtaaatggctgaaatcagtttctctgaacttctgtatgtaatctgtttcaaaactctgggaagtgagggttcattgtggccaacttcagatactttgataaaaaataatatgtgaattaattaatgagccttgtctctacaaatatgtgccatgctatgcaacaggggtgggttgtctgaaaatatgtcttttgtgcaatgttgcttaagagcaataaaatggagatgaattcttctctagattgtcattattttgaactattttaaaactttacatgatataattagcatatgttatttaaaattaccacaaacttattgtccaaaatcataaagaaatgcacaccttcatcctcttttcttaacctatgaattttttgcctgcagtactaagagtcaagaccaggaccctgcaactgttctacttcatagcacacacacacacacacacacacacacacacacacacacacacacacacacattcatttcaagtcctttagttacttgagacaaggactcttttaggttgtgtaggctagtctcaaaatttctgtatagcccaggctagttttgaacttgtaacttcctgtgttagccttgcaagtatctgggactacaagggggaacaatgtcacactctgtttttaatctaggttccatgaagtggggc

SEQ ID NO: 28513 - DNA, 1071 bp, Mus musculus
tacatatctgctgactaaaatgctaagcctaggttggcttgaatgtacaatgtgaggtgtagcaatgtgactgagaacacagccagttgctctccacattaaagcacttgtagttgctacttggaatttgatagttctcaataaaagttctcgatataacctgatgtgtgtattaataatcataaatgacttatctgttcatcatatttaggagacctctattggctcgtcaggctcctccctgctcagtattcagtgtgagcagcacggtgagatgcctgtcctccaggaggtcacattgtaataagaagtgactttcaggcagactggcactggccagagtgagaaaaatagctttagaggggacagtggcaggggctcatgggtggctgcggatgagtctgtctaggtaggatgccaacgtggcgccttggtcactgtatttctccttgttgaagaccttgaagcagatgggctggcaggagaaccacagccggaggttgaggacttcctcacagtgaccgacagtgatgacagatttgaggacctggaacccgggacagttcatgaaggtagaacacatttgttttagactagttggtcatttatagtgtaattattaaaaaaattcctaaaattcctttaagagcgatatttaatcttatctaaatattttgaagatgaagctctaaagcaaactgatatctgatttgtttcattaataagtgggtttctgatactagtaagggcagacttttttcttgtattcctccacctcggtgctgtgtgttatatgaagtcatgatgaactgcacttgaactctggccctggcttttgttccagcagcgctgtctcccctactgcacaatctgtagcttccatagcatgtccccagactgtcttcttacatagttagggatcaagtgttctcatcgaaaggagaacttactagcttctagaacccttagctactattgcaatgcaaagacagtcatcaactgtcattaactgagtatagacatggctgtgtttccatgaacctctatctacaaacccagctaatacatagt

SEQ ID NO: 28514 - DNA, 1239 bp, Mus musculus
aaaacagattgcctgtccccatgtccatgccacctgctaaagacttggatgctgtagcaaaatgaaaactgaacagctttggctagttgaaaacttacattttttgataatacaagataacagtgagaaatatcaaaacgggaccagtattttccttggtacaggaaggcaagaacctgaagtttcaggaaggcagatgacataccagtgtctgctaattagcacgagaggcaggacatgtggccgtgcagactcttttgacaaaggacttgggaggaattctatttaaaagcaaaaccaaagtgtaacccaatcaggagtttgcttgtgttcaaaattaagattatttaagcatggtgattgagtaagcagaagcttctcgtgttcagagtcattaatttatggagtgcactttgagaatttagttaaaacgtgtttctgaaatgatttatcaaattactgtcaaaatggtgttcagccaagtatcttcttccgctgtgatgacacatgccatttttctctctccacacagaggcaaagcacggaggacacaagaatgggagaagaggagggatttcaggagggtcctttttcacatggttcatggtcattgcattgctcggcgtctggacatctgtggctgtcgtgtggtttgacttggtcgattatgaagaagttctaggtaagaactagggtatgatttctctagtgagcttgtaagagtgaaaatccaaggattgttatttcttctcttgtattatgacaggttgtagcttcccaccaactcttgaaaaagcaaagggctgccccagagtagtgacctgaatcttgaagatttctgtgtaggctctctatttattgtggtatatggatgcttccatcaaaacaaattttgttaaattcattttcgctattttctgcactctttattttctgttcaggtttattatgaattttaaaaaattctagatcatgaactgattcctttagtgggtatagatctgaagtagcatcttattgtatagcccaggttggcctggaacctacaatgatcctcctgccttggcttccaagtgttagggttacagatgtgagctgccgtggttggttgatggcaaaacctttctctagagagagttttcaaggaacacctacctgcccatgtctgatgagataagagtgtgtgtgcacggctgggtgagttctgggtggaccacgtggttaggtagggggcatctc

SEQ ID NO: 28515 - DNA, 1164 bp, Mus musculus
tgcatttgaactctacctgggactttccagagggtcaggtgactgtcagtgcattctgagaattttttactcaagaatgatcctgtggttggaggatgggacttgcctagctttgacctcaggtggaagggggaagctgtaaggagagtgtgggactggaaaaagcccttagggtctctcatttcccccttttcttgtacaagctccaatcctggagctatgctcaggggtcttgggtaactaactcatattcttcaggtcccgtcctcagggtctcatattgttggcccaggaccatcagctgcactgctcctattgtaacttttatgaaagctctaggtgctggagccactgttgccgagcccaggccacactgcttctgctcgccccccatcgtgcactagcggtctcaaaagattcaaagtccaagatggcaaccctcaaggaccagctgattgtgaatcttcttaaggaagaacagtctccccagaacaagattacagttgttggggttggtgctgttggcatggcttgtgccatcagtatcttaatgaaggacttggcagatgagcttgcccttgttgacgtcatggaagacaaactcaagggcgagatgatggatctccagcatagcagcttcttccttaaaacaccaaaaattgtctccagcaaagactattgtgtaactgcgaactccaagctggtcatcacagggaggccgtcaacaagagggggagagttcccaacattgtcaagtacagtccatactgccagctgctgattgtctcaaatccagtggatatcttaacctacgtggcttggaaaatcagtggctttcccaaaagccgagttattggaagtggttacagtctggattcagctcggttccattacctgatgggagaaaggctgggggttcacgcgctgagctgtcacggctgggtcctgggagagcatggcgattccagtgtgcctgtgtggagtgatgtgaacattgctggtgtctccctgaagtctctgaacccagaactgggcactggtgcagacaaggagcagtggaaggaggttcacaagcaggtggacagtgcctacaaggtgatcaagctgaaagccattagcctctctgtggcaaacttggccaagagcataatgaaggaccttagg

SEQ ID NO: 28516 - DNA, 1168 bp, Mus musculus
aggaaaaccggaacaaccaggggactgtaaattggtctgttgaggacattgttaaaggcataaacagtaacaatttggaaagccagctccaagctactcaagctgctcggaaattgctttctagagagaaacagcctcctatagacatcatcatctgggctggtttgatcccaaaatttgtgtccttcttggacaaaactgattgtagtcctattcagtttgagtctgcttgggcactcaccaacattgcttctggaacatctgaacagaccaaagctgtggtggatggaggtgctatcccagcgtttatttctctcttggcatctccccgtgcccacatcagcgagcagctgtttgggttcttggaaacattgcaggtgatggttcagctttctgagacttagttatcaaacacagtgcgattgacccactgttggcacttcttgcagttcctgatctgtcaaccttggcatgtggttacttacataatcttacctggacactttcaaacctttgtcaaaacaagaaccctgcacctcccttagacgccgttgagcagattcttcctacgttagttcgactcctgcaccacaatgatccagaagtattagcagattcctgctgggccatttcctacctgactgatggtccaaatgagcgcattgagatggttgtgaagaaaggagttgttccccaacttgtgaagcttctaggagctactgaactgcccattatgactcccgcactaagagccatagggaatattgtcactggaacagatgagcagactcagaaagtgacagatgcaggagcacttgcagtctttcccagcctgcaagtctaacaaaccccaaaactaatattcataaggaggccacgtggacaatgtcgaacattatagctggacgccaggatcagatacagcaagttgtgaatcacggcctagtcccctttcttgttggtgtcctctctaaggcagactttaagacacagaaggaggccgcgtgggctataactaactgtaccagcggtgggactgttgagcagattgtgtatcttgttcactgtgggataatagaacctttgatgaacctcttgagtgcaaaagataccaagattattcaggttattcttgatgccatttcaaatatctttcaggctgcagaga

SEQ ID NO: 28517 - DNA, 1191 bp, Mus musculus
atgccagaattccacaaactcaaaacaaaattgatcgagaagaaaggagcacgggcatatgcctgccagtgtagctggagaactgttgaagaactcactgacctgcagacagatcatcagcttcgctgggtgtgtggtaaacactgagagtgcagacagcggcacctgtgagaacaagttccgggtaccagcttgggtaccagtgcacagcagtattgtgcgcgctgggaaaaggcaacaaatgctgtgtaaccacacatgtctgaagaccaaatggactggaaaaggcatgcgtactgtgacaccttggcattcttcctttcgacgtggacattttacttaggttaaaatatctgcgtttgccagcatatcaccttttagggactgaaatagtgacatcccgtgcagatttacagcttttttatagcaactgccatactgactgctaatgcactctaaaatgttcctcatgtgtcatcgttgttaaagaatacccactggcatggcagagaggtcattgtatatgagtgttcatggctcttcctattctgatccatcattgtctgagactataagttgaacatgacagaaaagcagatgaccattggttaactgaggagttggcaagaatacaggaacattgtaaccctgccttttatgtatctcatcttgcctcaccaactcaattcagtattatgcataatagtaataatgatgttaccagttttagtgtatttcctcctttgctcactgaaatagcaaaagttgttagttttctattagcaaacatatatatatacatatatatgttttgatgcaactaaagttactaaaatcctaaaaataagtcgttgttagacttttcaagtatactccataactctaaatgagcagcagtaagatgactttcagacaacctgtatactttctaatagtatcaggttggcccattctttattgaagcataaagaaccaatgggtagctcgtgggctcctgtgatatcactgagatgggaggaactgtatcatacatagtaacgttcaagaaatgcattgcctcagttttacctcccagccccatagacatttcagggcttttctagtctgctagagttcttttctgtgtgaccatttcctgtgtgtgtattacttaagtgtgtgacactgggcactctgaaaggaagtacattt

SEQ ID NO: 28518 - DNA, 1323 bp, Mus musculus
atgcatgaatgttcctctaattccacatcctcctcgccaacatgagctgccacttgtcttattgatctgagccattctgacaggtataaaattaaacctcacagtagccttgattggcatttctctgatgagaaggatgtttaacatttaagtgtttctcagtcatttccgtttccttttttgagaactctttttagctctggaacccgttattattttttagttaattaattaattaattaattaattaattaatttggttttttgagacaggatttctctgtatagccctggctgtcctggaactcactttgtagatcaggctggcctcgaactcagaaatctgcctgcctctgcctcccgagtgctgggattaaaggcatgcgccacccggaacccatttttaaattggattatttttcttgatatttggttcttttggttctttatatcttttgaatgttagccctgtagcagatttgtagttggtaaaaatctttttttccagcctctccttttctccggcggctgggaagatggcggacattcagacggagcgtgcttaccaaaagcagcctacgagctttcaaaacaagaagcgggttctgctgggagaacccgacaaggaaaaactccctcggtactacaagaacattggtctaggcttcaagacgcccaaagaggccaccaagggcacctacctagacaagaaatgccccttcactggtaatgtctccatccgaggtccgatcctgtctggtgtcgtgatgaagatgaagatgcagaggaccatcgtcatccgccgggactatctccattacatctgaaagtacaatcgctttgagaagtgtcacaagaacatgtctgtgcacctgtttcagggatcattgtcacattgtcacagttggagagtgtaggcccctgagcaagactgtgcaattcaatgtgctcaaggtcaccaaggatgctggcaccaagaagcagtttcagaagttctaaggggactctggccaatgccctagaacaaataaagttattttccaacgttaaaaacaaaacaaaacttttttccattctgtagatttccgttttgcccaagtgatgttgtcctttgcctcatagaagcttttcagtttcatgaggtcccatttactaattgttatcttagtgcttgtgctaacaatgttctgttcagaaagttgtctcttgtcccaaggagttcaaggatatctctcctttctcttctatcagggccagtgtaactgtttttatattgaggactttgatccatttggacttaaattttgtgtaatatggatccat

SEQ ID NO: 28519 - DNA, 1232 bp, Mus musculus
tttttttttttttttgacttgggaaactctgtttattgatcctcaaacccaatacaaaactctgcacaagttttacaggtccttgaccttgaggcaacacagctgtgcttgctaaagtcggcttgcttgtctctctgggctctgattctgctttctgagacaccaagaggatttctcctgctctcctcctctgcagtctccaagttggtgatcatcatctgattgtggtggagggtggaggagaggagaggcagaaagacccagaagtttctctgtaggcttagagaagtgagccccacagccaatccaaagccggatctggtccaggttgagggcaacaaagttttctccgttacttttgggcagtggatcatcggagcccaattgctccagaagtggccattcctgtaacacttgtgagcaaccacaatgtggtaaaaaggctgattggtgcagccacccgaagcaaggtgtatgcttaggtggactctctgataggctttgcagaaaaggcggtgaggtgaaccatggtgcttctgcgagctgctcttaggctgtccccctctcggtgactcttaacatcttaattttccaagagtagaaagaacagggagattgactggtattaccccctttgctatccagttaattgtcctagtaagtaagccacattaaaatgatagttgaaaagctttggagatacacgtttttatcaggggcaataaagaatttaccacttgcattgtttgtgcatgagcctgcgagtttgtatggagaaaatgtaattgtgtgccttaacttacaaattttagcagctttatttgaaacatcctccattttatttatctacctgcagtccacctgtttgagatgttcagttcagtgattcatgttcattcaagctatcactgagctttggatagctttatcctgcccgcccaggaggcactccctgaccccctggccttgggcacccactttctgtctctgtttatctttgctctttgggggctggggtaggggatttatagtgaaatcattcactgtagcctctggggacccatttagttcactaagatgttctcatggttcatttgtttagcattattgaacacttgacactcttagtatcaaataatttttttcagtttaatttatttaaagttaataaactccttgcactcttttgggtcagtgtgtgtgtgtgtgtgtgtgtgtgtgtgtgtgtgtgt

SEQ ID NO: 28520 - DNA, 2770 bp, Mus musculus
ttccatcaaagatgaaggggaattacggaatggatggcttattaagacaccgactaagtcgtttgcagtttatgctgccactgccacggagaagtcagagtggatgaatcacataaataagtgtgtcactgatttactctccaaaagtgggaagacgcccagcaacgagcatgctgctgtctgggttcctgactctgaggccaccgtgtgtatgcgctgtcagaaagcaaaattcacaccagtcaatcggcggcaccattgccgcaaatgtggctttgttgtttgtggtccctgctctgaaaagcgatttcttcttcccagccagtcttctaagcctgtgcggatttgtgacttctgctatgacctgctttccacgggggacatggccgcgtgtcagccgactagatcagactcttatagtcagtcgttgaagtctcctttaaatgatgcatctgatgacgacgacgatgatgatagcagtgactaaggatatgctgtgaagtatttaattgactgcctgagagtcagctttgggggcgctctcagtttgctttagccatgactgcctgagaagtcttaacctctgtgcctctctgtatcctatggaaagcagccccatgctttctgctcccctctgcactctctcacagggacaaacttgcagatacatccgatagggtcttggctttctactgtccttatttctagattatttccttgtaagttggaaagaatgtttatttaacagatcttgtattacatttatttccccctgatgtggaaaatctaaaagcacagaatgatgggaacaagagtatgatgtgcttggtatctggcttttccccaagcagtcgatgtcaaggttacgacaccagtgacagagcatggtttggaaatcctttattctcttttctcaataccaagtggtgccttactgtggcagcagtgtcactgtcactgaaataaacgtaagccctaccttctttcttgtttgattgatttagacacactggtgctcttacaggtggagaatgagtgtttgatggatataggtaagcatatttatttgacagctatgaggaactaaatttagaggtttctccaatcttatatgaatatttttcataaaatagttgtgattatatttttacatcttttatgcaccaaattataatggtcacatatgtttagcccgttgccactgttcgggattcgatttgaaactcatcactagtatagaagtggcatatcccactagcttctactttcctgatatatttttacaaataactttatttgctttacattatttctaaaaggaaaaatctgaggaaacccttatattttccaacagggttcctctgtgtagctttgcttatcctggaactcgatttgttgaccaggctggccttgaattctcaaaaatccatctgcctctgcctttgcctccccaggcaccactaccacctgacaaaaatgaaaagtcttaagaaaatcctcccaggagaacatggagtcttagagatctggaagagatcggagtttgactaggtttcctgtctgcaagtcaattttttttgtgaaattatcttgatttacaacgtggtattgtattttacagagttcatgaagccccaaacaatttttatttttgtaaaacaattgtatgtttaatctgtttctgaaatcattttgcaatatatggaaatagagtagcagttgatatttctaaattgtgaccattgtccgagattgctttgagaactggtagttattctctttatgtttggaggcagccattaggctgtaggcctgcttactgcatagcactggacgtgccaggcacattctggcccctggcatgcttaagtaactaggttttcaaatgtgggaaaccaagctgaaaggtctgttttgttttgttgttgttttgttttggtttgtttttttttttttttcagagttcttttcaaacccagtttccctttttcaaactttaaaacctgcataattctgcagatgtcctagggtttgagtcagtaacttgtgaatgaaagtcattggtatttggctttgtggttacagtactaattttactttgctgctcagttttgaaagtgtgtgagctacataggtctccctgtaggaaatgtgaaaaaaagcacaatagaaccaggctaggggctttgttcctgctttttgttttgtttggttttactatcagatggatggatttgtgtttgtctcagagcagcatatacatgcagtcagtaagcatgtttgaaaggaccataaaaaccagagaaatgctgatgggaacttggaagttcagaaaccaaggggaaatgtcctgagataacatttgcattgtcgacctcagttgactgtttttacaataaaaatattttgcagcttatttcctgtgtttttatattgtaattgaatattttcttccttttctaactaagatattatgcataattccaccttagtatatattagatatgaatgcttaggatgtagacactaatgaagaatagttttttgtttttagatagacctattttggcctcaaacggactatgtagcaagtagtagctctaattgcgaagctgagaattcccttgaactgatcctcgtgcctccacatccagaggactagaatagcaggctggactgacccagagtactgaggtccttcgttcttctaggcaagcacccaccagctgagccacactccagccctgtccactctttaggaggtgctgat

SEQ ID NO: 28521 - DNA, 1161 bp, Mus musculus
aatgatagagtattttattgatataacctctgtcccgaacctctaacacacagacataaaaacacacacagacacacacatagacagacacacatagatatatatagacatacacaaacacacacacacatacacacacatacacacacacacacacacacacacacacacacacacgcgcgtgcgcgtgcgcgcgcgcaagtcattgcagtctagagatctgtactttgaaagttctctcccatctcttcacgatccatagagagcctgtgccttcatgactgactatgcccctacagtatctcatctctgaagtgtttcctattgtaaggcatttgtaactgcctataaaataattaatcctccgctaggagaaacaaccttgaaatgatgtccctggtgacctttccattgtcccaggcttcacagagcatctgcaaacaagtccaggctcctttgcctgcctatgggatgcagataattatacctgttttcaagcataaggtttagggtgagacatggctaagtcaatctgagctggaagtttaaaaactgatgtaaattgatttagggaggtaaactctgaatgcccaccccacctcgccccccacccctcatccctgtcagttaaccaactcctctctttgtccactcaccctgcgaggaataaatgggccatcactaagcgacccagagatggagatatctgtaagagtcaggtttcaaattgatgtcctcctcaagatgtagtgtgtatgcaaaaagtaaataggacaatagcaaacagaatgacaaagcaagtaattaaaccccaaaggacatctgtacaatacaaacgtccacacagcctctgtagctagattgttattggtaatgaaggtgggatgatccgatttggtgaactgcttggtctagaggctttccactttacatggcctctgactacgtggataccaggccatcaaatccactgctttacagttatgctagaactcgacccagctagatgggaattggacatctttagaaatgaactgaactcagagggtgttgggaaatgttggtaaacgatccggttctcagtgtaagccgtgctcaggaacttctccatggaaagtttctgaccccgagtatctactctccatcaagggcattgtttcc

SEQ ID NO: 28522 - DNA, 4054 bp, Mus musculus
tcaggtacattaactttggtgaacaatatattcagtaattctgatgtgactccacgatatggtacaaatactacagatgtcgtggccaaaagcatttgtttcatatgcagagggaaaaatcagacccatgagatgatatctggaatctatttgtagataacccacagagcagtcagtatttggagatgtctagattcctaactgccagctcagctaaaaatgcacaagcccaggcactcagtgacgtcatgcttgtgtctgccacaagaaagggagagaaacagtggtaactcctcagacatggagcctgtcttcccaagggatttctggtggcatctgtttgcgcctaagtgaagattgatgggttggtttccacaagctttcgtttttaaacttcacaatatccttagccactttggcctctctttcctccacagcaggcgagtactaatacttaccacagcaggagagtactaatacttaccacagcaggcgagtactaatacttaccacagcaggcgggtactaatacttacctccctcacagagttgtgaggattgtatactgattggaagtggggctgtcagaactgaactctgtgaactttcagggtctttctcctgaacctagttgtgggaggctacggcagtttactgccatgattattcttcagggttggtgctaatgaggctagagcacagggttccactcatatataccagttaacgtggtgtagaggaaagtccattctcttacctctatctggtcagctcttaaagaatagttttggtggattttgatgagccatccacacttgctggaagattaaacacatttacagcttgaagcacattctaataccattgccgcatattcaaagtgctcatttccctagcccctttgcaaccataactaaacatttgtttatgaaataatttcaaggaaaaaaagaaacatactgttatgtgaagtattattcctgaagcagcttgatgcagggaaccctgggaaactttcaggaaggtacagtgcttttctctgatgaggctgggcatttagagctgcagtcagatggggaagagagttaacactggctctgattaggtgccaggcaggatgtctcctaagaacaggaatctagacttaattctttccttaagtcttttccatattgacttccccttttatttatttgttttctaattaaggggccaagtctgtagagtttgttaaactgagaagttgttactatttgttgtcatggaggtgtgcatattttataccacagctattatagggtcatatgttggtaacttgaaatagaccagttaagtgtcttctggacaaaggttctgaatccatgtagctttgcccctactcccttacatcacacgaaagctgtcttacaagctggaagttcagccgtcagaatttgtttggccagcatgaattggtttatgtattaaactatacttttttttttgtttttttaaaaaccttcccaccacatttatttatcccttaagtacacttacatctctgtcacttaccgacttttcatttgctttgtctatgcttagtgttttgttcctgtaaatcagcaaacaatcaattattgggattttttctttggggttaagattaccacaccacctatagtaagtgggtagcacactgtggtttttgtgtgagaatctaacatttatatctaaaattggcaagtttttaatcactaggtgttttgttaggcaactataagtctaataacacagaacaatttttttgaaacctggccaaaaatacattttatgagttaattactcattatcatcatcaccatcattttgctattatacctactagtggtttacagtgttcttcaatgcactgaaagtacaagtaagaagaccccaagagttgaggatgtagcttagtggtagaggatttgcctagcatgtgcaaggtcctgagttccatccccagcactgtaggatgaaaacaaaataagcaagactccagaattcagtagtactgaccatttctaaaccaatagcctagaataatgcttgcaaagtctggaatacatggtatgtatcagtcatacatctggagtcttaattttttagcttttatagtagaccccacattccccaaagtttgtattttatgttcagcattttagaatgtgtattctgttaattactatatcctgggttatattctgtactgtacatagctacttaaagctcgccatacttatcttttgtgacaatttgtatttgtatggttgcataggtggggaattttttgcaagatgaaaaaaggttggattttacttgccactgcagaaagttcaaaacaaaacagaacattaactttctgtatatttttccaattcccatgcagactgttcttgttttattaggtctttggttttagcaaaaagagtgtttacttaaaatgtgtgagggttcatatgtctggttgtcgtttttgtttctcaaatctgtacaggtttacagtcttcgcttttgttaaagtttgaattgctttgctattttgctctgtcctcacagaggtattcagtctctgtatactcttaaaagaagaaaaagcaaaggagggtatctttattctttatcgttttctttgagttggaaacaaaagtatgtatgaaggactacaactagaagatagacatgcatttaaataggctagtggaaaaaagtttttaccgttttctttctgttttagagacagttaaaagactgctccttgtactgggagataccagtgtatgcttctattgttgccttgaaattatctttttattttttaaggcctatagatactattacctttaaagtctttaaagttaggtttcatgccagcagcctctaatgtattataaatggcaaccctatcttcttattctgttaaaattgtatatgaacacctgtctattttacaaacttacatatatgacagtgttgtctactttgtcataggccagtttctcttgaaatgtgacaccaattcaagtggcttaggtgcagggagagaccaagaatagatgcagagaggcaggaagagaagttactattcagaggaaggcagcttaaatggatgatgttctgtgtatcattgataagtttccttgtggtattgaaaaatgtttctaattgtacttgcctgatgttttagtattgttttctagatggacttgtaaaaaccaaaccgtgatttgtgaggttagaagtgtgtatttgggggcctcaggtgtgtgtgtggttttattttcctccagacgttttgaactttagtcaataattgtgtgtgttatttttaagaagtaacttttattttttctctagtaaaattgtgaacacattttccttctgaaggcaggatatgagctatggattctgaaaagtattgtaggttgtactatgtgccttcttagtgtgtttatgggcacaatgttttctctcatcaacttgaaacttaaaagggacattttggttagattactgtacaccaatctatgcataaatggcagcttgttttcttgagccactatctaattgttctttttttatatataaatttttttatattgattgggtcagagatggtcagttttatacagaatgaacagcacagcactttgccaaaaaaccccaaaaaacaaaaaacatgtagcattgcttaaccattgtgtattaataccagttctttgtaatgggttcagtagtgcattttgcactgcacagagtttttaaatctgtcagtaaataaaatgtcctttaacttaacatgtggaggattcttttatcttcatggtcattactcttgaaagtaatacaacttacttaaagcacttgctatttagcattgctttgtgcaaaaagttgtttgatatgcactgtaaatgtttcttttcaaagcatgttactgaacacatgaaatctcaatattcaataactgctggggtagaagtattgttgcaaatacaaggccagcttgggctacatagcaaaaccctgtcttttt

SEQ ID NO: 28523 - DNA, 1182 bp, Mus musculus
gcggcccggcccttcccgagatgcacctggaggcctccggccgcggtgggccttttgtgccacgctgtggttaagagcccaggaaggccctcgtcacacttcccgggtcttcgcatggtccttcacaccggctaaagcttactttcccagctttacacgtagacaggatcagaggagacccagtgccttgtctaggcctaaggagcgttcacccaacccataattgcttatcaagactgggggggggggggggagttacctccctttgctggagctgtcgtcttgtacagcttgagatctaacccgttatggcaagaaagcagaggtgtgttatctgagtggaagtaaaactgatggcctacagccccgctccatagtgacttcaagaccagcctagattatgtgagacactgtcctaaaagtgccaactggtggcctatgtaggtgaacttggccaggatacactgaaaacgagggctgtcgtttacatgggattggtcttaagtatcataagtccaaccgcataagttagtgtacgtacgtcattaaaaatgtactgtgggcatatctaagtattacgtgaacagagtagccataggaaaagcaaaattagaatgattgaatcaacgaaaactaagatagcaagctggcagtggtggtgcacacctttaagatcagaactcagatggcagaagcaagggacctcttaagtttgaggccagcctctgctatagagtgagttccaggacagccaaggctaggcagcaaaaccctgtcttgaaaaaccaaaaataaattaaaaagtaaaacaaggtacttacaagcctttatacattcagaatgggaagtatggtatgttttcacatgtagaacctacagctcagtggtagagcacttggcctatcatgggtttgatcctcagcacttggaaggcgagacatgaaataggggactatttgtaaagtagatagtgggaggcaaatatgatcaaacttttatgcaggcataaaatgttaaaatgaaacctttctatatagctaatacatactgataaacatcaaatttgaaaatgtacagagactccatattgaccaatcatagagttgattaataaatacaagctatttttgctcttcctcctcaacagaagttaagaaacaaatttagccgtttgtggtgctg

SEQ ID NO: 28524 - DNA, 1693 bp, Mus musculus
gtttatcttaactgttaattactgaataatttcttcacatgtacagaatgaagtaaactatgtgaacatctacagaaaaggagggcagctgtcaccagtgtgtaatggaggcattatgacaccaccaaagagtactgaaaaaccaccaggaaaacactgaagttaacaacctggaattgaacaaataatggatagtttcatataaatgagttttacagaaaagtagtgctgtaactatccttgtctaaggagttacactgccattcttttacttaaaaactatatcaatttggcactaaatgcctaggatgcacaaaatcctgggttcaatccccagcactacaaaaggaaacaaaacaaaaacttcaaaaaattggcactaaagaagtatttcctataaaagagaacttgtttacaaaggtgacttcactcccaaggatagtggatggaagccaacaatttaagctatagcagttgtttctgtttgttactgtgtttctttaaaattcagtgttactgtatttcttttgatgaactaggaattttatcattggaatatggactaaactagtgctaccttaaaggatacattagctgacacagaactttgaatctagattttatattcttaaattcctatactcttgaatggtgcaatttgtttttgaaaataaattttaagcttatttacaaaggttgttttgtaataaagtgactaatttatctaaagcagtttgtaacaaacgataaaacttgaattttatgaatggtaaagttcaatctgttttgaactagtttgtctgccttgccatatttcttaatcagtaaggcactgaaccaaatgtttaaactgtgctctaaatgggagaaccaaagaaattataaacaagatataaatgctttggcttcttctactcgggggttttacttgatagaaaggttgctttataatctttttgtgtatcacaatttgggtaaaattaaacactttttcaaactatataagaaagtcactttattgcacactaagatatctctaaggcgctttatgtttgcaaaactggtggtccatttttaagccccatattatgagatgaggactgtgtcaacatgaaaaaactttaacatatgacctaaactattttcttatggcagaaaatattaaatgtatacttactcctagaaatttatttatttaaacttgctgtatatagaatagctacttatacattaaatattttaagttagcctttgaaaaggaaatttgggcctaaaaaagttaatttcattagaaaaaaaatggtaccaggcatgaaccttgtctctctttgaagaaattataaactattgttaagatatgaagtttttgtataatttgtttataaactaatttgtttcagtttgttttggtctaaaaagaaaacaccactaaattgtacatatgtattatataaacttaatcttttaatactgtttacttttagcccactgtttaaaaaataaaattgaaaaaaaattaactaactgcttaaaagtaaagttttgccattgcttgtagaaacttctttttccttctctgtgctgccagctgtaatacttcttcagggttgcttgcattcaattctgtttggccaatggctttgatcttaaaacagaaaagtgttattagaagtttgactgaaaaaaattgtca

SEQ ID NO: 28525 - DNA, 2061 bp, Mus musculus
atgtattttcatgtttttatcattaaaggaaattgtaagccagtgtggtgcctcacgcctttaatcccagcactttcgaggcagaggcaggtgaatctctatgagtttgaggccagcctggcctacatagtgagttccaggacagcacacagagcactataggtaaaaccctggtggttttttgagggggtagggaagaaattctaaattaatatggcctcataaagagattcaggatagataaaagcctgtagagaaatggttttaataagatgcatatttaactttacatgataaaattgttttgtgaacaggttctataattttattttattagaatgctataaaattgcattttaagaactccaaattagaaagaaaaatatttccttttttttggtaatgtatatgtacaatttttttcaagtgtgtgcacttagagtaacgtctagagcttaactgacatctgttctcccccctcctccccgtttagtgtaaatggtcctgttcactaatggtcctgttcactaatgttcatgcttattttgactaaacatgcagctgtggcactgtatgtctgatgaactctgaatatcttggtagtcactagtgtttaacatcaggctttatgaaaattaccagctactcaaatacacactgagtactcatgtggtcattcttgtgatcagagcatgcagaaacagcttacatattgtaaagggggaagtataaaccgtatttcccttgtaatacgatttttttcaattcccttataaaatgaattgagtttttgacataacatgtgctaagttagttttagtttttgttctgtttgctgtatcagtaagctaagaatttttttattaaaagttcataattagtcccaggcatgatggtgaactcttttaatcccagcattcaggaggagcagtagcaggcagttctctgggttcgaggccagtctggattacatagtgtgtaccaggatagccaaagctacccccacccccccaaaaaaggtttaaaattaatttttcattcagcatcacctgaaagaagaagtattatagaaatggcactattggctgaggatgtgtcaatcagtagcatggcgctgggccagcacacacaagtccctgggttcagctcctagcaccatggtggggggggagggagtgggcagagaagggcagacaaatgaagaaaagactgaaatgataatattaggtatcatagatatgttgattcacttccatctggactgtcactaagacaacactatgttgttgcaagcatttaacttttttctttagtgatttgtggagtaacaagtaaaaggtcctactgcttgctattctaagtacttattatatacttgggtaaccgagccgctgctaggatcagccgtaaagctgcgctgaagggtcagccgtaaagctgcactgaggggcagagtttgcaggatgtgggtgggaggaattcctcaaagaaagattgaacatatttgctcttaatataacaaacccattgaaataagtgccttaacttctttatttctaaatccatcttatactttatgtcatattacctgttttcttttccataagaaactgctgttaacttttgccacatgggtaaagttgagtgaggtgaggcttaggcccctccctccctccctcccatgtgtatgcgtgtgtatgcgtgtgtatgcgtgtgtatgcgtgtcctagtgcccttccctactatacaagagcttctgggcttcatccccagcacaacaaaacattaagccaccccacaccattttcatgattagcttcaattcactaaaaagcaaatctttgtcaagaatttccagtcttctgaattaattaattaatttaggcccttgcatgccaaatagtccaacatgtgaaacctacttgataagggatgtaatatggactctggatgtaatatggactctgtgaaacctacttgataagggatgtaatatggactctgtgagtttagtaattttttaaaaatctctttggcatctgtatcttgatgttttgcatt

SEQ ID NO: 28526 - DNA, 1208 bp, Mus musculus
taagtctagtgtggaccagtgttctttgttgttaattttggatagtgacaactgtagttgaaattaaaagttgaaatctgtaaaatctataatttgtaaaagtaatatttaaaaattcatatgtatttcataatgaaaaaattattcatcattaatcttgcaggttgctctttctcccctttttttcttacttgacccagtggggctgaaggcacataatgaacacgttaaactacatcagtgtagactgagttctctgctactgctatgtttagcagatgaccactgtgtttttttcatatttaagagaggaagtcaccttggttttgcagctgtaatatattattaaagtaatttatatattttgaccaattctttgctcttttgaagtcaaaaggaagtattgtttagtactatctgctttagatctttttgtcttagtgattcccttgtcttttcattctgtgtctcttaagaatatttttgtttgtttgcttgcttgcttgctcttcttttttcttttatagaaaggtctcactgcccttgctggcctgtaactcactatgtagaccaggctagtgtggaactcattatgtagaccaggctagtctagaactcgccaagattggtctgcctctgcctcgtgaatgttgagattaaaggcagcctgtgctgcatgagatcctgtctcaaaacagaaagagggtaaagagaagaaaagaccttgaattattgtctattaactaaacattttaaactgatgatgatggtgaatgcttgtaatctcagcactgggtgcctgagtcgaaggattgcaagtgagaagcaagcagagacagcatcagaaaacattgcctcaaaaccagaaccctgccagggccagggaggaagctctgttggcagagtgcttgcccagaatgcacaaagccctgactttctttcctgcagcatacgagccggggtacggtggtctgtaggaatcactggtacagggttatattgtcagctggatggtgagtttgaggccagtctgggctacatgggatcctatctcaaaaaaccaaacaacaaaatgaaattctgatttcctcataaaccttgtgtttatttctattttgatttttggtttgaggtaggattcagttggaaaacttaggctggtctttatttacctcctgagtgctaagaccagtcatgtactaccatgt

SEQ ID NO: 28527 - DNA, 1223 bp, Mus musculus
ctccccaaagacagagtaactgagctgagggtgagatgaaactgaagcgagttggaagtgtggggtaatgtttgaaatgccttttgtgaagcgagttttatcatgttgttatgtatacttgtacttatgttttcctgttactgcaaatcttttttctccccttatcatgtttttagaatttgcaaattagatcgcttcatcaatggactctgctcaactgactgccaacctgagaacaatacttttttttagacctgttggattcaaacaattgtttaattgtaatagtgtaatagtgaattatgttttaagcatgcagtaaaggtgttctttttatgacagttcttcctgaacagttttgcgactataataaaaaaaaaatctatgtacacacacattatacttttttaacaggttattgagccacatgatatatcagtggcactcaacacccgaaaattgtggagcatgcaccttcatgttcaagcaaagttgctccaagaaatagttcgttctttctctggcacaacctgccagcccattcaacatatgttacggcgtatttgtgttcaattgtgtgaccttgcctctccaactgctcttctgatcatgagaactgtgttggatttgattgtagaagacttgcaaaggtattttcattccaccttaagaagttttcctcaagttactcttgacacagataacctcttttacatagtttggaaactagggtttagtaagcctagataacatgtggatgtataaatacacacacacacacacacacacacacgcacacacatactataatatatgaaaattatttttttagaatgctttatcttctcatttcatgtgtaagtcatgttgaaggtcttgattggggtttttacttaaatttcattatagcataatgcttgcttgtgtgcatgtacatgctcatacatgtatggtcaggactttatatagttgcttttttctttccttctgtatgtggattctggggttgaactcaggtcattagggttgttctatatgagtacctttatttcctgagtcaccttcctgccccagttttgcagtttttaaaaggtgaagtataaagaactactctgacttgaagtatattattgaaatcctgaaattataaaattttgcagtgactataagcttctggaaaaaaatcattatatcaaaggaatgaggtgtatgttttatacaaa

SEQ ID NO: 28528 - DNA, 1128 bp, Mus musculus
aggccaacctggtctacagaatgagttccaggacagccagggctacacagaaaaaccctgtctcaaaaaaccaaaaacaaaaaaaatcccttttattcatttactgtgtcttatacatctcattcattagttaaggagtgtttggtttatttcaacttttgtttcgtggtactgaggtttaaatccaagaccttttgcttggtaggcaagtgttctaccaatgagctcttgaattttcgagacagcatgttgcataactcaagctgagtttgaattgctgtgtagctcaggtcgtccttggccttgctatgtgttctaggctgcctttcagttctagaacctaggtcctgggaaagtacctattaatacagatatgttgaaactggctcgatttaaatttagagcctattatataaagatgtgggaacttaactttaattcatgtatcatatatgtatgtatgcaattctttttctttttagggtgctgaacagtcacaaaatgatccaggtgtatgcagttcaaatccttgccccagtgagggaatccctagggaagtgggtgatgggactagagtagatccacttcctccaggtaagacacttattgtattatgtttgtacttacgttacttcacagtgctctagaaatgattattcaagaatgaatgctatttgataattgttgatataataccactggatattttgcttcaggttatctgttgtctgattttatgtttagaagttgaatttaaccatttaactaaaaggctgtagctcagtggttagaatgtttgccttgcatggcaaagtccagggtttgagctacagcactgacaaaataagcaatctgtacaaaccttaaaaccatgcagttgaatcttgggttttgtagtagggctacgttttaaactacaggaaaagtgtcgatcaggtacaatctttaagcaccaattagttgtatttaaaattctgtgaataaacatgttgatactgctaaactagaagagaaaagcttgaaatacgccaagtcacaactttattgtactctatgttaaggtcaaatcagatttgaattattaattcaggaaaatctagcattttacttgtgttccatctctccatt

SEQ ID NO: 28529 - DNA, 1134 bp, Mus musculus
ttttattatttgtttttgtggagcttgaccccagagatatcaggaatgcaggtttttccactttcaagattgagtgagaagctgcttgtgaactggagtcttgcagaaggcatacatagcctgaaaaaccatttttacacaatacacagtaacttagaacaggcactagttaacccttaatccttggcttttctgtcaccgtcttaagggttgagatgccttgtctcaggagcacagtaggagcacagtagtgcttcctagggtcactgctagattgggcattcctttcctgtagtcagggatcattagcctatcactgccaccccttacctagctaattagcatatcaacacctgctttgggtttggcacacatttgagctgcctctcattggctcctgtcttgcaaacactacattattccaagctgcacaaaattatgttcctaacagtgagaaaacaggggagatatagaaagtatggtgcagatgtgtggagaaatgcctgcttgtccatagggatgagagaaggaattctgttctgagattgccctttatttcacagaactcataggtaagtactgtactttaggagtatctgtgttggctcccaagtatcagcacaataggaattacagactatatatttttgtctaatgcattctttttaaatgtactatgttaatatttagaaatctgctttccttttctttttgcgtgtgtacattccatgctgtacattcatatttacttagggaacctgtgtgtgtgcctgcatgtgtacagaggttagaattggtggtctgtcttcttccattattgatctctgctttatttactgagacaaggtctctgactaaacctcgaattctcagattgggctaatctaagctagccagttaccctgggaatcccctgtctttacttcctgaatttagggattagaggtaggttgccatgcctatccagttttttgttttgttttgcttttaaagacaaaatttctttatgtagcccttggctgtcctgcaactggcctcaaactcatggagatctgcctgcctctgctaggattaaaagcttgcttatttgggtggtggggagctgaactctggttttcatgcttgaatgacagg

SEQ ID NO: 28530 - DNA, 1185 bp, Mus musculus
gtatgctgaccttgttaaaggaggtgtgcacactggggtgggctttgaggttacagaaacccaagtcaggcccacccagtctctgtacctgctgcctgggatcaggatgtagtttctccagcatcatgcctgcctgtatgccacgacgcaatggactaaccctctgaaactgtaagcaagcccccaatcaaatactttcttttatgtaagctgctttagtcatggtgtctcttcagagcaatagaacagtgattaagacatactccaagtaccattaattttaagactcaccttaacaccaagaaagcaagcattgattgattagttactagttactagttacttgctgatttcccagaagacctgtagagaatcaggaggaatatggagaaccagcctctcttccttctaactgattttggccaaaggcaaacagtaaccatcaggctgacatgttacactcctatgtaggtttattttaagcttcttggctgggacctctgaggctactggatcatatgctgtgtgccaagagaacaacttaaatgttactggtcacttatctctgtgttagtatctcaaaggtacttgtgtaggatagacatagttaatttttcaaagaccctgctttctctctgcctgttctgtctctatgataatcctaggttgttttcatgttacttctcaatatctttcaaggttgaaataccaacaggtattctggtggctcaaacaatcaagttacagcagaaaccccacagatctgtcctggccctggccacataataacagcactactgaagtaagtccagttgggtggattccacccagaaagagaggaaggccaagccagaagagagtcaaggcagagaacttcatccaggacacaggagttggaatcgctgtgggctggcatttcacaatatgcatgtcactcagtcatgtaactagagaatagaacttacacctctgagactatttcaaagtcatcactctgaggaggctttatcccaattccagaaatatcttggcattcaatcttggtgacaaattattttgactatatttagtcgtggcaagttacttttttttttctttctgagaatcagcattattttcaaatatagacaggtcatccaaaagccagaataagatggggaaatcaatactatccaggtagaaaac

SEQ ID NO: 28531 - DNA, 1200 bp, Mus musculus
ctacattaagaacttggatgacaccattgatgatgagaaattaaggaaagcgttttctccctttggaacaatcaccagtgcgaaggtgatgctggaagatgggagaagcaaagggtttggctttgtctgtttctcctctcctgaagaggcgaccaaagctgtcaccgagatgaatggacgcattgtgggctccaagcctctgtatgtcgccttggcccagaggaaggaagaacggaaggctcacctgacgaagcagtacatgcagcgtgtggcggggatgagagtactccctgccggtgccatcttaaatcagttccagcctgcagctggtggctactttgtgcccgcaggtgcgcaggctcagggaagacccccatattacacgcctaaccagttagcacagatgaggcctaatccacgctggcagcaaggcgggagacctcaaggcttccaaggattgccaagtgccctgcggggcatgtctgggcctcgtccagctcttcgacatctggctccaactggtaatgctccggcctctcgtggccttcctactactgctcagagagtcgggtctgagtgcccggacggcttggctatggactttggtggggctggtgccgcccagcaagggctgactgacagctgcaagtctggaggagtccctacagccacagttgctgcctctgctcccagggctgtggctccacacaagtatgcctccagtggccacagcccacaccctgccatccagctgctgcaggccccccagcctgtagtccatgtccagggtcaggagcccctgacttcctccatgcttgctgcagcgccccaaccaggagcagaagcagatgctgggggagcatctgttcccgcttatccgaacaatgcattcaaacctggctgtgaaaatcaccgggatgctgctggaaattgacaactctgagctgctgcacatgctggagtccccggagtccctctgctccaaggtagatgaagctgtggcagtcctgcaggttcatcatgccaagaaagaagttgcccagaaggtggacactgttgctgctgctacctcttagacaagaataagactcaaaagccaaataacccctcatggcatccagctaagtagacgtcctagttgtcagtggacctccacaccaagaaccaaggtgcaaattcaataggtcattttgtatcaga

SEQ ID NO: 28532 - DNA, 1353 bp, Mus musculus
tacaaagtgttcatactgctctttactcaccaaggctggtagatgtatgtcatctcccagtttaacattactttcccatacagacccacaaagtctgctgggtttgagcaaactggtgggtacctggtttgcttttgcttataaaggtctcaaggcccattggtctagtcattttccttggttaagtgtctcacacacacagcttttcagagcaaaggaataaaagtcactcattgaaacccctgactggctggcatgctttcctgtttatccattttgctagatgatgaaacaaaatgatagtaaggtgttgtccaaacaaagcagcagaagatgtagcacacacggttgctcagtgcaagcacctcacagccccaaatatctgaactcaaattcggaatgtcttaaataaccaaagaagaacacatggttattctttgtatatatatatatatatatatatatatatatatatatatatatatatatatatatatatatatatatctcattttaaaacgtcgggtgtgacaatttgtttggagaccctgtttgagaggagtttcagataaaaggtcatatataaaaattgtctactgttgcgccagctagtgctgaacaatttcattcaaatcctgagtatgtgccctgctgttacttcctttggcagttgaccgttgaaatcagatttttacttggtttttaaagtataagctaaacaagcaataaaaaaggggaatggggcgtgctagtatttcaatttgctctcttgttgctctacttctgtgcctctgtgcattattaatatttggatgcatgcagtgctagcatggaactttggtcttcacaattactgcagtttttccagaaaacactcacaccaataaatgtaacagaacattccatttgttaatgggcatatgtgcataagcagtgtagaaaataggctcatgttagaaactggctacatccttcataactaaaagtgtggttatatgaatggacactgtcaatgttcatagcttaaacctgggtacctggtcaaaatgcttaggaaacattaaaattgagctaaattgtctcaagtccttttattcatataataaagattgaagggatggggggaaggctgacattttctggttttgtttgtgaaattgctggacacaaccttgacagtatcctttaatgtaatgaggtcaattgtattgttaaccatctttttatgtataatagtgaaaaatttacagtaagttggtgtttacaacctataatcaggtaaaatctgtatgtgacctgtttataagttgtactgagttagtttttgtgaactgtggaagagtaagccatgag

SEQ ID NO: 28533 - DNA, 1134 bp, Mus musculus
aagctgcttattgcaactgaaatgtcgaagaaagtagcaggaaggagcttcgccttttggaacatcaatgagctagttgccacaggcgctaggtctagcatttagacctgcaaggaagggcaataagcattaggtaaggcttgaatttgaattttttcactaattaaatgagtgctttttttgtaaagcaaggtaagagtaatctttttgatttgcaggtgaatgagaaccctacctgcctaacgaggaatgtctttcccacaccttaaatacgaaggtttctggctgggtaaggtttgtagctcacagtaaaaaccgatgacactgttggtttcccacaagtcaatgtcacagttgagacacccctcaagctcagttttgttttggtgcccattgagcaaattctaagacataggcagttacattctgcaaagccatgggtgtttgtcataagctagatgtgcctcttcatgtgtacaactcaatgttctaaggtaaagtcatccttcaataagggaaagtcatgttggcttttcaaaagtaagtttttcatgtatgactttaataagctgttcccaccctaagaagaactaggaactttcacagttgtcagaataattgtcttccttaaagctctatagcgtgtaagtttactcttgtgtggaccagtagggatagtcaagtgtttagtcttctcccctaacccatcacaaacagggtctcactgttgtcctagcctggaactcaatccaccagccttctgtgtctcccaagtgctggagttaaaagggtggtgcctgtatgataactcaagttccttttaaaaaaaacatccaaagaacagttgggttactattcacataatgttgctggttgttcataagggctatttctgctgccctgaaagggcttatttgaaaattgcttaattcaggttacttcttaatagaacattttcaggggacaaatctgcaaaatgtttcccacacagggaacatccctgcatcaacaagtttgcttggcatttaagtcaggacaaagttcacagaaatcatagttaccaatgaggtagcaatcgttcaatggtggttaacagattggagaaaatacatttgcttaggaggcatttacagt

SEQ ID NO: 28534 - DNA, 1134 bp, Mus musculus
tgctcccagaatcctttgacctcattctgctttctagtctgcttgtgacactggacagtcctttcttagagctattctatgttctaggctacgaagggttaaataatcccaaaaatgaggtatgtcataccctcacgtctcgatctcaagaagctgtgatgtacgtggaacagcactgttattctgaacactagtgtgtaaagtaaggattagtacagtccgtctcattactttttaattcagggcaccctgagtgaaaaccaatacaaaaaaaaaaaaaatccctaactctgagctctatctctaattcctcttcctccttcccctcttcctcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagtcatacagctgcaaaccatatcacttcttggtaacaatgcagacctcataaacctaaaaaagagaaagaaaagaaaacttttgttactttccttttttgcttgtcacttatatacaggctatgtgagagtattgatttgtaggtattacacattaaaaaaaaagttatcttcattggatagaattgaatggtggtcgctgataggaatagggcgtcctctatctcttatctctgtctcttttctctttctctttctctgtcatgagactgtgtgtgacagggccacctgtcttttttatttttatttttctgaacttttttttttttaatgtgtaggtgcatgtcttggggatttaaaaatttcaaggctggtttacttatgcaaagcatgcctatgtctggaatacttagggaaagaaagcgactccatgttgtccgaattcctcaagggacagaaaaaaaaaaattggagactgttgaaatgcagatttgaagtaattttattttaattattttgggttctgcgacattattgtgaaaaattaaagttgttgtgcaatacttaattcagacacgtgccacaagttaacggtagactaacactggggggcgggggctaggcatcacgcttttgtctgcatactcttgagct

SEQ ID NO: 28535 - DNA, 1111 bp, Mus musculus
gctataggggaatgtaggctgggtttccctgaggatcttagtgtttcaattcctttagatgaaggcattctctaatggtcttccatgaaacagctctctcaaacaaacttagctggtgaaaatacctttattcagggtgagctttatgcatatactttatttggagagaaccataagtatatatggacatttgtgagtaaggaactttcagcataaatgaatatccttgtctagagtttaaatttctgtgaatgcttcctttgtatggagcattccagaaattccaggtacttgctgggtgggtttaaagcttttcacaggggtcgcctaagaccatcggaagacacagctgtgtacgttatgattcataactagcaaaattagagttatgaagtagcaacagaaataattttatttttgggggggtctccacagcatgaggaactgtaataaagggttgcagcattaggaaggtggaaagccactggtctggggtaacttaagggcactggtaggcaaaggctcaggtcacacgatcctctgacagtctcatcattcctgacacttaacatggagacactagacaagcctgtggctttcccagtgtaaagtgggaagagtggcagagcctacctcatggggtgtgtcttagcactctgagtgtatcctagtgataaacaggatggggctctgttcaggcctggtttctgagcagctattgctcaggtaggtctcttggcttttccatcggatgaggtggggcccagggcaagggtattgcaggggagttcagaggtcttgctgccagcttctatctccacatcagcctcctgacactgcatttggaaacgtgacaacagtaatccaggtcagaaatgaagggatgctactgagaccacacttcccactgtccactgattacagaaagcgttagttagtcacggattgtttgatttctggctcctccctgccagggaaagggggctggccaaatcatcaccactacttctggcctggcaccagggtgagctcttgtttccttaaaaagcagccacttgcgccagccttgatactgggcagtagcattggtgggttgaagggtgaaagaact

SEQ ID NO: 28536 - DNA, 1150 bp, Mus musculus
ttcaaattgtcatttgtttaacaattttcagatttagcagtagaactcattttgctttcaggctttatccagcctttgttgtttttcctcacatattgagaatgttacaatcacagattcttgctcttaagggcctctcaataaatgcatgagcatatcattatgcccaaagtaaagagggataataaggtagcagccagttaggctactgcttttagaagaaataaggtggaagcttggggctacattgatcaatgaatgtttattttggatcagaaagttctaaaaacattgtgtaatatttatgagggtctttggtttggttgtttgtttttttgtttgtttgtttttttaaagaagggcatcagtgaaaggcacatctgtgtcaactggactctacaaattggtacctgcccacaattagtaccttggtgcagttgtcatgaacccgtgaaaaagcaaatcacttgattgttgataataattgctagtttcataactttagtttttaacattagtagagcaaatgttttttcctgtattgatttaatttatttattttatcttatttaaaatctttctctatctttaagctctggtagcataagttctttcccttgaatccacttttgttttctctgactgaatacccagccttggttcttcttactgaccacccaccctattctttaatcactgaacacaccctggctctccccctctcgacacccactcttgttctctcctcgctgaacacctgcccttctcacctcacgggaacttttgagcttttattcagaggtaaatgcttttcctgcttcaccgttgtttatctgctttccacagtcaaatggacccctcttaggcacttgtctctggatcctcacacccatgctaggttgcttagtggatgactctagtgccaacacactgggaactagttacttgcatgtgtttattttcccctagtttaagtgcttaaaaataacttctttttttttctctttcttttttagaatttaatattcttaatttctcccctttcttgcctcccctccatgagtccctcatcccatccccatcccctttgctcctaagagggtgctcctcacccatctactcctgcctcacccttctaacatccccgttt

SEQ ID NO: 28537 - DNA, 1254 bp, Mus musculus
taagtcttcccccctccagctgtcctaacaagacctctgcttgtgctcactttctaggattcaatgaaaaccctggctacacattattttgttaaataatgtatcacttgttttcactcaagtgtttgattattatattttatgtatagcaagagttgaaggtggcagaagcagagagctgtgtggtaaaatcagtacagaaggattttatgcggaatgactcgtgttactcagattttcaatcacttcgagaagtattctttgtaacagagctgtgcccacacacaagtctgtttgctcttcttatgtaacaaagtgccatgggatggggacacagctctagcagagcacttgcctgccatgtgaggctcaaggttcagtttctagcaccaacaaaacaacaatttatgaaaatgaaacgttttgttgcaatctgtttttttccaacttagaactacaactaagtagagcatcatgtgtataatatctgggcttttgacccatgtatactgtctatgagtaaacactgggcttatgatgttaaaagcaggtaatagtctggcaggctggcagagactgctcagcagagcacggactttctgagaccattccagctgactaaaacatactctgcctgctatacagtgtattctgaagggtgtattctgctttgtaacttttgattctttttttattctgaaatttataaaaacataaagttgtaaaataaatgctttgaacctattttgaagtaatgttatcttcatcttatagtatcagtcttaaggagtaataaaacaaaacattatgaaacagttattgaaaattccattttcaacaaagatactctaaagtaactcattaatgttttgttgttttgacaaggattcaaatgtacttaattatgtatttctaatttttgtttatgttttattttaaaatggccagtatatttatgaataaaatgtatggcccacttctaccattttagtgataaatggaaaagtcttctaaaaacggtaggtgttaatttaagaaccatgtatgccaattaaatttgctgctgctggtctgatggaacttccacagctttctttagtcttgattaaaaacatttatatcaaaattctagaatgtgtcttcaccaagaattttatctacttacatatatttatagcctgtaaaaagtaaaacaaagaatgtgtaactattgtgagcaagatagctttgctcataatatctgatgtttaccaa

SEQ ID NO: 28538 - DNA, 1137 bp, Mus musculus
ccgtgttaataggctacatttaacagttaatatgcacagtaatatgcctattacacattcagagattaggccttttacttgtcagggcccagtcagtaaaatctttcccttggctaaaactgacatttatacaggtcatgtaaagatatgtaaaacgataagcacagaaactgtttgctgctgccctgggaagactaagctcatttgtacgttgactctttataggctcttgcagtaagcctaaatatagaggggctgcatattttaaccttgtgtggcattttgcatgcagctttggctttagaacacttgtcaggagagagtgaatatttgacacttgggaatcgttgctttagatgatgatgggagcagttaattacagacgtctctgagtctcaggtggaaggccaggggcagaaatgctttgctgttccatagaaagatggtggaaaggtggggtgggtgtatttagtgtaattctaaagggaggtggtacagaagggatatggtcttcatcagggatggtgggagctacaaaagagattgtgtgacgtgatttcaagttattctgatctgtttcctacagaagagtttgggaagtactgtgacgatattgtgaacacagcggcatggggcggtcagctcgaggtaagctggatcaccgtgactgtggattaaattatttctgaatcccacttgtagttcttacatgttttccagctaagcccagttcttttttctttctctgttcgccattttctcctgacagagagctgtatattcttgtatctgtcattgaaccttgtccccttaagtaagtgaagtatggtttcatcttaaatagcccagcattggatttatgacttaacagacgctagtgctgcatctctgttgttatttgagatgctagtctgcttgatttttctgtatttaaaaaaaaaaaatgaagacagtcaaatgaagacttacttggtgtggtggtgcacacctataatccaagctggtgagaagccatcttaatgctggcctgagctacacagggagatcatgtcttaaaaaataaaaaatgtgttgattttattccccgaaggcaaattttaatctaagagttcggtgttgcagaagtaacttctgtat

SEQ ID NO: 28539 - DNA, 1184 bp, Mus musculus
ggagctgcaaggtgacgggaaaggggctgggaatgtaagaggcgtccacacccaaggctgggagcgtggagtgtgtcctctggtacctggacgggcacacgtcctggatccgtctaggctttccctcagataacttttgatcagtcttctccagctttccccattccctcgacccccttatttgcagtccccggagatgtccccgtgtgcgacctgccgtggacccctagcgggtccggtgcacgtgctgctgctgagtgatgtgcctggagaccaaagtcttggacctcctcttcctcccttcccattcctgcccccgatcccgacgcctggccttagtggtgtggtctgaattgcttctccttggcttgtcggtcacagagaaagatatttaaaaggcagaagttttaccttagtatagttttttaaccttggttttgccctgtcaaaccaaacaaattcgagattgtgtttacgttgggtcgcaagcctcatccggacctttctccgtagctgattgttgtgtcatgattaattgcttctataattactttacattctataattgtacctcttcccaccctcttaactgcttttcgctttttggtccgggggctctgacacggctgttttgatgactttttttagccaaaattcagggaatgaagaacgctgttcccaaaaacgacaaaaagaggaggaagcagctcacggaagatgttgctaaattggaaagagaaatggagcaaaaacacagggaagaactggagcaattgaagcaattgactttcaaggacagtaaggtatggggagcgaagcttgtctctgagcccgagcaaacagctgtctgagtgtgttgaactgcttattgaatacggtctcaaaattctgaaatcgagtcatacagtcacacatcacatttcctcgacattagtttttttagacagagtgccttgtagtctaggctgtcacccatgtggatttggagcagaggctaaaccttgaactttaacttcagatcctactggtgtgacttcacaagtgctgggattacaggcatgcaccaccacacctagctgtacatttctttagtatttttgtgaccaggtttatgggcagattttctttttttaaatggaagaacagcaaaaaagtgcctacttccttaacctaataaccatgta

SEQ ID NO: 28540 - DNA, 1164 bp, Mus musculus
cctccctcctccttctcctcctcctcctcctcctcctcccgggctctttctttcctctccagtcccctcccccagcatgcctcccggcgtgcttcccttcccccggcctcgcggtcccgcaccctcccctcccccgcctcctgccttgtgacacatcctgggccctcccggaggccgtagcggcggcgcggcggcattgctggccaccacctcctccctagccgcagcccagctcaacccgcggcccgccgcgctgtcgctgcagtcatggctgctgacggggtggacgaacgttcgcctctgctgtcagcatcccattcgggaaatgtcactcccacagccccgccgtacttgcaggaaagcagccccagaggtaaggccggcatagacctttctgcttctcgcagaaacgtctggaaggatggaaggatgaatgccggggagctctagcgcggaggcggaggagagcttctcccttgggctgggggaaaaggatgccttcccaggctctgcctgcctacccgaaagcctgtctgcagggcttcgctgctgctgcttgtggtgtggagtgtgtgcttgaacacttccttcccagcttcaggatcggacatgaattttcccaagctccgagctgctgtttccaaagcagcccctaagtgcagctgggcggtggtgcagatccttcagtcattcacaagtgctttcggttgctgaaaaacacggggcactgctcaccctggcatctgcccttgagaggacttcagcaggaaacatcttagtcccttacactcggccccggagtgcaagcagggaactgcctaaccagaagcaacagagtttatccctaatatgtccgaaattcctaagctacgggcattgctgcctgtaaggagtgtgtttcatagcttcagtggtgaatgaagagccttccgttaggaaggaggaattttttaaatgcatgtctgggtgaggttgaaattaacttctaaaaagttccccaagtttataccgtatatatttttagttttgtttttcagtgtagaattaaaaagggatttggagaaatggtgtggtgaaggagaagtctctttaccaaaggattcgatttattcaagcactgtctttgttcaaagtctttgggagtgtttactacggtagtctgga

SEQ ID NO: 28541 - DNA, 1993 bp, Mus musculus
cgcttctctatttacttcataaaatttgtagttatacaagtatcattgttgtctgtcgattagagtcaagagctacatgtagtcttacaggtacttagtggcttcagtttggaaatacacttcatattatcacaaacagggaggccaacacaagttttccaaaaggacatttccttaaagtttctaatctcttgctttgatgttatttttcgtttcaggttggcacacaagatttttcaaggcgatttcatgcaacctatgtgtcttgggcaattgcttatctgctaggtttgatttgccttatccgagcttgttactggggcgcaatcagagtcagttatccagagcacggctttgcttaagtctcctcatgaatccttgatgcaggcgagagtgtccagtagtccttgagaagctctgctggacgccttcaaatcatttatcctcctggattccatcctggtttgtatagtagtctcaagaatttgtgagtcttttctgaacagacgctcactgaagtacattatatgcaagttcattttgctgctaggttttcagacttggaaaaataaagctgtgtctctgttcttttaaatcataaaggtatttttgcatttgtcctcccacgttatatctaatatcagtctttcattatgtttaaaccagttgttccattacttgttgctgtgggactatccccaagaagtgtttataaatgtttctacaatagggtcacatttatacttacattttaaacagaattgcttgctttaaaaatctaagcaatatgcatttttgcttgaactgcttactgtaattttaacctaagagtatagataccttattcaggaaaaacaaattgagtgtactttgaaaaacttgacattcttgtcagagaatcatttctagatagtatatgcttgttttttttgtttttttttttttttgttattgtttgtagaaagatacaatattttggtagtaaattaaaatacctaggatgaacatatatatagtccacagttggagatgttagataaatgtcttttctctaagattacaggactttttgcctttcagtcttgtctttttatttagcatttacaaaaatctggtctggatttatggaatttaatgttactctgctgaatgtattcctttataaactggaggaagtatttcagacaacatgttttataatacttcatcatctcgtcaaagacatgttgacactgggttgcagtccttttcattcaatcatggtaaacttatcttcttgacatctgtgtacacccgcttctctgggaagagaacttaggacttttttgctttagctgaaagttagaattagagattctcttaccatttctcacctggtcagataatgactcgacttcttcaagagaacggatcagagagagagagtttcatcgtcacctaaaacttcgcgtggaattcatggactcagctcttgcactgcccagttttgcagtttagaaggaattccttgagagtcagtggtctaaactctttcacattgtagaattagacaatgagatgccctgaatacattagtaggtgattccaagggacaagactaatgttctaaattatttatgttcctgattaatatgaaaatgtacttaatgcaaagtcggagtcagctacacctcaaagagaaaatgataaatgtataaatgaagtagctcaggattctatgtacctttgaaaatatgctaataaagattattattcaaaaatcactttgttctatttcttcctaaaaaattagattttatttccaaaatttactttgagatcttgctgtgaaatattcatattaaggaagacagaccatttttggataatgttcctttatcttttttattctgttttcattactatgttttaaatatttttatttggtatgctatggtattgttagcacactgtatattcagaataaaataatcagtgtcttgtcttaatgaca

SEQ ID NO: 28542 - DNA, 1173 bp, Mus musculus
tttgacacgcaggcacgcgcgcgcccgtggaagctgagagcgcgcagccccgggtcccctttccgcttcccgtggcctccctccgcctcactcttctgccccgggcagccgaggcctccgttgcctgagagacgcgggtacctcgccactcatccgcagcaccagccgggcgtcacgggggcgtgaccgaccacccagctatgtctccgccccctctgcgcgtgccccgcccctcgggcccaagggggcgggctctgcgggcgcggggtccagactcgaccgactcccggcgggaccgcgtctcgaccgccgctgccgcccttctccggccgttccctccccgcgagaggacgcagggagccgaggcctggcgtgcggggtgccatggaaggccgcaggcggggggacgcggcgggagtggagacactggccggctgaggccgaggcatgcggaaccccggtgggagcctgccccacacgctgccccgggccttgcagcacgccggtcggacgggagtcgtggagcagccgggccgctgggcaccggagcggacagcgggaggggaccgctcggaggaccgccttccccgcgggggcggggccagcgcggcggcggctgctgctgcggcggcggcctcgggcgccctgctcggcgcctatctggagcgccacggtctgcccgcggcctcggacttgccggcgccggccggggcgttggcaggcggccccgggagcggcggcggcgtggtggtcggggtggccgaggtgagaaactggcgctgctgctgcctcggcagcacctgttggtgccggagcctcgtgctggtgtgcgtgctggccgccctgtgcttcgcttccctggccctggtccgccgctacctgcagcacctcctgctctgggtggagagcctcgactcgctgctcggtgtcctgctcttcgtcgtgggcttcatcgtggtctccttcccctgcggttggggctacatcgtgcttaatgtggcggccggctacctgtacggcttcgtgctaggcatggggctcatggtggtgggcgtcctcattggcacctttatcgctcatgtggtctgcaagcggctactcaccgcctgggtggctgccaggatccagaacagcgacaagctgagcgccgttatccgcgtcgtggagggagga

SEQ ID NO: 28543 - DNA, 1177 bp, Mus musculus
tgctacttaagaatgtggatgatagctgggtagtggtggcgcacgcctttaatcccagcacttgggaggcagaggcagatggatttctgagtttgaggccagcctggtctacagagtgagttccaggacagccagagctacacagagaaactcttgtctcgaaaaaaaaaaaacaaaaaaacaaaacagcaacaacaacaaaaaaagaatgttgatgcttatttaataagatgcaagagaatcacaaaagtgtttacatgctgatctgtatgtggactttgctcatagataagaaaaattagttgctaaatgtctctttcaataattgtagagtagtatagtaaattcttattaaaagtttaatttccttctaagtctatgggttgcatatattcccttgatagttgttcgggtgcttcatccatatttcagatctttaccctaaaaaagccagcagtgacaagatttatagaaatgtgactttgcacttgataacaaatcgtgacctttaacctactttccagattactgacgtccccttgcccagctacctgatggcgtcttcagctgggctgctcccgactcagcttctgaattcttacttgggaaccacactacggactatggaagatgtcatcgcagaacaaagtcttagtggctattttgtcttttgtttacaggtgagtgcaaggccaagagttgtctggctttgctgctctttgttttgctgactgtttccttggccacagttgaagaattgtttcattttagatagttgtttcaatacttctttatatttggatgacagtttcaattgtgtgaacacccggaaatacatgggcgtggtcagatgcatagaatatcctctgtaaaatcataagaaaagaatcataaaaaatggattccttttacgggggttgtttttaaagtcattgcaagtcaaatgctgtatcttgactttgtatgaaaactgctgtcaaaaaattttgtattggttcaaagaattagtttttatctaggcttaaagtttttgttttgcttgctttgtgtggataagcatgctaatcacataatgttaaattttgcatgtactgtgcctacagaatagtaggtgtaatttcctatctgtgtctattcaaagtacaatgaatactctgacataaaacgcattcttaag

SEQ ID NO: 28544 - DNA, 1973 bp, Mus musculus
caatcggatcccagtggctcttccttctacaacaagaggaccctcacgttttctggaggtggaatcaatattgtatgattcttacaaactgtgattgttgagagcctagcgtgctgtccaggcctagcagtcacttacctgatggcagagacaagtgctgttgtattatggcacaaacaaaactgactagtttttaaattgcacaattttctaaaagcaagaatcattttctgggtctgtcagtgtaaatgtagatgcagctctggctgcccccccttgttatacctgtaatggcctataggtgtgcactttagtgtttttgaattattttattgctgggacttatgaacagaaaaataacccaaatattttctttctgtttagtatctttatttataaagcccatgaatagttgtgtgcatctttaaggatgagtgaaagtatagagttcgcaatggctcttgttgtatgctctttgcttaggcattctctccagaagggtgaactgttttgtttaatgttcacttgcttgtttcaagcagaaaagctctgctttgttttccttgcttgtaaggaaatagctgtatttcggttgactgtatgttatccggcattatgtcactgtggtcatttacacctctcggtacaagtgtaaaccctacattgtgggactgaagtgctcttaagaccccttttattttcactgtgtaagatgcaaagtgaaagggacattatttagcaggtggctcacaagtcgagcccgcattcttattcgattatattgatttctcccattagacctcatccaagggctgtccgatagcaactcttaccaaaccatttcccccttttatattaataattaggctttgaaataagcttattgttcctataaaatggtgggcttaccatctctgacgtcattcaggtggccttgtttagtcaaaacgccttgttaaaaagaaacgagctttaaaatcatgtttatagtttcagttaaaaaaaatatatatatgtccccatagctttcagctttaaaactataaacattaacaaaaatcccacattcgtgctgtctgctgcattattgctgttttgtttggggctttggtgttccttttccctgacaagactcaggaattctgaaatgtgaaattgtctcaatcctttatcttgtagcatgtgtgtttgctaacagcacttaggacttagcatacaataatccaacatgattcgtatggcgtgcactcatttatcagctttatttttaaaatagtttaattgcaaacttaatgatgagttaattttgatgcaaatagattgtagttgatacggtaacgttttctgttaaggacttcacttttctatgactgttccaacctatcagagctctctccgctgccttttgctggcagtaaaacctttgccctgggtactgctgacatccagagaaatcccgcgcaagcagatttttctagtcttaaccccagagaagagtttgattgtgttcacacacgaggtttttgcccagttcaggtggctttccttcccctgctgatgcgtaaatccctctgcctctgagtagcagtagaagaccagagtaactgggacgaaaggcacctggtctacagtgcatgcctggcctccagacctttgttatcggtagaaaaacaactatacatactgagtccttactgtctgtttagttaagtttcagttagtttaaccatcccaataaaagaaatatttgatttatcctttttagtacaacttggcaacatttttcttgtgtttctcattggctatttttcgttaaaggaatctttatttgagatcattattttcatgcttgctttacaattcatgtattttgaagtgcattatatttacttagcatttgtaacttgaatgacttcaccaaatgaataccttttggtaatttgtaataacttcttccaaatgttaacactttc

SEQ ID NO: 28545 - DNA, 1310 bp, Mus musculus
gatgtaataaactctgcattgtcttttttttttttaactctgtactgctttgacctatcataactacccaccgtgatcatttatagaccctttctatctgcccttagaaaacagatgggtatcaaagaaataataaaaaattaaaatgattaaacataaacaaacaaatcagaatagagcaaaacaggagaaaggaagcacaagaacatatatagatgcaggagtgtacacattcctccacacagagatctcataaaaacaaaaaactggaaactgtaatataaacaaaggacgtataagtttaaaaattaaaaaattgttgacacccttttgagtcaaaatatccctccaaatatgtcgctgaattccttttgcattggtcatttattgctaagcatgggacctaattagagtttcttgttatgataagactcctttgtagacaactaaatttttgtttgtaaaacatgatcagtaagagacaactttggcttttcagttagtggtaaagatatatgtccactttactcagttaaatgtcccaacattacgacaacatttttttttctaatccagtccaggttggaaagaagtctccttagtgtcagattaagccccatctcttaacaatatggacagatgagtgtgccatggccatgagatatttcataatgcagaaggaatttgttgttactttttggattgtactcttctaggctggaccgaattcataagcagattgaagtaagacctgttctttacagatggtattttaatagatactggagtttgtctgtattatatctgtgccccttcttttaagaacaatgttacattatgttcctttggaaaaactgtgatttgacaactgatttcaataaaaatatttgcctctcttaaaaaaaataattcctcatctgatgaatactggtgcaggtcatatgactgaagcctcagtataagtgaggtcatgtgaatgtcagttgtactgtgttttggggttttattagatattttctttatttacatttcaaatgttattccccattcctagtttccccttagaaaaccctctatccctctcccctcttcccctgctcaccaacccacccactccctcttcctggccctgcaagttccctatactggggcatacaaccttcacaggaccaaggggctttcctcccactgatgaccaactaggcaatcatctgctatatatgcagctagaaccatgagtcccaccatgtgttttctttgaatggtggtttagttccagggagctctggaaatactggttagttcatatt

SEQ ID NO: 28546 - DNA, 1176 bp, Mus musculus
gaaagctggtacaagtgctctggaaatcagtatggtttttcctcagaaaactggacatagtactacctgagaccactcctgggcatatacccaaaagatgctacaagaattatcaaggacaaatgcaccactatgttcatagcagcctgatttataatagccagaagcaggaaagaacttagatgtccctcaacagaggaataaatacagaaaatgtgacatatttatacaatggagtactactcagctattaaaaataatgaattcatgaaattcttaggcaaatggatagaactagaagataccatcctgagtgaggtaatctaatcacaaaagaacacacatggtatacagtcactgataattggacattagccccaaagattggaatacctaagataaaactcacaaatcattttaagctcaagaagaatgaagaccgaaatgtggatccttcaattcttttcagatgggggaacaaaatactcatggtaggtagagggtgggaggtacttgggaggatgtaaggagaaggagggggaagacgtgctggatcaggaatgagagaagacaaggatgatatacagagggccagggatttgaacagacctgtgtagcaattggagaggggtaaatgtgggtaaccatcagcaagtcccagatgccaggaaagcaagaagctcccaggatccaacagggatgagattagccgaattgccgaacaaaggagagggagaccatatccaaagtttaggcaagacaactggtaggggactgggactacgtactcatctccaaaattttatcccaaaagggctcctgtctaaaggaaatgcaggaacaaagtgtggaacagagcatgaaggaaaggccatcccagagactgtcccacctgggaatccatcccatatacagacactaaacccagacactatacccagacactattgtggatgccaatgttccttgctgacaggaacctgttatagctgtctcctgagaggcttttccagagcctgataaagacagaggcagatgcttgcaaccaaccattggacttagcatggggtcctcaatggaggagttagagaaagcactgaaggagctgaaggggtttgcaaccccataggaagaacaacaatatcaaccagcgaaacaccccagagctcccaggga

SEQ ID NO: 28547 - DNA, 1121 bp, Mus musculus
acctcaagatgtactacaggctgtgcgtttaaaagcacaaatttataacctttttctaccaactcctatatccactagggttacatttgttggtgtgtacctttaagcaactcttcattaaatttacatcatttgtcttcagcttggcactaatgttaattgtaagtctttaaacagtttcttttaaaaatctaatcttattaaatctactgtgcagcctaaaattgtgaaatgtttccaaacactttaagatttttgcttttaaaatatcatgcaatttcttatcataagcttaataacttaattaaattgtaaatgttctttcaccatctgaatccaatatagtaacaatacaatttattttctctcagaacttgactatagttcaatgcatgatagtttaattcaatgacagtttttttctgagtacaaaagccagttacctttaccaggtaatttgggggtatttccacttaatgatccttttgggaaaaattctctactttgccttaactgagagaggcagaaggaagaggttattataaatcaggttcatactttcttttgcagtgaagctgtgtcgggattagagtgaggaggatggcatctatcccattaatatttcttcctccctaagaatgatgttttcatcttatcaaatctcaaaagaagtctctatggatgtcattgttatcaacattctgataccctagaatcatctaggttcaaactgcagtaaattcagttacataacttcctctaagcatgttttggcaacaatatatttttagtgttattcatttatttacaatttgtgtagagtccctcccaaaaacatggtacaagaatgactgcattgcctggagttggtggatccactcatgactaaagatcattcacacctgtgagattatagtcatggtatttgggaaggagcacaaccaggtcttcagttgatgcccccagttgttctccatattaatatctttatagggatccttgggtctctgactaattacaggtttctaagaagtattatcgagagagagagagagagagagagagagagagagagagagagagagagagagagagagagagagagagagttaacatttacc

SEQ ID NO: 28548 - DNA, 3041 bp, Mus musculus
atttatggaatagatttgtataatatttgcctaagggtctggatgtcaaatactttgcctatctgtgcagtggccagttatcgccaatgtaacagaattgtgtattcatcacatatccctaagtggttgtccacagtaccagccagcattcctgtccgtgttactgagtcctgccaccactgcctgagtctttgttttctgcaggcttctcagaaacagcttcctgctgaggttaggctcagagaagatccacctgtcttgtttgcctcgccccgtgagccgttgcctccttcccacatgggtaatttgcctctggatattgctgttaatctgaagcaatgcacctctataaggcagggtttcttaaaatttattttcatttatccaagaaatttttatgtaacccactgtaaccccagcttaaatacaaactaatatttatgataggtatacaaatcaatcattgcaagtaaattaaaagaaatttattttagacacctggagagatggctccaagttaacagttctcttgcagagaacctattgatttccagcacatacatcaggcagctctacttggctgtaactccagcttcaggggatctgatagtctccttcctctgccctccgtgaggacctgcttgtgtgtgtgtgtgtgtgtgtgtgtgtgtgtgtgtgtgtgtgtgtgtgtgagagagagagagagagagagagagagagagagtgcacatacacacacacacaaaacaaagtgaacaatttttgttagacttacagttttaccatttattaaaggtgaaagcatatttgcctactgctgaggtgaatatgcttgcttggttttatataagatctagatcgcaactgactatttgatattgaagtacacagaacatctttaatgtacttcagagttggttgatatcttgatttttgattgccaatacttagaaccttttttcacataaacacatagtacaaaatgccatcagtgtttagaggtgtttccgaagttggaaatgctatcgtcatcctaagccaaaacacatttaaagtttgtttttttttttttatgaagcaaatgttgacaatttttgaaatcaaactttctagcataatacaatctagaaatctattgattggatattgacttgatttagaatgacaggaaaatagaagtctttctcttctgtaacctagtgtttatgctaaagctgagtatgcacagtaaaatcacattaaatcacaatgcataaagtaacactgctgagtcaggcagtgtttattgttgttgtgtgacatggcagcagtgtagtgcaaaatgcgcctgctgtctatgacaaccaaggctgcagtgaagttgagtgatacaacatggcaagccctgccagaaacacctcagattcattacacatttggttttgacttaatttttgaccattgttcattagaaagctgtactgttgttgatttttttccagtcagttacatggctgcctatgggaccatggcccacagtttaagaacatgggcatgactcagtagtaacaattcagttatcagtaaagtaatgaaatctgatttttttttcttttttttttctcatttgaaaccattattagtccacagtctcagtttcagttctctgtgcttgggaagatgtcacagtggcttttaggactttcttttgcatacagagggagccagcccagaaatgcattagattctctgtatgttaatggtaggagaggggctttttggctctgcagcaaggctcagtaggcttgctcagaactgcaggcccatctccatctccatgtggtagctgtcttatttctgccgtttggtcttccatggtttctttcatattgtggtttacctgcattttttctttttaaaacagtttttctttaaatgactcgtcttgatcaagttttataaatgccattcataggagctgtgattctggcaaattaaagtaattcatagttttctgcaatttgaaataaaagcatttccaacttctagattatcattttataaattctttgtttcagcactcaaccttcattccatactattttatagtgtgttgtactcaaatacttatttttccttttgtgccactatttgaacaaatgccattcattcttaaagaacattgacatatgtatgtggccatcctgtgcatagacatacaatttctcacatacagatattcagaaatagtatttgtactagtctagtcaccttattttctgtttaagattggtttgtttaagaccattaacattttaaatcttctgatgaatttacaagtattcactttagacagggctctgtcagctttcccagagtagacccagggcctcactgatcttctgctgctgtgttttatgtgtctggccttgccttttcatttcatactagaaagccatcttccagaatgctctctaggctattttttcatgaaggtgatgtaagataacagctgggtagaattgtgagcagtatgtgcataacttactaaatatgtaaatttatattaaatacattttccatgtgagttccctttaaataaagttactcttgatgtaacatagctgtgtttggttttcatttttgtgtctctacatattaccaaaacagtagaaaatggagctggggaagtggctcagtgggtaagaccacttggtatacaagcttgaatacctgagctcagacccctgtacccaagtaaaaagccaggtgtggccatgcaggcttaacctcagcactggagggaagagatgtgggcttgctggggcttgcggtcaacagctgaaggacatatggtctctgctctatgtgtcatgcacacacttgttcaaaaactcatactaccatacacacaaaagaaaaagttagagataaacagaaaattagtcttatttggggtgacattaaaaaccaccccagtagaataatttatgaataacctgggctggcaagctcaagagcctgatgcaggcttctagagaggcctttgctatttcacaaca

SEQ ID NO: 28549 - DNA, 1318 bp, Mus musculus
aacaaacaagccagcagacgtcctgtttgtaataataactatgattttgtttttcttcaaggctccaaaagaagcgcttgctcagtgtgtcttggcagagattccccagcaggtggtgggctacttcaacacatacaaactccttcctcccaaaaacccagctgtgaagtagaggagccaggacagctgcaggatttcaaaagctgtgtggagcaacgccatctctcacacagaatgatgtatctgccctctgcgcttcttaccccaggctatatgatgtaaacctagctttttgtatatatcctatctgtttaaagcatccattttatactttttgaagaggacagtagcaagtccatttctgctcagtgtattcagtgattgttagtgatttatagaaattacaagagtgctgtttggaattgaacttaatgtggggaaagtgatgtatgtttgtttattgtctactttctataatgaaatgccatttttaagtgttgcccgtggagtgaatggggatttacaggatgaagtggtatacaggttgctatactgtttatagtaaatattttgcaagtcaatcaaagtgaggtactgagtttgtacctgtgactctctattctgtctcttttatgctgcagtgctacagtgtactagctgtgttttcatatggttgcttatgaaaaccaatgggcttactccgttttgaaaatgtccactcaaccagtggacagctccttgtagacaagacatttttattgccttttgaaatgttttcactgtgaagtcttgtacatatatggcctttgctttactgagtaaacaagacactcaaacttctgtgggcatcaaatgataggtcatcccagaggccacatgattagaccagtgtaggttgactaagtgagtaggattgcttcgttcactaaagctttgaggaccaaacatttaaggtgaaaattcaaacagagttgcaggccagacatggtggcacatcatctgagcatttgggaggcagagacattagggccagcacaagccaacccacttacatagttaattccaggccagccagctacccaatgagaatgtgtttcagaataacaaagaaaaataagtaattgagaaatacattttttctaagtaatggtataattgcaaaagttcatttgtaatttttttcttgtcctgtgtattgatttatatgaatttatttagatatttttgccatttaaaaatagtattattgttttctttaagcttataattctagttatttattaaccaaaattccatttttcatttcaataatatacta

SEQ ID NO: 28550 - DNA, 1145 bp, Mus musculus
acaagatcaagccagccttctggggaagactagtctgcagacctcatcaggttcttaacctttcataccagttatagacttcaggcctatagacttgtttatctactcagtagtcaaagtcttaaagagaggtgaatcacccctgctgtctccttcccatccctcttctgaactggaccctccacatctggctcactgaatccagtaagacaaagttggaggtgaggaggaccgagagacaggttaataatgatgctttattatagtgacagttcccaacatcaccagtaaattgagcttagggaatggatcatcggcttaaaacagttttacctgtcagctcagtcacctacctgtctttgggaaagaagctactatttgttttagaaaatgaaaatgttattacccttttctccagctgacttcaattatcctcctaggtctaggtgttctaaattaggtgttttataaccactccatcaacagaccacctttgttgtgtttggggctcaaaaagaaccctaactagtaagctgcttctgaactgagaaagctcctgacatataggagggagctgtaactgcgtttcccagaatctgaacaggcttactattgcatgtcctaaactgtcacattaggagactaccgtttttgtagaaccatgtgatggccctgctatattactactacatgttcattttctcaaaggaggcctaacattgcactgatggccatcatggttcctgcactagagtattcagagtaaactgatgccagacaaatgtagtttactgcaggcttactggatcctgacatttaattaaatataacataatctagtaaacactgaagtaacaaatcagttgttgaaacatgaaataaatgttcttctgtaacatgtccaacttttcttaatgtgttgaacagagaaatcaagtcaactgggaatttgacaccaatctaaatgtgctatttcctaaatgctaaaagttcgactccaaaattcaacagaatgcaattaaaatggtggtatttctttttattactaattctacatctttttcatgaacacttaattctgttggtccttgtgattaacgtagtatcttgttttcattatgtttcttaagaaacaagacaagtct

SEQ ID NO: 28551 - DNA, 1541 bp, Mus musculus
tttgtttttgtttttgttcagttttaatcgcttggatctaccaccatataagagttatgaacaactaaaggaaaaacttctttttgcaatagaagagacagagggatttggacaagaatgactgacttgtcttggagaagctcttgcatttaaatacccagccaagaaaaattgcacagatagtgtgtataagctgctcattctgtacagtgaattttctgaacctttcaaagtataaatgttttccgttcttccacagaaatatgcaaaacatttcatcattttctactttatttattgttccctttaaatgactgaccaggaaaaaaaaatcatccttaaattttgacgcaagcaagagaatttattaaaaagtatatatctatataaccatatatgacagtggctctagttttatagagcgccaggtgtattaaacatgacagccgttcattcacaaaactctgaatttgctttgccttgtttctgttttccaggggaaaagtgcatatgtgccatgttcttctccctaggtgacattggattgtgttagctgcatggctgttcaggaaggaatttagggcttaagccaactcttactttaagtgtatttttttaaattgctgctggcttttctgaagacaagtacttcaactcattaagttgtactaaatgaataggttttttttaatcacatcattgttatatcagtagacacagaagtcgtgtgatagatccagtcgtgtctaggagcagctgggattgacttgctgcagagcagaggtctatttacatcttactttcggatgttgggtatttgtggaaatttaaagaatcaggcatctctatacttacatttttaaacttgtaatgttcttcaaattcaattgctaatgatttgatagtttaatgcttagggatacataaaaggtactgaacttggctgcttctgtgctcaaggtttacttgtatgaagtcagagatgttctaatggattgaaaagctgcagaagtatttaaacgctcacactaagtactttttattagtgtttgaatgtccccaccccttccttacaaaatcagaattgtttctaaattcagtaggtatattaaaagaattctttgtgctccctattttatacagagcaagttttctccaaatgacactgatttttcttttcattataagggcattcttggtgtatgaaaaaaattaaaatctaatgtgaatgatactgctacttttagcaaactgggcttcctaattaatataaaacattaatttccatttttatcctttcaatatgcactgcgaagttcattaacttaaaattttgtaactatgaagttcacttagaattataacttctatccactagtttagttttgctaagattttatttttctactttagattatgttcttcagttttattcagaattcacaaataaaagcagtagtctacttagttgaataaactatagaaaatctggctattctcaagcttaaaagaatttttttaattctaacatatggcaagtt

SEQ ID NO: 28552 - DNA, 1154 bp, Mus musculus
gtagtttaaaagggggtagacacagtctaacaatggttgagaactcagtgagactggagtttaaatgttctacattttagcagtttaaaaagacaaattatctaaattctataagtctttcttctctttcatatgtggtgagattactaatgactcatagctgcctggtagactgttgtgaagtctaagtgagaaacacatgccatagtgttcacctgcagccctcactgacaggtgtacctccttgtgggttactgcagtcaagccccttaaggtttctaagctgctcattgacctgccgtttgtaggacagatctaatagtagctggttgtggtattatcgtgagggttactgaagggatatctacagtgtacctatgtggtactacaaatactttttactgcactactattgcttgaaccagtttcagtggcgtgtttgtttgtttttaacatttttcatttgtttactctcattggtgggatgttggccattattttatattaaattacatttcattttgtcatacagtttgtgaaagagactgataatgaagtacgaatgcgactcttgcagtttgtgactggaacctgtcgcttgcctctaggaggatttgctgagctcatgggtaaatgaggattcactgcagtttctctgaagttaattttgtgataatagtatgtgttagacatacagtagcattaaatataacgacttatttgtatgaaaattatatgtaaagtttctatgatagaaaagaaagagccattgatactgaaaacaattttcttggtcaatgttctattgctgtgaagatacaccatgaccacagcaatcttatgaaggaaagcatttaattgggtcttgcttacaactccagaggttatagcagagagcaaggccagaattcagggagacatggtgctggaggagtagctgagagttacacacctggatccacaggcaacaggaagagaatgacattgagcctggcaagggctattgaaacctcagagcctatccccaataacacacttcctccagcaaggccacacctcctcattctttcaaatagtgctactccctggtgaccaagcattcaactgtatgagcctgtggcagccattctcattccacccacaaagatatgtga

SEQ ID NO: 28553 - DNA, 1256 bp, Mus musculus
tacaaggatctttttcattgcacaagggtgtttttctttataagaaaataagtctaatcagatgagctgatacttacgattctcagtacatatacctctgacaaaagtgaaaggagggccagatgttctttagagaacgtgtttaattttcacttagcaactagacgctacctttactatttaattttactaaaaaaatcttgcctttttctttaaaaaagccttcgttactaaattatgaaattgaaattgtatacataagaataataaaaatcagttaaagaaatgaacagtaacaaaacacctctggcttatcaaccttttatgatagaaggaaactcagatgtcactttatttatagagagctattaagtcacgtgccatgactctgtgaaggaatggcacattacaataaaggctaatgttttgaatgtgtatactagtaaagcaattaacagtaacctgaatttaaatgtcagtcgatggaagtacagcctatgacagggctttgaaaacgtttctacagtgaagcagttctacagagaacactaatgagcaatgtgtaaactgtttggaaggtgctggtgaataactggaactttccacatggcttcaccacacttgtgccagaaacatattctgaaagttgagctccataggtgctcaccgtgctgctgaatttcacaataatttgctttactattgttaaaaataaacatctttcctcacaaaccatggtgtttatatttttctaaaatggaaaggaagcattcttttcagaaaagagaaatgtttttttctttcagaaaaatgcagtaaaaacatattatccattatccgaatgcagtaaaaacatcttagccgttatccgaatgttggttctgttgtttaggtgcaggtgctttccctgttgttctgcttccttcagtgtctttgctagatcaagtgcagacgctgcacacaatctctagttcctctagttctggatttgagaaatctgtctttggaattcatgttcagttttacttggatagtaaaattatcccgaaaaattaaaatctattaaagaaacacacattatctgactaagtagcacactgtgatctttacttttattttcattttgcctagagttgtaacttaagtgtgcatggcttagctttacacaaacagctgtgtggctctttttatgtatatgccctagtcaggggttctattcccaacaaagatagataatccaattttagaacaatttt

SEQ ID NO: 28554 - DNA, 1160 bp, Mus musculus
ggaggtatgtgcttgcgtgtgaatgtttacatgtgagtataggtgtgtgagaaggccagaggcatcagtcccctgtagctgcaattatagagggttgtgagctgcctggtgtgaattttgaggaccaaacttggatcctctgaaaaagtgatcttaactgctgagccaagtctagctatagatgagctgacttttaccctaattctgtctctttctagttgcatttgtccctatccaggtacctaatcttttaagcaagttgttttacctctcagccttaggtttgtgtgtgtgtttgtttttggacttttgagacaatgattcaccactaatggtacttttcttgcttcaagtcctaaatgctgagtttactacaggcataactcaccatctttcccatatctaaatcctttttaaaaatgtgtgtgtgtgtgtgtgtgtgtgtgtgtgtgtgtgtgtgtgtgtgtgtgtgtggtttgctatatatgtatgtatatttgtgggaggcatatatgtacttgtatatgcatagatgtcgagttctgaagttgatgtgtagagtcatctgtcatttctttcccaccttatttggtgaggcagggtctctgaattaaacccagagcttgtcaatatggctagtcttaccactggccagtttgctctgagggatggatcacctgactcttctttcagaggcttgaattacagatggactgcacacatgtaatttatatgtgtggggatccaaactccggtttccttatgcttacagggcttctcctgctgaaacgtccctactcacctctgtatgtcttctacatcatatcaagtcagtaatagggtatagtgggtacacgcctttaatcccagcacttgggaggcagaggcaggtggaactgtgagttcaaagccagcctggagtatggagctagttccaggacagctagggctacataatgaaacccaaaaccgaaacaaacaagaagacagcagttagatgttttactgtgaagcagttttaaaggaagggtttattttttcccgcagcttcagtctgtggtttgctgcttccatcacttttaggcctgtgacaaggcagaaacatcacaatgaaaggccaaaagcagagaacgtggaggagactggggacaagcagtatc

SEQ ID NO: 28555 - DNA, 1179 bp, Mus musculus
tatgaatatttgtacccacatgtatgtatatgtaacacacacaagcctgaagcccatgaaggccagaagagggcactagaccccctggaattagagatagttgtaagtcatcatgtgggtgctagaaattgaacccagccgggcgtagtggcacactcctttaatcccagcactagggaggcagaagcaggcggatttctgagtttgaggccagcctgggctacaaagtgagttccaggacagccagggctatacagagaaaccctgtctcgaaaaaccaaaaaaaaagaaaaagaaaaagaaattgaacccaggtcttctgcaagagcaataagcactctaaacagctaagccgtctctctccagtaccccttttcagttatgtcataaacattgctggttttcaaccttatactagaggttgatataaattaaacttaacacttctgtggcattagtgcctttttttaatgttttgtttctttttattcatatgcattgttgttttgcctgcctgcatgtatgtatgaatgagggcattggatcccctgcaactggaattacagatagttgtgatccaccatgtgggtgctgggaattgaatccaggtcctctggaagagcagccagtggtgctcttaacctctgagccatctttctagcccctcattggtgactcttgtaaattgctgaacttggtaggactctaaagtattatgtatgttcagtgagaaaagatgctgggtttgtatggataggaagaaatagcaggatgtatggcatgtttttgccaccgtgtggtatgtgttcctctcaggtagtcttactgagatcagtggcttttatatatagtcttttatgtgttgaaacattaatgtaagtgtgtgtggggggagggtgtgggtgtgttgtgtgagagtatgtgcatgtgaaggcggggtacacatggtagaggctagaggtcaacccttgtcattctgcaggagccatctacctttttgaaacagggtatctcactgagaactacagctcatttattagacaaggctgactgaccagtgacccacaggttacgtgtgtgctatcatgcccaagagttttcttttatgtgtgtgaatgttttgcttgcatgtgtgtccatgcattatgtgtggccattatgaagtgcctgcagaggcca

SEQ ID NO: 28556 - DNA, 1511 bp, Mus musculus
ttaagtcaggaaacatgaaatgtcatttgttgaaatttttctttcagcattgagggaccaaaagaggacataaaaagtcaataaaactacccccagcccagttaaattttaaaactggatataagaaattaaatcttagaaaatccttagaaggttttagaaatgataattacagtttgagggagattaatcaagaacttacttattttaaaattgattgtatttaatactttttgtatcattacagaagatactggcccagcctatcaaaaagtgcaatatatatatagcatactttgacattttaaaggttggattgacttactagctgttttgaaaacctaaaagaaaaggttatttgcaactaatttatagttaaattagtttaacttgattaaacacttaaggtaaaatttggtgaaattttaatgtttaatctgtcctgaaaattttttatgagacatatacacccggtttaattttatgttttattgtgaactaacatatgtacagcaagtattctaaatcaggaaggaacctagtcaggttttagaccagtgagattcttaattctcatgggtatagacttcagaataaatgttacatttgtgggacttcataaattaattaattttcttcagactcaaagggagaagaataaataaagcttggagtaatgagatattattgtgtagttttgcaccttttaaaaaataaatcatgaaaaaaattactaagtgttgacttcctggttaaaattggaagaataaaagttaagtttttcaggtatattaactaatgtcttgaattcctgttgctaagtttgacttaggttctctgagaatctttgtgcgtgttaaattagagccctaaactctgtaaagaggtgatttttgtatagtttatgaatagattgtgaggaaggttctgcttcctatggggaatcagatgcaggtgtgctgaaaaagagacttacattggtacaaacatggactctcctaaggccgtataaggctaagtaacaaacaaacagaggaacaaacaggctctccccgaactccacttggatgcttggtaattgatttgcttatcccagccgttaactatagttttatcttcaagcttttttaaatccagtttcttttttcagattttttttttttttttgctttattattttctttgcaaatgctcttgtggatgattaagactttgcaaaagcagacaaagccgtgaaatagatctccatgtgtgtatgctctagcctcagccattactgattcatagccagtttcaccttaatgtaaacttccacaccagtctccagctcatacattatcttgaagaaaattctagatatatcattttacccatacataatttcatactgctaataggtgaaataattatttactattatattaaaattctcaattccctgaacattgcagagcattctgtattcatttataaatccttttaggtttagattcatggattattcctccatg

SEQ ID NO: 28557 - DNA, 1198 bp, Mus musculus
agcaaaagaaaaacccagccctggcaccaaaggctaatagattctggatgactgcttggcgaccgttttcctcatctgagaactgagggtgctgctcccctgaatatttcaaagtctactgcacactgagataatatgagttgccactgaaattatattctacagttcattttgttattcttttctcatacattacacccgaaaccaaagtttcccctcccctccctctacaattaatttttaagtattttggtgttccaaaatgatcagataagctggcggtggtggcgcacgcctttgatcccagcacgtgggaggcagaggcaggcggatttctgagttcgaggccagcctggtctacagagtgagttccaggacagccagggctatacagagaaaccttgtctcgaaaaaacaaacaaaccgatcagatagctccagttatctagccatgtgtcatcacggttgtgagcaaaaccagtgttaacaagcagccccaattttaaacaataactgagcttctggtttgagacccatatttttaggtccaatactggaaagacggaggcagaaagatcaccatgagtttgagtccagctgggactacggagactctgtttcaaaagaaaagactctggggtctggagaagtcaactctactcaggaaaatatattcacagcatctgaagactcatggcaatgtgtgggcagagtagtaacaattcaactcattctaaaaattataattaatgtgaggataagaatctgatgggttttgactgtggagagcaaagtaacctagaagaggccaggaattggtgtgggatactggagatgttctgtggccatgactgaaaacgtcaggagtgtgtgtgtcaaaactcatcaaaggaagcataaaaatgagtgtttttccacgtcaatatacctcaatttcaaaactaataaaatattaaagtttgactccctccagcatgcatgtatttctttaaagtgttaagttatatgcttgttggtgtgctggcatcatagtaacaaggtaaacttgttttcctgcctgctgcttctgaccatttgttttgactctcatttgtgtagttatttagatcaggtaggacccacccagcaaagctctccaggtacttccttctgcaaaataagtggaagccattgaaaaatgtggaaatacaaacatttg

SEQ ID NO: 28558 - DNA, 1175 bp, Mus musculus
tgatagaagcgaacagctcctttgtgtttgatgggtttaagtctccctcagattcctgtcctatagcaggcctggtcccttccttacaggtagccactgttaagagtcccaggcaacagtttaccttcaaaccagagcaagttgattttcatttaggtagatggatgtcagaggagtatttattgaataattgcaggcagctaagtaggactttagtggcatttgtttccaataagatcacaagattgttttctctgaaaaatattgtcaacttacagaaccaactaagtcatgacagaaaacatttaagaaaatggccatctgaagaagagaaaactgttgttacacacccaaagaatgacaacttggaagccagcccgcctgccagcaccctcagcactgaggcgtccctgaacgagagcctcactgacggcagcgagagggacgccagcctagagagcagcgtggatgccgacagcgaggcttcggagcccgagatcgcttccaagcagcctgtgctgctgcggtccaggggtgattcctgcggacacgcggagcagcacccacacctcccactggcaagtgaattgccacaagccaaggagacgcatggtggcgaggaggaaatggcggaagcgattgctgaacttcatttgagtggcactgtaactggcaatagagatttccacagggaaaaacagccactaaatgtcccaaataatttgtgtttttcagagggaaaacatacgaggcttcacagtgcccaaaatgcttttcagaccctttctcagagttatgtaactacttctaaagaatgctcagtccagtcctgtctctaccagttcacatccatggagttattaatgggcaacaataagctgctctgtgaggactgtactgaaaagagacggaagtgccacaaagaaaccagctccgcaggtaaacagctcattgcctgctttctgtgttactgatgggttggaggtaactcgggctttacagttccttaatgggtgacccaagttcctgggtgccttgggcctcttggcccaggccttgttctacttgggtctctgaattcaggacactggctgggcagagtagattcattcacaggagagattacagtaaatggagagcaagaagtacacttctctgtcttgaaactgcaaacc

SEQ ID NO: 28559 - DNA, 3665 bp, Mus musculus
ttttttgcttttgtgagacagggtttctctgtgtagccctggctgtcctggaactcactttgtatcactttgtagaccaggctggcctcgaactcagaaatccacctacctctgcctcccaagtgctggcattaaaggcgtgcgccaccactgcctggctcaaatctatatttttaaatgtaaaaacatgttttatgttaattttcatgtccatggaaattgcccctacacacacacacacagagttgatagtaaagcaaccccctctatgatatgactcatccttacatgcattcaaagatgatgctaaattggatctttagtatactatttcctaatgtaatacaaccttcctgagtggatccaatatatcttatgctacaatttgcttactttttgttgaagccttttttaagcttggctgttttgaatcatacttcacatttttatgtgctagttatttttctagtaaacattgatgtgagtttataactatgaaaggaaaatcatacatccttgcaccaccccactttaaatcatctcagggctctgcagtggtgtgtgtgttagtctataggaaaagtttctagaacagtctgaactagtgcctaatgtaacataattaatttttcatattttatgtgagtcagtagtataaaaaggagccattgtaattttggtagtgtgagtttacaagtaatgaattgattcgcttattgctttgaatatttgaaggtattgaaacatttcataaactaatcatttgcagtctttgaaagataatttacaacacataaaactggtaaatagaagttatagtctatataggaatatagaatactttaaagtttaaggatatctttgaactgtaaaccaccaaattatatttataaatggtagagatcatattcttataaccaacaatgaatatataatacttttttacttctatacattaatacatgttaagcatagttttgtcttcataagcatttatttaaaacttcaggtggatagttagggttgtagttcaatggcaaagcacttgcctggttccatccctagcaaaacaaagaaaatattcaggtgggcttggctactttcatgggacacagacttgccacttctgttccccttaaataagcagtaacacagaatagtttcttctagcattcaaaggattgaactgtgaaaacttagcatgaaaaatattactaccaagattttcaataatcaatgaagtggctcactgatacatagtattgaatcaagatgtaagggaacaggttcaatgtcttagtcatcagtgcctgtgtttgattctatgggcaaatgtgagggagagaggctgtaaactgtccagacctttagccaggatggaaccttcttaacatgtgtaacataaagtccccagtgttgcctcttgatatgtggctgggtgaaactgattgtctaatggagacattttaagattgtggagaaattttcaatggtatttgaatttttttaattgaaggtgaagaaatatattttatctgtagagcccagttgtgtcctctaaaaagaactttccagtgtcttctgtttcatcagacattcagtgttattaatctattgacacggaagagtctagcaccagagcaatgaatgagaaaaataatttatttgttcaagctagcctgtcatagcagttgcacccacacccccaaacaaatgcaagcggtcagcctttttcccccctctctcctggaaaagatactattaagacatgtacaatctaagcaggttccaataccgggcatatgatagtattttatgagcctttaaaacagaaaaacctgctgagtgatggtggcccatgcctttagattcagcacttgggaggcagaggcaggtggatttgagttcaaggacaccctggtccacagagcaggttccaggaaagccaagacaacacagagaaaccttgcctgaaaaaccttggggaaaaaaaaaacaccctaaaatctatatgattttatacattattctagtagtgatgtacaaataaaatgttcatttattacctagttctgaggagattctggaatgtatttttttttaatgacctaaagtttgagtgtttttcttgtcacctgaaaatgtaggaaaatggtttgatttgatatctaggaatttcttatcaagcttatgtaatatagaaaaatcacccagatctacacttaaatttttgttcttactttgaagttttccaaagcacatttgtagaaattttaaattgtgaggccactgtactaacagattacctcaggaaaccgtgcaaacaaacaagaatgtttacagatccgcacaactagtcagtgctttggcaccgtgaatttgaaaggtaaaagagagaagtttttatctagaaactggtttacagggtacctctagccccagttctcccctgactttcccatatttaaaataataaaattctgatgatgtgccaattatgtgaatgcttgtgacataaacaaatatacatctgtatttaagatttgttgtttaatgttttaaaaaataatatgaagactgcttatgtaggtggtcaaggggatgatcatatatcaacagagctattttaccatagttcttagcttgcatgtgtgattaattagtgatttttatgtaatacttgaataagatatcctgaagatatgaaatgtcttcgtgaaatgtagctgtgaaatgtcaccgcacatcaaatttttatagtacaaaataacatcctgcctactttcatgaactttatactcagcttatttttctgcatgacatctggtcatataaacctaaaccaaatatgtgcgataaaatcaagctttcagctagcatccattgcagtattagagaaatgatttctgcattaaaatgtttttgttcatgcagaaatcatcaattgaaatgtgtttaaaagatgattatttttaggtatcagtaatacattcatggtatcattccttctctttcatccagttttacagtattttaaaaatatctgtgtaacttattgagcattatttgatcattgctgtatgtaaaagatcacaataaatattagattcttatgttaattgattaggcctagagtttttgcattatacattgttagcagaatgttaataaacattgtgtcattgcctattttagttccctggcttgctataaacaagatataactgaggagtttgtgaacaacactttctggcctacactcttagaggtcaggaaactgaggacacagacaaacagatctactgtccacatgaggctctgggggtgcgctctgagtgttcacctggtcaaggaggaagggtttcacagtcagaacctaatcactttctaaatactccacttcacagaactttcacatggggagtttgtgaatggggcacaaacatctagttcatagtggccttcaagttccaggaatgcactattttaaaataaatttgtcgccaatctaatactaggagttgtatctattagttcttccactgagctacgttttcagtccagaaaacaaacaaacctgtcagctatttctcataatgatttgagttatttagataggattgtgtcttagtcagggtttctattcctgcacaaacatcatgacc

SEQ ID NO: 28560 - DNA, 1147 bp, Mus musculus
aatagattaggtaaatgaaatgtggcaatacctttttatttatttattttatgcatatgagtacactgtagctgtcttcagacacaccagacacacatggttgtgagccaccatgtggttgttgggaattgaactcaggacccgtgctcttaaccacctcgcatctctcagccgggaatacctttttaatgtagctgttagaaggttttaattacttaagaggtttgcaccctaattctagtaaagatgaagaaactattgtcataatttgatagtatgggaagttttcgtttcttacttggcttttctgtgtctttttctgtttcagaagaaaagcagcaaacagaaagggttacaaaagagatgaatgaatttattcacagagagcaaaatagtttatcacttctagaagcaagtgaagccgaccgtgatgcggtcaatgacaagaaaagaactccaaacgaagctccgtcagtgttagagcccaaaagagagcataaagggaaggagaaggagcgggggagtaggtcaggcagctccagtagcggcagctccagtagcggcagcaggacgagcagcagtagcagctccgtctccagttcttcctacagctccagctcaggcagcagctgcacgtcctctcgctcctcatctcctaagcggagaaagagacccagtaggagcaggtctcccccagcgaaagctagacgcagcaggagcaggagctactcgcgcagagtgaaagtagacagcagcaggaccagggggaagctgagagataggcggagatctaatagaagtagcattgaaagagaaagacgaagaaaccggagcccttccagagacagacgtagaagcagaagtcgctcaagggatagacgaaccaatcgttccagtcgcagtaggagtcgagataggcgtaaaattgaggatccacgtggaaatcttagtgggaacagtcataagcataaaggtgaggctaaagaacaagacaggaaaaaggagaggagtcgaagtgtagataaagacaggagaaagaaagacaaggaaagggaccgtgaactggataaaagaaaagaaaaacagaaaagggaagaaaaagattttaaattcagtagtcaggatgatcggttaaaaaggaagcgag

SEQ ID NO: 28561 - DNA, 1150 bp, Mus musculus
ccttgttgttcattaagttgcttactttatgttaatatgaagagtgactgtgtattcttgtggtttgaatggtaaatgtttattgagtccaagttatttgatttctttctctttttttttttcagatggtctgtcagttgaaactgtggcaggattggtctataatcctttctcaggttactggcattggagtgaaaataccagccttaactatgcagcccatgctgtgagatccagggctcaggagcaccaggagcctgctgagtctgctttaaagggggaaacaggagcactccatgctaacacctccggtagccccagtgtacgggaggagcagaggacatgaggtgcctccaaggacagcagtaaatatacttgaaattgtgttgtttacaaagtcaaaaatcttactccatttcgggagagattttgaagaacaaaaggtcaataaaaatatctaaatcaatggagaaaaatttctgtgtcacctaagagacactttgaagaattttctggtgaggttttgtcacgtgtgcttaaggtctctatgcttttactgtagaaaagtgtgtgttcatttcatttacatgttaggcatttctcacatgtgtaaacagaaacatatgctgatatttattgatttcaactggaatctctgttgtctatggtattcctttattttagttaaagatacaatgcccttgactgataaaaaaaaacccaaaaaacaaaaaacaaaaaccagctctagtttttaatcactgatatttgggagtacaaaatatattttaaacctagggtagtgagcatacgtgtacctccctctctccttccgtctcttctcccctccctcccttaattgagttcagtttgtgtgtttcttttttaaatatttatttgttatatgtaagtacagtatcactatcttcagatacaccagaagaggttgtcagatctcacgtggatgctggggtttgaactcaggacccctggaagagcagcagtcagtgatcttaaccactgagccatctctttagctgagttcagtttgtgttgaccatcttctcttgagtatagggcctaccttggagtgtggttgatacaccagagatcacagcattaaaggaagttgccttttaccagcagctat

SEQ ID NO: 28562 - DNA, 1213 bp, Mus musculus
tggatagcttagttcatttcacaggcagttgtgggccaagggttctgtgtgatggctgtggatttgggctgtaagacttaactgcacaccaacggctttgcttctgaccgtcggggtaaggatcacttcacatagggttgcagaggccctttgaggatagaagtttctgagaagttaatgtactttgctaaaaaagtaaactctctttaatgtagctgttccacggaaatctttagggtgttatccattttcaaagaggaagtgttttgaagatgtttgccacctaggtagccatagggcatatggaaatgggaataatgttgaactcctaagttagaaattcttacctgtacaaaccttagctatgaatattttgtattaaaaccattcctactaggagggcctgtttgatgaggagtgtgagagaggggagaaagtgtgcatgagtaggtgtgcttgggtgtcagtgtcatttgggtgtctcctggtgttctgagcaactggtagcaggtctgtgtgactagggaatctcttgaacagaacatggagaggagggctgtggacctgactctgcacccattttcttgcttgcttccctttctcattgggaagaaatgcctgacactttgtagataagcaagctagtcttaccgagtgatgctgttccctgtaaggatgttttcagtatgagtgtgtggatgaatagctgctcatttatgcattacttggagggaacctccttagatagacaatgtttgttgtgaagttgtagcgcaacttatttgaccacggtacccttagagaggggtgatgaacaggcattgccaactggggtcatgggtacttggacagcttagagctgggtacagatttaagtagaacctgagaacatacccctgtatccatcttccatatgggttattgaaacaaaatgaccaagaaaaattacagcgatgtgggtctttgtgggaggccttcacttattcatgcactgcccagatttgaagtcctgtccagtttggtgaacaggtgcgccttataaggaaaacaatgagagaaatctgggaacaatttattcatttgctcaagtcacgcccccccccaccccccaccaaagtaactgaaggaagcacagtcttttatataaacagatgcttcagatgcttttaattggacagaaaccccaggggccacatgttacttttaccctttt

SEQ ID NO: 28563 - DNA, 1158 bp, Mus musculus
ctactttcaaatcttcagatgaactatccggggactgccctacgtggggatctaccctgtctgcagacaccaaagtttatactgttgctctggtcaagaggcacttgctgacagggacctggagtgactgcttcttgggaggtccagcaagcaactgaccaatgcagatgtagatgcttggagccaaccatcagactgagcacagggaccccattggagagctggcaaaaggactggaggagttgagggggattgcaacccaataggaagaacaacatcagctggccagatcacccaatgctctcagagactagaaccaccaacaaaggagggtacagggagggatccatgttattggctgagtagctgacaagagacctgggactttcatacccaggaccttagctacctgccctgtgaacgcctcccaagcctcctcatttcgcttctaagaactgtaagagtctcagcattactgctggttcagagaccccatggaatttattcctgtggctctgctttgctctctgggcagacagcagacagacagatagactgtattaactagaaatgtcaagatagacttattttgacttactatgggtaagcgatcattccatctatgtcatggattatatattcttggaccagggagtggtaccatttggaggtgtggccttgttggaataggtgtgacctggttggagtaggtgtgtcactgtgggtgtgggcttaagaccctcccctaggtgcatagaagtcagtcttctactagcagcctttgaatgaagatgtagaactctcagctctgccttagccacgcctacctggatactgccatgctcccaccttgatgataatggacttaaactctgaacctgtaagccagccccaattaaatattgttttgtataagacttgccttggtcatggtgtctgttcacagcagtaaaaccctaactaagacagaacttggtaccagggactggggtattgctgtgataggcctgaccatgcttttatttgaagaatgtggattttgggactttggatttggaaagcagtggaatgctttaaatggggcttaatggataatcctagtaggaatatggaagactttaatgctgggagtgatttgaactgtgttgacctgtccca

SEQ ID NO: 28564 - DNA, 1099 bp, Mus musculus
ataccttgatgacaagtatcaacctcatatgaaaaacaaaacaaagacaaaaacaggatagctaaaacaatcctgaaatataaatgatctccaagatgtatcatcatctctgatttcaattgtactacagagaagtagtaacaaaaacttcatggtactgacacaaatcagacaccttgattgaaagaatcaaattgaatactcacatataaatccacatacatatggacacctgatttaaaaaacaaatccagaaatacacaatgaaaaagagaaagcatcttcaacaaatggttctgcttgaccttgatagatgattctagaacaatacaaatagatcaatatccatcaccctgaacaaaactcaggttcaagtggactaatgtcctcaacctaaaaccagatacactttagaacctcatagaaggaaaagaggggattagccctgtgaaagaataccaataactcagttaaaaatcagttttatgttcatctaagttcccagaagcccctccatacaccagagctgggctcacgtgctttggccctcagcagaggtctgatgtgggaacatactatcctgacacaaggagctcacagcagtccccagtgcctgtggcaccactgctaaattcttatggagtctcactttgacctttaccaaacttctgagctccctcaggaacgagataacttcagcagcgttggcttgaaccacaccgaccacaaagggaagctcacctgtgtcctgggtacggtgcattccagaatgtgtgtggcataacattgtatagctatttcccacactgtagaatgtgttcacagacagcagctggtctccgtaaataccccaccccacttccttgtcctctgctgggtcacagagtagctgtagtagttcagaaggggtcggggagcatcaggacttgggttttctatgctgtgtgacacaaggagagaagtgacaatcgtgaaggccaagcatctgcagctcagaggaagcagagtgctgatctgtgtgcaaagatttggaatttttaaaaagtaccaagttcctgaaattcaataaaatatttttattaattaaaaaaaaaatcag

SEQ ID NO: 28565 - DNA, 1299 bp, Mus musculus
aacaggcctatccaccctaatcagtctttgaagaaattgtagactaagaagacgaaagaaattggatcatcatattgaagaaaaaaatgagggagtgaaccaggttgtgaaccatgtacaactgatgtttgacctatttgactcaatgtgaaaagaatttaaccagctgcccttgctgactcttttatcctgtctcaagaatatgttgttgatcacatagcatggtcatccactcacatcttaaaaaaatacagggagcatcggagagaatgggttcaatgtatctatgcctgcctacttcaatctgcaagggagtttcataaaggccccgcattcgccgagccgagaaactactcgtcaacgaatcaaattcagtgatgacagagtatgaaagagccaccttctcaactgttgcccccacgatgtcctttctggaacaagaatggatcttggagaatgcttgaaagtccatgacctggctttaagagcagattatgaaattgtgtccaaagaacaagactttttctttgaacttgatgccatggatcatctgcagtcattcattgcagattgtgatagaagaacagaagtacctaagaaaagattagcagaaactcaagaagagatacgtgctgaagtggctgcaaaggcagagcgtgttcatgagttaaatgaggaaataggcaagttgttggccaaagtggaacaactaggagctgaaggaaatgtggaagaatctcagaaagtcatggatgaagtagagaaagcacaggcaaagaaaacagaagcagaggaagtttatcggaattctacgcttccagcttccagctttcaacagcagtaacttcgtgtctatgaagtctgctctgtgtgtttaggtcttcatgataatgacagacgacttgctgatcattttgggggtaaattgcacctgggatttattgaaataagagagaagctggaagaattagagttgtagctgagaagcaggagaagagaaaccaggaacgtctgaaacgaagagaagagagggagagagaagaacgggagaaactgaggagatctagatccagagagcatcgcagacaccgatctcgctccatgtcacgaggacgcaagaggaggactcgatccaagtctcgtgagaaacgccatcgccacaggtccaggtccagtagccgaagccgcagccatagccaccagagaagtcggcacagttcaagagataggagcagagagcgatccaggaggagatcctcaaaagaaagattcggagatcaatacttagcatcacgtgac

SEQ ID NO: 28566 - DNA, 1177 bp, Mus musculus
tatatttttgttgtctttgtcaagtgaccataagtgtgtagttttatttctgggtcttcaattctattccattgatccacatgtccgtgtctgtacctaaattcttaagatgacccaggtttctggatttttgtacattttaattattatatcatttcacattcctttagttatatttccttttttgttctttgggttcctaataacagttttcagacatctattctgtttggttttaagtaactgaattataaactttccattatctgaataccctagtggtctccagagttttatgtccagttagatcttgtattctgaaggctgtgaaaggccatgatttgatgatgcacattcttcctgttttcagtggtaggttgttctgtacagtatcaaatgactatcatgttagcagaacaatcgactgctttatgacttcaggtttattttttaggatagtatactagaagaacaattgcgaatgcatcttcattgttgtttgacactttgtgatttctgggagccaaatatttcagttgtcaccattttatgggagtattattctaagaacctggtaagtaaagagaatatggatttgctataaaaatttgaaatttataatatttgacaagcgttttacgatttaattttgagaaatgtgaattttttaaatagtaatttttgtttggagtaggatgtagcttgcaagtattttatctttcataaacattgtctatagaaaactggcatatggaatcagcgcttggtgtcttttctcttttgaatgggtaagcaaagtaaccagaagtataggatcatacaaattaacaatctttatttataaattaaaatataaaatttaaacttgagcatttaacatttttagatttttatttatccgtatgggtattttctctgcatatatgttggtgcatcatgtatgtgcagtttcttcagaggccagaagaggccatcagatcctttgggactagatttagaggtggtgtgagtcaccatgttggtgccgggaattgaacttgggtcctttggaagatcagacattaactactaggctatctccagctcccctcacttattataatatcataatatttaggctttgacacaattaatattcactgttcacaataagaatctttgtacctgagtagtcttt

SEQ ID NO: 28567 - DNA, 1209 bp, Mus musculus
tgctcagcagtgccagccatcttgcttgcttgctgtcacacttctctgccatgtttcctagaaccgtaagccaagtaagacttcctttccacaagttgtctagtgtttgtcacagtgatagagttgtaaccaatacaacatgctatacatgtatgaaaatgtcataatgaaacccattgttttgtataataaagatctatattcagtattcgttatccaaaaaattaagttacataacaaaaacattgagaaacatggaaaaaataggttttaaggaacatagcttcattggacaaatcacctggtaaaaatacattttcgggaaaatacaaaatgtaaggaccccttcatgttctctgtttttatgtaattaaaaaaaaattggagggtatatatgctaattacagtctaataaaatatatttataattaaaacaggtcaaacttttatgagctagttggtgttttcagctttcgtttgttggtttttcatttagaatagctccttcagtatttcctggcttcctttgaaaggccttaccaatattatcaagtctccactgtcgatgcttacactggtgaggaactgctgtagtgataaacaagaccctgacctctataagtccagcagcagttacatcatttttctttgcattctggcaaaagttgttaagaaagcaatgagaaccagcggccctcacccttggaagcaagttaaaggaaggtacgtgctatatagtatctcttcgtcatgagtgttcaccagtacctttgactggtgaattaacttatgattggagcttttgcacatttaaagtgtatgccttaacctatgatgccattttttttgtcttgtcaatatgttataaagagggacaatattaatattcataaactagagggttccagtttctaactcatctaattattactgaaaattgcaattctgtgtattaaataccagagtattaggaacagttttggctatagttaattgtaatattatataatcctttgctttagttattgaaagtgatagaattctattttttaatttttaaaaatcattttatggtacattggtagctattaggttcatgcttgattttttttttttttagaaaaatatttttattactattttactgttagtcatttctgtgtacatgtgtgaatgtctgtatgtgcctgagggtaggggcatcctttg

SEQ ID NO: 28568 - DNA, 1127 bp, Mus musculus
ttataataatactgtgttgcaaatattggatgaagatatctttaaatgatagattttagttaatgaaataatcttaccaattttcatgttttgtagaatatattctaagtttcatcaaaaaagaatggaagaactaactgaagttggcctacagaactttttcagcctttttctactgttagcagctgttgcagagatagaagatgtagcaagccatgttttagacctccttcgtttcctcaggcctgcctccatgtcatctcatggagcccttgtttggaagggtcagatggcatttctcctgatgtatgcccagaaaaacttggacattggtgtttgggctgagaaactgtcatgtgaattccaagagaaagcaaaggaattcttggtatctaagaatgatgaaatggtacagagacatgctctatggacactgctttgcatctatattgatggtgttcaagaagtatttgagaccagcagttgcttgtatccttctcatgagcatcttctcaatgatggatttagcatgttactgccagcctgtcgagaatctgaacttaggacagtcctgaactttctacaagctgttctggcgagaatcaggtatgttttctaacgaggtagtgataagcttcactttttacatacttatatagtccaagtgtagaagagtttgttttactgctacataggcataaatcattagtttttcaaacacttaaattttttatgcagacacagacaacaaaaaactgagagcagcctggtgcgattctggaaccctgcatttagaccttccttctgtgttacctctctgtaaagtgttaattatcaaaaaaggaatgttagtctgagcaagatcgtgagttcaaatttgatgtggcttaaatctatggaatgttgttcccatggacagatatgggctattatgtactattttattttaatttagtattttttattagtgtatgtgtgtctgtgtgtgtgtgtgtgtgtgtgtgtgtatgtaatgcatgagtgtgagtgggtatacacatcttaatggcaaatataggagagatcacagcccccactcctcaaaccccacacaaccacacctctaaactccctggggtctccagtct

SEQ ID NO: 28569 - DNA, 1209 bp, Mus musculus
tcctatttttctcttttttattagatattttctttatttacatttcaaatgcaatcccctttcctggtttcccctcttgagaacctcccatccccttccgcctccccctgcttaccaagccacctactccctcttgctggccctggcattcccctatactggggattcttcacaggaccaagggcctctcctcccattgatgaccgtctaggccaccctctgctacatatgcagctagagccacatgtcccaccatgtgttttctttggttggtggtttagtcctagggaactctggaaatactggttagttcatattgttgttcctcctatggagctgcaaacccctgcagctccatggatcctttctctggctccttcattggggaccctgtgttccatccaatggatggctctgagcatccacttctgtattttccaggcactggcagagcctctcaggaggctgaggctcttaggctcctgtcagcaagctcttgttggcatcctcaatagtgtctggttttggtggttgtttatgggatggatccccaagtagggcagtctctggatggtcattccttcagtctctgcttcagactttgtctctgtaactccttccatgggtattttattctcccttctacaaaggatcgaagtatccacactttggtcttccttcttgagtttcacgtgttttgcgaattgtatcttgggttttccaagcttctgggctaatatcctattcatatttttcaattttttggacttttctgaagtattttttttcagttactacaactttcatgatggtgctggtatttcctctccacgaagcagtcactacactcctaattttttttaagatcatagtcctttgtatatatcttaagtgtacatttcttgaatgcaagcattatgtatgatggctagcactctaaagtgtttcatgtaactagattctgaagtgtatctgtgagcttagctgctggacgaatggttctggtgtctaaattcactcttgtactcgagacaaagttaaagtgtttacatagctctttttttctttctgaatgcagacagtgattgacatgatgggacattactataatagtcagaatggtcattttccctctaaccctgttttacatgttcttttttaagatataaattacgcttctatgtttgtggcttatcatgcacttttgag

SEQ ID NO: 28570 - DNA, 1166 bp, Mus musculus
gaggaggtggcgccagttgggcccaagatgcccctttgcatggcaccttgaaaattatttcctgttgttcacattacttctgtaccctagaaggactcccggcaccacaccatcacacactgcaactgcctactgtacccaaccctgctgctccagcacgagaccagaacaggactccgagaagccaggaaccctgctcagcacctctcaactgataagaagtggggggagtctcacagttgtgaataactgtactctatcatcttaaggagtcatgccccaactgcaaccatgcctgcccttaggtcccaatattttaaatgcagacacaataatatctgtgcagatagaggaaaaccaaagctgtggtatttgaacagcattacttaaaaatgaccgagtttggcattttggtgtagtctgcttcttgcatcttcccttctcaccccgccagtctgggcctgagggtttccagcttccggtcagatctagagtcttcaccctcacagcaaagcgtgactcttgagcttgtttgggagtgcagagctatgggggcagtaactgctgacccaaaaatatcgctggccttcccaccacgtgggttaaaacagacttataaagacaccttcctaattaagccgggaacttggctcgagtgcattcgatgccagcttttttttttctggagctctcagcaagaaacctgtcctcagagctcagtgccattttgagagaaacattttgttattttggcagaactaggtataatggttaaattaaacttagtaatacaagtatgtcactaaaagataaaaagaggccccagccttaggtagaggaactccttttacgcccgaggatttgtcctctagagtatgtttgaggttcttccattggtttctctattggatgccatcctattaggctttgctgaagtaacaacttcttttggactccacaaagattgctggttctcccctgggagcttcttggatatggagcctgacctgccagcctgagtattggagccctggaacatattgtcactgccctgcctacctacataactctaagccaataattatcagttgccaagttcatcagccagtgtggggttttgttgttctttgtagggtcattggtgttcttgttagtggaacttaaca

SEQ ID NO: 28571 - DNA, 1162 bp, Mus musculus
gtttggtcttaaaggagtcaattatagaatttgttgacatgtcctcacaataattcttaaataagtacaataaagatagttgagatgtgtacaaggatagtttctgtgaagttgaagtctttggttttgtaatgttccgttctttacaaagcctccctcccgaccttgttggttttgctgtcagtggtggttaacagtctgtttctcatgacacacctcacgggtggcctcccctagacagcttttggaaactgtggattagagatagccccactctgtttctggtaagatactgcctcagtatcagtggttgcctacacttatcaactggtgccacgtattcctcaaaatgccaagattataaactgcaagtttcacgggcctttgaatccttccagcgtttagtgaagcgggcgcctaactgaaccagctgctggagaacagtggatgctctgggggaaaactgatggaactttcagaattctgccaatggaaacaacagtggacgatggcaattgggactgagatttcctgcttgcttctagctgcagagcccatctgaggactgatgttgtccgtgtgcacatccgggatggagctctggtccctgtgcttaaggagcttcccggtggggccacaggtacagccaccagaggaaagggattagtgatagctctcagagaggagagcaggctgtcctgggcattttaaaaaatggcattttggtttggttttttttttttttttttttttttttttttgaggtggggtctcgccacatgactggctaacctgaagctctttatatagttgaagaactcacaaaaaactttctgtttctgtctctgtctcccaaattctgagattaaaggcatgtggctggcttaataaactggttgtgtgtgtgtatatatgtaaatgaatatctttcatgagccacgtgtggtgttgcatgccgttgatatcccagcacttgggaggcagaggcagtcagatctcttaagctcaaggacagcttggtctacagagaattacagggcaaccagggttatacatggaaatgaagtctcacaaaaccatcattccaagattgtagtgtttatcagtgcaactattcaagtgtacagtgtagcaggattgtttccgtttgtctgggtaaagg

SEQ ID NO: 28572 - DNA, 1657 bp, Mus musculus
attttttaaaaatttatgtatgtgtagttcctgggtatatgttagctgtattgatcatgtggcccaaatgagtcaatattaaattccactttctagtttaagttggtttgttctttgtagtagacactgaaagcaagagtcctcctgactcctataagactggcattgtgttagggacagataatcagcagggaaacacagtgactatatttcccaagtgaagaaagagagaaaactgagtgaaaagaaagaaaaatacatattactactctagagatgaaaaatccatgaggatctttttaatgttttaaatttgttttaaatattaaataattttatagaagaattagtggtatctgacatgctggctgtctctcttttgacaaatagaaataggtaacttgaaaaggtttctaagagcgaggcaatacttaaagattatttgaacaaatagcttctttaatttagaagtgagagaagtatgaaagaacagctaaaaataagagaatccaatttgataaccaaacattcatacctgtttttattttaggaggaaaaataaccagtagaagtatagaataaatccctgaagggacctagaaagttaccaattcattcacttaagctctggaatgttacattccagtaatagaatctcagataaggtgagatgagtttggctcattctggcatgttatacttgtgggttcttgcccatattgtttgacctctctgaaattgaatttctataaaagtatacctgccttatataaattccaggacaacaatgaagataaatgacaaaagaccaggcaaatacaaagtcttgtagttaaaatgggtgtctacaaaacacacaacagagttacctgtagtttatgatgcaaggaagccagaatttaggttctcgaaatcctagtagtatttttacttattctgtaaaatgaaatacatttcaaaaggacagaatggagttggggtaactgggctcgtccatattctttcacgggaacagacagacatacttgcctcgagattccacgggaaaagatgtggaagatgagaagaatccagcgatgatggagggaggcagatggaacagcaaagatgggaggtgactggagagtttgtcagcttcttcatatctagttccagtgaagaaactatccctacttatatgtgattcaatacagaagtttaagggaacctactaattccaatcattgctgattatggtggaaagtgccgtcaaaaccatcctccattaattcaaaatgaatatgtgaatcagcagtactgactcaggtttcctgggtggctagcagatgtaaatatggtttcttaactggtatcacacaataaaatccttccattttgcacattagcccacttttctggttttttctttcatgtagaacaccaattgtaacgtcacacaaggtgcatgaaatttacatttggaaaagcggagtttagatgtcggttccttaactagctgtgtctgacttgtctacaactaaagtgcagtttatatactggacactaacctaggtgccttacatgtcttagctttgttagcattgtggtaacaagcgtgaagttaagaatgctttcctgggaaagttgcagcccgggaaacttcagtaactacaaagat

SEQ ID NO: 28573 - DNA, 1177 bp, Mus musculus
attattgggtgtttcttgtgagtttcctcacaagacttccagttctgtaagctcaggagattcttgtttggtttcttcttaaactcagaacagacactgtgcacaaattggatgtcacagtctgaaactctcaagtcccaaatgctccacagtctaatattttcaagctctctcatgctcaaaagttttagactgaagaacatttctaatttcatatttcaaagtagtccaaattctaaaacgttgccaaatgtggaaggaaccttttgatcctaagcattttgaatagatgataacctatccttttgatgtagagagaaggaaggaagagagggagcaagcaggggggaagggctcttagggaagtaagtaaattgagaagtgtgtgtggaatggctgtgtcttagtcataagattgggtattggggcacagtaagtgagtaaaggcaattttaattggtatatagtaacattgtggacatttgtgtttttgtctcataactacttcaaatcctaaagccaaagtcatcttttgtaaattttgagctttgagtattttaaatatgaccttagaccgtttgaatcttcctgagcttgctggagttgttttgacgagtggcagtgactggaggtcagatcagagcctcccgttctgtgatgagccactgctgggccccagccctgtgctgcagtgacacactgcgagccctgcgatctttagttctgtgcttctctttctgcatgacttttctagcttcctgtgcaggaaaaaaagactgttaattccatatttccctctgtgtccatcatgaaagttgccgtgatactgaattatttttacacagtgttggaccaggagctaatggcatatacttttttcctccctttttcttatgatctgcatatatttaattgaattacctttggcttcagtattttttttttcattatttatttattcactttacatccctatcaaagctccccccttcccttctgagtcctaccctcacaaatctttcctcgcattaacccccccaccccccttctccttagagaagaaggggaagcccctcttggttacccacctcgccctggaatgtcaagtcgaagcaagtctaagcacatcctcttccactgaggctgaccagaccaggtagtccatctcagggaaggg

SEQ ID NO: 28574 - DNA, 1180 bp, Mus musculus
gtaataaaatttcttcaaagagttctgaatctagaacatattatatgctttaatgttcttccagatgttaaaatgaaaaataaaatagaatactttttatctctaggaaaggacttgtttgttatttaatttatatggtatattttttacaaggaaaaatgtttatatgtctgaaataaaaaaaaaggaatcagctttacttttaaatttatagtgaatgctttagaagtagaaattttcaaatatattttgtattcctaagttctggctcttgcttttaacagctagaaggaaggcctcctgcatgaacatctccagaggcctcagaagtgatttaacaagtgagaacactgaagaagcaagcattgctgtgttcgaataaagcaagccacagggtaccgtgagggaaagcgtgaggcacgccgcagaacagtgcaaaccatgtgtctgtctgaggggctaaaggcacagagatgcttctgtcattagcccagtttagagttctaaggtttagttgtttgatttccgtggctgtttttacccttagttctttgttggaaattgtatgacaggtagctaggctgttctaatgaacacagaatctgtgggtgtttaaactgtgcagaaattatattctaaaagtagacgtgtttaaaagttgaatttttgttttctatgattattaggtaagacatactaaaacagttccttggaacaataatttaaagcaagttataagcaacatcctattgtcaaaattttagtttttctgaatgtaataaaattaaaacccagatgtttaaggaatgctattttatataatgtcaatggaatttttatattttaaaatgtttaaatatataaataacactacctcttttctgaaatggcaaagtgttaataatactgcatagaagtccttaattattaattaaaaattttattaaagttgatgatagagatttatagaaaacattaaggggctgtagaggtggctcagtgggtgctgctgttgttgttgttgctgttgttgttgttgttgttgttgctgttgttgttgttgttgatggtgatgatttgcagcatcacatggatgctttgtatctccagtcccaggaaagccaatgctttctggccactccgggcactaagcatacacaagatgtataggcgcacatgc

SEQ ID NO: 28575 - DNA, 1868 bp, Mus musculus
gggtaagggggaaatttgatactgttttaagtgctgctaaagaagaaagttgtagagaagtatcacaaaggaagaacggagaatgtgtctaccatcttgattccattgaaggccgccatacaggccatagccaatgcttgccctgagtggtttaaataatttcataaaggattttatactcaatgaattgagggcaaagcaatcacactggaacaaaaatgtgccaatttttccaatatgcaaattgtaatgatcggtaattcataaaactactttgagagcaattgaatattttagtattgtaatttgcactatgatattacgatgttcaggcaaactaaaatactctgaaatctaatgccaaatgtacagttcataggttcatggtacttcgtataagtgtttcattgcattgcgacagttgtttaatagcattaactttccctgggtgtgttgttatgatgcagatctaacagggttattgtaagcacactaattagtcatctggggttttatagataaaatcatacattgatcagaaatcacttttctacttatttttttgtagagtatttttccacacttgaaaaaacatgattattttatatcaaacatcagttttcctttaaaatcttattttagtagccaatgcatgtttgaaataagatgttaaatattatgtgccaatagtaagattgtgtttgtaagtgaaaaatgcatgctataatgaatcatacagctttggtggcatattctactgccaccttatatgcaagctttctcttaacctgtgtgcatggtccacatgctttcaagagtccttttttaatatttacaaagtgacatgtgatttttagtgctgatgagccagtgagccaagatgcaatcctgttctgctttcatttttcttctttacattatgttgtaaattttctcagaaaactttttcttggagttgttggcaataaactacaacaaatgaaagaattggctggtaaatcttacagacaacttaccgttacaaagcatgaagatgtgagaagatcattttacaagcttcattatatgaacacaatactctggcatcttttttgtgtagttaagaagagcttatcgtttctgaaacactgccaaagtcagtactactgccaaaagggagggacacctgcattacactaaactgaataataacagactatccagactgtatagactgccaatcagtacagtaaagtgggagggatatacccactcttttgtttcttattaattagagaaatgtataaggaatatgaattttggcaacagagacatggctttacatgctgataactcatggaaatatttgaaataaaactcattccattcttgaaaaaaatatgcccaggcattttgtttgtttcagaaatgtacttgtgtttttgaaagctctaatttcaaacaagtaatatatgtagaccaactgttccttctacaaataatgtcatttattgtaacacataatgggtagaacatagctttcagtcagttattcgaatcaccagtataaatattcataatgtttgaaggtgatttcactgtgaggttatgaaagcaatggaaaccctagttatttgtttgggtttttatgtgtctatttatagaaaaatgcttcttttaagtctaattttaacaacatcaactaagttaatctaatgctaagaaaattgactctacttactatttcaagtcacagtcctgaaactgagtcttgctgcaatccaaaaataaaacattgattcaaacgaagagcagcctactctgccatggaaagggcagctacagcagtcatgatatcatagatgtgagcagggtaaagaattcctaca

SEQ ID NO: 28576 - DNA, 1777 bp, Mus musculus
atcttttgtggctctttatatttctctattatgtattgcaattagccaaactcaggctaattctcctcatctacagagaagattcatttcagtttgacaagcaggaagtatgtgctcaatgagacataagctcccttagcatggaatcatttgagcaaagaaagaccacagaattaaacgaagagtatgatctcatatttttttaaagacatagttacacaggtgatattgttgatccccaactgccacagaggtaaagatgaaaatgtgttgtcactgcagggtgacaatggagacttagttaaaaaaaaaaaatactaaacaatactagtaaatttactccattctttacctactcaacatgtgtttgaatggcaagctttgtctactcacttgatccaacatatatttttctctagattatcttttttccacacatcgtttttacatgtataccaagaaatcatatatatacatagatactctcataaaggctctaatcatatatttatttgcttaaaagtcaaattcatgcatttacttatgatttttttgatccaaaaatggtagagagctaagcatggattgctaaatttagaatatgctctcagtgaaagctggaaagcatttgatgttgctttcatccaccattgctatattggatgctaagagacctgaaggcagttgcctcttttgttggctatgaatttgagctcattcttggactggaagtacaattaaatgccaatagtgtaagccaagccaaggtattaagtatttcacaagtgcatctacatatttagaacctgatgccaagccacagaacgtctgaactttacgtccatagttagagcgagctttttaactagaatatacaacaatattcataagtcaacctcttcttttctgtgaactaactcgttatttatttatgacatatttattcctgatatgttgagagacaggcatgtcaaccccacacgtagtgatgatagaaattagaatttaaggatcctattgctatgactctcatttctctctgccctatccataccttattgtacaaatatatctcaattcctataaatgtgaatatcctctggcattatttagtccctgtaggctagtatgttctgggaggactttagtttttggaaatatattgaacagaatttgagatgttgacactctttctgatattgttttagctgttgaactttagcagaaggaatgagcttcactatgtgtgagtggaaaatgtaccactgacaagatatgctattggctgctctgttaataaatcctgtgactcatactttctgtaagcatatctcttatgaaagattgattgattcaaccaaattggcttgctgctggtataataaaagcagataatatgcctagagatccaggatggctctaaacagatcatgagcaagttatcacctaaaagtgcagaaagtccttatcaccagtgctctgagtatttaattgctatttagttcaggccttattaataggaatacaaaaataattattttaagccttactgaagagaaatatactgacttatctagttagctgcattgtattttagagagtgaagatcttgatagccatatattttaggacagccatcacctaatgaagtagaaagtataaaagatactctcactgggaaaccagcatcagtttacaagatttctatttactgtgagaagctcagtcctagagtgtacaaagcttgaaccagaactgttgaggtagaaatggacag

SEQ ID NO: 28577 - DNA, 1153 bp, Mus musculus
attctatggaagcatgtacctcctgaatgaattactttgttgtcgttgtagcaaaatacctaacagaagaaacttcagagagagagagagagagagagaaagagagagagagagagagagagagagttatttttaatttttttccattataaattctttgatctaaagtctcatactcactgtagctaagattgtctggaatgggtagtctaccctaaggcggtttcccacttgatttaattctcctggagattccatcacacccagctatgggaagtgtttatttttcacttaagtttcaaggggataaagctcatcatggtagggaaagcttggcagctgagacaccgcatccctggaggtcggagcttggtcagctgcttcccttagcaggcagtcatgaacccgagatctcaggcatggcacaggcgaacttgtgacttttagttgtcactcttgtgctcctatatcttaaatgttcctccacaacttcacaaaacacaacttgctactgaggatcctgtgttcaaacacatgcctctgaaggtacaatttgcccttcgactatgcctattctgcctttctgaattgacctcaacagaagataaatactatcataaaagattctgtgtatcttctgaaagcccccgcgtgtcttcacaagaagactctgctgctctgtctcctttcagtgtttctgttttccttctctttgctattctctccctccaactttttatagcctaaggttgctctctctctctctgtctctctgtctctttctcaggaaaactttgtgggtctagatgggactatgatggaaaagaaaaaacgaaaagcaagcaagatatcccaatagtccaaagtatcccggctgtttcttcatgcacctcccccatccttgtcagcaaaagtagggagattatgttcccaaagaggaactgcagtcacacctaagacacaaagcagtggtcacactggatctgcctcccagtgagaaagcaaaacacatttcagctctttgtgaatgttttgttactgctcaaactctgagagggaccaatgaggaatatgagtactggtcatagagaatgcacatgcacgtttggagtttcttcagggaccttggaagttttgacacatgaatggtagt

SEQ ID NO: 28578 - DNA, 1149 bp, Mus musculus
ccattgtttctcagtggttaaaataaatgttcaccagaaactactgaactgactgaaaaaggataacattaatcctcaagagtgttttccttttaatattttcatttaattttactgtaagacagaaaaaaattgcttatcacttcaaaactagagataaatagttttaaagtaacatatttttcagttatgtcctcatatttggatgtcttacacttttggtttaaaaagaaactgttagtgatatagttacaaattgaaaagttctatgctaaaaataaatttttgtaaaagtgaaaataggagaaattgactgaattcaatatttataattaaaatagaaaaaccacctagtctatataattttacacaactgttatttcttagtactacagagaggaccagttgagtaacactaacaaatattgcatgccagccttcatagcataaagacatttagaaaccagtaagttctgggatgtattttaaaatacacagcagagaggaagcagttttagggtaagagtgactgctctgtggggaaagttcttgctgtgcaagcctgaagacctgagtctgaacacctagaactcaaacagatacgagctcacgagcatgcatgttctagtccacggcttctccagtgagcgagagaaagtggacacagtacagagcccagaagtgcatgagccagttagcctgccgtacacaacagcactaagacatatgtctcaaacatggtgggcagcagaggtcggcaggcaaggttgctctgacattcagacccatgtcatgtcatagtcagtctccctcttactctggaatgtttgaacatacttacacacagagcttttttaaaacgcatgtttaaaataattcttttagcataaaatctttttcaagagatatactaaccttattaaattaaaattttctatttatcagaatattattgggccattaaaaattatgaaaataatagtctgatttttccagataaattgtaagaataatttaatatagtagtattttaatattacacatctccattgggataaggagaaatataacctatagatcttttttttttgctttgctactagattaaagctgaattttaatacatagacttttacagcatatgctgtt

SEQ ID NO: 28579 - DNA, 1201 bp, Mus musculus
ttaataaagattggtttttattttttgatagacaggcttagccccttagctgacctctggcttttcacccttgctgttactgcaaggtgtccttagctcaataggctgtagaaaaaacagggatgaagagaaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcagtatgggcaccgcttggtgcagaagtactgcaagagaaggtccggcttgaccatttctgagtttcctgtgagataaacccggtttaaaagaggttggtaccaaattttggttaaaaataaaaaatattttccgactctacctcgcctccccaaaaggtaccgagagccacatgtgtgggttttacccacgagagaaatcgggtccatgtccacccaagccaaggttaaaagcccactcatctacggatgagaaaatcatttgatcacctcagttaagcgttgccttatttaacttaattaataggggggagagagattggagacgtactactgaaagggcaagcccttcactgcctcccacccaaataaaagagccggtcgaacgccttctccctgtttcccacctatcatccaaaaatgcggaggaatatcaacttagtgttattttcacatcgttcagtcaaacttagccagagttccaacgccctacttaaaattcaactagaaagttacctaccaagtacctattagcattataaagtcagagtctgaagctccaggcctttcagttagttgtttactagaaaggacagtcttaagccagataccgtttaccataagaaaagttaaagaatcccagtgaagcaagttttttctttagccctagcttccaggcagaactattgagcatagataattttcccccctcaggccagctttttctttttttaaattttgttaataaaagggaggagaagtagtctcccctcccccagcctgaaacctgcttgctcggggtggagcttcctgctcattcgttctgccatgcccactgctggaacctgaggagccacacacgtgcacctttctactggacccgagattattcggtgggaattgggtcccctcccccttc

SEQ ID NO: 28580 - DNA, 1100 bp, Mus musculus
tttaatggatttattaaatttctctttaaaagcctctggataatttccttaaaattgaatttaaggtcatttacttgtgctttggctgtgttggcatatccagtctggccatgataggattgctgtgctctgaaggtttcatattgccctgttttttgttgattgagttcttaagctggcctttctccatctgagagtccctgaatgatttagcaggtattatgaagggggcaaacctagatgatccttgtgtggaaggcttttgctgggtatcctatggctggtcagttgagctcaaaggcagtgcaagtctcccagaagttcggtgtttccatggggacacagtggttaggggatgcttggggacaggcagagtgatggcagtacaatggagcgctattggacagtatgctgttctgggctgctgattgtgccccagaggacttgaaaggcaggataatgggtgaagggagagagtctaacctgtattggtccagaccaacaaggttgatcaaggtgtgcaaagatgtggcaggacaatggaagtcttgaggggaaggaaagcagcaggcagtcccatatttcagttctttaataaaatattttgcataatacagtctattaaatttgaaaagaaataaaattattttgctcaaattttaagatttaaaaatccaccattatttcatttttatgccttcagcatttttgttaatatatctatatatgtgtgtgtgtatgtgtgtgtgggtgtgtggggtctatgtgtctgtgtgtgtgtgtattctcaaaaccaagtacatttgaaaggcattctatgcttcaaggaaaccgtgtgttaaatcattattttattaacttctggtgagttgtgtttgatatagaaagaattccctggttttctatcataactgcaaacccgtgattatttaaaacatctgacaaaattcatcctgttagtataaaaaggtttcaaacaatgagacataaattacggaaactttgttcgttctcattctcagttgggcagtggaaatatgagggctaaacttgtgatttaattgctaaaacatgtaggagactacagtttttataagcct

SEQ ID NO: 28581 - DNA, 1847 bp, Mus musculus
agagaagacaaaccattataacagttcatgagtgttagctttttggcgtgttctgaatgccaaatgcctctctttgctgcatttgttatgtcagttacctttcttcttatggtggatataaaatccactgtcgtgttgcagcagatgatggcacctgtggcttgggaaggcgagcgtgctcagcttcagagcacatgaagtgaacctggctgtatgtgcatgctcctggagtgagctacctaacaggagggggtagcacactggctactgtgtgcaggcatcatcctttctctgtagtaaaaggtgggacctcaagaattttcttcaaagtgctcatctcaaaaatctgatttttttcccagtagatggtatgctccaatgtaaagacagggtattaaaataacttgtggtacattacagagggacagaatgttgaggctgagttcaaagacagggtttgtgccaacacatcctggatcaatactaactgtagtcccacctgttactattaaaggtgagtggtggcagctgtgcttaaggagagcaagtttactgactttcgtgaggttgagcatcgtctgtgaaatatgaatgacatgctctttttacaccctatggattttcaattctgtgtgaaaacagaagcctttctgacttttaatattagtagcagatgaaattgaaagatgatgatgtagcttaaatgatccttcttgtaaccattactgagttgttttatgatatatttgaagaaaattgaaaaataatagagacacaaatcattggcccagctaaaggaggcttgagctgagctatcggtctgttataccaaataaggaacacagcaggctaatcaggaggcccgagtaaggaaggcaaaggaggaaaattaaacccactttcgtagctactcagaggacttgattcctctgaagtcctttcctgagtctgttgccttcccatgcttttaagagaatttgaacacttacaaagagaatatttatattgttaacaataagtttactaccaaccttcaaaataacttaaaggtaataataaaatgccattaaaaaaataaatccctaagatctattttttcagtccatgttaacacattttgataccagtgcatgaatgtcttttaaattagatgccatcagcttcgcttttatagtgttcatgtttgtaaagagaacatttggaatggaaagatgatcgctgtggtacttagatgtacatctcgcatgttcctgctctgttccagatgagcacgagaagctagcgaaggtgttctttaaggctaagacagataacctttttcctgttatttttttcctctctgagttttataatgaatcccttctgtatacagtgaaggtaagggagagtttatagcaagatgtgccttcctcaaaacctgttagtagaaagctcctgggagctaaatgtcttctttcacttaaataaaaaagattatagatagcctcaaactctattaggtgacatgagtgccgagctcagcgttagtagtgacataaaactgacacagaagatagctgtagtctgagtccaagaccaacaccgcctgccactgctgcctgtgcagacatctggcactccacaggagagccatggtctctgctgtgcagcatgctgaaagcatcttgacttcccaggagattccacattacatggatgcaagctcatttctagccagttgttttgcaaggtctgcatcctacaactaaaaggaaattttgttgtcctggtcacttgaaagtattcaaacaagcaaatggaagaaaacactggatttgctcatggtaccagtgttgaaagattgttac

SEQ ID NO: 28582 - DNA, 1249 bp, Mus musculus
cctgttctacaatttattcaagcctcacttcttgggtgaagtagaaaacaggcagacaggtttatacattgatgtccaagaaccagacagtcctgcacagacactagtggcattttgtttccatttccaggaaaggaagcaaggttgtgcaatgtggagtgaagtcctcctcagcagtaaagccatgctctaggttgagtaagtcagttaagagcaccatactgccatactgaaaacatctgcttagagttatttacaagtggttggctattttttgttgaagtattttttgaatagcgaatgtctttttccttcaaatttctgtcattctcccaaggccccctcctcctgcagccagagattacaggtggttttgtttctccctccttccctgtgtgtgtgtgtgtgtgtgtgtgtgtgtgtgtgtgtgtgtgtgtgtgtgtagtcaactcctctattcacaagctagtaaagctatctacttttattcctgtccaggtatttcttgtaagatgatataatgcagaaattcttgtgcatactctgtaactgaaggaggcttttttgatttatttttgtctttaataaaattcagattgttatttcaggctggtatgtaggaatggtagctggcttctctacacgacgactgagctgtgggtttgcccagtggtatttacctcatgcagaccaatagctgaatcaccagtttcctagcatactcagtacagtgtaccatagtcatgccagagactgaatcatcggactgagagtcggcttagcagttaagagcactcatgtggaggactagggttctgttcccagcacccgcatggagactcccaactctctgcaactccagttccggggtggtctgactccttatgttcctgatggttcttgtaagcacatggtgcatatatactcagacgagcgtgcgcgcgcgcacacacacacacacacacacacacacacgtgagaaaaaaaaagtcctctttattttttcatgggccttcatttttatggagtacagcataaaagtgactgacttatcattgcaaacttcttaatgttttttctaagctacagtaaccattttgcttttatatcaagtaacccccccccccgcttatagataaccacatatttttactatctatccattagtttcctcgttgcttcagtattgataagctactgttactaatgacaagttcatgtcagccccaccatagaagcccctgtaaga

SEQ ID NO: 28583 - DNA, 1233 bp, Mus musculus
ccttgctcgcttgcctaccctcaatcagtttctctactcttacacagttcaggattcctgcttcaggaatggtgccatcctcagtgtgctgggtcttcccacatcatttaacttaataaagtcacccacccggaccctagacatgtccacaggccaatttgagttagactattacccattgaggcttccacaggtgattcaaattgacaatgaaagctaatcctcacactaccttataaccataggatggctactaccacacacacacacacacacacacacacacacacacacacacacacacacacacacacactgcattcctctggaggcataataggagtgtgggctgtagactaaaggatatgacaatgaattgtaacccatgatgatgtagatctggttccttttgacctctttaagcccagggcttcatgcatgctgggtaagcattccaccaactaaactacatcccaaccctgtattttgatcttcttccagtaagggacagtctgggcagttggtgaaagttaatagggtgtctgaattgggtggtggtggtgaagcaatgccaatggcttgatttatcaggtggtgatggtgcattggtggttcaatggtagaattctcgcctcccactcgggtgacccgggttcgattcccggccaatgcaatatggtcttttctgtctgctacctacacgtcccagcactcgggaggcagaggcaggcagatttctgagttcgaggccagcctggtttacagagtgagttccaggacagccaaggctatatacagagagaccctgtctcgaaaaacaaacaaacaaaaacaaaacaaaacaaaaaagagaaagagagagaaaatgggaacttctgcgtttagggttagtggaatcatgctgacaacactcgaaaaggaggaaaaagaataagaacaaagcctagcggcacaggtgcgaagatgccacactgaaacccgtgactctttatgctaacctaagacattagctaaacaataaaatgacataaaaatatccaggaaaagaatgatgccaatgagtatacatatcaaaaagagacaggtggcaggctggagagatgatggctcagagcatgcactgctcttgcagaaggcccctgtttggttcccagcacctgcatctggtggctcgcagtcacctgactccagctctagaggatctactgcccttttcagatcccagaggcactg

SEQ ID NO: 28584 - DNA, 1134 bp, Mus musculus
ctgtttcccagctgaaccgcatctgcagccatcacagagcgtttaacacaggttccgcagatcaagctcaggtcttatcacccacatgccatttacttgccaactaagctatgtgctcaggcctcgaaggtattcaaaagccttacttcatactttatcttagtagttattcaggtggaagtgtaaataaaatactcactgctgggtgttgtcaagccagtaggatggatgacatctcattaataatacccagatgttggtggctttctgagttgcctgcttactgttgatgctattgttttgatttttaactaaatgcaaataccttcctgcctcatcccagaaaatgaaaaataatgcttttgacactgttcctagaatgttaaagttgaaaaatgatgatgatgatataatccagaaatttttacttcagagcatggcaatagatgcttctttcacaaagactcaagatcaaacttcttacctaaaagttaggttaactgttgactcctcaagggttttgatcaataccacttaaaccttttccacttgacatgctagaattttggtgtgtgtgtgtgtatttgttcatgagcacaatagctcccatggggtctgcacatgcaggtgtccaccagcatcagcctgcctgagatagtgtcattcttggttctggggagaagggtgtgtgaaggagaataaagcaaccctaataatgttaattgttctcagaactggactttttttttcctcccctcaaaattaaaactctttttcttttggatttaatgaagtattgctaactgaagccagtttgacttgtgagagaggttagactgacggaaggtgtgcagcctgatttacaaccaaaccctgaacccttttgaagaacaataaaacatattttacatgcaaaaaaaaaatactcattgctcaagtttggctagaagcaaaatatctgaatttattttttaagagaggttttaaacatttgtttattgtgtgtgtgcatgtgtgcgagagaatgtgccattgcttacagtggaggtcagaggacaactaacaggtgccagtcctctccagggtggccaagggaagcaccctgacctccccactccagccatctcagcggca

SEQ ID NO: 28585 - DNA, 1223 bp, Mus musculus
taagtttaaaagagggtagttctcttttgtttgaaatggtcctactgtgccctgcctggcctggaccttcctgtgtagaccagtctggccctgaattcagaaacctgcctgcctgtatctcctaagtgtttgcactaaaggcgtgtgataccacacacagctaaaagaaagtaattttgaagaacaaagaattaagtttttggatgggtgtggtgtggtggcacatgcctttaatcccagcactccagaggtagaggcaggcggatctctgagtttgaggccagcctggtctacagagtgagttccaggacagccagggctatacagagaaccttgtctcgaaaaacaaaacaaaaaaaaaaaggtgactcacagttgtcagatggttctttttgttattgtgctgcaaaaaataaagaatgtgacagtgttctgtatacttttttgaaaacgtgcctctctttcttgattctcttttcttgccctgaaagaactagctcgaggttctgtctttgtttatttgaaaaccaatatatctttgcatgtttagtttttaaagtagctaatgcttagcactccttagtgatttttttgtttaatacatgtggctctgattgtcctggaactttctatgtggaccaggctaactctcagaaatctgcctgcctctgcttcctgagtgctgggactaacagtgcgcaccactacacccggcagatcatgttttagttattaaaactaagcagaacttgttgcttgtgttactgcctttacaatcttgtcggaagtatgtcctatctggtggttcttttctgatattggttattgtctcagaatctcagcttctgcatctaagcagtaagaaaactaattcttagggagccacatcttagaattacataagataaaatgtataatgcctagcattagtaagtattccataattagtagaaagctgggtatggtggcatctaatccccatattggaggctgaggcaggaggatcaagtgaattcaagtctatgatgtatagccaagatttatctttaaaatcctcacaacaactagcaactacaagtagtactattaacagttgtatacattttgggtctgttaatgtgtcttatctgtgctttagaacttgaacttaaaaaatgaaaaccagtctcttaagaagaatatctcagcacttatcaaaactgccagagtggagataaaccgta

SEQ ID NO: 28586 - DNA, 1239 bp, Mus musculus
aaggtgcagtctctaacagtgagctttctaaagggacagacagtaaagaaggtgcaacaaaggtggagagtgggccaaatgaagcaaaaggcaaggacttaaagttaagcttcatggaaaaactgaacttaactctttctcctgctaaaaagcagcctgcttgtcaagataacccacatcaaataactggtgttcccgagcccagtggcacgtgtgactcacggtccttggagacgactggaacggtggcatgccttccttctggcagtgaacataatagagaggaaaccaaatcagagttaccagagccaaaggaggctcttttggcaacatctcaactcaggatcagcattccagaaaacaaaatgaaggaagaaaagaggttgttatttaaatctgttgagaatactgtgccttgtgaactgcttgcttgtggcacggaaatttccctcccagcacctgtagaaattgaacaagcaagatgcttgcttggatcagtggaagtggaagagacctgtggtggtgcaaggacagccgcttctgtggtgatgcatgtgttaccagaacatgcttctgaagatgccagccaagaattggacaccaaaagacacgatggtataaatgcttgtgctatttctgaaggtgtgaaaacaaaggtgattctttcaccaaaagcagctgcagccagtgagagccatcttgcacctttggttgaagaacctagcatttcactagtaaactgttcgggagacaataatcctaaacttgaaccttctcttgaagagaggcctatagttgagactaaatcctgtcctttggagtcttgtttacctaaagagacttttgtaccttcaccacagaagactgagttgattgaccacaaaatagaaactggagaatcaaactcagtatatcaagatgatgataactcagttttgagtattgactttaataatctgagacctattccagaccccatcagccctctgaatagtccagtgagaccggtatgcaaagttgttagcatggagagctcatgtgcaattccactgtatgatagcagtcataaaggtaatagtttatgttctataagttgtccttttgtcacctagaacaacaaaataagtgctttggagaattacaaaaattattcattgacattgtgtgtatatgtgatgtgtaaggggtttgtgccaaggaatgcttgagggaggaaaccagaggacagtcatggagttg

SEQ ID NO: 28587 - DNA, 1214 bp, Mus musculus
attaggcccatggccttgagtattcaaagcctgtattctactaatattgagctatagtcttagatttcatatatacttttgttgttcagaaacaattatcaaatggtgtagaagaggtgatgctggtaaaatgaaataaaaattattcagttaactgaccttttgagcttattttccccatgctgagagtcaatttaagtattaagccttaacattttgccttaaaggaggaaaggttattaaaataatactttgttgtgttcaggatgcaaatgtcaaatggctaatactcagtggtcatgtgattttaatatattcttctccacagatgagtttccatccaattcaactctttctaccttcaagagtcagtctgatctaaataaggaaaatgaaaaaccagttcccaaatttgacaaatgttcagaagcagattcttgtaagcatttgtctttagatgaattagaagaaggcgaaattagaagtgatgatgaagaatctgtagcacaaaaacgcttggaaaagagtgcaagacctagagtttctgctgaagtgcagccagggaaaagcagcccaggaagcaggaggagcactgtgcatgtgcataaggacaacgggaggactgctgtaaaactccctcgggacagactcacatggagcaaaagatcaagtgaatcaagaccctccaacaccgaaaggaaaagtaaaacaatgagcatctccagcttggaaaaaatacttccgcttatccttgtaccctcttccctgtgggaggttatgcatatgttacggttgctaggtaaacatgtaagaaaaaattatatgaaattcaagataaaattttcattgacacaatttcatagaattattgaatctgcaattttgagtttcacatcactagttaaatgccttgatttgtctaagatctgtaagtcagtaagtactttacaaaagagtctttgtgaagttatagaatctaaccttaaacaagtgaagaagaatggcatagttgaccgtttatttgaacagcaacaaacagatatgaaaaaaaaattgtggaagtttgtagatgaacaacttgattatttgtttgaaaagcttaaaaaaatcctactaaagttttgtgattctgtaaactttgaaaatgagaatagtgaaggaaaacttggaaaaaaatataaagagagaacccaacattcaaattgtcagaagaa

SEQ ID NO: 28588 - DNA, 1217 bp, Mus musculus
taacaattattatttgtgtgtgtgtgttctcataaagatctcctctgtgtgctttagtctgtagcctaagcacctggttttgcctccccgagattcagttgaacatttcttttttgttcctcttctgtgtctgtctatggctctcttatcagcagcacgtcaggaaaaattataacatgggtttttgtatctctagaaatcttcctcatagtgagaattcagtaagtgttctgtgagtacatttagtaattaccactcaagatgtgcggtgcttttgtgggtaacacctttggtgatttgccaattctcgactgttaactcatgatagggcctgggtcctcaacctgaaatggtttccatctttaggattgtatggcttcagcattgttttccccacactctgaggtaccaaaagttgtgtaagttttgcctgcagtcctgtccctgagtacaaataggcacttgactgcttgaatgctgatattgtctttcctcctgaaggtttgccctgcgctattttaaggacacctatccagtgtttcagagactcttccttgagagttctgatgcgaacccagtgcgctatggacgtaggcggatgaagctccgggacctaatggaagcagccaatatatttctacagcacaggcagactgtttttcgggaactctgggactggagtgtgtgtgttcctctcctcaggagccatgatgctttggtgcgctggtacgtggattaacctgtgctaacttgggggtgggagtgggcaaagacaaagaaaaactctttagatattgctgttggttatggtgttgactgtgtgtttgttgggtcctgggaatcgcagttatggacggttgtgagttgtcatgtgggtgtttgggattgcactccagtcctctggaagagcagtcagtactcccaactgctgagccatctctccagccctagatctttttgttctgttttgttcttaccccttacctcgatcatacagtttttcattagaaaaagattatatgcatggagtgtcgccctttttcctgctccactaaaggagttcattgtgcttgctttgtgttttatacccataaacgtgtgttgtggtggttaagattttacttttagtgtttagctggtgagtacttttgttagtcaacaggagggcaggagaattgacatgcttctgtttccttcaggcatacagctaactgtct

SEQ ID NO: 28589 - DNA, 1157 bp, Mus musculus
aggacacacgagtgccataacacgtggaaggcagagggccagctgcactgcacagtagtagattaatttattgctgtggcttgaaggcacctgaatgctgaggttttcagatttagcagcaagcacctttacccactgaactatttcattgcctatctcttaaatttaagtgaaaatgttacatttttttatacatggaaacataagttatttctgtaatatgtagaaaatggcataaatcaagttttttattatagactaccttgtgcgtaaaatgagaaggccaaaaataaccaaaatttggtaatactcagggagatatggtaatatcctattcctaggatgtgtaattagtttcatgttttataactcacgttgaatgtatttaaatagaacaaatatattaaaagtgtaagtaggcctcagtggtttacaaatcttaaggcactttgaagagccgtaaagcttttcagatttatactgagattgctctctgattgctagtctctgttcatgtatagcattacaatgctctttgggtgggttccccccccccaacagtatttttattctttgaaaatcccgtgcattttattttgtatgatgacctcctggcttttcccatctaactccttcccattcattcccccctttccttcctctggttttgtgtttcttgttttggtttttcagttttcttttctctttgagtctagtttgtttcccagctagtacttgcctctggttcttttgtttgataggtttttgttgttggtggttttgtttgtttagagaaagtattactgtgtagctcaggcttgcctacaacactggactctcctgcctccactttctaaatgctgtgattatgggcctgtgccaccataccataccctagctaggcctgttttctattaatattaaatgatgaatgtcatctaatcccttcttagaaagcagactctgggctctgttgatgtcgcaagcagtctataactgtatataccccccaccctctcatttcatgttcatctgatttttgtcttagtacattgagcttctggtaggcaccacacacacccctttatattacttgggaggaatgaaaaccagtttccaggagggtaaggatgaggagagcataaagacttggtgaa

SEQ ID NO: 28590 - DNA, 1186 bp, Mus musculus
gaagagagaatgtgggttggacctacaaaaccacaaaaactaatcggacttggaaagaatgacgtcaggtgggcatagaggactagactggtatacagggtgtgcttcttggtccggtcctgtagtgtgggggtaggtctgactgggtgtataggttagatgtgacatgggagaagcctggtggaggcctagaggttggctgcagaggaggctcaccaggctagacactggagcagggctttcctaatgctaggactctttaatacagttccccgtgttgtggtggccccaaccgtaacggtatgtttgtttctacttcataactagaattctgctactgttacgaataataatgtaaatgtaaatgtctgtcttctggtggtcttaggcaacccatgtgaaaggtttgttctcccaaagggggtcactccctacaggttagaatgctaccctagagaatgatgtgggacatactagtgtcttatacatgattaataattttcttacaggttcacggaactttatgtagaagaattagaaagtaaagaagacttacaaatacttattgtggattatctgaaaggactgaacgtgagcaagaacactgtgcaaggcattgtaaagtaggttgtcctttgcttgtctttgtacaattacttctgaacataaaagacccattccatgcagctatactttttcatgatttgcttttgtgtgaagaaaactggtagaaggatttgctttacaatggaaaccttacatgaatactttgagattttcttaaaggaattacttgggctggagatggctcagcagctaagaacactgactgctcttccaaagatcccaagttcaatcccaagcaaccacatggtggctcacaaccatctataatgttgtgacctctgacttcttctggtgtgtctgaagagaatgtgagcggcgatgtactcacatacataaaataaataaataaaacttgaaaaaataagttctgaattaaaaaaaaaagaaataacttagacaactaagactcactacctatgaaattaaataggtgctattatcttgattaattctgtatatttatagcttagtacttgaattcctaaatagtaagttgttcttttatcttttgctttgtctctttcctacttaaaatttgcatagtagctaaacagaaatg

SEQ ID NO: 28591 - DNA, 1196 bp, Mus musculus
tgatggcgcacacctttaatcccagcactcgggaggcagaggcaggcggatttctgagttcgaggccagcctggtttacaaagtgagttccaagactgccaggggtacacagagaaaccctgtctcaaaaaaccaaaaaaaaaaaataaaaaaaaaaatatatatatatatatcaaagaatagggtacagaaggattagaattagaatagatagtgagaatttggtgattttataaaattagatgtcgaagagaacatttaacaggttgaacaagagatgtttatagccttagctcctcctgggggtagaaaaaggccatgtcaattacaagtcttacctcttggaacattagattgtttgagggtcacagctagctgcagaggaattttcttggcatatagctatcaaatagtatttttgtttgtacagacagatatattttaaggccttggagtcattgattatactttgaataattcttgtcatttccttttaggtgttcttattgatgctatgagaaagggctactggattgtcttagatgaattaaatttggcacctactgatgtgttagaggccctcaacagactgctggatgataaccgtgaactgctcataacagaaacacaggaagttgttagggcgcaccctcgcttcatgctttttgccacccaaaatcccccaggactttatggaggtagaaaggtgtgtaacaatttcatgcaaagtcttttcatcaacatgagaaatggtaaaatcgttgttaggaatgagacatttggggattctttttctttttttggtttttcttgaaacgggttctctgtagccctggctgtcctggaactcactttgtagaccagactggcctcagactcagaaatctgcctgcctctgcctcccgagtgttgggattaaaggcgtgctaattgtaaatcactgctaattgtaaatcaaaaagaataggtgccttttaaaaataagattttaattaaagtgattgcatcacttcatttcctcctgccaaccccttccatgtttctttttccaatcctttctatgtctgcctcccctaattcctgcttaatttgataattattgttacataaataaatgcattatggatagattggtagatagatgcacaaatacttagataaacctgctaagtctacttttcgtttacttacacaca

SEQ ID NO: 28592 - DNA, 1165 bp, Mus musculus
ggccagatgttttattaaaacaaacgctttctaaattctgtgtggtatgttcattttctcgcttgttctagaagcagcctttctctcccaactctaactggtcttgtgaacagttgtcagtctggcagacctctgcttcttgtgggtctcatggttttgactgactcttgcttcttcagcttcctgacccagtggcagcagtgggtaacagtcactcttacttcatgtctcaacattcttcactaccaactgcttaagtgtccctttatttccacctccaggcttcatgcttctggcaggcagagtcaggaagcaggaggaagctgatgtaattcaagaagtccttgaaaaacatttcaagaaaaaattgtgtcctcagtctcttttttccaaagaaaatgttctaaagttactgggtgagtagacccaaacaccataggaacatgaatcatgttgtactcattagagcctacagttttattttgctttggtaggtaaatcgtctacccagacaactgtgttggagtctaagttcagccatgtagtgtggactgaaagcatgcggagactggcagtgctggtgggcagggcgctggaattcggtgaacccgtactgctagttggagacactgggtaagctctgaaactgtagctcattgagaagtcccactttactgtctgtgggatggggatacacctatagggatgggtgaagcacttagaggagtttctcttctcttttgttgtctgtttttcttttccctccctccctccctccctccctccctccctccctcccaacgcaagattttaccttcatactaaaaaagctattcaataggtgtggagagaaattgctggtgtttcttgcggaattcataacgttatttcttcctctccattgattgctgttggaagaatttaaagaatgaaatgtgtgtagatgatgaccttttgtacaaaccatctgagaggtgctgctgttgtacagggaaacacataaacctgagttgcaggctcctgagtttgattaggcttgtaccgaggtctgagtgtggctcatctcttgctgatacagtgtctctgactatgcatttggaacacatgctgctgcttaatctggtgtatatttctaataggtgtggaaaaactactgtctgccaaa

SEQ ID NO: 28593 - DNA, 1117 bp, Mus musculus
cgactctcggttgtccggagtgaagggcagatcctagcatactgcctcaacaggatgagcctgaagactagcagctggacaaggtcagtggaatcttccgtgtgttctcttgtatacattttggttttgctgaaaatagcgagcacagtgtagccctcccagcatttgtagccacttaattgtctagccatcatatttttactgtttgttttcagtttcgtatatttagaagtcctctgcagaagtagattcttctagactgatgagcctgttatatgctcatagaaagcaatcagaatgtataggcacaagctaggtctagaattcaggcctttgtcatgctgggcatacttatattagcctcaccccatccctaagtacacgtttacgtgtcttttgtcttttttattttttaaaatgtcatgtaaaaactgctaacttttcttgttctatgagttccaggagtcagcctcttactttacaagacttagagaatattatgcagacttgtagccctgacgacctgacgttcaatgcggtggaagtggatacttgctgggtcgatgaaccagaggttttagccacggctgttaaattgctcatagaaagagcaaccaatcaggattggatgctcagagttaagtggctttgtcatctagccaagaacataccgcaggggcttggtaagtagcagcgcttgtacgggtaagaaggggttacatatgttttccttgttcaagagtctcggcagacatgctagtctgtgactacactgttgaaagtattgctgaggaaaagcaaaaaaatgtgtgagactgcgttgtttagatagctattaaattagggtaatatttgccccttatgtatcaagaggaatgcctcgatatttcagggactgtcattttcagttcagaaggaaaaagtattgcatcatgttatttttttttaaccccacccctgatcatattactttttagctttgttatttagctttgttattttttctgagaatagtgttgtttttggtaattcatttacccttaaggatcttaagattctaatttattttttgtattggacagggtctcactatgtagctctggctggcctagaactc

SEQ ID NO: 28594 - DNA, 1092 bp, Mus musculus
tgctaagattacaggtttgcaggaccatgcccaacatggtgaatatcctttacagacagtagtcatggtttattttgttttaagatcttaggttctgtgcagtggcgtgaccggttttggactgtggctgatacagtgacagtagatgcttcaggtctggctttacttgccctccactggcactgggtttcgaaacatttgatctatcagatcccccaactcctggtgaatcaggaaaacaagtaagaccccgtttcaagcagtaatgttaaaatataaaagaacattgaattgaaaacgatttcctcttgcttggtatacttctttggctttcctaattacattaacatgcaaaagtgtagacttctctttagtacccagcatttccccttgttttctttgaagatactataaagagttgcagacagtttccgagcacatccacagttgtctgggcagccctgctgacagctttgctggtgtaaagaagctgcaggcattcctcggacgaccattcccttttaaggtacacctagaaaccctaggtttctcctgaacctgaaagctcaagtagttttgctccaaagctaaccctttatttcttaagaaagtgctaccttgtattcacttaaggctggctagagcattattaacttaaagtctaccaaagcagctaggctactgaaaagaactgtttttcaactcaaagtctgctctctttgtttttattttaggacaagctggtagtggactgttttctacagctacaggcccttaacagagcccttgctatcggagaacagctgcctgtctttggggaatgtgggtggcaagaagacattaatcgtctccaagtggttgcttctgaatggaatttgaagaaaagtctcctacaggcctggggattgatcctcagagccaacattctggaagatgtcaatttaggtaatattttctggtatttggtttgctgagtgtcttctttcctgttgctcataaagtttgcccttaggactcaacttcacaagtatcagtcagctacagcattagatgtgtagaagttaatatgattgaacttggggaaactccaac

SEQ ID NO: 28595 - DNA, 1216 bp, Mus musculus
aagcaaataaatatttttttaagcactgagtttctaggaagtggcttcattgtagcacagtcatggtggtggtgttcttgggcctctcctctgataattagtaacttcagtttttagtacatttttatccttggcctgaccgatagcatgttttctgttaaatacaatttcttattaagaggcgttactctcagtgtttgttttcaagcttctttccagaggaatcagttttgttacttgtgactgtgactgagcctgtctctgttcatagatgtgctcagccctctccagagtaaccattctacctatcctgatgctatatttcattcaggtttttgtcttggcaatgtagcataactgtgtaccagatgtctacaaagttagagtcttacttaaaatctcaaaactgtgaaactgcatgatccctgccagttctgagagggaaaagaatgtcaaaaatctgctgcatttccagccagattataacatttgctaactctttcccccaaggggttttgtttacctaaagaattgatggaagattccgcaggagagggagcaacgcagttccatgactacgagggaggtgggatcggagatggcgagggcatgaaggatgtgagtgaccggatagaaaatgaggaacaggtacgttcgcacagcttatgtaagctgactcttgagtgtttaatcaaacttgttagtacgccaacagcatcatactgatctgtgtaggtctttagattaaaacctaactccaggacctttgcagctcagccatttgttacgataatagtcttggaaggattgacctttccagtttgatttttttttttttttaaagatttatttattttattttattatatgtgagtacactgtagctgtcttaagtcactccagaagagggcatcagatcttgttatggatggttgtgagctaacatgtggttgctgggatttgagctcaagacctttggaagagcagtcggtgctcttaaccgctgagccatctcaccagccccctccagtttgattttaaatggggacttgctgatgatttctgaagagtattttgatatgataattgtttgattttgttttgtttaagtttacattattttgtgcaggaatgggataaggcatacacatataataagtcaggagacaaattgtggagtgttttttggtctgtgtacctgtctataaacaaacaa

SEQ ID NO: 28596 - DNA, 1842 bp, Mus musculus
cttggaaaaaagaccccaaccagaaggttttccattgctcttcaaactcgacagtataggtatattcatgcttgtgaaattactgttctcaaaatgcaacccaatccctcccctaaaagcctacacgctgttttcccaaccctccaaagagacttccagaggaagtgaacgccacacatagataaatacgtttctttgctttgttgactatttatatcctagatctagtcatcatggcatatgcctactatcccagcatttggaaggcagaagcaggagggtcaggagttgaaaggctatcttaactacagagcaaattcaaggccagtcagagctggagagaggggttatcctaaaaatgatgtcagagtctaattgcccattcttttaatagctgtattgaatcccactgttgtatggctgttcctgggaatgagcattggttgttttgaggtttcatatttgcaaataaggctctaatgatctccttaattcctgcagagttttaagaggagacctgggcaggctgacaatgaacgttccgtaggtgactacaatgagcgtgtgcgtaagagactgaggactgtgggcacagacagagagactgaacaggagccaacccaggctcaggtggaagatgcagacgcgttcgaacatgttaaacaaggcagtgatgcatatgatgcacaaacttatggtatggtgctaagaatactacgactttttctcacaaagcttttctctgaggttgtgccacatgactgtgcctgccagacaaagtagaaggggaagaaatatctagctatctctcaatacatacttttataaggtacatataacttgtttctggtagcaaggtaaccgtagccaagtgtaaatgctcagggttctcggggtaagccctctatcctcatagacagctggctagatgctgtaaacctggtgttgaccttgtttcttggtattgaacattgctgagtgtccttgaacagtgaacatccataatacagatggggaagatgagatcacacttcgcttgtccttacattcctctctttctgaggtacactgctatgatatgttcctctgagcacagaacagaaatgatggcagtgctttgtgtctctatgtgttcccaacaccaaagaagaagttgatgagtgtacgcatacttggtcaagatcctccctgaggctggagcatgggcttgttccttcctcacattaggcggtgtgtcatagcttccaatatggcaccctataaacttgtgacactgagtgacttgaaggtggtggatgtggatggtgaatggatcctgaattctgcttgttaattcagttgataagagtgcttgcctaggggggctggcgagatggctcagtgggtaagagcacccgactgctcttccgaaggtccagagttcaaatcccagcaaccacatggtggctcacaaccatccccaacaagatctgactccctcttctggagtgtctgaagacagctacagtgtacttacatataatcaataaataaatctttaaaaaaaaaaaaaaaaaaaagagtgcttgcctagggttggagaaatggctcagtggttaagagtactgactgctctttcagaggtcctgagttcaattcccagcaaccccatggtgactcacaaccatctgtaatggggtcagatgccctcttctgtgtgtctggagacagcttcagtatactcatataaataaaataatttaaaaaagaaaaaaaataatagctagcatgcacaaagcgttggatttgttcctaccactacataaagctaagtacggcatctgtggtgccggtactccagag

SEQ ID NO: 28597 - DNA, 2144 bp, Mus musculus
aacttgttcagaagtgtagctgcaaccctgtcctggggtgctggtgctcagtgccattcctttcacaaagctccacacaaccctgcaaggtgaagaccattcttcccaacacagaatcgtgaggaggagagcagagagtctcagatgcagaaagcaacgaggaccctgagctcctttaaaaagagacggcctgtagcatacatcctagcagctggccgactcggggtgtcagggagcatatagctgcaggttgcactgatcctaactgactggcaaggcaagtggggattgctccatagaaagtagagacatggatgcaaggaaagcagcatttcttacttgttcctcttccttgaacttctccatggcataaagagctgccttcttcataaacattttggaagtttctcagcttttcttgtcaactaaaaaggtcaagaactagttaggaaactatttaatttttctttttctttcaaaatgtcttttgttaacaggattctatcttggacattaaagtaccaatatttaaaggaccaggagagatgcctgaaatccgatcctacatggaagagtttccatttccattttacatcattcttcgggatgtgaacgcgcttcctgagaccctcagtgatgcgctcaggcagtggtttgagctggtgactgcatctgaccactcctagagcagagcacagtctagtgaggctgtggggtcactggagctcccttacacagctgtttgtgaactcagagctctgattctacttcatcttggacctgatttttcttttttactgtatccaacagttataaaaacatttttattgcactatacatttgtatttacaacatagaagagcttagcacaagctcttggactccctgctgtactgactgagcacagacagctcacaagtagtaccagggctcgtgactagggaccaggtagaggtcacactgcccctttagagctcagccactcgctttcctctgctcagtaccttgaggaatgaatccaggaacacggggctgcactctggtccctgccttaagctctacatagagccacttggttggacacatcttaccctgctagaaagcagggtacttagatggtgtgttctcataaagcagccagcaaaggtgaccgcagagctgcacaaaactgaagcagctttttgtgcctcccagtggctgcctcaggagcctatgcaataatggacaggtgattctccctcatttcattcttgggctgccatagcccctgctgtaatttatttctttagccatccttcccccgatactaagaggaaaaattattcctcatactgctttcaagctatcctaagccagtgtcactgtggaaaggagcgaacggatgctgcgtccacgagaacttgacagctccatcctcccctcacccgcacagcacggtagtgttaggcttggttcccttgggcctgggggcagttttacttggccagaaagcagtgtttgaatacttgaaatcatgtgttgtgttctgtttaaatgttgtttgtagacattgtgctgtacacctgtctccatgtctgtttgcagatgacactgtgaagtgtgccacccttatatggtggtcatcaaagacagattgctctgtgtttaacaaagcgtcctaaagcatggacttaaagttattttattttttattccaaaatgctatgcagcttatattctgaaagctattaaataattgttgagttaatctttgatcagggtttactttggtttggcttggtttggtttttttgagatctttgatcattcttaatggcgtatgaaaaatatgacaggattgaaagagtgtgcttccgattgatcctacttgctaacccaaccatgcgagcccagacttgtagctcagtattgcaaacgtttatgcctcactggtcagctctgtgattcgtgagttgcagcacgcaggcttggtagcgagggaaacggggtaagttggcagaaccacgtgggtggtataaagattctgttctgtgacataacccttcactcacacgcactggctacagttgcactcagcatgtgtggctgagaaagagtcccaaatcctgcacttacaatgatttctttcccacagggtagcgctc

SEQ ID NO: 28598 - DNA, 1311 bp, Mus musculus
cagcacatctggctttgtattgtgtagcctagcgtccagctttccacttcacactactgtttttttttggggggggggggtggatggggggagtgccttttggtgacaggattgaatgtagtgccttgggcattggtaagcccacagctacaacctgtaacagccactgttggttcttgactgtaccagatacaataatagaactttgccgtggttaagctggtaaaacaatgactagattgtcctttcctccacaggatacaatccgaatgatgataacccaaggcaatatgcagctaaaggaactagaaaggacgcttgccttagccaactcgtaactggaagatttttcatgtgttttgcacaggctccgagccactgtcatagagcacccaaaaaggtgataatcactctgatcaagaatataagtgaagcgtgttaatatttccactacagtccgtggctgtaataattaaacgtgaactaatgtcaagatgagaggttggaatcctcaattgctcagagggaaggtgaaatggcagcccctttgaaaaacagacgactagttagcaattcttagaaaggcaatgaggacagggctggtaaagatagctcctcatgaagactcttgctgccaaggacagaagtttggtccctgtgacactcatatcgtggaaaaaaaaaaaaaaccactccagaaagttgccctccgacctccacacaggcactgtggcacacaaaccaaaatgagtgtatgttgtgatgtgatcacaagctgttacaaagtcagatgcaggactggcagtgtactgccctagaaaagtgattctcttgctgtgggtcatgacccctttggggccaaacaactctttcacgggggtctagtattaggtatttatgattcataacagcaatattacagttatgaagtaacaaaatttttacagttgtgggtcaccataaaattagagctgtattaaagggtcacagcattaggaaggttaagaactggctagaaacagcgctagatcttgcttgaataacctgctttgtccttcagagttctgaagtgactttcttcaggtgtgacatggtttgataaccataagactgaggtctcgcggagctttagtggaaatagctaagaacaccaagaagagggagcactgggtgggcagttcagctcctgcacctaacatcctcatgaaatgatgaatcagagcactgactgctctcccaaaggtccagagttcaaatcccggcaaccacatggtggctcacaaccgtctgtaatgagatctggtgccctct

SEQ ID NO: 28599 - DNA, 1592 bp, Mus musculus
agaagtgacctttgtgaaatagtatgcatttatccctttgtcaagccaagttcttcctttttcttatagtgacactccatggatgtagacattcctggaaacatacagggtagatatatgagtacagaatctagtgaggccagttatttcatgggactgacccgtcctcagcctcttgggaggtgcagatttttcccattctccttcactggagtcctgtcctcagctcacttgccccatccctgctatgacactccctggacaaaatgtcactggacctgcctaatactaagtaagagatgaaaccccgagttcagcaagttatgctccaagcaggagttattttcactattagaatacttattacctcaagatacccttgacaagaaatgcagacatcaactgtaactgaacatcaaatctagaccacagactaccttggtggcagtactttgatgctatacctcctacccatcagaagcaggcagcttatcactgtgaatggatgtttttgtcaagtcattaagcataaagccaggctattgaataaggccagtcagccccttacccacagggttgacttctaaggaagtggtggttggcttgttttggaaggctctactgtgtactctagactgtctcagccacctgagttctgggattaaaggagtgagcatggctaatcctgtgttgtttgtaacacccgtcttaggtttgttgcaattgtaaagcactgaagatcagctgtgtcttttccccttgtgctatgtgcaaaaacaagcaaatatcccagctgtacttttacagataactgtttatatcacatactctcacatagatcatgcttcaaactgaggcctaggaagcatcaacagctgtggagaaacatgttataaaacagtaatgttgtatattatcaatgtcctttttaaaaacaagtaattgttagcacatcccttagactgtattctgagtatctgtgatggggtgaaagtgttagtctagcatcgctttttatttgaggagtccggaatataggtttttcatgtttagatttgtgtgtgcaaggcatgttgtctgattttatcacatggaacttgtgtctcctatatgcattaaatgttgttttcagttctgctagtattctactttttagtcattagttctgcacattgcactctagagttcctgagagagcctgcacccagccactttacttacttagagcaaatgcatccagtttagttaacatcaggtgtcttccaccaacacaaagtgggtgcaatctgtgtgtttgtggggaatcctttaatgttaatgcaagcatattaagtccactagatataagactaaataatagcacctctaaaaagaactgtccctcaaagataaagggaaagttaggtagagcattaacctttcccttggaaatcagttcagccgggcagtggtggcgcacgcctttaatcccagcactcgggaggcagaggcaggtggatttctgagttcaaggccagcttggtctacagagtgagttctaggacagccagggctatacagagaaaccctgtctcaaaaaaccaaaaaaataa

SEQ ID NO: 28600 - DNA, 1126 bp, Mus musculus
gttttccttattactattgttttgttttgacagctctggttatcctggaactcactctgtaccctgagctggccttgaacttagagatctgcctgcctgtacctactcagtgctggaatggagggtgtgcaacagactatcaaatgaaatcaaattatataccataaaatccactgcctttcagtgtatttacagttgcaacccatcatcataatagaacatttcatcgttcctcagtgaagcccagggtctgctacagtaatttccactgtcctactcaactgaaatcagtttctgtgtttgccttttctgaacagatgcatgtaaataaagtatttatatgcaaattaagttgttattgactaagttacttggaggccaaggtccttgctttgttctgctgaagctctgctgcattgcacatagtaggtgttcagctctctgtagggtgaatggtgtggaaggcagtaatggagtttgggggtaggtataactgggagttgcttagattgccctgcatgaagaatggaggtagcgttagagtgaccagctgccacactctgttgcctgttcatctagattttagaaatttctatcttagctttttatgagatgtggacatttacccagcaagggccaccctggatgtggagtgtaaatcacaaatagtaacctactgtagcgtcaaggtcatgagtgggcccaccatagcccagcttctccttcctctgcagagtcttcccccagctacactttcctcaggccctccccaggttccttcttctccaaggaagcttgactccctgtccagagatgagctaaagctctcagaagcacacatacaggcatcaggagagccctgctggcctgagcatctcctatcccatctgcattcccaggcctgagtcaccaggtgctgttctgtagtagtcacctggggttttcaagaccacagagggcagcgtagagaagtggttaagagccgagcagaaggctgcatcaggctgagctgtttgcagctactgccctttggtagctgtgaggtagtggggactccccagctattcattttctatctggaaaataagcatgtgaataagtcagaggtgtgagtagacttttgagg

SEQ ID NO: 28601 - DNA, 1457 bp, Mus musculus
acaaaactcattttcttcactcgggttggcatatgtccaccagttatctactgctatgtaacaagcacccccaaatatccgtggttttaaatagtaaccatattatttgctcatggttcctatgattggttgtataaggttcaacttcaatagcaagtctgtttgctgtgtggtatgagctgtaaacaccacctgattaaagtttaggctggacaatccaggattgtcactcacaagcctggtctctcaccctgtatgggcatggtgggttgaatgaaaatgacccccataggctcatatatttgaatgcttggctcctagttagtggggtgttaggaaggatttaaaggtgtggtattgttgtaagaatgtaaattctcgttttttcctcagctgccgccaaggtgctcggtccttccgagggagctaaggccgcgttggggtgaggccctcacttcatccggcgactagcaccgtgccggcagtctacagcatggcttccatctccgagctcgcttgcatctactccgccctcatcctgcacgacgatgaggtgacggtcacggaggataagatcaatgccctcattaaagcagctggtgtcagcgtcgaacctttctggcctggcttgtttgccaaggctctggccaatgtcaacattgggtgcctcatctgcaatgtaggggctggtgggcccgctccaacagctggagctgcgcctgctggtggtgctgctctgtccactgctgctgccccagctgaggagaagaaagtggaggcaaagaaggaagagtccgaggagtctgaagatgacatgggctttggtctttttgactaaactgcttttgttaagttggccaataaagagctgaacctgtaaaaaaaaaaaaaaaaaaaaaaaaaagaatgtaaattctcagctactgctcagcaccaagatagcttgcatgctgccatgctctgaaccatgatgattatggactaatcctctgaaattttaagcaagcctccaattaaatgtttataagttagttgtcttggtcatggtgtcttcttacagcaataggacattaactaagacacctggcatggtaagagcattgactcttacgctctggcgttgaattagtcagggttctttagcggaacagaactcatagctatggtccagctcgtccaccaatggctgtctaccaatgggagactcacgaatccagaagatgttcagtatacaaggctggctgtctcagctggtcttcagtatatgctagagaagtgggtccaaatgccagtgaaggaatggacttgctggtgagggtgagaaacagcagcctaggagtatagcccacatcagaggtggatcttcccatctcaaatgggccagattcaaagtctgtctttgcacttcaaattatttaattaggaaaaaattatttactggaggtggtggtacacac

SEQ ID NO: 28602 - DNA, 2678 bp, Mus musculus
aacacacctttgcagtcaccttgtgcagacgggtgatttctttttggtgcagtatcttgtgaacctttgggaccagatttctaaaatgatgccaaccagtgtagagaaatatggatgtcgtctgaggagattggaacagatagcattgatttgtgtgggggggaaaccgtagaagcaatactgtacctgccgaggggtctaaaacacacaagccaagagggttcccagatgtaggcagaggtcactcagataagagatgcacgtgtgcttgtgtgtgttcacctcctgggaatggtgtgttgatgcgctatgttcagagaccttgttcaggaccaggttttaatgctccatgaccacaggagtttagtccttggtggctccatttgttacctgactcgttctttcatctgtaacaacatacctcatgtcctttgcctgttcctaccaagatcagcttgccaccagcttgctctgcaagacagaagacacagaaagcctgtggccggtgggaaaaaaaggaggcctagagacgtatgttagtcagttaactatgtgtgtgcttttatagataggtagggaactaagagtcctaaatctagccctatttcaaaccattctaagggttagtactgtcaggcgtgcatggcattagcaaaggttctttttaaagcagagtcccttagggatgtcaaagctggttctagctttgtgtctaaagcagcttgctcctgaagctcacttcttttacgcatcttcttcccatcttcttgcttccttttccccaaattctttattatttgagacagcgtatctctatgtagccctggctgtcctggaactcactatgtagaccggactgtccttgaactcagagattcacctgcctctgcttccccaagtgatcaaaggtgaacaccaccatgtctggccaggtcttacacttttggagctggtaactaaaactggagacgatgattgaaatgtaagattgagcctcccagtagtctgcacattattaaggagatttctagtcatcatggaaccatggctccttccttatgatttctatgaagagacttgaatgagatggtaggagcctggagttctaatcttcaggactattccccgacggcctctgccaacagagtggatggtggttggccacttttaagagtctaacaccactgtgcacccacacaaagacactagagagtgagaaaaagcatagttttctctttttgagtggggctcagaggtaactcaggctggcctcagacttgccaggtagctaaggatgctctccagtttctgaccgctcagcctcgactttccctaagtgctaggattataggaatgcaacaccgtgcttggcttgaacagtgctgagaactggacccagagctttgtgcatgtgaaggcaagcactctaccaatctagtatccccagcatcctttcttaatagtttttttttttttttaaacaaagaatttctctttgaatagacaaagaattaagtttttaataagactgtagtttcaaaataagacacttgcctgtctggtaaatcacataaaattagcatgtctaagtggcgcttccatttttaagctggttatatcatgagtttttgttgttgaaatgtgccttaaaagcctatcacttcaagagcatgtgattctttgagggataggcaggaacactcctgtgacatagggcccatgttcctgatcataaatgcactctttagttacaacactgattcctgcctcgagcctggtgtgacactgacctcttgaagatgtctgaatgtgactagaattgcgaaatgtcctcacatttgttttgtattttatcttagatttggggggttagcttactgcactgtagatctgtgtctatgctcaaatgggactataaactgaaaggtcaaactcctaactacggtggcttcagtagaacatgtgtttggttttaggaattgagaacttgaagatgtgtagagcaggcagacttttgctctctgagtcaagtacagcttctatgtaagagttgtgccgaattacttgtcataatggaggttagtgtgagtgacctgtacagagtgcttttgaaggagtagaaataaaagctgattaatagataccacgtgttattttgtgaacataatatattttggatcattaaatagaaaatggctaaatatcacagcagtactattaagtatgggttatttgtcaactgagtctgaaacagaatttatcaaatcaatggaactgtcatgattgacgtatggtatgcactcaacaaacacaggctgggtgtagtttgtaatcaagcacactgttttgctgttgctaggacttcatttgtaacacagtcttcagggatgttaactgccaacttgaaagcatgtttgtgtgccgatggcttgacgtaccccgtacccatagcttagttttctgggagcagaatggtctcttgttgaaattcaagatgatgtttactatatacatatatatacatcactgttttattggttatgttaggttcatttaataaaaagaagttttaaaaataacctcttgaagtggggtctcttaatggcattccaggctgatcttggatttctgggctcaacagatcttcctgcctcagcctgtcttcagttgggccacaa

SEQ ID NO: 28603 - DNA, 1104 bp, Mus musculus
caggctggccttggtttcaccatcttgtcttcactctttgagtgcagctattacaggtgggatctcccacacccagttaaaatgttgatgttgaaatgaatgtcaaggttcaagtggacattttgcaagtaactgagatcaacagttccctcatgtttaaagctgttgccagcacaaagcttatagttttaatgatttgggttatttattttaaatgtttgcatttctctattggaaagtatttgaaatgtcttgtatgtaactcatactaagacatttcattcctatttattgttttaaagaataaacatgttctaatggaaaagctgttcttagtgaaagagttaaaagccattgatgcagtcaaggcaggttaaggagtctgtgtgtatgtagttttatgttttatggcttccttgaatgttctactgctagttttaatatctccagggcaaacttgagattttgaaacctttgtgtcacattatgactgtcccctgactgagccagtcattgtggcaactggaagacgctgtcactggggccatggggcagccacgtacacagtggagcacactggggtactcatggtccaggcggctctcacagcataaggtactgagtactgggtaaaagatactgtagacttgggttttagttcactggactctggaaaagggtaagctgtgtctgaaaacaagcacattttacaataccgatatgaaaaacttatggcttaaaactatttccttattgttgttggtgaaggagtgtcagtgtggtaaggtaatactgaagaatcagtatccctcaggatcttctgaaagaagaatcgtgcccagatgctgagcggaaactgctgtccctgtgtctaccaactggagagaaacagccacaccaggcctctggctgctgggaaatgggctcctccacctcacagagctcaggataagctgggtttctggcttattcatcaggattgcttcctagtctccgaattcagatggttctagttaaatttgccttagtcatatttaatactctaggtattctcaaactgttaacaagtgcatgaacaacttttttgggggccgatttcaaaca

SEQ ID NO: 28604 - DNA, 1684 bp, Mus musculus
acaaatgccttttcctgtcacctgggagaggtgttacgtcaatgcattctagaatgagtaagctacacttagcagcttaaatgtaattacaatctgaaatttattttcctttaccagcttaattctaaggaagcttgaatatgggacctgtgcagtacaggtgttaaagttatgtttcctttttcctaaatgcctgagaccagcggtgtttcagattttagattaaaaaaatgttttgaaatatttgcatatatattatgtaatctatattttatacatatatatgtatatacaaacagggagggggaagatagagatggaacccagctagagctataaaaatccctttgtgtatcacatgggcctgccctatgcacacagcttgaaggacggtgtgctcagtgttttagtgtgtctgagagttaactgacctgtgtgcacaggaggccagttgtgcagttctcacctaggtcgtgccactcacagttggatttctggagcattttggtcagtcaacctggactgcgaactagtaagttgctgtgtattctgtgactgtagctaatatttagcttgcctcaaattttttgagctgatatttagtcttaacaaattctccttattggatgaactgcacaggaagtttttcttttcaaccacgtctctctatgacataaacgttggggtacttagggtaaagtagacactgcatgtgtttatgaaggtgcaaacagaaagaagggtgtcaagtgctacagttgcattgctgttgctgtttgtaaactgtgccgtctcagcgtttgggtgagtaaatgtttgcaaccactggagaagagtaaaggccctgtgtgtggtgctacatcctcctaggatttagttcacacagactatgccaggatggaggggcacctgaaaactgccctgggagttttggaggaagggcttctaaaatacttaaaaatacgtgaatcacttcagtctgtttaaacggaaaaaaatatttgataccaggtctttatatatatatataaatatatataaaagaatagttgtctcaagaggaataaaatctggagtgtaaaaaaaatgttaaaaaaaaagaatacttgtctcactttataatattttttaaaggaaaaaagaaaacgtttccaatagcttttgtgttctgtgagctctcactttttacctgaagcagtcttctgtagcatgtcccacagcatcagagtaacttgatggtgactatcatttttgtgcccattatcaggctccagtcatctgtgagaggggataaactaccttgctactaacttaggccttttgtgatctaatgacatagctgagggtggtgtgttcgggtatataagaggttagtatattcaaaaacaatctctgctattgtggttataattatttttgtagtgttttaatagatgcacattaaagtttgtaaaaaaaatctaaaatgtctgtgtgtttatctaatagcagttatttttaatgaaatagctaaaaatagagatttcataaaataaagcataaccacccaaatacaaggttacatactgttttcttactcaccaggagtgtagagttgggtcctttccttcctgtgtgaatgttctatttatatagcatgaattttaagactaaatgtttagactggacatggtaatacacatct

SEQ ID NO: 28605 - DNA, 1175 bp, Mus musculus
atatcatcaaattttagaattaattcaaaataatttgtgttttaaggtagtcttcttttaaaatactgtttagagtgaaggtatattaggagtagttgcatttttaattttgtttttccttttaagctattaaataagtgagggtggggtgtggttcaattagtatgacttgcttaccatcaggaagccctgggtcccataccagtactacatacagctaggcatggcggtacaaaagaatcagaatacttttttccctagacagggtttctttgtgtagccctggctgtcctggaactagctctgtagaccaggctggccgtgaattcagaaacctgcttgcctctgtctcccgagtgccagaaaagcatgcatcaccaccgcccagccgagaatcagcaatttaaggtcatcctcaggtacacattgagtctgaggccagcctgggatatgtgagactgtgccttattattttaagaaggcagctttggaatggcaaattacagaattttagtcccttaaataatgaaaattattatccaccttaatgtttaggaagattcttacctctgaagacgatgctggggccaagatatgatagtcaagttgctgaagaaaaccggttccatcccagtatgctctcaaattatctaaagagcctgaaggtaagaagcagagctctttgctactcctgtagtcttcccgtcttggttttgttttagggcttttctgtaagtgagaggtattatgtgtacacatggacacagaggccagaagacagtcttgggtatggtcctcaggcaccagtcaccttttgtttttgaaataagattttttatcgatagattcctttcatatatgtatgtatttttggatgcttctacagtagtagacttccatatgatttttgaaatggcctttagtgttagttgtctctccctatattccttccttttctcttttctcccctcttcctccccatttaattctcctgttctagtttctcttttatttctccgtaacactatactcttatctccccttctttgggagggtctttcctcactggtcccttactaggtacctaatctctgtggttattcagactgtagcaaacatagtgaaagcttaaaacaaataaccacgttataagagaacaacatacaatagttgtc

SEQ ID NO: 28606 - DNA, 1200 bp, Mus musculus
tctagatgaagagtggggggcatgcagtcaaccctctttgtctgtattgtacatacatggaggagggaaactgctatccagcttcagcctttcacagtctaggaagtgaacttcatctaaccttttgacacgtgtttttttgtggtatgtgcttaactattcttctagaattgtttccttaaggggcttattcatgagcaactgtatttatatcggatactcttcttcagtcaaataacaacagtatacaaagtgaggcagttaaagtaaaactataatgcatttcctttccacagcagtaaaattatgtgtttgtcttcattctattgggattatagtgttgaggaaaggagaatgtgtgaatatgatgatggttgagatttcagattggaatgtaatttcctaataaactatcattctctttatctgtaggtaaggtaaggcataaactaattcttagtgttattggatagccagttatgtagggagctatgattttaatgacttagcttttaaactcaacctttataatatagaatccattgtaatgtactaactttaaagaacttttaaagaacagcatatggggctgacagctcaggaggtaaggatacataactgctaatcttgatactcttattcagttcctggggcctatgttgtaaagaatggttgttctgatctccacatttgtgtagtcacgtgtagtgcaaatacatacatagacacacacaaatgaacaactgtaacttagaaaagaacaaggtgggagctgagtatggcggcttatgtatgtggtcctaggactcaggagactggggattgctgtgagttctaggttagactgtgtaaaatcctgtcttaaacaaacatacaaacaaaaccatttattgcagttttctcatataggatgcagttgaaatactagtttctagttaagttgagctcttcggatatctattgccatcaacatgggatattgtaatatttgtacttctgttatttctattttgggcagttgtggttgttttttggaataggacttaaattgtattctgagcttcacagaagtatcttttcactctcctagtgtcttaggtagggttttgttgctgtaaagggaaaccatggccatgcagctcttataaaaacaacatttaattggggctagcttacagtttcagaggtttagtccattgt

SEQ ID NO: 28607 - DNA, 1199 bp, Mus musculus
ttttacaatgcataagcatctgtattttatatttttgatactattataaaagtatttttatttcagtttctgaatgtttattgctaatgtacaaaagatgattttaaacatgttgactttgaattctatagtattattacagtcaattattggttcttatagtgatttttgtagattttatagcatttctctacgtaattatgtgatccactgaaaaaggctatccttgtctgatcttgggtgcatttcactgcagtgtcttcattgttctgactgcagtctataacgccaagctgaacagtaatgtttagagcagatatccttggacatcttcctatcctgaagggagcattcagtcttttgtcaaaactgtttccataacaatattagttaagaattgatcaagtgggcttgagagattgcagaggactagagtgtggttcctagcactcgggcagctcgtaactagctatgcctctggctgcagcagatccagcctctcttctggcctctgtgggtacctagacacataaatagtgaaatcatttgtaagaggtgagtaattctagttagcattgttgtaagaaatgaaagaaaaaatggggctgggagatgactcagcaggtgaaacacttcctgtgtgagtgtgagggccctgagtttggatctgcagcaccacagaaagctgggtatgctaggttgtgtataatccagtgctcatggcgagatgagaggcagagtactcaactgcaaacataggcaccatgtgtggaaagtgacacctctaccttcatatgtgtgctatggcacataggagagcatacttccatatttgaacgtgtgtgtctctcctgccccacatacacattaaatacacaccagagagggagggcaatggaaaaaaaaatagcaaggcagcaataaaagggaagatttgaactttttctttttatttgttattgtaactttgttaatgttttgttaatcccactggttaagagtaagaccactaccataaatttttgagccaaatttgaagtaagctttattaaatgctggccagggtgacagatactggtcaggtctatactcaggaattaccgtagaatggctacaaactgttagttccacgattagacatgcccttgttcttcctgcctttgcccagttggggcaggcatacatcctggcatccatgt

SEQ ID NO: 28608 - DNA, 1759 bp, Mus musculus
gtactggcattagaaattttctcactaacttatcatggatttcttatatttctcaattttttatattctgagcaatgacaaggtcaagtattatgtacattaaacagtttggtctggctataccattttaagaagttcttctggttttgttttctgtgagagtggggtgtaaaaacagtaatgaagctccattttcttgtgaattgtatcctttctttagaaactattttgagcattttactatgtctcgtgtttgaaccatgacgtcagatgtctggggttcccatcctggcagtggttttgagttcctttgtggcacttaccttcatgtgctgctgtctgggagcgttgctgctttcagacagcagggctcctcctgctttacccactcactgtgatccctgggaacagcagcaagcacaaccgcgttgtgttatttccctcaaacagtgcttcagacacagtggcagctttgcctagaaggtcatgtcagctgaacaaagtgttgtctaggagatgctggcctcccatggacagatgcagaggcgttgctgagactggtcatggaggacgtgaagatgttgctcccactgctcctgctgcacctgcgcttggaggtggtttccgatcctgagctgcacctcagcgttgactctggacagtaggtccctgccgttgtaaaacttgttctgattggcttgtgaaggaattcagaatagcaactagcaagcagcttacttaatgtatttattttagagacacaggttttaagtatatgtatttaaaacaaatgttcacgatctgtattttatatatgtataagcatatctgaaagtatatgcaacagtgtatattcttatattgatacagccagaaatgaaaatccaaatgctttacctagcaggctaaggatctgatggaatttttatttggcaaagtacagattaaccaaaactgtatttatatgaacctgagttttaatgtttttaaacgaactttacatctgcagtgcttttctgtatggaatactagggctgtgcctagacttatgccgctattgttcccaagttatgtaatatgttagcaagtttattcaaaatgccataataattttgtcttaggttgcttttgtacatttgggcactgaaggaatttaaacacctgactgttacaggattgttgaggggagattgtcaaggttccttctgtcgtttacatggtggatccagaactgcctgtggactccaggcagcctagtgcctgctccccagggtcactgaatcttttctccatagatggtctgctcccaagccggtgcaaaagcggggtccttttgaagatacagtaacgtgctttgtcagtgatctctgatagaattaaaatgttatggtaacattaacctttcaaatgaaatggaaagagcattatataggacttactttttcagcttatcctttcctttcaattgtggtgacgtaatcattggccttaaaagcagaccccatgtagtccccaaccgcatcacctcctggagtatccttacagccatttaggctgttggacgaaaggtaggatttggacatcttgaaggaaaacttcccttctcggcttatgttacaacagctgttttctttagctgatattttccagacaggactaagaagactgtttccctgagttatcgcatgggaaggcttgctttttgtttggggaaaaaaaaatatggatgactactgcctagatggttcctttgctttcc

SEQ ID NO: 28609 - DNA, 1189 bp, Mus musculus
tgactcctccggtcagccgggcccctcagatgagggctgctccccaaagagcacctgcagctcagcctccagcagcagctgcaacatctgcagttggctcacctgccgctgcgccccggcagccaggcctgatggcccagatggctaccaccgcggccggtgtggctgtgggctctgcagtggggcacaccctgggtcacgccatcactgggggcttcagcggaggtggcagtgctgagcccgcaaagcccgacatcacttaccaggagcctcagggagcccagctgcagaaccagcagtcttttggaccttgctctctagagatcaagcagtttctggagtgtgctcagaaccagagcgatgtcaagctctgtgagggcttcaacgaggtgctgcggcagtgcaggattgcaaatggtttaatgtaatcaagaaattcaagctgaagagatgtgacattggttctgtataattgatagtacaagtgtggacccttatatttctaacagttcattgctttggaatggccatggatgcttactgaggcttgtatgtagtgttggttactgggcaagtgtttggcctccttgggctgtgttgtgattgtgagttaaaaaaaataaattggttattctgaaaaaaaaaaaaaagacttcaaaacccacttccacagtgacacacttcttccaacaagaccacgcctacttcagaaaggccacaccttctaatagtgccactccctatggccaagcatttaaatacatgagtctgtggggggcaattcttatttaaaaaaacaaaacaaaacaaaacatagggggattttctcattttaccatctctctttccagatgccccttacttgttactgagttgataagatgaacctgtataaataagttaagaattaatcaggagatagcctaccagatgggggtagtgttaggtgcagggccactgtcttagtcagggtttctattcctacacaaacatcatgaccaagaagcagttggggaggaaagggtttattcagcttacatttccacattgctgttcatcactgaaagaagtcaggactggaactcaggcaggtcaggaagcaggagctgatgcagaggccatggagggatgctctttcttgcttcccctggcttgctcagcctgctctcttatcaccacccacaagggg

SEQ ID NO: 28610 - DNA, 1207 bp, Mus musculus
ccttggatgacgggagtcgtagtttctgtgacttctgggtaaccgcctttcaggccgatccctgcccttcacgaaaccccacaaatcccagaatgcactctggcgggcccgcccccggtgcgcaggcgccctggggccgcaggatttgaatcggcggcgttgttattgacgccatattggggccggcggcgggtggcagagttgttccgtggagaagagagggtcgagtgcattgcttagctctgtacggccgggctacctcgcagctcccgcgcgtggccgccactcacgagcttccgtctgcaccggcgtgtcggagatcgcgtctgggtcgcgccactggccgggtccacttccgaagggagcgggtctccgcgcaggagccccggcgcgctcagcccgagcgcacggcgggggcggcccggcctctcgggagcggccccgagccggcggcgcgaccctcgcgcctcgcccgcctgccctgtcgcggctccgccgtcccgggccccacacccaccgggcacctcggagggcccgtttgcccccgtccttcccggccccgcccgagccgagcctcggccgcccgccaccatggcgtgcggagccactctgaaaaggactctggatttcgacccgctgctgagccccgcatctccgaagcggaggcggtgcgcgcctttgtcggcgccggcttcggctgccgcctcccctgccgccgccaccgccgccgccgccgcctcggccgcggccgcctcgccgcagaagtatctccggatggagccttcccccttcggcgacgtctcttcccggctcaccacaggtgggcctcggccccggggctgccggggtgggctgcggccgggagcttgggtgcggacacaaagggaaggaagggcctgaaccgaggtgggggtggtgtcggcaggttgggtgggtacgagtcgggttggccggcattgtgggggtccctcattgtgaggcagatcatttggggctagatccctagaatcgtttccttatgtagagccccagcggaaatgatcagagagggtgatattattcataagtcaggcgagagaagggtcacatttcacccgaatctccgggtctcttgggctgaatcgattggttgcagctattaactcagtgactgagtggtttgaggcgagaaggcagcccctcctccattttagacttggctggtttt

SEQ ID NO: 28611 - DNA, 1099 bp, Mus musculus
gaatgaaaaaaactacccaggaggacttatgggtgaccccactaggcaggcaacagcagtaaccaatatcctaggatggggacaccaagacagagacagctaggatggatcagggggttcaaataataggaattgaatgagtaggacaagagtgcaggtagtgaagctttgttttcttcggtcagaagcaaaagggtaaagcctttcaatgatcaacacgtgtgagaacagtgaggcctgatgcagcaaagcaaccactagttagctgaccaagagcagcggggttggtgtcactgttgattaactacaattagatgcacatttagatccttaaaatcccttctgcttataaactagaagcattgctatcagtgggctgctatggctactgctcggtggtgggatctctaagaactaaggtataatgggaagtctgcgagtgtggccgcaaggaaaatgggaggatccaacagtcctctttattcttttgcttcctggctgatgagctaacagtttagctctaaactggactctagtcatgtcttctgcctcaactgatcatacgccttcaaaatgcaattgaaataaacttcctgactagataaacctgagtattttattgtagttatggaaggctaattgaaagaaacagcagcaaaactgagtttggctttggctataacaatcaggagagattctggtgaaatgctacacagtaaggtgagcagaatcttgtttagagatcaccaacgtcagcactgaagagaggcaaggagatcaaactccagcgttgaggtttatgcttatttgtaggtaaaaattcaagagaacattaaaagtgaaaggaatcaggcaagtatcttagaagccaactgaagactttgaagctcatatatgaatagagtaaacaatgcggtaatcttaggtaacttggttaattgaccgagccaagtatcaaactgaccagtaagcgggggaaaaagccatatgctaatactttataatacggactccataacatcactttacagtcttaaccaaaaggcttaccccaacactaaaactaaacattaataaagttcacaagtgaggaacttgc

SEQ ID NO: 28612 - DNA, 1098 bp, Mus musculus
aattaaaacaaggtaaccacctccagtgcagctggaaggaagagaaagatgcctaccttctgaaggtgatacaggtctgtcttctgcagcccctttggctgtgatccacaggcatcctcttcctctttgctatctgctttgaatacaacagagaatagacactggaagtagaatttatacttttttaaaacatgagcaagacaggcagatgatgctccttccagaagctgaaggcaatacatattacattgtttatatagtagtgagatcttcaatcactagctactgaactcaagcgtttctagccagcagaacaaaagcctatataaaaatatcatacagacttgaaactatttccctttgattagaagcattccgatccacctgcgctcaaccttccactgtcctgcttttgattcattaccgtttagcataaggaaggaggtgtataaaagctataaaagtaactctaggaagaggtccccctaactgatataaacgtatggctatgctgcaggaggatgtggtactcgctctgacttgggaacctgacaatgatttggttcaaatatgatataaaaattagctaaagaatgtatattcttaaagaaccagaagataactcttgattttagaaagttataacctaaggttaggataactgctagctaaattctttattttattccattccattaccgtgtttaaaactgattataacacccagcctgatttaaccctctccaatttaattctaaattaaaataaatatgccaacagtgtaaagaaaccataggtggcaaataaccaaatatttcttcttgtgaaaattttaagtatactttgttattaataacaattggttttttaaaccaagaaataaagacaaatcagcaggatggtgttgttttgattcataaaacactattctttatactgttgtcaaacattttaatcttcagccttaccatttgaaaaatgataatcacttaatgctaatttatcataggatttgttcgctaggtcacattacatgaactctaattaaaattatggtatctacagtctctttatgtccttaagagttgcttctcattg

SEQ ID NO: 28613 - DNA, 1199 bp, Mus musculus
ttgcactctagcagtagaagccctttgtttctgtttggttgtgttgatgtgaaatcatgttgagtatgtttaggataatgatgtaaggaaggaatacaatgcttctgagtgatgttcattagaaagatatcttacatatgtataaagggaagtatgtgtgaaaaggaaagcaggaatttgatgggaaaccataaggaagactacatgaggctcaaagttggtgggcttatattcaatgctagttgacacactgttgtataactttggtagtctaatctcagcaggagcatttggtctttctggatctctattcttatttataagaaaagcattcattaatggcttgatttcaggattagaatctggaaagtgattattttattattattaatattttttattttttaaaaaatgaatgacctggaaaacttaatattgtaaaataatatattgaaatacacttgctgaagaagcttcttttgtattttcttttaaaactagtcagcatctgcatgagtttccgctaattctgatttttgggatcgccacatctcctgttattatccaccgactgcttcctcattcagtgtcatcgctgttgtgtgtagaactgttccagtctctgtcttgcgagcaacacctgacagtagttcttgataaggtaaaaagaaaaagtgcttaccaatgacagagtaaaaccaaagctaccagacatatattatgtataataaatgataccaatacatttatttctatgtatctcagactttgttcaacttatgtacatatttgaatgctcttactcaattatggttagaattatgttttctctttgcatatagttgccttctcagataaaaaataagctttatgaaagctacaatcatttgtatatattcattgttgtttttatgacttagttgaagaatttaggcttttaaaaagaatcaggggtcaaaatacagctcactaatagagtacttgtctgcagtgtaaagggaggccctggaaagtaggaagtaaatactaatgagtaataagccactgacagtaataaataaaattttatagaatttatatgcttcagagtattatcagtgtgctttgatcttatatccttgtataaaatgatctaaagctttcaggtttattttgatttgataggtatgcgtgttagtccacatatatatatgtgcacc

SEQ ID NO: 28614 - DNA, 1265 bp, Mus musculus
aactgttgataataaattagagccttaagtcaaccccagatggtaggttaaataatgtcaacaaaataattgtatgacataagaatcaagaagaaaactctgaatgaaatgctaaaacagatttaatttgggtgtgtttggtgtcaagttatattatttcaaaatgaaggactttatatatatgagagagagagagagagagagagagagaaagagagagagagatcttgtacacagagcatggaggtgccatggtatttttgtgtgtgtgtgtgtgtgtgtgtgtgtgtgatgtacacagagcacggaggcaatgatgcaggaccagagagcatcaggtgaaactataatattcaagcaacgaggtttaagaccgtgtctgagggttacagtgccaaagccatttctgtacacactgttctcttgttcaggtacctggagaggaaggctagccttcttctccagtccatggatagtactttgtccccatagcagtgaggatctagcttctcttctcagagtgaggaaggagtaagacagttgaacacacctcagggtgaatctacttcgtagctcagacactgacttctgggtgaagactgagaactctagtgatgcatttgtgccatttactgtctggttcctatttctttgctgtcagctgatatacttttcagaaaattttataagctgcttttatactttcttttttataaagtatggttacctgttgggctctcaatttgtgactttcagtgattttaaaatatttctataatgttaatggggaaatccagcaataaacttatttctaccacttttgtgcagttactttgttttatggtcatgtcattagggtaaagcaggagtattaacatgggttttttttttttttcctatgtacgaaattatatcagatcagggctttgtttgcaagtagactagaatctcttttttacaagccttgagaaaaaaaatatttttttttttttttggtaagagttacaggataacaaatcttttcagagagctatattttcaaggcttagtccctgtatgattttactccaagcttaaatactcattgatctaggagaaagtttctccagagaaacactgaggaagagtggacataaagcaagtcctaaatgtctatgtccattccacggttggtttctatcggaagcttaatggtgctctatgtaagcagaaaattagcaagtcacttacagatgtggataaatgctttctacagtaagaggtag

SEQ ID NO: 28615 - DNA, 2239 bp, Mus musculus
agccacgggcagagggcagtactgataactcatgtactataaatacatatcatttgtagttttattttaaatagaaagccatcaagcatgctgttgtgagctttttaatttgttgacatggattaacctagctttaaaaaaaaatgagaaaaaaagccatgacatttgtcatgtagaactttattttatccctatgggacttgaacagaatcaatacttcagttattgtaaataattgagttaagcctcaaatttctgtcacccagttgtcctttccatgaacgatactgaattagtgtgattggtatcttttcagcagatcaccattcatgtatagcagtactctttatttgtagatatttttgtatatatttattattgtaaatcatttgctgccaccagcagtctgtaagtctaaatgagtaaatgatacatttatatttgcaattttaattttaacaaagtgatcaagtttttaaacttttattgttttaaattaagaactttttgaactaaaactagaactgccatacttaatttttttttaacataaaacatttacaagatgatatcaaggtgttttgtttcgcacggtaggcacattacagcactctgctctgtgaatttgccatcctccactcgtggatggtgttcatgtgaagttagagcagattccttcatttcattcatatggctatagatttttttcctttttccattgcttctgatcagatatagttactatgagtccctgaaatgtaacggaaatgtgaataaagactttactacattgaagattttaaacattggtattttaagatatcctttgtcaatgtgatagaaagtagtagtggcgcagtgtaaatatgccaggtggtggtttgtgaagtagcccagtattgccttaaataaaatcacatttcagttcttcttttgtatgtgatcttataagattttttttccctcccactttctgagatttatggatggtgtatagctttaaactgtataaacttttgtggaaagaattttttagacatttttataaattttaaaattggtatcatccaagtgagcccatcttgtgtttataaaatgcaagaatccttaacatttatagttacatagatgaaacactttctataaggaagtattatgttttgattttactatttataggcattaggttgtgcagatttgtctgtcttcacattatctaatgatacgattttcattagattagtcttcaagaacagtattagtcatgattgattatttgatcattcagtaactagttcttctagcttagctttcttcaccgtttctgtgctgggaggaagtgatttctggagcactgacagccctcatggatagcagcacagctgaaatcaggactggaaacaaggcagcgttcggatatcgactttcatgtttgccatcaatagcattgtttctttgggggttttttgtttgtttgtttttccttttgttcgttcgtttgttttttgatatgttacaaaacatctgcgttcacagtgctgccccgacctgtggtggtgtggtcacatgggtgtgttccctgttctgcgtcagagtggcagagaatgaggcactaagatgctggtactctgaataaataagcatggtgaaagaatgaccgtaatttcttttggacacttaaaagtttaattattaaagtaatacagttttatttggggggcctaatggattgtgttgagtagttggtttcactttaaggtttcttttcagtatgcataatacttgacatattaaaatccttggtaagcccactgttatttattaatgttaaaataaaggtggttttcatggttgatttatattttttcaacaactgaataatgttttgttcatggggcattttcatacaattttcttaacgcttctaactctttaaatatgggtatttagcaataatatctgatagaatactgtagcaaagaggtttgttgccaggcatttatgttagccactgtaaagtgaaaaagccaatgcaaaaccaggcattgtggtccacacccaattctagtactcaggattgcctgcctcaaaacccaagccagcctgtgctacatatgagatcctgtctgcagaaacaaggacagaaaatatggaagagaaaacaatatattgtgcaacttcttccctcattagaagattaaccactacacttgactatattttccaagaggattgccaa

SEQ ID NO: 28616 - DNA, 1180 bp, Mus musculus
ttactgctaaagactattgaaaatggcttgtgctccaattcattcagtagttctactgaaccaccacaaaattttaccaataatagtgcacatgtttctgttataagtgggcctcagaatacaagatccagtcatttgaataaaaaaggaaatagtgcatctaagaagagaaaaaaagttgctcctgcagtaagtgtatctaatacttcccaaaatgtgctaccaactgatttaccagtgggccttccagcaaagaatcttccagtccctgataccaacacacggtcagacatgactccagattgtgaacctcgggctttggtggaaaatctcacacagaaattaaataacattgacaatcatttgtttataactgatgtaaaagagaactgtaaagccagtcttgagccccatacaatgttaacccctttaacattaaaaacggaaaacggcgattcccgaatgatgcctttgagttcatgcacaccagtgaattctgatttgcagatttctgaagataatgttattcagaactttgagaagactcttgaaattattaaaactgctatgaattctcaaatacttgaggtaaaaagtggatctcagggtactggtgagacaacacagaatgctcagataaattacagcatgcaacttccctcagtaaactctatcccagataacaagctgcctgatgcttctcagtgctcctctttcctaactgtaatgccaacaaagtctgaagcattacataaggaggatcaaatacaggacattttagagggtttgcaaaacttaaaactagaaaatgacacctctgctccagcttcccagagtatgctaatgaacaaatcagtagcactgtcccctactcctactaaatcaactccaaatattgtagtccagccagtacccgaagtgatacatgttcagcttaatgacagagttaataagccctttgtgtgtcaaaaccaaggctgtaactacagtgctatgacaaaggatgccctgtttaaacactatggtaaaatccatcagtatactccagagatgattcttgaaattaagaagaatcaattaaaatttgctccatttaaatgtgtagtaccttcatgtaccaaaacatttacaagaaattctaatctccgggcacactgtcagttggtgcatcattttacaa

SEQ ID NO: 28617 - DNA, 1182 bp, Mus musculus
tatgtatgggtgggtgggtgggtttctacagagattagaagttagactctggttgtgagctacgtgtactgggaattgaattttggtcctctggaagaacagcaagtattcttagccctgtgctgtctctccatccccttgacctctgctttataaaagggatatgaaaagttagaaaagtgaatttttttgttttacaggtctttgcttagtttttacttgtgtttttaagaatttctttctggttctttatacacccgttttcatatcaagctgactttaggcacaggtgtctttctgtgttgctattttaagattcaagaacagcacatgtcagtcttaaaagtccagtttaagaaagaaagagagaatctgtgcttgatagtgtagagtaaccttgatagtgtagagtaacctttcctgtattttgatagtgtagagtaaccttgatagtgtagagtaacctttcctgtattttgatagtgtagagtaaccttgatagtgtagagtaacctttcctgtattttgatagtgtagagtaacctttcctgtattttgcttgtttcacagactgaaggggctggactcgctacctgcatagaattatgtgtaaaagctcttcgcttggaatctacagaaaatactgaagtgaaaatatcaatttgcaaaaccatttcatgtttgttgcctgaggatctggaagtcaaacgtgcttgtcagttgagtgaatttcttattgagcctacagtagatgcatattatgctgtggagatgttatacaaccagccagaccagaaatatgatgaagagaatcttccaataccaaattctctacgttgtgagctcttacttgttttgaaaactcagtggccctttgatccagaattttgggattggaaaactttgaagcgccagtgtcttgctctcatgggagaagaggcgtctattgtgtcctcaattgatgaactgaatgacagtgaagtctatgagaaagtagactaccagggtgaaaggggagacacatctgtgaatggcctttctgctgctggacttggtactgattctggcctgctgatggatactggtgatgaaaagcagaagaagaaagagataaaagaattaaaagatagggggtttatatctgctaggtttaggaattggcaagcctacatgcagtattgt

SEQ ID NO: 28618 - DNA, 1178 bp, Mus musculus
gtgctttcctttgggggtctgtaacatcattggtagttctgttcatctaataataacagccttctggataggctttaatgcagacaatactttctttatggagctgttatttggggagatgctgtaattgaaggcctgctaggggaagggtctatccctgaggtacaccctaatcctagataggtagggttttcattcttgtgccttgttagatgttatgcacacagactttgtatttttatattacatagtctaaagtccaaatgtgactcaaagattttctttatatcacttgtttaagtattatgttttcttattaaaagacagctactctgagattgaaaaattctgattaatatggtaagaaactgcatctgatttttattctgtagaaactcaaagaggctatttatcttgtatttagacataattttatccagagaattggaatctaaagtcagttttaatttcaaatgtaatggctacattaatgcacaatagattattctatgattattacattactcctgtctatccttcaaacttttttttcaaagggaactcactctgttttggagtaaattgcagcaaagggtggaaccatcagtacaagtgtacctggaaaggtgtcggcagctttccctgttaacaaagactgtgtatcacattttcttcctgattaaagttattaattcagaggtaaggctattcaagctacttttccttaatttaaattgtctaacttgtctttagtaagatcttttcttttgttattttgacactttatttaatgaaaatttttttctttcactttagcgttttggaccttgattttatttgtgtgtgtgtgtgtgtgtgtgtgtgtgtgtgtacacagacacacacagacacacacacactaattaatcctttgaaatatttgatctagagaaacctagctgttgatacaaaaaccgtcctcttacctaccatctgtaatatttcctatttttgatttttggtgtcctagtgtgtgttatagtgctttgggagtttagctctatgcaagttcggaaagtgtatagaggaatgtggaaattattctattgctgacagtggtcaaaaacaaaaaccaaccaaccaaccaaaaacagactaaacactcctctggcacaaatacttgataaaattaagcaacg

SEQ ID NO: 28619 - DNA, 1320 bp, Mus musculus
tcctttctgtgctctgttctcttggctgtgctaattccctccctctccagtgttacctgttccttagagtattctctgaagaactattttgtttggacatgaattcctttagtttgattataccatagaaagtttttctttctccttcaacgatggcatgacttctccatgtcttcaaaacaagtatgatttgggaaattgatacattcccgagtttggctgccagcataagatacaaccgtgttggagacatattggaaacatttttgttcaaaacagttaggaagacatcattgactagtcagtatatgtttttttttaatttacatttgaatgttctattattccttccaaaacagacacttcttgaatatgcagagaaatggaaaacttccgaagaccctttacctttgctggaggtatacacagtggccatccagagctacgttaaagctcgaccataccttacctctgagtgtgaaagtgtagccttggtgctggaacgcttggcattgtgagtagaactttgaaaaatgaatcaaacaccataattaacttttccttaaactttatggcccaggtcttataatatttaatttaaaatagatttatttaaaataactaataaagattctaacagtaggattattgatttttgtcttattttcaataatcatttgtatccgtttctgttttagaagctgtgttgaacttttactgtgtctgcctgttgagctatcagataagcagtgggaacaatttcagaccttggtacaggtgagattacttacctagttaccacagatgtagtttaattggatttgcttatttgattaaaccttaaagcatctaaatgctgtgtttatttactgttgtaggtagcgcatgagacactgatggagagtggcagctgtgaactgcagttcctagctactctagctcaggagactggggtgtggaaaaacgcagtgctctccactatcctttcccaggaaccactggataaagagaaaggtaaatttccagagagagaaagaagcaaaaggtcattagcctatgaaaaacaaatatttaaatttgtttggatataactcttctcaagatatatcaaatgaggcccatataattttacctgaaggccttaaattaaagccttacaaagttttgtgggggaagatgtatttataggaatttagaataacccaaattacaatttttttttctcaacttcttttcatcaggagagttctttgtgcagtgctctggcagatagcagtcatttatatgtactgatgagttcatttaacagatggaaatcag

SEQ ID NO: 28620 - DNA, 1176 bp, Mus musculus
cagcatcatgtcttcctcctaggatggttcattaagccccacttaaagcattctactgctttccaaatccacattcctccaaagaaaaacatgctcaggcctatagtagcaatcaataccacattccctggtaccaacctctgccttagggttttactgctgtgaacagacatcatgataagacaacttttataaagagcagtatttataggggctggcttacaggttctgaggttcagtccatcatcacggcaggagcatggcagcatccaggcagacatgcactagagaagctgagggttctatctgtatcttgttctgaaggccagcaaggaagcctgactcctcaggcagctgggagaaaggtctcaaagcccaccccagcagtgacaaacttcctccacaaaggccacgcctgctctaaccaggccacagctgctaagagtgccactccttgggcagagcatattcaagcaaccacaattccaaactcctttcccttccccagcagcttcggcacagtggggctgattgttacgtggtcattctccgttgtgaagttagtaagatgcccctcaagacttcggtactcaagtggatttcaaggattctagaggctgtgtgctagaaactgaacatgaaaccaggagtgctccccagccccaccagtaactgcatgcctgtggcaggaagtcttaagagacctacaagtcaacagccctccttagagaaggtttgtgtctccaagttaccagttttcttgtgtagttgttttgtttcatgttggtgtacctaggaactaatgctagtttgtaattgcagtaatgaatcaccatttgtagttctttttggtttttgttttttaatttcttaagcttcccacttcattatttatctgaatgatctagctagtcttaagagactggaggatataaccagtttagatctatgaaaaatgaaaagttactcttttatctccagggtatttaggaaatcaataataagaattctgaaaaaaaaattaaattggaatgacacaattctagctgagctatgttgtggctagaatagcctaacctcagtgtacgtcctgaatagagagagccagtcctcacaatttaaaagacctgcacccccctgagagtagctttgtagaaacgtgactgcccttcagaa

SEQ ID NO: 28621 - DNA, 1168 bp, Mus musculus
tattcagtggccttttcaggaaatgtatataataaagccagatgtgattctagtcctcacaggtgacgggaggaggacactaagtggaaaatgttctctgatactgtgttgttccagcgaatgttttgtaatgcatgcttttaaatcattacataagatgaacaagcacaaggcaaccttacagaaaacagcatcaatactgcacattaacaagacagaatcctctaatgcttgcatgtacatgagaccaggggagcacactgtaaggctaaggatttcctctattggattgaacagtgaaaaagagttgaagaaacaggctcgggagatggctcagtggttaagagcacagactgcccttccagaggtcctgagttcaattcccagccactacatggtggcttataactgcccccctcccccatgagttctgatgccctcttccacttgggaggcagaggcaagcagatttctgagtttgaggccagcctggtctacagagtgagttccaggacagccagggctctggctctctctgtagaccaggctgaccttaaactcagaaattcgcctgcctctgcccccaagtgctgagattaaaggcatgtaccaccatgcccagcttaaataagtcttttaaactttttttttttttaatcactggatcttctgacaaaatcagaaatcttaataagaaaaaattcttgaagagctgtgttgctctccagagatttccagatagctcagctctgactaaagaaagtttctaaagaagaacagttattgctttctgctagctcatctctggcagaccacagcccaggtttttatttacataacaatctgtcatttatccaggtttcctttcaattatcttgagaaccagcagccctggagtccagtcccttgctctccagagatagaaagcatacattttttttttcttaaccttgcaaaagaatgcagaaatctgtctgcttttgttaataaacttgttgggtgggaccctgccctgaaattaccatttccaccaaacctggcctaaccttgctgtgtcctaggctgaactagaactcaggaatctgcctgcctttgtatttttctaacaagctggctcatggtgtacctgcttttgttcctttagattcatgaagcctctcataattca

SEQ ID NO: 28622 - DNA, 1132 bp, Mus musculus
gtttctttcttactgtaagcgagctcactgctgaaccatcagaaaataatagtaataaattacatcatcatcatgtttgaaaatgctttctcataccctcctgctagtaaccagaacaccaccctatccgtcttcagtgtcaccagctacaggaccctgagcattaacaaagggcacatggttggcaatccgtggttcaaattcaaactctgcctcaaaaagttctttgtagttgattttcttttataaaaaaaaaaaaaaaatctacatgtaatcaaaaactacacattgcacttacttatcatggtcttcatttccattcatgtattatcctctctctctctctctctctctctctctctcaatgtgtgtggagggggtctgtctttcatgactggcattactaaacaatgcacactaatttgaatatgaaatgtgcccacattctgaaagattactattatcattatttatttgcatgcatacacacattgttttttctttcccttagtgtcttctcatttagacactttattcattgagctcagctcatgtaagataatctctctctctctctctctctctctctctctctctctctctctctctctctctctggtttttcgagacagggtttctttgtttaccttaactttcacagttggttgtttctctccaaaagagatgattaggaatgaaatggtttggtggctttggtttttgttttttttttcccccctgataattttaaagaaactatatccacaagtctgggcacaccctgagatcacaagcatatgtttttatcctaatagatactgatatcaaccatctcataagatattccaatctgccctctcaggaaaagataggaacttgggatgcatgctggaaacagcattagtttcccttctgttcccacaagcacctcctccaggttcccttacctctggctttgggttccaccagtggaaataatgaaaaggaaagattaaattactgatctagagtctttttctgcttcctcagctgttgatcttctcttccctggatgtttttttatttcttttcttaattaggaaggaccttcagagcttcttaacttattcttcctatctcccaaccatgccag

SEQ ID NO: 28623 - DNA, 1150 bp, Mus musculus
aatgtggaagtgtatgccagataaaccctttcctctccaagttgccttggtcttggtgtttcctgtcagcagtagtaacactcgctagaacagaggtcggtacaaggagagtgggttatttctgaaacaaatgtgagcatcttgctttggggaggattgtggaaggactttggaactttgggctagaaaagccactgggtattaagagcttagtggactattctataggagcttgcaagataagaatgctaagagcagtgcaaaagacagaagcccggcttgtgaagtttcagagggaagcaaagattgtaatgggccatttatgtaaagaatatgtgatatttggtcagttggagttaaatcagctgtgatgaacaagaggccagaagcactaaagtaaaacgtttgctttgctgggacaatggatgctggccagcatcttaactaatggttaagaagagaccagttatcactaaggtaaaagacttctgggaagtgtttccttaggaccagtacacagaagttgtgttccagaggtggccaaggttgtcccttgttctggttgacccccaaacttgatagtataagagtcacccaggtagtgctggttttgaaggcatgaaggggccatggaaaactgctgaggtctggcactaagtggccaagttggagtccctgaagagaacccaggagaggctattggtgaaagttcaacctagtcgcagcagaagacactagcattttggagatgctagtaccatggagtaaccaccagacacttgtctggtgaattaaagctggtctgagcctagaagatgatctgtatgtgctgcagaagacagagccctttggatgagctcagaagattgtgagtggatcccagacaatggacacttgagttttttatacagtttggctttgcttttgacttgttcagactatgactgtgccctggttctcccctcttgaagtaagaaagtatttagtttttcattttacaggaacccacaatttgagagattttaaacttctaaagtgattttggagttttagagactttgcacttaaaaaaaaaaaaaagagtctacatgtcttaaagatatttaagtactacaggacttttaaaacttggaatgttttatatcgtgat

SEQ ID NO: 28624 - DNA, 1428 bp, Mus musculus
tcttacagatccaacagacgcaaactcctgcctggttctcggtttagccagcttggattgagagctacctggtcccattgcccctatctgcggggacagggacaatttgcacttactcattagctccccaaaggagtagatatgcaatagggttgaatcactaacctctatgctaccacctcagcatagggcacacagagacgagccagcaaagaacaagagggcagcatcttttcttccttagttgtcatctatgtaattcacagtaccagtgcagtccatagggcaatagcttaccctccgcatcatatatcgagtcccataaggaccaagcatagccagtaattcaaggtggaaattaagcctaagcctctattagtttataaatgaaatcggagcactcacaagtttccgttccttttctgtctttaggaaggaacatgaggatcccttggagcccattcaagaggacgatggaaggagccatttagagtaaatagagtgaaaagtacaggctgccacactggggcctgaaggttggcagtggaaaagcctgctgggctgtgatctctcactccaaagtcccaagtgcctttttgcttcctgcaaaaggaaggaagccaaggaggagaccatgtccatcgccctgaagcaagtgttcaacaaggacaagaccttcaggcccaagaggaagtttgaacccggcacacagagatttgagctgcacaaacgggctcaggcgtccctcaactcgggtgtggacctgagggcagccgtgcagttacccaacggggaggaccagaacgactgggtggctgtgcacgtggtggacttcttcaatcgcattaacctcatctacggcaccatctgtgagttctgcactgagcggacctgtcctgtgatgtcagggggccccaaatacgagtaccgatggcaggatgacctcaagtataagaaaccaactgcactgcccgctccccagtacatgaatctgcttatggattggattgaagtccagataaacaatgaggacatatttccaacatgtgttggtaagtgcccgatggccttagagatttgatcatgtatcttttgatttaaaaagatgttttgtccccttcctccctgagctgagaaagtttgcacagtgtgagtcttacaccatctttgaatactagatagcacacattagggcttccctaatctccatcagctatatatctgaaaaagaaaaaaaaatctgattgaaatggtcggaggtcatttatagtctatctgtggttttgtggactagtggtatacattccatgcacttgggagaattgggaagatgttaattaggatctttttttggctttcttagggctagattccaaatccacacagcctggtgagctttttaacgtttggcaaattgacatgtaaggt

SEQ ID NO: 28625 - DNA, 1243 bp, Mus musculus
tagaagtggatctttctacttcagattaagttaaactctctcacaggtgtgccctctacttttggatttttggttctagatggagtcaacatgacaaccaaaagtaactattacaagtccacccaatatcaacttgatacacaatcatatctccttatgtcataattaatttccaaatgaaaacaataaccatgtcataaaaacacctaaacatgaataactattccacatacaatcagaaatgcattcattatatatttaaccaagtcctaattatgcctaacgtgatataactattcttcatacaacagcaaacatgataaatttacaataggtggcaatgtcttattcttttaatatctcaaacttaaatatgataaccattgatgttatcttaattgatgttatatcatatgataaagaaattgatgaaagaaagcacaaatgtctgtataaatgctttcttaagaaaataggacagaaactctgtcaattataatcatcttttctgcaactagtcatgtggccttagtatttataactaccttcctctgctaaaccattttgtattttctccacccttggcaagaacctcagcaggtcttggctcttttcctggaggagtgacccataccttcattccttacatgtatgtgccctttgtcatcctgcctggaccaggttgttgtaacattgactttaatcacaggacatcgtagcaccaacacatgccccaaaggatctcctgccctatagacataacctttcttacctccatagtggggaggcagtcccagtcctccttggtagtctgcatcagtcacgcctcctaacactgttattcctttcttagccggttgacttaagggcatcagaaggccaaagttgccagaggaaaatctgagcttccagttcaatgaatgtaatgttgttctaggcaagcagaactgaaggtctcaggaataggaagcaaacacttcccatggatcactacagggtgagagtgagtagaattattctcttttctaccacttgactcctggacctatggatcctggtatcaaagaaaatgtctcatatattgtacactgattcagagcatgccttctggaaaaccctgccccagcccttcatactgctgccatcaaattgtcacctgtgtcttcctggtaccaacttttgtcctggttagggttactattgctgtgaggaaacaccatgagcaccaaagcaacttggggag

SEQ ID NO: 28626 - DNA, 1133 bp, Mus musculus
tggctagcatcttaggtctgagcctactgttaccttcctttttcaatttaacaacttccctactattagcatagtctgagaaacctctctattgttgtgcttagtttattggcatgggtgttggctaaggtatccagtaggccaccattacagttattgttatcacagtgggcagttatgttaggcctgtggagacaaatgaaattacaaacatgtacccatctgctagggctatttaagaccatctgcaatagtttatcaaaacagaaatgtacatgctttcatttctccacacccctttgccagcagtgtagattgtttcaatgatgatactgcaatcaccagttacaggattaatctgacatattttctgctttatcattaaaagtaagtcttgatctttttttgacttttcaacaaactaaatgcaaggtgggttcaatactatgccatatgaaatttaatttttatagctagttgtaatatggatcattattgaaattttaaaaagtttaaattaaatttctctgtctgtctgtctgtctgtctgtctgtgtgtctgtctgtctgtctgtgtgtctgtctgtctgtctctgtgtgtgcatgtgtgtaccacagcatctatgtgtaggccagaggactagttttgaatgtcatttctttcatttcaaccatgtgatttggggatcaagctcccatcctcagatttgcatgacaaatacttttacccactgaatcatcttgtcatcatgttaaaatccttttttttaagttctaggaactgaatccaaggtcttgtacatactgggcaagtgtgttaccactgaactatatctctttaatacatacacacacatacacatacacactgtgcatatcttttgggagtcagatattttctaggcacgttttgatggcaagtagttttaatttctgaatcattgcaaaagccagagatggtgaactaaataaagtggagtcagcctagagagccattgacatatgaatatataaagaaaccttgacagggaacaggatacttcaggctcccatcagcaccctagaactaacactgtgacacagctctccacacccaaattccccctgccccccaaagagaactagtctctcag

SEQ ID NO: 28627 - DNA, 1273 bp, Mus musculus
actatgatggtcaactgggccggtctgttgacattacttaagccatatttttaaaccactatggtgtatgtttcgaattgagataacttcaaaaaaaaaaaaaaaaaaaaagaccagtggaggagaagcatcaggcctggttttgccccttttaaactgtcctttctagaggtagaaatatatccatattttttgaaaaccttgtcactctggtcatctcatggtctccatgacacttagcctcccagagctgtctgtgagtcacacagctcccacagacactgtatcttggccacaaaaacgccgtggcctgaggactcgctgcttttctcaagcaaaccagtgagttttctctttgccatctttgatttctgcctgctcctgcagctttctgcctcaactgatgggcttgggtgatgaataggggtgtgtaaatggggtgagttggaggtcttcagccttgaatggggtgtaaggtttctataaatctccctcactggagccccacgctggtgcttgtttataatgtatgtgaccctgactggttttctgcttaggagggttggcttctttactaccctcaagaataaagggtaatgcaaagaacgattgagcaaggtcttggtttctcttacaacactgtagcttgacctgtctgcttgatgtgcacctttgtaggggtcagctccaaagatggcgagcctccctgttgtgggtagtcaggtacctgcagacagacgatgccttggtcctaggcctgctgtgcaggagtattgatgtccctcgctgcagcagtaggcacagcaaatcgcttctccagtggatttgattggctagtagctaggaagtgggcttttgcagagatacccacagttgaatgggtttttttaaaccattgttgtagacaatgaaaaggtagtttgccctcttcatgtctatttcccttccagatagttgcatccagaagacagctgttttgtcccactctcctactttgctcctctgttaaaataataacaggggttgacttatgtcccgctcctgaatacatgtaaaatttgtacaaaaatatcttccatgaaaatgatttgtaatctgtagacattacttgggagatgtcttgagatgtaaaatcccatcctttaggttgagggtttttgtttttctccaaataaatccagtctttaaagttgaaaagaaagaagaaagaaagaaagaaagaaagaaagaaagaaagaaagaaagaaagaaaggaaggaaggaaggaaggaag

SEQ ID NO: 28628 - DNA, 1209 bp, Mus musculus
catccgtgtcttgagtttgtccctagagtcagacttggggacttaactttcaatggatttccaccgtgctgaaggcttcggcggatcacgtgcaccaaccaggtcaaaggtagcactcgtcagcagcttgtctcagtttcccagcaggtgacgggggccgtgtaccagcctcaaacctgcagatgcagttgctggatgggtaacatgcgaagccttgcagtttatacagccagtctttcctttctgacagggcagacagtttacagaagaatcaagacctggagtttgaaagaaataaagaacgatttgaatttctaaaggtatggagcagagttcagtttggagttctgtttggttttgcgtgtggggggacatgaggagaggtgtgcagaccgagtaaaagtgtcttcctgttgttcaaccctagtggggttcccaggccttttgcaacatgcggataatccctcctggctcgggaatcattcaccaagtgaacctggagtatttggcaagagtagtgtttgatcaggatggatgctactacccagacagcctcgtgggcacagattcacacacgaccatgattgacggcctgggagttcttggttggggtgagtcttctcccgcattcctatcaggtccgctcttacagagcatgcgtctcgctcaccgcctgtgcttgcgcggtcctcgtcgggagcatgcacctccctcaccgcctgtgcttgcgcggtcacagaggaaggcgctttctctgttttatctactgctgtatttccagtacctaggagtgaaatttgctttccatttgtaaaaataagctgaatgaagtttcaggacgttcgtataagtgaagatcaagtaggcatttgttaacaacggtgcctcctaaatctcctctctattaagtgtggtgttgaagagatgttggcacaggggaattcctggggaatagagagaagtgagtgtccgcaggggactacagctctctaccaggtagacgtgccggctgggctgcttgcctctagctgagggccagtgcggacgataaaagcgttcccctgctctgctgtcactgcaggtgtgggtggtattgaagcagaagctgtcatgctgggtcagcccatcagcatggtgcttccccaggtgattggctacaagctgatggggaagcctcaccctctggtgacatccacggacatcgtgctc

SEQ ID NO: 28629 - DNA, 1145 bp, Mus musculus
gcaggcactgtttctctggtcagaagttctgtatgactgtgcagagacagcctggtgagaagacaccacctaggagaggaccagctatggtcttcaggactggtccgggagaatcctcaggggttgccatatgtatttaactcttacactccataacaggttgctatgggacagtggggcgggggagggaagagtcagcccagttgtccttgtcatctgaagaattatggagaagcaggaaggatgtccttgcagcttcgttcattggctggtgccaatgtcaccttctgtccactcttcagaagcgaatactttcagttcacctcactttgaattgtaaacaccgtcgctatgagccagtgattgagacctttctgtgcattggtgtagaacccccagtctggttcacttggtgacctatctgggaaacctgggcaaatgttgatttgtgcgttcttcaatagactttagatctccagccacccaagtccatagtggatgcctatgtgctactgaatttaggagattcagtaacaacggaccatatctctcccgccggcaatattgcaagaaacagccctgcggctcgctacttgacgaacagagggtgagtgcgggtgatgccggaagggctgaaggcagagggaaaaaatgaagctggcatttctctcttcctgtggtgacgttgagatcagactgttgtctttctttgctaagcactggtactcgaaagccagttggtttccctgtgagtcacagtgaccaggagggatagcttcctaagcaactgtaagccttaggctcagccttctcaagcctgaagcctgggcagagcctgctgaggcccagcagtgttacaacctggaattcattgccatgtcctgttgacagtgtgccaggactgcctccagtgtgcagctcactcaccccttcctcccctcagacaggcgtacagtcgtccccacaccattctctctctgctcagtacagataatgaatttgggggttcccgagtctaattgccatgtgggaagcaaacaatttcctgatttctgtccctctcttctgaatcagttcccttggagagggggctcagagcaaatttgaggagtaaggcgcttttttctctgggaactggaggggat

SEQ ID NO: 28630 - DNA, 2735 bp, Mus musculus
tgtggatggcttagtcgctgggagctcttgggggactggttggttgatattgtttttctccctgtggggttccttcagttgtagggtactctcttaagtcaagtctaagtggggtctgtggacagcatggctcctgagcctgttcacacacataccctgtgacccctgggtgtcaccagccctgtgctttggtgccttcctggcctctggtgaacttgaactttgtatgtgaactcctctttgcttctgagttggaaagctgggtttcctcctttctcaggtgccagacgcccaggaaatgggtcctaatcggcctggggaagactgtctatatagtttttttttcttccaacttgtaaaataaatgggatcccactcattcctgacttttagctactgagtggcttctaagtcattttcagacccgtttctaacattgtgcgctccatctcttcctcctagacgtcccactacactgtccttggagacgcttttaaggagcgctttgtgtgtaagccacaccctaaaccaaagatctatgacaattttgagaagaaagcaaagatattctgcgccaaacagaactgtagccacgactggggaatttttgtgagatacaagacgttcgagattccagtcataaaaattgaaagtttcgtcgtggaagatattgtgagcggagttcagaaccggcactcaaagtggaaggactttcattttgaaaggatacagttcgatcctgcagaaatgtccgtatgacctcaggcttctccgtctcgtgccgcagggagccgtgccttaagcatggagttgatgagccaatgctttcttacccaagcttgcacaatcctttcttacacaagcctgcactgtgttgaatgccagataacctgactggttggtttcaagctggtgctgtccacacaaagcacacacgcctgaactgcggcgccgaatagtttcttcaccaataactcatagcgtagcccttggccatggtggggaggggttaaacttgtcccttttacacttttcagaactgcccgacagggaacgtgcagccactcggtacaccgagacgcatgatggctggcgtgctggaagggttcccgttctctgtctgctcgatctgctgtaagctgcctttgcccttaatgacagtgcccttaagaacagtgacttagttctttttcaggccaccagactgactgccagatcccttctgtcccttctgtcccttgcactgattcctttccggatttgaccctgccaccctgtcaccctctgcagagtctcctggtttctgtctcttccttggtttctttgctgactcaaatttggtagttgcaaggttcagtatgcacacatatatatttaaaatgacatataatttaaaatgtaaaagactatagttgacagctatgcttactgagatggtatttctgttctgttcattactatacatcttacccttgctctcatctgttcttttaacttgggccatttcccgtctttgaatagacatctcaaaccctgtctgtatgtctgtctgtttcccacctgtttgagacagggtctctctgtagaccagaaactccatatgtagactatgctggccttgaactcacagatccccctgcctctcaagtgttgaaattaaaatctttcaccatgcctggctctagctattttcaataaaggctcatgtttaaagtttgaactacttccaattcattccctgacgtggcttgttgttgttgtttacttttggagacactgttcctctctgtagccctggctgtgtagaccaggctgcccttggtcacagagatctgccagcttctgcctccggagcactgagattgaaggcctgcatcaccatgcctggcttgccctttcttcttaaacattatatattcaaatggcatttccgtgtttcttctcaaggtgtgccagtgcttcagagagcttagtttggggttcttcagatcaagagacaagtgtctgagcgctgttactgccaacagagcaaagtactcttcagttcagggaaggaacagtgctggttttgtaggcagtacagtggttttaacaccttcctagaacttacttgtaattcatcagttgtagaccatcaatggcctaaaccaaactgcagagatcatctgaccacataactccccttccaggacatttacatttgaagactatcccaagcccacccagagcacagtgggttacccaaactccccaggtcaaccctggaggtcaacagtatgacatgggatagcacaccacttctcacagatgcctagagaaattacccagcaacataactctttggggaaaaaacacctatagggattaggcttttaattgatagaataggtagaaaaaaagatatgtagtagttcttgatagtggttactggtaaaattcttagtgcaataaaatgaatttgccgagagctgactttcttttttttcttgtttttttgagacagggtttctctgtatagctttggctgtcctggaatgcactctgtagtccaggctggccttcgaactcagaaatccgccttcctctgcctcccaagtgttgggattaaaggcgtgcgccaccacgcctggctgagagctgactttcatttatgtcttttagtctatgttgcctttctttgctgctacagtttaagaactctacagcttgtataagatacctactggaaattattt

SEQ ID NO: 28631 - DNA, 1167 bp, Mus musculus
cagtgccatctccacggacctcactgtcatcagtgtctcctggtagagactgtgatgtgtcttaagactgccagagcccctcctcgataatccgaggctgtggggaaaaggtaaagagtcatctattgcagtctagatgacttcctggaaaaactttgcctcttaaaatatcttaactgtgtgtgttaatttgtaaaattcattatttgttcaaaaagttatgtatgtcccattcccagatatatgcacttttaagtgaagaaaatgttgctagctgtttatttaaaacttgggaaactttttaaataaaaatcaaaaaaatttagaagttatttcataaagccatatggtattgacatatttttatggtagtatttttgaattttttttttgagagttattctggaagtgtgttacaagctaggagaatgcttttggacagttatttttcataaaagatttgtatgattcaaaaccatttcttagactgaagtaagtcgttttaatctgcacaggttatcttggcttctgccaaaagcaaagtttagtattttctttatatacttggttatctggactggcaataagacaaatgtgtattcaacaaaagacaataaaactgtacactctaaaaaattcagacaattttctgtgcaacattgatttctttaaagttttgctggagccaaaggcttaaaacctgggtgaacagttagttacgggcccagcttcagtggctgtagtctctcctcccccatagctcagttctttagttgcgacgttgaggatctttcttacactcttcaggggaatggctttggagcgtttggcttactacaaacacacaggaaccctggccaaaacctgctttggcaatttttctgcacaaagtggctctttgtttttattgttagcagaaataagatggctgtgtatctaacctgataaagattgtcagtgcacagcagagcttggacttactccaaacataagcctcagtttgccttgtttcctgtgattggtcattcttgagtagaaatgggaaggcttgcttcacggccagtattgggttttagtgggagagcagagcatagagaatcattaccctcatggattttaccaatagtttagttaaaacggttgtataaagaatatatagttctccgg

SEQ ID NO: 28632 - DNA, 1109 bp, Mus musculus
tatttcagctgagttcttccgtagaaatccagcttgccttcacagattagttccttggttaaagcgtgaacttactgtgctttttggagcccatggttcgctagtcaatatcgtccagcacatcatcatgagtaatgttactcgctatgatttggagagtcaggcatttgtgtctgacttaagaccatttttgcttaatcgaactgagcattttatacatgaatttatcagttttgctagatctcccttcaatatggcagcttttgaccagcatgctaattatgattgccctccttcatctgaagaaggcagccgttcagattcttcagtcattacaatatcaccagatgaggctgaaactcaagagctagatatgaatgcatctactgttaggcaggcaccgtgggatgatgaaactcctggaccatcttattcaagttcagagcaagtgcatgttggcgtgtcttcccttttaaattcttcagacagttcagatgaagagcttgtctctggaggaaccacatctcagatacaaggagtacagaccaatgacgatgtcaataatgacagtgattcatcgtcagataattgtgtcattgttgggtttgttaagccattggctgaaaggaccccggaacttgttgaactgtcttctgattctgaggagttgggcccttatgagaaagtggagacagtgaagactcaggagcaagagcagtcgtacagttcaggtgacagtgatgttagccgggcgtcatctccacgctctgtccttggaaaagatgaacaaatgagtaaaagccattgtgattctgacacaagaataagctcaaagaaagaagagaaacgatctacatcattgccagctcccagggacagctcatctacaagaggtgacagggtatgctccccatataaccatcgacacaggaagggaggaaggtcgaggagttcagattcccggtcccagagtagaagtggccatgacccgaggaatcacaggaagcacgggaagaaaagactgaggaacaagaggtccagaagcagggagagtagtagcaggccgagagcaagaaaggacaaaaagagatccagaactagagatagca

SEQ ID NO: 28633 - DNA, 1283 bp, Mus musculus
ttttctccagcgaggtcccatctcttgtttgtttgtttttttttttttttttttaaatagcatgtactttttaaaaaaaaagatttatttattattatacataagtacactatagctgtcttcagacgcaccagcagagggagtcagatcctgttacgggtggttttgagccaccatgtggttgctgagatttgaactcaggacctttggaagagcagtcagtgctgttacccgctgagccatcctaccagcctgaggtcccatctcttaaagttactaccacctcactgaatactgccaacaactgtggaccacactttgagtacccgaggcttcagaggggacactaagtgctaagcagttgttggatgaggaggggctcaggagttctggagcaggagtctcctgctgtgttagcagtaggcaggggtgctctgtatatttggggtgtaagcatttcctagtatagtttatatactacttcaggactgctgtggtgtaaatgtggcggctaccagttttcaaagagccacccggggaaaagcatggtgagaagcccataatgtggctatgtggagtgtgtcctgagggagtgtatcatctcagcgggaggctgcgcagacttagaatctgctcagtgtgagccttaggatactgggtatgttgattagagtcatgttttttagctttttcttggtgtcttactggctttccaaaataactgggttctgcaccttccttttgtttgtagctgtgatcaagatggttcaggaagccggcagagtgactgttaaagatggcacttgtgagctcttgaagctgcctctccgttgccatgagtgtcagcagctgctgccttccatcccgcagctgaaagagcacctcaggaagcactggggcgggtgacactcgtctcggcgaccaagggcagtgctagcatctgtccgcattgcctatgctccgttcaatcctgaactaaagcgtacacttcttcgaaacaaagcttatttattcttgagcagccacacattgggtgcactctggtgcaggaactgggaattcgggttttgtgggtgtattctctggtaatggaggctgagacatgcctggtcacccttcccaggaccatgacaggcctgactaatgagagggcaaagccggcttgagactcaaatgcacgatgtagaagcagaggattggtaatatattttgttcctaccctcgttcctggattgtgtagtatctgttcatcaaggtagctgaggttctgaggggcctggttc

SEQ ID NO: 28634 - DNA, 1149 bp, Mus musculus
gtcatatcttgtgtaactgataatagctgtgtacattagactgacatgctaggtatgtgttgtatgacccttcattgttaagctatgggattaaaattctgtatttaactggtaatcaaaagaaaacaattagttacatgtcggtctgtctagttatatgaagtgaaccaattgtgatgcctttgcattgtattgcctcagccattactagaaggtggcataatacatttcgcctgtgttattagtgatagaaatgattcattcctaaagaagtttatcataagctactgcttaagggcttgctcttctagattgcatccccttctgctgtgcaatttttaagatatatatataaacagaaaacatgatcacctttttccccttctcaaaccatgataagcccttgcttgggtgtagtgacttccaaagcccaagtaacttacaaatgaaagtgatgagatctgtacgtggaggggtgatttgcatgtataatccagggaaggtgctccttaggtctgttccaggctttctattcgacttaggctccaacgtaactgcaatttaatgttggtagtatagcaaattatgaatagatttgttgtatgttttgaagtcacatgcttacatgcttaaatctggatatcagaatttaagcagttactgaaatgtatggctgtctaatatactgattacaaagtgtttccagtgtgtcactgcaggcctttttttctcagttcatcaaagcattatgggcttttatgatgtaattttatgtctatgttcctggaatgtgggaatacttagtatccatatatacttatttcttatccatatataagaaataaaggtataggcctaagcccaagtcagaaaagggaacttcaaccaacctggatgaaaatatgtgactttcaggtctacctaggtctgccacatctcttctagtcagaaatttaaaaacatttctaatctgtaagtaggctgaagttttcttcacggggagaacatctgagttagcaaatcaccatggtgaagagagggttcaatggttagtactgactgagagaggacccaaaagttccaagcaagtcccatctctctacagtgagtcccaaaaaccgacttcaggcactaggcatgcagaatact

SEQ ID NO: 28635 - DNA, 3214 bp, Mus musculus
aaagggctgttggggaaatacagatgttggccagtttcttaagatttatgttttaacccatctcctttgcaccttttctctggtaggtttgaccggatcgcacatacaaaggaaacgatgcgcttcgatggtttgaactcacttacctacaaggtgttggatgtacagagatacccgttatatacccaaatcacagtggacatcgggacaccgagatagcatttttagtaccaataagagacctgagaatggccggagacctcagatatgtgtctctgccagttgactgggctggtccctctcatttgtacagtctgaatgacagttcttcttatcattcagacgtccctccagatgcccagggtgagtgtaacatttacccacaacctggctcggcactggatgaaattctacaaggtgagtggagtgtaaaactggtcagcccttggagagacttcttggttgtgtcacccccaaagagtcagaactgtacacagttcaaaacttagtgactgtgggtcacattcccactgttgaaactgctaaattgtgacctggggaaggactttgctttagtcggtgatgttcgtacttggtgacaaattgagactgctgctggattcagattgacaagattttcttggattttttttttatacgaaaatcaaaatttcaatcagtctcgtgctctgtccctttacatcggtatgcgactattacaatcactgtgtgtgtgtcttttcttagcaaaggcgttttaaaacttgagcctggaccttggggtcctgtagtgtgtggattccaaggccttgccctcagagcaggggcctgggcactctcactcacgtggcctgtctccagatccctgtctgatttctgaatgtaaagaggctttttgttttgtttttgtttttgtttttagaagcagttcgtagtatttgaaagaataaatcaagttttgattatgctataggttgatttttgtgttgatccaaatcagaatagctattgagtgtttaagtcatgactttatttttctgggcatgctatataaacttgaatttcctatgtatttttattgtggtattttaaatgtgggggaagggattgggtattttttaggggaaaaaaaataatgtatgctgtagtggtcaaaggagctctgattgagctggcaggccaggttttgtaaagagcaaaattactttcaggtcccttgttgagggaacaggtcagcgttatcctgccagacatctgggtcaggaacttgggagacaacatctgcttacctggcagaactccccactccactcccccaggtgggctgggtggaaggaccctcagccaccaagaactgacgccctcatggccctagactatggggttgaaaactcatagcagtcaggtttgtttaccatctctccgagcctccaccacactccctgacccacccaacgtctccagttcttattgttctccttccttccttctttcctttcccttctcacctctttgcctccttccctaaaattcgctgtggccctcggggtcagactgttcattctccagcatgattgtgccttttaattagaggtctagaaagttcacctgaacccacacccccttcttcctgagaattctggtgcctctaaagcccctccttgccactcagggttttagtgggtgctcccactgctcagtgtacccatgagctgtcgtcattcacagagccctgtgccaggccgtgttctgtgcctgcctgcggtgatgtagccagaagcacgtactcaggtcatcaagccgagagggcgtcaaagaggaagcctgggctgggatccttaggctcagctgtctgtctaatcccagagctaagccctttctgcttcgggcagcctggactccagccctgagtatagaggcggtgtggatggctggccctcatcctacctgtgtctttattgctttgatcaccacagtctctaacttgctgctttctccagaagcctttttatgtatgggttagaaactcttttttccctagtcagagcagccaggctgtacaaaatctgtgctctctcggttccccatgcctctagaaggccgttaaaaccaagactggatgcactgagaggagtctttttttttttttttttttttttctgtcccaagatcctgacttttccaaagtgccttaaaagaagggagacagactcattgagtgtgttgcttctttctctcctaaagcaaacctctgccttttctctatgctgttcgtgttgggttttgttcatgtcagatacgtggttcattctcaggaccaagggaaactgtcttgcctgtcctcctatctcctccctttcagcatcctttggggaacctccagcccaaggcactgttaggcttgggcattagcctggcccaagagatgccactggggactagaggacagaaggggacgttcccttcacctgggaattctcaccctggtgtcaacatgctgtgcctttctctttctctatttttgttggtgacctggatagtgtggcctttgggacagatcagaggcacaggaaagcaaaggaaatgtgccaccctttagcctggcagggtctccctgcccactgggctgttccagacctgtgatactgtgtttgtatgttgatatcccatgtgtacaaatgtgtttaccattggggctgggggtgggtggctgtctctgaccttggcattcagaacagacatctgtatttttgcctttgaaatgcagtaatataacgtgaataaatgaccttatctttgtaactggcttcttttcttttttgttgggggggagagggggttggagacagcagcaggctccacatgccttccggaagtcagaagtgtccctgtaggaccttcatttttcttatctgtaagtaggaatgataccatatagagaccattttaggcttaaaagagatgatacgtttaaactgatgaccaatacctcacaggtacttaacaatatagtgtctattcccagttcaaaataaaattgtgcctagcagttctctggccacagtctactcctatcctcaacaaatgtcaggatagttgagaatgaatctgagagccatttgtgcaaggaattcacagtgtaagttatgtgctgttttcccatatggagtttcttgccaggccaggaagttgctagccagtggctccaaactag

SEQ ID NO: 28636 - DNA, 1216 bp, Mus musculus
acacacacattttaaaacagtctcactatattccaaactgctctgtattttggctggtctcagactcataatctacatactttgggctcgttggtgccagattacaggtgccaccatacctggccattatctatctatctatctatctacctatgtatctgtctatcacaaatctatttcattatgtgacacacatgacttgtttggccatttccccagtgatgcttctgcaactgtttacaacctgctcctatgatgcatgcttcacagggaacagtatggtattgttcacagtttgtcacacacatgtcagcccttctgttgggcagactcctggaaatgaggttgctgattcagggggttgacactcaggattgattgtgaagtaagggcagaaaaatggagcccaacagttaactgttagttaaatggccatgtgtcacagacccagtccttgtgagtgatctgctcaaaggtcacgtggcccctaatagcacttcttgtttctgcaccaggctggagacaccatgttcaatcgagctaagctgctcaatattggctttcaagaggccttgaaggactatgattacaactgctttgtgttcagtgatgtggacctcattccgatggacgaccgtaatgcctacaggtgtttttcgcagccacggcacatttctgttgcaatggacaagttcgggtttaggtaagacatacttagccagagtctgctgcaaatgtggtaggttctccggtgtgaactaaaaaatgtagttcctctgtagtgccctcgactctgcaggagaccaccacttctgagaaatagttgctttttttttttaagtgtatagtcctttcttgctggagaaatagtccagcagttcctaataattactgtgtatcctgataacagttcttaggtttgggcttccaacagtggctgcatctcctcactttctatccccctctgccccacatagtttgagaagcacagatactagagattggataactccacagatgtccttcagcactttcaaagagacatggttctttttctaagaaaaacatgtgttcctgctcaaacatggggctctaacttttgtatcacagtgctagtgaagagacagggtagcagtgtgatccaaaccttcctgacatgtgtagaagatagtcttatcgtcagttgtctaaccttaaaagtcaaaggcccaggcac

SEQ ID NO: 28637 - DNA, 1194 bp, Mus musculus
cctcccgagggcccgccccttagtgcctgccccccaagctccgccctcccttagctgccagaaaaacccggctgaaggttccgcccctcagtcccctctccgagccttgtccctcatgccccgcccctctcgaaaaagacccgctttgcggccccaccccttagactccgcccccccaggttccgcgaacagccttccgaaacccggttgaggccccgccctaggtcgagaccacgccccctgctcatccgcgcttgtggttcccgctgatctctccaaagtcccgcggccaggggtgtcggctttccgccgcaggcggccggtgctgcgctaggtcctagccccctccccccggcccctccttcgatcgctgtggtcgggtagcgcctggcgggcggcctgcgggcgggccgtcctctcagccgtagcccaccccctcttaaagccgcggcgggaagatgaggtttcgtgagcagttcctgggcggcagcgccgcgatgccgggcgcgaccctgcagcgggcctgccgcctgctcgtggccgtctgcgcgctgcacctcggcgtcaccctcgtctattacctctctggccgcgatctgagccgcctgccccagttggtcggagtctcctctacactgcagggcggcacgaacggcgccgcagccagcaagcagcccccaggagagcagcggccgcggggtgcgcggccgccgcctcctttaggcgtctccccgaagcctcgcccgggtctcgactccagccctggtgcagcttctggccccggcttgaagagcaacttgtcttcgttgccagtgcccaccaccactggactgttgtcgctgccagcttgccctgaggagtccccgctgctcggtaagacccaggatctgaggacgtggactcctcggatttcctcagtagggttccagggatattatcctaagatctctttcaggactgccagccaccaggttttgatcagagtgcataatccccaagaagggcttaatcctctttgggatgacccaaagagaggttggctggtgtctcaagaggcaggggccctgttgggaaacccccaggctcttaccccagcaccagacaaggccctggagacacccttgttctggcccaggactcaggaagtttgaagttggggtcagtttagagtagactgaaaaggctgctctgcaa

SEQ ID NO: 28638 - DNA, 1161 bp, Mus musculus
tcttcgagcgcctccagatctactctgacccaccccaccagaagcatcacctcctgtcagcctttccctctcctaacagccaccaaatacttatcaatagctctttagctggctgtggggcttcacacccacctcttccctgttgggattaaaaaagaaaaaattaaagatttatttatttattatatgtaagtacactgtagctgtctccagacacaccagaagagggcatcagatcccattacagatggttgtgagccaccatgtggttcctgggagttgaacgcaggacctctggaagagcagtcagtgctcttaacctctgggccatctctccagaccccaagctgggattttatctgacatgaactagacagatcttgtcacagtctgggggttcataagagcatctgccctgtgtgtctggaaaatgctgttttccttggagtcttccaccacttctggtccttacccccccccccccacgctgcatcccccccccccccgcccctgtaggtccctgggacttgaggggaggattgtgatataaacatctcatttagggctgagctttccaaagtctcttattctctgtactttggccatttggggacgaggagctcttttacggttgcagaaatagagtatagtgttataaagggataaagactaggaaataaaacaagaaggattaagtatgatagaggatgggaagtcagggtggagggggaaaactatcactaagggcttttgaaaagccatatgagaacctactactgtagaagtttctctgttctctataagaagaccttcctgtctttgtctggggtcaccattttgaaaaatgttgacaccccacccccacccccccacccccgaatactggtgtttttgcagaataaacgttctttgtttttgcatactatctgagtctgggatcttccttcagcgattttcggacccttacatatctatcatatatgataggttatttctctgccggtgaagtgagccaattcaagcctccaaggccttagcctgtgactgacctgtaaatatgaaattcacacctggcctcctgatacagtctcaaaatgtacacttgatctgggctatttactgtatgtaaatcttgtttgttggtttttattgcttgtttgt

SEQ ID NO: 28639 - DNA, 1231 bp, Mus musculus
attatgcaccccaatcccactcatagccctgtgggtttttatctgccttccactcttgcaacctccctccccaccaaaataaaaaaatttaaaaacaaaagagaaaacaaacaaacaaaaccaaaaaaaaaaaaaaacaaaaaaaaaaaaccaaacaatttgtcacgggagccgtggtgtgttgtagtatacagggacaacacggtgtaccgtccatccacacatctttacttgcaaatgacttccctgtaaaactataaagctcttctacacctgcccttgctctacataatggcatcgggacccgctatatgtatttaaaagcttcttgcactatatctgggcagggccctcatccattctaatcacattctaacctgcctacggctgccttctatccagccacgtgtcccatttttttttttaagaattatttatttagtatgtgagtatactgacacaccagaagagggcatcggaagtgagccaccatgtggttgctgggaattgaactcaggacctctggaagagcagtcagtgctcttaaccactgagccatctctccagcccccattgttggaccaacatctccaagaagcagctgagttggctcatcaaccggttgcctgggctccgagacttggtgctgtcaggctgctcatggatcgctgtctcagccctctgtagctccagttgtccattgctccggaccctggatgtccagtgggtagaaggactaaaggatgcccagatgagggatctcctgtctccacccacagacaacaggccaggtcagatggacaatcggagcaagctccggaacattgtagagctgcgcctagctggcctggacatcacagatgtctccctgcggctcattattcgccatatgcccctgctctcgaagctccaactcagttactgtaaccacatcaatgaccagtccatcaacctgctcactgccgtcggcaccaccacccgagactcgctgacagaggtcaacctatcagactgtaataaggtaactgacctgtgcctgtccttcttcaaacgctgtggaaatatctgtcatattgacctgaggtactgcaagcaagtcaccaaggaaggctgtgagcaattcatagctgaaatgtctgtgagtgtccaatttgggcaagtggaagagaaactcctgcaaaaactaagttagttccaggacaagtatgtaaatatggagggttggggggaa

SEQ ID NO: 28640 - DNA, 2305 bp, Mus musculus
gtgcaaaacagggtagtgtagaactccgataagacacatggtctgttgttatttattagcatgaacccaaagaaggggattcttgtctccgtgttaatcagtttggacacgtccactggagagcagatagggctgacaagggccattgttgtgtccagttcccctttacagggtttttgccctaaatcatcctcaaaccacgggcctttgactctcgcttcctctcatgaagcttggcgtccaggctgggagcccatgaccgtccgtgcacaggctgtttagagtctaatctccaggtcctccagagtggctaaacaaagaaccttgtctgagcaatggctggcttgtcccaggagggccctgaatgtcactgcctgtgtctgtcctgcaggtgttcttagcagagtgtgacacagtggagcaatacatctgccaagagacagagcggctgcagtctacaaacttggccctggctgaatgaagtgcagtggagagtggctgtactggcctgaagagcagctttacagccctgccctctctggaacagaagtcgcctgtttctccatggctgccaggggcaactagccaaatgtcaatttccctgctcctccgtcggttctcaatgaaaaagtcctgtctttgcaacctgaattagacttgtgttttctcatgttggctctgtggtggtgccgtccagcagctgcctttctaggagaggcctccctgcgtatgtgctgccagctctagttcctctggagctcctcccaggtttgtagggcaccctcatcttcagactcatgacctgtgaccctcagtttgtagatagaagatcagaaccaccaggaggtggagttcaggataaaggaatgttggataaagtttggcagctggacagtccagagtaccttgctgtcttgctatgacctgattccagaacatctggcagcatgttggtttaaagaccttgtcctcatcctccactgctcctccctatcctcctccactgctgccccccctcctcctccactgctcctccccatcctccactgctcctccccatcctcctccactgctcctccccctcctccactgctcctccccatcctccactgctccccctcctcctccactgctcctccccctcctccactgctcctccccatcctccactgctccccctcctcctccactgctgctccccctcctcctccactgctgctccccctcatcctccactgctgctcctcctcctccactgctgctccccctcatcctccactgctgctcctcctcctccactgctgctcctcctcctccactgctcctccccctcctccactgctcctccccatcctccactgctccccctcctcctccactgctccccctcctcctccactgctcctccccatcctccactgctccccctcctcctccactgctgctccccctcctcctcctctgcttttctccagccacaggctttggtttcaaggtgacatgttttcccctgtgtagttctggctgtcctgaaattcactgtgtagacctgagacccacctgcctatgattcccaagtactggggttaaaggcaagcaccactatgcctggctgtaaggtgctagtttgttttggtttttggttttttgagacaggatttctcaatgtagccctggccgtcctggaactcacactgtagacgaggcttctctcaaactcacagagatcctcctgcctctgcctcctgagtgctgggattaaaggtgtgtgccatcactgtccggcttcaaggtgctcttctaaaatggcccctgtggttagtctgtgaatgaatgaccttgcccctaaacagatctccaaactgtcaagaaccaagtaccaaccaagtctcaacctgaagccagttcagagccacggcctagacaaagacagtagtgtgagtgtgtaaatacgggtgaggccagctggcaacttctggtagccacataccctctgggctctacctgtcctctgcggttgtgcctgtcgattttatgggcctccactaccactcgtctgtgtgatttttagatctcttacattgcttagctttccgtgtgtcttagttagggttttactgctgtgaacagacaccatgaccaaggcaagtcttataaaaaacaacatttaattgggggtggcttacaggttcagaggttcagtccattatcatcaaggtgggagcatggcagtatccaggcaggcatggtgcaggaggagctgagagttctatgtcttcatccaaaggctgctagtggaagactg

SEQ ID NO: 28641 - DNA, 1391 bp, Mus musculus
ttacccgctgagccatctctccagccctcctctttcttttccaccctgcagaggacctccactttaatccttcgcagttcctgatttatgaagcaagccccttttgcctttttagaggaggctcgttgtcagcttctgagtaggattttggtttcaattgttaacttgggtgtgtgacgtttgcctgctaactgtgatcgtgttcactgcgtcaaagagcagccctgaccgttgatttctcctcccaggatggcgtgctggtggatgaatttggactgccgcagattcccgcttcgtagacttacaacattccagcacgtgatgtgaaacaacaagagaagtattctgggactaggaaatagttcccgatctgccaaccagatttaggtttctttcctttctttgaaggaaaagctatctacactgctcctgtatttttattttttccgttaaggaattcattgcttttgggaagctgtctttactaaaacttgattcttttttttttttttctcttaggaaagactaattgaaaagtacccttgactttgtatgacttgttttcattcattaacaataatctgaaattaaaccaaggagatgagactctgaattctatggtagtgtaagtacagtctcagtgtgctgatacattgataagataaaagtgattgatgagattgggactgctgatagtatgcttcagaacccttgtctgttgtggtattgtagatgggtttaagtcatggcctcttttgatagattttgttgtgtcatgtgagcaagtcattacacgatctactgttggaatgaactgtctctacggtatcatgagttactattttgattccatggttccctcagtatactagcctgacttgtaatgaataatgaatatttcttgatatttaatgtataggacatttatttatactcaataaatatttttcaaaaggatgtaattgtagtatcgctttaacctaaaacctccactgcagaaccaagtgttgcaatagaaaggaaagaacagaaagtagtttcagcttggattttggatgcgtcagttttttcattttttatttttatttttggttttctgagacagagtttctctgtgtagccctggctgtcctggaactcactttgtagaccagactggcctcgaactcagaaatccgcctgtctctgcctcccgagtgctgggattaaaggcgagcgccaccacccccggtgggtgtgtcatttataaactactgtttcttattagttcttgcgtcatgaggagtaagttaggaacgagtcattcgtactcagtactttaatgttctgttctccctcaagggactgacaataaaaaggaaaatccagacttcatccttttcttgtaagtc

SEQ ID NO: 28642 - DNA, 2424 bp, Mus musculus
gagctgttgtccaggggccaggccacatctcaagcctgcagcagaacttggcattgtaagaattacctaccacatgatactggtttggaaggcacaaaaaggtcatggaaaccagctgaagccagacactgtatggcagggtccaagtccctacagagagtcgtgcagaagccattggtgaaagtgaagcttcagtagcaatggagagagaccccacagtcctggagatgccagaagtgctgagagctgctgctgtggcgtcgatccagcctaaggaagaagctctgtgcctgcggatgcgagttgaagaagtgaggctgcctacgccctctggagcctggaagataatattatgattgagttccgcgtgttggacattgaactacaggattttggttttgctttagcatagctgtttttatgccctagttcctcccttttggaataagaatgtttaagtatgtaacttgttttttattttgcaggagctcacaattaagaaactttggacttttaaagagactttggacttttgaagtgttggaatttttgaagactttggggggcttttttggagttggactatattttatattaagatattaccatgagatttggggataagaaatggaaagttattgcacaaagtaacatgtttgtgtgctaagttgacatgggatgaattgtgctggtttaactgtcaacttgacaacctagagtcacccagagtcttagtgaggaattgtttagatcagatttggtctatcggtatgtctatgggagattgtcttgatagttcattgatgtgggaaaacacagcccactatgagtggcaccattccctaggcagaaaatcctaaactgtatgaatggaaaaatcaagctgagcagcaagcaaacaacatgcatgtattcatttctctcctcccttgactgtggatgtgatatgactagctgcttgagtccctgccttgacttaatgcaataatgaactgtaccctggaattgtaagccaaataaaccctttcctcctctatgtttcttcttgtcaggctattttatcacagcaacagaaatggcaagggtcctgtgactgatgtatatacccagcccagtggaaaaaaaaaagtgttgtattaccagggttatgtgatacatgcttctcctactccaagatgatatgtttcctaacctgctctggttacttcataacataactcttgacatctgtaacatgttctcattgttcttttatctttaatgaacttttattttctgtacttatttcctgtgctagttctttttggtttttaagacagttttactgtgtagccctgtgtagccatgaactcagagatccacctgcctctgcctcccaagtgctggaattaaaggcatgagctgcactgtctagcctcctgtgatagctcttaagtctctataaattttgtgtgtgtgtttgtgtgtttgcttgcttgctttgaggtaggattttatattggccttgaacttgccatatagccaaacatcttgaaaatcatgtttctcttgcctctgtgtcttaggtactgggattacaggcatgtgccaccctatccagattgtgaatcttactttctgttagtttacctaccaggaaatactcatttattatctttactcaatgaataataattgagttcccaatctaggccaggtaacagtgtagatgtggggtcacacccctgcctttatggatcaatcgttcagagatgagtgtgttgttagaaacagacaattgtaagcagaatagtttgaggactgtggagtcctagggagacagatcttgcccaagaaggcattgtagaggaagtaactctacaggacacttaagatctaatgatcagctgtgaggcgtgagaggccagtgcacagcataagcagaaggcacctctgcgtccaaagccactgagaggaaggttgggagcttgaggccagcctgggttaccccgtgtcaagtcatgtgttacttagataaaaattatctctacatttcaagggctcttgaaggaatttgagtgaatatataaaagtaaccctgaagctgagcatagtagcttacacctgtaatcccagcacttggggaagtgtaagaaggaggatcaggagttcaaagccagcctgtactgcaagagcctattttaccccccccccaaaaaagtcatctttgatcccatagtaataaatttccaatgtgttctccaaccattggaaacctagaagcaggtaatttctcaagaaataaaatgagttgggagttcctgttgcctcttcatttttaactgtgtgtgtgtgtgtgtgtgtgtgtgtgtgtgtgtgtgtgtgtgtgtgtgtgtgtgtgtgtgtgtgtgtgatgggagaaggtgagtgtcacagtgtgagata

SEQ ID NO: 28643 - DNA, 1371 bp, Mus musculus
gaggccgtgattgactactttgatgtccaggattgagaagatagatagatttatataaaagaatgattctgtgtattggaggagactcatttgccagcagataaatcatgctcgttcctcctgcctggcagaaccccagcacacgtgctgtcttgtcctgatacagccaaagcatgagtgtgtcagaaccccctgtctgggcctgtccacagacctctggctgtgtggccactggatttttaatcatgtgtttgaagaggctcctcacatatcactgtgattactaagagattgggggagtatcagcttttatttggataaatcagaatttttatcccaaactgactttgtggcacctagccatagtctggttgtcccatttgttctggtgggcctcaccttcctcatgaggaaagacgtgaagccctgaccattggtaaaactatgtctgcaatcgtgtgtcttaaacctacccatcttatccaaaagctcccggatgtctctagactggttaggttgctttatagagttccgttttctcaaatccctggcattctttcagcatgtcaccaagcctaccccgggacagtttaactgtctctcataatggtaagaacttgggaccagctctctcgccatgttcacaatgtgggtctatgaccatgtccactgtagccctaagtcctctgtggttggtagagactctcgcatagacagcggtactgggttgcttttttcctaggctttcagcagccatgctgactctctctgcatctgagctctgaaccactgttcaaatattcaaagtatgtggacagtccagagtttacgccaagcatcctactgtaggccttcttcagtctccactgtgcccatctgtgtggcccctcttctccataggctggacttatctttgttgttgtcttttggttttggtttgttttttcaagatagggtttctctgtgtagccctagctgccctggagctcgctcctgtagaccaggctagcctcaaactcagagagatccaccagcctatgcctcctgagtgctgggattaaaggcatgcgccactaccacctggcttctttttgctttaaaataaactttgagcctcccaaaacttgaaatcattaaacaaggcacttaatttttacttgtattttgtttattgagacaggatctcgctaagttgcttaagccgttcagatcttaaaccctcgacagtccttcctcagcctaagtgctggcattgcaggctctcaccaaacccagctgagagacacggaaggctaaaggaaaaaccagtctccatggaaattacggggacatggcagcagggacaggtgacaggagacaagtgatgggaag

SEQ ID NO: 28644 - DNA, 1667 bp, Mus musculus
aggagctggccctcaccgtgctctctcccctctcccagttcataggcacagccgcccttattgtgtgtgtactggccatcgttgacccttataacaaccctgtgccccgtggcctggaggctttcactgtgggcctggtggtcctggtcattggaacctccatgggcttcaattctggctatgccgtcaaccctgcccgtgactttggacctcgcctcttcaccgccctggctggctggggctcagaagtcttcacgtgagtacagtccccactccccagcttgcctcccctcttcctgccgacctgtctctgatttccggtgttctccctccaggactggccggcactggtggtgggtacccattgtctccccactcctgggttccatcgctggtgtcttcgtgtaccagctcatgattggttgccacctggagcagcccccaccctccaccgaggaagagaatgtgaagctggcccacatgaaacacaaggagcagatctgagtgggcagcagcccccctcccccactgtgcactctcctgagtgtccactgactgtgtggggaccagtccccgaaagccctttgtgatgcctctctcgggctaaaccgctccctgtgtccacccctgctggatgggccctccagaatttctatgaactctgcccattagggcattaggttcccacccacctttaagccaaggtaggatagcaaataagatggagagagagagagagagagagagagagagagagagagagagagaatgaatgtgtacatgtgtgctgttttctaagctgaatgatgcaaaggcaagggaccaagttttcaaaacaaactgtagcagctcaggggaagggagcccaggggaagggagaaagtgagtcaggaatgtgccagagtgtgcatgcttcagggactcctccatgtggaggtggacccagaagtgagtttctaagtatgcgtgtgcctactgtttttttttttttttttgaaatggacttctaggcttggggagggggaagggataagaagggtgtagctcacatctggagctatgacccttgactgggggctgtgtaatatgtttctgttataagatagacattgggaggggctgaagtccaggtcgtaagtttcataatttgttttttaaatatataaatatatacatacatatatgttacagccctaggaataggggtgggaaactccactttttaaaaggggtttcctttctttaatcctccaatcaacaatgtactgttgccttttatatataaaaaagaataaaacgtatacatgctacaggaacttctttttgtgtgtgttttttgttttcaaacagggtctctagtcctggctatcctgggactctgtataccaggctggccttgaactcatggatacccccctgctgacattaaaagcatgtgccaccacaccagagtcttgtttttctgggaatagcattcgagcgttggttttatttggccataaatttccagatgtttagttcagagtctaatcttagcttgtattcagtggtctcagattccatccaatggagcatcttccgaatcctcctgtctcatccccttccacaaggaggaagtttggagcccctctggtaggcagagccacccagagactggagaggctaag

SEQ ID NO: 28645 - DNA, 1999 bp, Mus musculus
cgccaagctgtagaccctccagttgcttccttctgccgtggtctgctcgctgagccagggccttcgtctctgatgcctgtcctgggctatgacccccctcagctctatctggcacagctccgggtaagttcttacaggactggctggcctggggagtgttctgtggagctgcagccctggaggaggtcatcgggcaatcttgattccattctgtcctttctaggaggcctttgaagatctggctctcttcttctatgaccagcatggtggagaggtgattggtgtcctctggaagcccagcagcttccagccccagccctttaaggtatgctggccagtgaccctgtcttgtgctgccagctgtgtacatgtggttcactgggtggctctgggtcaagtgtatgtatggagctcatatatcgattgacactgccctaaccctgcagctcatggtatgcctttgtgacacttcaactcaaatttgctctctggttcttcaggcctccagcataaagggacgcatggtggtgtctcaaggtggggagcttgtgatgttgcccaacatagaagcaatcttggaggactttgctgtgctgggtgaaggcctggtacaggctgtagaggcccgaagtgagaggtggactgtgtgattctcgccttgggacaagtgttggatctgtgcagcagcaggtcagcggcatagccactctcagtgcagatggacgcctgatgaaccactgaatcccccatccccagagaaagccccgtgagattcttctgatgtttcagctctggggcaggggccatggtgtcctgtgtcccctacacctgaccaccccaattcccagaggaggagacagagccagctcagagagaactgaatccacgagatccatttgcctatccatcttgagtcagcctgaactcttgttcatttttgttttctctccatcttcatcttcccgctggcaggacggatgtgtccagatgtcagcgtgcctttccctgttgctgcttctggcctttagattgtggcccttcctgggggtcagggcaccagcactgagcagtgggagggagctgtgtgtgtatgaatggaacccattcagtaggcacagtgccctgagggtaggaacagtgggaaaagatacagaccaggcagggctggctggagttgaggggatcccggtccaagagagagagagcgctgggcgctgcagcctggcctctctgggtcctgccccctccttgctgctgcctatcattacccattactgtgccatacgcctgctcttggaactctgaggtaggcaggatgcttcctctcagcctgatccacatccccttctggcagccactccctgcttttctcccctaatcctgactgtttttttttttagactcagctcaaatagcaccccacctagtccctgccctcacccccacccctctctcccttctgtgaactgtgaatgcgattattccttgtcgagttcacttggcaggcatgcataccagtatgcaccttctattgtcctgaactctgatttaaaattaaattgcttaagtctttctgggtacctgacttgtctttcctcttgatttcagcctggtctatgagaaagctctgtgaggacagagcatgctgagcgcaggcagataggtgacttggggtttctcacagcacctagaatgaggcttgcagagctgtgtgtaaggggagccccagcccaagctgggaggctggggtcaccaccacaaggccacagagaagcagagtcagagcctgtggactatgctgtgagcaggcgaggtgacgaaagaaggcctaagactgatggcgtgtagtggtatcacgcctttaatcccaacactctggaggcagggacaggagcagctctctgagttcgtcctcagagtgaattctgaattggaggccagtcaaagctactgagaccaaaagcaatggagacccagtttttatgaaaatggaatctta

SEQ ID NO: 28646 - DNA, 1197 bp, Mus musculus
gggtccctttgggactttgtgccctttgtctgaatattgggtgtgttcttcctgggacttaagcctagctttgacctagtccccagttccatgaacacttatgtgtctgaccttctctcttccctgattcctccaggaaatcttacaggacaaagacgggctgaaccagcgttacttccgcaagcgagccctttacctggcccacttagcttaccacctggcccaggatcccctcttcagcagcgtacgcttctcttacatgagtggatgccacctgaagccctcgctgctgctgcggccacatggtgggagtcactctctgggcttagtgcacagtatgggatggtaaatctggagggggccatgaggtcttcaagtctggaagcctcgaggccaggaggtcagaagtcatgggtgcccaagtatgagggggtgctaaggggacccactcagattttaggagttgtagaatctcactactccatgtctctacccagggaaggatgagcgcctagttactgtgcgcctgcttccctgccctcccttggacttcttccgtccctgccgcttgctgccaactaagaacaatgtgcgctctgcctggtaccgagggcagagctgtccggattacggtgagcaggcactggtgctgaaatgtgttggtgggcaggggtttggtggagccttctcttctaatagtctccatttgtttgcgtagagccgcctaccccccactataacacctggatcctgcaggatgtagctctggagacccacatgcacttgctggcaagtgtgctgggctctgcccagggcctgaaggatggcgtggcacttctgaaggtttggctgaggcagcgggaactggacaaggtgagttgtgggtggcctggtttcctcgcctctttgtgggaagggttgctcctgagctcagtccagtcatgcttctctttcagggcctgggtggatttaacggattcatcatctccatgctggttgccttcctggtatctaaacgaaagatccataccaccatgagcggctaccaggtcctgagaagtgtcctgcagtttctgggtaaggtaactagagtggacaggccaggggttccgcttgtccccgggggttctcttattccaccagagctccgttagtttcttgtcaccagacagaggagaaaactgagtctgaggcagg

SEQ ID NO: 28647 - DNA, 1161 bp, Mus musculus
tcaggttccctgcaagagcagtcatgcttttaactgttaagccatcatcgagatctctagccccctttcctcccccccccccttctctgtccttccttcccctcccctttctttctttgaggcaaaaatctgtgtaagccctgctgcctggaactagccatgtagtgtccaggctggcttcaaactcactgagacctgcctgcttctctctcctgagtgccaggctcaaagatgtgcatcattatgtttaactccttttcattttttttttaaattaattttttaggttagtatacaaagcaatgggttgaattatggtatcttaattcatatatatatatatattcatatatatatatatatataatattattttctcatttattttcctcccactgcctgccctcaggctcgtcgcaccctcgcaggctcgctcacctcacagcacactttagtaccttcagtactctgtctccatgtagacctcctctctgcttatgcccttggatttttttttaagttagatttattgcatgtaacttcttgaatttttataggctgatttttttttttgagtatacaaacaactataagagatgatttttaaaagcctcaagagtgccacttaaaactgttgatttatatttcgactggacttaaagaccaagcagtctgtgttttattgatcctttgaattttattgtgctaaacctttattcttaagtttaattaacaggataaggggcttataggttggttgaatggtttatcatgtttaaatgtgtagcaatgaaaatatttctttaaatttttgttttaaagatttatttatttattttatgtatatgagtacgccgcagctgccttcagacacaacagaagacggtatcagatcccgttacagatggttgtgagcaccatgtggttgctgggaattgaactcaggacctctggaagagcagtcagtgctcttaactgcagagccatctttccaaccctgaatttttaaaaaatgtttattttttgtgtgtgtaaatgaaatacatttaaaatggtctcttgagccacgtgtagaggtgtatccttacaattgtggtactgaggcagtaggttttggagttcagggcgcgcttgaggaacacactgtccctcagagaaacc

SEQ ID NO: 28648 - DNA, 1230 bp, Mus musculus
ctatagagggaagccaaggcaggaactggtcgatgcagaggccatggagaaagtctgctttctggcttgtatcccacggcttgctcagcctgctttcttatacagctaaggaccacctgcccaggggcgataccaccccagcccaacacccacatccatcagtagtcaaggcgatgctggaaaaccttgtccacagagcagtgtggcctcgcccgtgccaagctgacataagagtcagcacagtgagatgtgacagtctcattatcagttgcatttccatgaacaagcaaacaaaaatgaacaatgataaaaaagtattcaaaaactgctcagaaataaactctagaggcagagagaggcaagaggattcctgcgtttgaggctagctcagtctgtaaagccctttagggaatttttaaaaaactcagtaagaagattaacctaattgaaaaatagccaaagttagccgcaaatgtatactcaggctgaaggagaagggttaccaaagcccggagtttgaggcccactggacaactacctgttggagaggagaccctgacagttaatgaactgctgtgagcatcaaacccacggtgagacctcacaccagcataggggaacagcgtctgagcaacagagaacaagacctggaaggctgggaagaagggaaatgccacacacgctgctaactcactgagcagcgcatctgctcataggaaaagctaagtgccggtctcgtagctaaccacagttccggtctaagagcaagaaacaaatactcagtgtaggcaagcacagcactgctcacaccagtgtcccccatcaggacctacaggtcagacttagcacatccgtgcaatgggtaattttcaagcactggctgcagagtctgaaacatgcacgtaagtgagaggagtcagaggagggtggcatagtgtatgattacgttttattaaaggtccaggtagtcaacagaaaagcaagatgggagcaatgggagcctgggaaggcaaaggagtgggggaaaccaccaagcagagtattacaaactggtgtggtaggcgtgttgattgcgtggtaggttgcttttctgtggtgggcatgttactactgagctctcctcctagtccagcgtcttccctccccctttgctgacattctgtttgcctgcttgaggttactgtagtgatgacagacaggtgtgcctctcactgtgtaaactaggcttct

SEQ ID NO: 28649 - DNA, 1976 bp, Mus musculus
gaaaacagacctcacatataaaacctctgtaatccttcaacccttagcaagagatgggaggcaaaaggcagaactttcaaatgcttttgagctagttaacctgatttctgcagcagcgaacaagagagatcttacctcaaacaaggctgaagtattaggacaaagcccctccatgacaggaaggtatgtgatgagagccgtggtgtgatgtgggatatctgttctgtatggagtgtgaaccgtgagtcacagggaatctgatgatgctcagttataagactgtcttcaaaacagcgccttaacccaagtgtgatggctttcctaataatcccagcactgaggaaacgaaggtggagcagtgtgggtagtgtgagaccctctcaaaacagacctataaacctttcctgtgttgtcctgtgcaggaaacaggtctcagccactaaagctgaggcggagaaggatggagtgaaggtccccacaaccctggcagaatactgcatcaaaactaaagtgccttccaatgacaacagctcagatttgctttatgacgacttgtatgacgacgacattgatgatgaagatgaagaggaagaagatgccgactgttatgatgatgatgattctggaaatgaggagtcgtgacatgttccttcagtgcccctgtactgccctgacgtctcaggccaaagggagggagcaagtggggatctacagtggccactcagcaaaaacttactcccggggcggggaagcaaacagcccctgctgaccctttgcggatctcagtttgctccttttatggacctttactggagagagttccctccacagaatgtctgaagtcttgcattctttcccttccatcactgtattgattcttttttaaaaacagccaccacccctcaaactcccacctcacctcatctctgcagaatgttcacagcaaaacacctttgtctgtttttagattcttgaagaattagtctgttcaagacattgtgtttaaagctgggagcccactgggagtccacaagtgctgcatatattgggtagcaaaagaaaatgggaaaaaaagaaaaaaaaaaaacaacaaaaccaaaaaaaaataaaataaaaaaataaaaataaaaaaagcccacaaaacaaacttaaaaaaaaaaaaaagccaatttgccaagggttagctgctcctttccattagcgtgtgtgcatctgttcagccccgtggtggtgagttttgtttctttcccttcctaaggctgggctgcggtgggcatcagggacttactctcgctaagtctgatgaaatgtgctgcctcagtgacaccatcccaacatggaggctgcagctactctgaggagctatcagattttgttttttggaattgattgggatctgaaagcctgaaataaatattcatactttacatagaaccgagcacttggttgctatttattttaaaggtgggataactttttccaccagaaagtgggggaggggaggtggttagtgtgtgtgcgttcctggttctgaaaccacagaaggcctatcccagtgttggctgatgcctcgggggaaggaagagtgagggctgcggcgggaggatgcagcccaggtactcataagagggttgatttaagtagccactttaattactcagtgttagtcctacatgcatgggttaagattgtgctgtctttgagctgcgtatcttgatagtgacaactgtggatgtgtgcagcttgggactggtccttttcctcactggagatgatctggacttcttgtactttggccaaggagtgcaagcagaaatggtgtgcggagcttcccctggccccagctgactccaggcagccttgtttcctgggtgtcagtcacacgtggctcccccaagcctgagctccggtagcttcatcctagacttgaaagagggttttgtttagcaaactgtctaagtaaagccagacttcaa

SEQ ID NO: 28650 - DNA, 1496 bp, Mus musculus
gctccaccgggcccctggcccctgcagcggcccccggctacgcgcctgccccgttcctgcacatcatgccggcccaccagcagccccactcccagctgttgcaccaccacctacagcaggatgccccggtgagcgcagtgatggaggcagcctccccacgtggggcctggggttctgttccagcctttatagccttttctcctcttcctcctcagagcggctctggtcagcgcagccagcccagctcccttcagcccaagtctcaagcctccaaacccacctacggcagcgctccatactggacaaactagaccctgaaaaggagggggtgggctctgggcaggagggaacacatggagcaccttcctggagccccgtgcccttgctgggatcctgagacaactgtcagctgagccctgtgggaagcctgcctcccagaccctctgctgtgtgtaatgtatttatgtatgtacttgtaaatgtgatacaagcctggaggagctgggctgtggtcacgggtagcacacaagtgtgtgctcccagtccagacacccttaccatagccaagtaggccccactccgacccctctgccttcagatcttccatgtggccccagctcagtgggctgctgggtgtgccactgaaggactggtggtttggggccaggtcagtaccaatgaagaatcacgacttatctcattccctgtgaaccattatgttttctcctctgtaattacttcatccttgtgtttgaaaaactgatccttctgtcatttgtcatggtccctcttctaacaaatcttaatctggaaacagaagaaataacccctgtccagcagaagcctgtccgtctgcgcacagcagaagcctgtccgtctgcgcacagcagggcttccgctttgggtctggtcctgctctggggacttgtctttctaaccaacatttaaaaacaaaatctgcactaggtctcagagatgtgcagccagtcagctcccttataaagaaatcaaagatctgcttccatccatctcagtgaaagcctgtctgcaatcaaaggctcccccatcccagttgtcctgagccaggtggacagctgtttcagggttttctctcacccaaactccacctaataaaatcctgagagcattcttggtctccgtgttctggctaagggggtggcttgggagaggcactgcctcacagggagggtcacttgaattgctgttcccttctttcttcagggcctaagctgggcctagtcaatagtcaagttcatgggcccagagaacagagtgctgagatagtgctgtccaaaccccacctgcctagtctgggaagaagccgagtgcccagactcagagctggagagctgccgctgacagtcacctgtcctaccactgcctgtggctgttggttaagtcagaggttgggggcagggaatattcagtaccctgaagtgttggggctctccagctccactgtgtgagaccaggct

SEQ ID NO: 28651 - DNA, 1137 bp, Mus musculus
tgccgctgcacactctgtgggtcctcccttggctgtggaggcggtgccagtttgttttcgtccaccagggtctccagtgtgttcaaagcagttgcttttttaggttcttaattttgtggacatcatggtcaaaagaaagctgtgtcttaagatcacatctcattttttcaacatttggttcctgttatgcaaattactctttatatatgtatttatactatctagaatttgcatatatattttagaattatatattatttgcattatggaatttgcatgaaaaatggaaagtgtcttacagtttcattatattgggacttcatcttccttttatgatgtaacaagtcgataattgttttagacatgcttttagcctcttgtactttttattccctaaattctgattatggttttcaaaatgcctacttcttgttatatactaaagctagttgcattgcctcttctcatttatttccatattctttttcttgtaaaacaaaagaatgaaagagatccaggctggagaggtggccctgtgtttagagcccctcctgcatccgcctcaggccgctcacagccacctgtaactccaagactcttccagctttgactggtacctgaggacatgcatccgcccaaatatacacataagataaagtaaaattgttgcaaaagatgagataattgttcctttgttaatctgctgtgcatatggttgctgcagtcctaattgagagtcgccctagtgtttgtctgggcatgtctacctgttaactttttctctttgctctttgtagaacggacatggcggtggtcgaagtcagcacacagtagacagtaagtgtctcttctctttatggctgctggagaccagtcagaggaatgtggctaatgtaattcggaaagccccagttgattggcgattaatgctccaaaatcagaacttgcctgtttcccctggaaaccagcggtttgtttttgagaaggtctcactcgtagctgtggctggcctggagcttgtgtgcagaccatgccgacctggaccttgtgctagctgtgcctgcctctgtctcctgagtgccaggatcaaggatgcatgctaccacaccatgcccccaaactgcttgttttgatcag

SEQ ID NO: 28652 - DNA, 1380 bp, Mus musculus
taagattcaaaagtaggtgatgtagccagctatgttgtatagtatacatctagtatttatgaggccctgtcctgtgctcaatcctttcccaccccccaaaatgatacaagtataatttagaatgctactgggctagggtttttgtttattttgggcaggaggcggttatttatttatttgtttgtttatttttttttcattgagaccacatctctctatgtagtcctggctagtccagaacttgttatgtagaccaatttggcctcaattcagttttgcctgccttttcctcccgggttttgcagctaaaggcatgtgctgccatacttagctctttttgagaaaacattctgaagcatttttatatcttttttgttgttgttttgttttgtttttcgagacagggcttctctgtatagccctggctgtcctggaactcactttgaagcatttttatgttctattttgtgtctccccactccccgaattagatgtttgatttttttttttttttaaccatgatttggaagttttgctcacaatgccttctttcttgcagattttgtattttgtacatacattttgtatattctgtatatgatgacttctgtgagcaatgatcgttgccgaggtgctcgggaaaaaccacagatgccaacagcacacgcagcccagtcacagaaacaagtggtgcaggtaagctcccgaaaagcctgactcccttagacggaactacactttcatatactccccttcctaggagactcaggatttaaccttgtctttatagagtgactaataagtgtaggaatgaggtgatcatggtaaaactgaatgttgttccaggagaatcattgtgtagttccgaattccagttgtcaccatctcctatagcaattctacagcaattttcttccttccttctcctttccttccctactcctttcctttccctctcctgcttgtcattgtctggcatgtaatactaggaagtgaacccagagcctccctgttctagacgagcactctactactgacctgtacccctagcctgttattcttctaaatgagacggttgagtagagcatggagcacagggtctggtacaaagttaattttgtacaacattgactcctcaggtgacaggtttcttaacagaaacagtatctttttccccctttatatatatggtttttaaaaaaatttttatatttattaactgtatatttattatctgtttatgtgtgtacacgcatgaacataaatcactgtggtttttgaggttagacatcagttagaaagagcttctaccatgtgagttcagggttggagctctggagttggcagtgagggcccttacttattgaaccatattgctgg

SEQ ID NO: 28653 - DNA, 2451 bp, Mus musculus
cttactctttcctagaggtactaaccgtctcctcatcttcccacagaatcatgatgaaacctggaggaattacttttcggacattgacttcttccccaatgctgtttacacccactgctacgactcgtccggaacgaaactctttgtggcagggggccccctcccttctgggctccacggaaactatgctggactgtggagttaatgacaactaactttctcccaaaatgcagatttacactaacttccaccctcagtttccttgtttgatttccctagctgtggaaggctctcctgtctatgcaaacagagtttgcttgtgggtcaggcagttactaggaagaggctctatgcagaaatccaaaagctgggacgttctacgtcagttggtggcttgttgttctgggttttttgtttgttttcactttgcagtaattagaattttacttttcccttttctgctttttaaagcaaacactgttacaatccctttttattttttcctctccttcctctggcttctttacactgaaatgacaaagtcattcttacccttacttcactgaggtagggcccctttataatcgtgtggtggctgtccgactttctgtgaaagtgtgggagcctttgtgtgcgtgtgtgtgtgtgtgtctgtctgtgtgtctgtgtgcgtttgtgtgtgtgaacttgtgtgcctgctggtactgcatcactgatactacttggaatgaggattatctgtaattaaagtatttataaaagaaacaactttactcagagtccagctttgggactagcctgtatcttctttaaggtccgacattgtaggaagagaaacagacacaccaggaaaacccttgagttagagaagccggatgggaggggaggctgcatcccaggactccaaactgtccaggcctacctgtccttccacccacgcaggaatgcccatgtgtgtgttacttccactcccgacctcctgtctgctcgcccagactggggactgcaggccacatcacagcctagataaagacaatcctctccccagcctcctgcctctgacagggtctgatctgaccgagagcaggcagtctcgagcttgtgtgcttactgctcatgacttggaggaggaacttttccattcttggggttttgctggtattttctaatttgtctgtccaggaaggtgtggtttgtagcgagtgctttgtgtgtgggatctgttctcagtgcagcagggcttagtgttggaagtcactgtcctgctctgttggctcattcctagggtagtgacaggtggctgtgccagcatcgctgcatgtgacagtgtagctgtgattggtaatttgcttgtttctctcaaactatttagtgtgaagagttttttgttgttgtttttgtttttaacttgcaagccagttgttgtcttccgaacatcatgtggaaaggaagctctccccaccctagtaccctgagacacacagtgctgcctgagaaatgcagtcatacacctgcacccagtttctcagttgctccccagttcttccatgctctctttgtgtcaaatgagtattctcataatggctggggctgctggggagggaagcggcaggcccaccgtaggacacagcatcctccacaggttttagaataatcatcctataatctagagaaataggtgctatcaacaggaaattaagcaaaatgctggatgctgtgaatcttttgtcttaatttttttctattcttaaactacaggctgtagatgtcttagttctcacagaacttctgtctttttaaactgacttgtgtgtttaagtaaacaaaactcttgtaggatgttttgtgccattgccagtccgtctcctgtgatgcttttgattgtcttgagattttctgtttttaaaaatgtagcatttgacttttttgccaaggaaaaataaatactatcccagtgcagagctgtttgagtgactatatatggcaaagatgctgcagggagcagacccgaaggattggtgagggcatgctaagatttttcagagttacctagaaaggcttgctcctgcttcccggctctaggctctggggtgcaactgagggcccccgtgcctagagcaagtagtgtagtacctgaaagaaacaagtggttctggggccccgtctgcttcactgagggtgtcctgagagtgactagaagtggctgcatagtggcctttcttgcaattaagaccacactgaatggtcttcccaatgctgggggcttgggagaagactgctaagtcacacgaccaaggctttccagggcaagcaggctgtgctgatctttgcatttgctcagaccaaactcacactgggaccttgataatcagattgcaaaacagaagagggtgggtaaattagttaaatcaatttgagaatatgtcttacaaagagtgacatttggacagg

SEQ ID NO: 28654 - DNA, 1099 bp, Mus musculus
ccattgagtgggctgaagatattaaactaatccaagaagctcagcgggaagcagagcggaaggccgaggaagcagaagctaaagtgaattccaagagtggtccagagggtgacagcaaagtgagcttccccaagactcacaatacagccacaatgccacctcctattaaccccatccttgccagcttacagcacaacaacatcctcactccaactcgggtcagcagtagtgccacaaagcagaaagttctcagcccaccccacacaaaggcagacttcaatcctgctgacttcgagtgtgaagaggacccatttgataatctggagttaaaaaccattgatgagaaggaagagctgagaaacattctggtaggaaccactggacccataatggctcagttactggacagtaacacagcccggggaagctcgggggctgtgttacaggatgaggaggtcttggcatccttggagcaggcaaccttagacttcaagcctcttcataaacccaatggctttataaccttaccacagttgggcaactgtgaaaagatgtcgctgtcttccaaagtgtccctcccccctattcctacagtaagcaatatcaaatctctctccttccccaaacttgactctgatgacagcaatcagaagacagtcaagcttgcgagcactttccatagcacatcctgcctccgaagtggcgcatcccggagtctcctaaagccttccacccaaagcagtgccagtgagctcaatggggaccacactcttgggctttcagctttgaacttgaacagtggcacagaggtgccaacactgacatcctcccagatgccttccctgtctagcgtgtctgtgtgtacagaagaatcatcacctccagatccatgtcccacagtaagttgtcagtcctactctttattccaaaggcggctcagtgatcccacttagcagcagacttgcttcccacaagccttagtgattgatagtgcgtggagaatggctttgttttctgatagaattctgcttcttttcctgagggcagcttgtgtatttattttttgttcttcagtgctagggatcaaacccaggcactc

SEQ ID NO: 28655 - DNA, 1207 bp, Mus musculus
tggagttgaatcccagtgataggaaggggaagtagagttgcgctaaaagccaggcttttggaagacagtgactgttgatagtctttttgccttcccttctatctagaaagcatactttaggggttaaatactttgtcttggtgggaatattcatgtgggcaggagctcgtccagaggtcagcaagtgaattgttactttcgagggaaccttaaagacccatgggactgcttgaaggaggcagaatcttcacctgcagtatacacctacattcagctgctctgcgtggctcaactctttctgaaaaaaatttgttctcctttatcccatagatgatggagtttcttcagttaatgagcaaatttaaggaaatgggctttgaactgaaagacattaaggaagttttgctattacacaacaatgaccaggacaatgctctggaagacctcatggcccgggctggagccagctgagacctggccctgctacggccctgccacagcaccaccattccccaaggaggctctgcacagctcacttgtggggaagacgggacatgcttccagattttctttgggggttagaaggtcggatgtggagttgacacttgttagtctctgtgagcccaggcctgagctgggggaaagtaggaagatttgggcatatatgctctctattggttccttccatattaaacatacctgtgttttgagaagtgtccttcccactttgggctttcagaaggaatacttggttctttctggggtctctaatgttctcagccaaaacctggcctggctaccaagaagagtgggaagacaggaggagcagactgctgctgttttggggctagatcctttcctctcctctctgctgcaccactgtcagactgggctctaacccaagtggaatgcaactgagagggtcttcctgggcccgccttccccgacagccctagtgttacactggttctggagtgtctctgcggtacaaagatgcacttttcttcatggggcaaagtctgcctcttctgccaggcagttcccatttgcccctgtccagactgtttcttttggcttagaccataatcctctgctgcccggggcattggagcccctgtgctaggaagctgtcagttttgagtatcattggccctttccagcacatgggtgagaaaacaggccacgacttgtcactcagcactaaccc

SEQ ID NO: 28656 - DNA, 1140 bp, Mus musculus
gtatgtacatgcatgccttattctttttgcttaagatatctttggctatgtcttgaatttatttgttcttcatattaattttgtttgtatttaaaagacagagccatgttatataaatctagctggcttggtactcatgtgtagcccaggatggcctcaaacttgtggccagcttcttgcctctgcttcccaagtgctgggattacagccatgtgccactacaactagagaatttcaggttttctttttctatgtctttttaaaaatgtcataagtgagtttgtagttgttactgtttttgtggggtttttttaatgttgcagttgagatttaataaacatagtacctcattcacgctaagtgctttaccactttttctcttttcattttgaaacagtctcactaaattacccagactggccttgaacttgcagtcttcctgtctcaggcctcccaagtgcggcctgccttcctctcccgtccccttctgtcccctgccctcccacccacctccctaccacacacacctttctggtttttttgtcattcaagactggtttctctgtgtagccctgactgcactggaactttgtagactatgctggccttgggttttctttttagagcaggttctcgtgttcatgctggcctcaaacttgctgtgtagctgaggatgagcttaaacttgtgatcctcctgcatgcgcctcccaggtgctgaagttacgggcatgcactggcacactgggtttgtgtattgctagggaccaagtcctttggctttgtgtttgcccggtaagtactgtaccactgagctatatagatctctaaggtctaatattttatattttggtgtttataaggatttatttttttaatcctagcattgaatctttgctttgggttttatggacattttaacagtgttgattcttctgagaatccatgactgtgtagccctggctgtcctggaactcactctgtagaccaggctggcctcgaactcagaaatctgcctgcctctgcctcccaagtgctgggattaaaggtgtgcgccaccatgcccggcttatcagtgttctaatagttttcaatgtggagagtcttcctacctgtctgcctgccttccttctttttgttt

SEQ ID NO: 28657 - DNA, 1235 bp, Mus musculus
tccaggctggaagcaagagataaggctggcctcctgtgccccattgccatttcaccctagctcaaagtccaggagccaggcttccagaaaggctcttcaagagcaagcttaaggaaatacagtgagccaagtggctgtatgatatggtatggtatggtatggtatggtatggtatggtatgcacatgtgtgtgcatgtgtgtgtgcctgtgtgtgtgcgtgtgcgtgtgtgtatgtgtgtgcgtgtgtgtgtgtgtgtgttgtacccgagtgtgtgttgagcctatctgtccagggaaccagattggtgtccgagatgaggaaatggctgtggcctgggaaatcagtgagaggccgcttgggaatgagaatgcagtggactgaaagcacagcctggccatctggaacctgggttctggtcccagcctcggcattctccctgagctcctaagcaattcccaggcttctctagggcttcagttctcacaactggaaaataaagagtagctgacatcaccgacagagtcttttcataccagaaggaatttcttcacaggagtttctgcaaaagactatgacatctgtgtgtctgtggtctcacgaggtacctggaggtgtatgtgcacggacatgggaagtacgtgaagatttatttcgggaaaagtggtgtgtgtgtagctgtactgggtgtcatgtatgctgttgcttctgctgctggtctggtctgagggaggaaagctgaggctgtagctcagtgagatggtggctctcccatggctgaagacaagtgcaagcagagagagcctcaggctgctgggcctcggacccacgagcctcctctcactgagccagtgcggccagagtgtctctccttcaggcgccccacatgccagcatttccaccctctggattctcctcacatgtcactctccaggtgccggggcctagagtgggcgtgtgagaaggaggagtggggctgttggcttaggaagggaagcgcctctctgtacaccacaaccaggagctgcccactccccacacctccagcccagcttacctccccctagtacagagatcctaattagataagaaaatgccaagggaggcaagccagagaaagcatctgcaggggccacaggcccatggtggccccatctgagccccctctcccaccccagttcgcatccccaccactcatcatctgggccccaacgctagaactccccccaccgcatc

SEQ ID NO: 28658 - DNA, 1129 bp, Mus musculus
gcgagtttggagttgtcaaagctgtgaacgagtcacttcagtcctgttcaggcactgcaaggagtcctggccagtgaccactggatctcagttacccaacttggagatggattagtaaccttgctttgaggtcacttcgtgaggcagcccttctccttcacggtcaagggcagagtgaacattcctaaccctcacgccagcctccacccatagctactacagatcacacacacccagctggggctgagacccaggcagcactcagcagtcctcccaacccacagcccaatctgtttttagagggattccccaaacttctggttgtagctctgcagacataagggggggagtttccaaacagcaccctccctccagattgtccatttagctaggcaacagtgaggtggggacacagagcatctgggacattgctggggctggtaagagtggtcttggggtccagaatcctaaaccagactccagtactgggtagttgaggtcaccagtgtgtagcttgtcgctgtctggcaatatcactaatggttactgccagcctccatgggtgatagcatttctgtgaactagtatcattctgtatgccattgagtctgtcaccatctttgtgtcagaactgtatccatgtcaacttctctgctactctgtgtgactgtatccatttcaacaggtatcagtgcattgttggtgttgttgtgattgactcttactgcaacattgttactgtggtgacgtgcttgtgtgtcattgtgcaaggtgcaattgtatcatttcctctgacttattaacattgtgtggtagtgtctttgtgtcacagtgggacagtgtcactcaagtggagccctaggatttgtcttatatgttgtttgtatatgtaggtactgatgacacagggttccacgtgagaaatggtactggaagcttgtgttataaagcacggggctgctttcatgatgtttgggcactctgttccattcttattctggggctgacctctgtgtggtccataaaggagcctaggctggggtacaaccttctctggggttgtatgacgtttatcatctagatctatcctggagtcctaaagtaaggatttgggaaaggagctgtttgt

SEQ ID NO: 28659 - DNA, 1196 bp, Mus musculus
gtgtgtgtgtgtgtgtgtgtgtgtgtgtgtgtagatggggtctctgggaggctctgctggctggaagcgttctctagcatgtgcctcttcccagtgtgaggtgaacactgggtcctgtgtcatcctgaattgctggtgtgtgtgaacatgtgggcatgtgtactcacgcctgtgtttaccatcaggaacagattgtggagagcagggagagggagggaggatggcttgctcttacccagcagagcagaaggttcctcagaagtagcatgcatggtacacgtgcatgctaagggggcagagaaaacagaacattgttccataaggaaaaggagacttctccccccaccaactctggctctgccaaaaagaccatcttcagttcttcctgttacaaactcatgcttcgagtgccctgctggtgtgtgtgtgtgtgtgtgtgtgtgtgtgtgtgtgtgtccctgcatggattttcttttttcttttttctttctttctttctttcttttttttttttttttttttttttttttgacagtctctttacatagccctggctgttctggaactcgccctgtagtccaggctggcctcaaactcatggaggtctgtctgcctctgccttctcagggctgggattaaaggcatgtgccaccatgcccagtcaatgtctatagtttcaagggtgtgctgtactatagtagtgatctggtaggggtgggggtaaagaaacaagcctttgatctaggctcccagtctgaagagccattttgtctgttctgactccatggaggacactacagtgccctcttcttcctgcgttcacacttgctgtagaccctttccttccacctaccccagctagagagagtttctttcagccatatgttcttgcctatccctcccagagatcatggcattccggctgtctactctccccatgtaatgagtgcccccaccccgccccgctgcccttcacatgactggtatattggccctttttgggtggagggctccttctggttcttctgtaaaccacaaactttggactgagcttggccggtaggaagtttgtcacctgtgcctccgattctgtgaagctgtccagagcatgtgcccaaagagagaacatgaattcctctgctctttcctgctccccgtgcaagaggcaggggctgctggagcaaatgccttctgaa

SEQ ID NO: 28660 - DNA, 1208 bp, Mus musculus
ctcggccagctcaggcatttcccccatctgtggcatatgttttcgtatagtggattgtaaatgcaggctggcagttcaggattttaagcctggttctcctactcccaagttactgttctgggtcatagcgctctcatccgtaaagtgaggaatagggtgctcaccccattagagttgaaaagcttacaaggagatgtacacatttgacactcagataccaccagagcacttggtgctgtaattgatcaactccgcttgctgtgaatcaaggttttctccagtatgtctagtaatctggatgcccaattatgagcaaataaaattggggctcttctggattcaggctacagcaggacccagcaagttgaaggtgctctcaaaccagggaggagagattgggatggtgggagaaaaagttggggaacttaaggtcttgatatgggatgagtgagatgtggccagaaggctatcctccagctgtagcctgaactttaaacactacatcccttgctttccaatgtagggcatctcagtgaggggacggggacgggacaggtggtgaagattcaggagattgggagaagtgaaacaagttactctaggaggccctttacatacagagggtcctgaaacatctaacaactgctggagaccgcagaaccactgtgatgtctcacactgccaaccgcctggcctccattctctgttcagctagttcaaggcttcagctcctcagcttctacctactgttctctgtcattgctctgtcacgtgtgtctccatgcccttctctgacgtcagcagttctcagtgtcaccaagtctccagaactttgggccacattattgtaaattattgagtcgttttgatcttgcaatcccatcccggttgctgctttggccaggttaaagcaatcacatataataaaggcagtaacttacactggatgggtgattcagtggggcatcttcgttagcttcagaaactgggaagagacttcccggtgggttgcctaattaaaaatcatctgcgatttccaaaatgattagagagagagtgtgacgggaaacacttgtgctcagaatcccctgagaggacaggttttagggtactctccctaacctgtggtccctagggagtcggcctgactgacatcttcagggagagaaccagaggtgaagccttggagtgagaatgtctgctcaagg

SEQ ID NO: 28661 - DNA, 1174 bp, Mus musculus
gcctaggatggagagtgcctgttttgtagtttgctcctcatactggaggttattcaagcaccatgtcttgtaggtttagagggaataatgaggcaggaagtttggtggggcgtggctatactcctcagctatacgttggcctacaggaccagtgtgtggcgatcactgaagagtctaaggctctcctggaagggtataacaagactgtatcctttgtgcttcgtgctccttaatgggtatctcctccctcctacactctcatcccagtctcttctccccctcacccctttgggcacatgcaaagtcattcaaacccctgttgtcaccttgacctgtcgccagacaatgcttctctccaagcagtttgtgcagtgggatgagttactctgccagctagaggctgccaagcaagtgaagccagcagaggaatgacagccactccccacgtccccaccaggggaaggcaggcggctcgagggcctcgcaccaacctgtctctataaggcagagacagcttcatctctgaattcagatactacctgtctgtgttcgactggcggctctgaggtcagggtcaggttgaccttagagtcatgatctgtactccctgtcaatgtatttattccagtgacaataaacttgaacgaccactaaaggagcctgttggcctgctgatgtaagacgggctcagctgtgaggatttgggaggtgaaggggagagctgtcaaccccttggggtggggccaggagctatactcctgatctggtttgcggagagataaagagttcttacatcatttgactgatacagtggggcattgtatatttatttaccccatacttgccaattaccctctaaatatcatcctatggtaaggagggcacaggagggacgcctatacctcacagggtttggggaagaccaggtgggcccacatgtcagatggtcatggaggagcaggcagggacgttcagaaccaaggcagcacagccttgtgtctacattataccagtagccagagaaggagcccaagaggtttggatgtaggaaattttaggaatgggggagagaaagcagggagaaacagctataaagcaacgcgctccaccaaatgtatgctgccctcttgtggtctgagggagtgccttggcgccttcaagtgcctgtatggca

SEQ ID NO: 28662 - DNA, 2029 bp, Mus musculus
ctgaatctgtttaaaagaaaaaaaggcgtgggcttgctggtgtaaggttaagcatcacactttgtgactgaacaggcgcatttctcagagagcctggcaagccctgtaaccacacagaatttccaccagatatgagtgcagcttggaaatgcagatgccataattctatacgttagcctgtagctgggttgggtggccttccaggggccaggtgatgccattggtattaggtgttttggtctttgtcctctgatcaagcagcttggccagtagggtagaagaactttttcttttcttgaaactgtcttttcattcccctcctctccatagatagcccataggctagacaaatgcagtatggaaggccagggcagagctgggctcctcatgaggtttcttatcctgtctgtctcccaggagagacagttgtacacgggcctggagaagcaacggctctggagtggggaccaaacacgtggatggtggagtacggccggggtgttattccgtctaccctgttctttgcactagccgacactttcttcagcacccaggactacctcacactcttctatacccttcgggcctatgcccggggcctccggcttgagcttaccacctacctctttggccaagactcctgaccagccaggcctgaaggaagatctgtggatggacaggagcgcggcaggaccacatccatctctctactcgctggaactcatattcagacagcagcgtataccatgcagatattaagtacctgctgtatgaggaaggacatacatacttgtacatccagacacagctcttgggaagcaaatgagacacagagatgctaagacttgtatgtactgtaagatcatgcactcacatccacccagaaagggtcctctacatatactccagggggccagtcatgtttgaacacacatcacaagcttgactcactgactcaggctttcctagagcctcctgctggcattcagggctctgggatcaagggttgaggtagatgttacacactacctcactctgatgcctcattcctgtagtaatctctggtgaagggaaagaggagctgcccttcggaggtccccttcacctgcagctatgatgcccttcccttcatccctttcctcaccatatgccttatctccattccactcccctgctatgcaaatgcccccctggcttgtcctccctgccccccccccccggcaaccagttcagctgggaaagcagaggcatgtagaggatgctaaagggaagggaggtcctccactacggagacccttgttggggttagaatgggaaagctggctagtgccccagggccagttcccaaggagaggacctggagaagtaagccggggtccaaggagccaccccattccaaaagaagcctttagtgtgtgtgtgcacaccctatcagtttccagacatatctgttgcaatctctgtcttcttgtctctctctgttaataaaaacatattaaacagtttcgtttccttatgtgtctaaacagcagggaagccagctgcctcctggggcactaaaaggcctcctgtacaatccagtttgtaagacaaggtttagacagaagggagtgtgctaagaattactttgaagtcagccttctaggggtggtggtgttaaacctttggctctagactcagctctgcctgctgttggcatctgagtgttggaactggaagtgagcaccaccacacccagagtgcccccccccaccccccgcaatataaagctgacttagaatttacgatgtgatactgaaattcaccgtgaacttaacctccagcttccacttcctaggactgagaattaaggccaaggctttgtgcagtctgggcaagcgctgtgctaaccacacccttagaagacagatgagtcactgaggctggctggcttgcatctatagagataaattttttttttaattttatttctttttttatatgagtacactgcagctgtcttcagacacacactagaagggtgctttgg

SEQ ID NO: 28663 - DNA, 1170 bp, Mus musculus
aggtaagcccgaatacacagccaccaactgggataggaaaaaaatccttcttccttattactacccttcgcccacaagggggagcagtgcgcctccttttgggtcatttccgggcaagcaattttgatcctttgagtggggccttcctcgcccccgttgcagcctggatagcccttgaattccgtcaggtagtatttctagcctattcttgtcagtaggtgaatccccactatgatggtacctttctgtttgacaatgacttcccggctctgcagcccgatgctccggatccaggtaccctcaatttaaccactgttggggagaagggagactgggtctgacccgggtacctgtgctacagagagtaatactcctttattccaggacccagtgaccaccctctcttccgagcagaggccgccagaggagtttggtaactttgggtttcccctcttacaacctccagcccaggtctgaagacgaagacctgagcttgggccctgcccttagcacccaatccacttccctatgtcatttttccctcaccacctagtaaggtcatgtgcttccacccctggtcggatgtgacgctgccactcatgtctgtccctgagatccgagctgtcatcgatgcatgggcctcagtcacagaggagctgggtgcccagtacccttgggtgcaggtctgtgagggggaggtgtaactttggtttgggggagaaccattactgcttccacagggtatggtgaggaggggttgacttgatgtctgtgtgactattgaatatctctctcctttctacccaatagatctttgaaaataaaggagccatgatgggctgttctaacccccatccccactgccaggcaagtatgtgacaggccttaatggctttcttggctgagtccaccggcattgtggacaggactactagattaagagatagggcaaaagaaatacattggtaattcggaggctcagagataatgggctggcctgctcttctttgtgcttgccctttgacaggtttgggctagcagcttcctgccagatatcgcccagcgtgaagagcgatcccagcagacctatcacagccagcatggaaaacctttgttattggaatatggtcaccaagagctcctcaggaaggtagaccagaccttttaccc

SEQ ID NO: 28664 - DNA, 1099 bp, Mus musculus
tatatacatgtttgcattgatacttgttcaggatttctttttgcttctctgcatacaggagaagcttcaaaaaacgtaattgatcattgcctacaagcatttaatgccatgggattgcctaaacttattaagacagacaatgggccatcttattccagtaaaaactttatttcattctgtaaaaaattcggtattaaacataaaactaaaattccttacaaccccatgggacaaaaaaatagttaaacgtgctcatcgcaccttaaagaattggctttttaaaacaaaagaggggcagctatatcccccaaggtcaccaaaggcccaccttgccttcaccttatttgtcctaaatttcttgcacaccgatatcaagggccagtctgcagcggatcgccactggcatccagttaattctaattcttatgcattggtaaaatggaaggaccccctgactaatgaatggaagggtccagatccagttctaatttggggtaggggctcagtttgtgttttttcacgagatgaagatggagcgcggtggctgccagagagattaattcgtcagatgaacacagattctgactcttctggtaagcatcattctaaagactaaaattccttttgtgcttagaattcagctgagagcgaaagctcccaaagctgttttccagctactctctgagccagctcccgacaggaggccggagactagcctcagctttacaatttgcatttgaataaagtacctagacttccccgaaagaagttctgctttctgactttctcactgtctttcaagattttgtctttcaagcaggtaaatcaacactctcaaagcggaccagcggatgtgcatccccgcccccctagagcacacaggtggctgctgttatctcctttccaaggacatttccagcacgtggctttcagtctgagttaaaaatttaggttttcctagagggctagaagagtagatatttctatattaataaagattggtttttattttgatagacaggcttagccccttagctgacctctggcttttcacccttgctattactgcaaggtgtagctccttaggctgtggaaaaaa

SEQ ID NO: 28665 - DNA, 1099 bp, Mus musculus; identical to SEQ ID NO: 28664

SEQ ID NO: 28666 - DNA, 2124 bp, Mus musculus
gagagcttaaaaatctatcgccaggctccggtctccaaggtgcctcaaaacgggcccactaatttggctaaggtaagaggtaatgcaggggccgatcgaacctccctcggtgttccttgaaaggcttataaaagccttcaggcggttcactccctttgatcttacctcggaagcccagaaggcctcagtggccatggcctttcataaagcagtcagctcccgatatcagaaaggaacttcagagattaaaaagtatattatgagagggagacagttattcgatctagtgaaagaggcagagaaagtgtgtgtgtgtgagagagagagagaggcgagaggcaaaagaaaaaaaacaggagggatcgtacgtagacaagaaagaaatttgccacagtggtaagagaaaaagaaaagacaggatctagacaggaaacctggacaactgaagaccgagcctcagctaaagaggctcagctgtgtcagactgaagttacttatttgggatacacccttcgaagtagaaagcagtggctaaaagaagccagaaaaagactgtaacgcagatccccaccccaactacaccaaggcaagtaagaaaattcttgggtactgctggcttctacagactctagatacctgggttggcgaccttagctgcccgttgtacccactaaccaaagaaggagaagtgtctatgtggaccccagatcaccagaaagcctttaaaaaaatgaaaaaggccctactgatggccagcctatgcctgacctaaccaagccattcactctttatgtgaaaaagagagcaggggtcgccagaagaatccttactcagactttgggactttaaaaaaggccagtggcttacttatccaagaagttacaccctgttgccagcgggtggttttcttgcctgaaagctattgctgccataacactgcttgtcaaagatgctgataagctcactccgggacatagtggcaccccaccccacgctcttgaaagcattatccaaaagccccctgactgatggatggtgaccaacgctcctgtgacacatcagagcttttttgttgtctgaacaagtgaccttcgcttcattccacctgctgtcccactgcgtgagactgcacctactcatcactgcactgacattctggcagaaggtcagatcagccttggcctgagggttcgagctggtacactgccttgaggttaaaggtaagcagaaggtggggacagcagtatggtggtgaacagaaagcaagtgatctaggccagcagccttcctgagggacgtcggcccagaaagctgaacttgtgactttaagacaagctctataaatggcaagaaaaaagtctacactgacaacaggtatgcttttgccactgtacggggcaatatacaaagagggctgttgacatcttcagaaaaagacctaagatgctgtggctaaaaaaaaaaaaaaaaaaaaaaatcaggtggcagatctaaccgccaaacaggtggcccaaggagcaatgatcctggcagtcaaggagcctaaagattattatgacatcagagagaccagctttagatacaccgctgagcactatcaagttatagacagtatttgacttggcctgggggccaagaaattcaaaggtgtggttaggtcctttgactactatgttacaagactctctgacttggcaaaagaaatagtcaaaagctgcaaggcctgtactatgacaaggtataatttgtaaaagaaatcttcccaaggtaatggacctgcctttgttgcccaggtaaatcagggactggccaagatattggggattggttagaagttacattgtgcatgcaggccccaaagctcaggacaggtagagaaaatgaatagaaccattaagggacccttaacaaattgacagcggagactggcgctatgattagatagctctcctaccctttatgctcttcagggatagaaacacccctggacagtttagactgacccccctataaattactctacagggggccccctccactggtaaaaatagcctttgtacatggtgctgacatgctgctttcccagcctttgttctctaggctcaaggtgctccagtgagtgag

SEQ ID NO: 28667 - DNA, 2124 bp, Mus musculus; identical to SEQ ID NO: 28666

SEQ ID NO: 28668 - DNA, 1329 bp, Mus musculus
ctgtgactttgtacttccttgtgactcttatctggtatttttggtattttccaacaaagcccttcccacctccttgagttgtggatttttcctttaaatacccctttacttagctactcggggcgccacagtcctctacccctgcgtggtgtatgaccgtgggcccgagagcgctcttgaataaaaatcctcttgcaatttgcagcaagaccgtttctcgttggtgattttggggtgtcgcctctcctgagtcagaacgtgggggagtcctcacgttgtaggtctttcatttggtgcgatggccgggaaacgcaaccacccctcacacctgtgaaccgacttggaggtatggggatcccctcttgtgtgtgtgccggccggtgtctctgttttctgaaatgaacattggaacatgtgcttgtcatgttgggttgtttgtgtcttgtcctatgtttctgaagcacggcaaagtctgagtttggatccatctgagtttattaaatttgtatcttggtttcagggttacgagatcgtgggttcgagtcccacctcgtgccttggttttcgggttgcgagatcgtgggttcgagtcccacctcgtgctttggtttcagggttacgagatcgtgggttcgagtcccaccttgtgccttggttttacaccttgcagagtgaggaacaagtgtgcttctctggttttggtcgtctaggtagaagtggacgacggtgtttgtagacgatggggtgatggggttttctgaaatgcgcgtgtctgtatttgcagctgtccttttgggccgtaaggaccggaggactgtggtcggcagacgtgctaggaggaccacaggctgtggccctgggggacgccctgggaggtaaggagagccagggacgcctggccgtctccggatcggtcagagggaccgagttctgttgaagcggaagcttccccctccaacatcgtctaattcttttgcctgcttgtggaggacaagaaagggtcgagtgtgtctggatctgttggtttctgttttatgtgtttttgtgtatgtgtttagagctatgtgaaaatctaaaaaagcaaaggtaattctcataggtgctttataccctgactagagatagtttacacctgaaatgtgagagaatgggataaaataagcagtatcaattggtctttggagccctgcacctgtagttaggaatctagtgtggctggagaagccctgctaggagctaattataaacgctgctcttatagggaccagcagcttctcaagttctatggtaagggaacagatggctgtttttcctacaaaaatctctgtg

SEQ ID NO: 28669 - DNA, 1329 bp, Mus musculus; identical to SEQ ID NO: 28668

SEQ ID NO: 28670 - DNA, 1105 bp, Mus musculus
ttcaccagcccaggaggagggaggggcacgtgcagatgccttggtgattttgtaagtggtaaatgctgcggccagcttgggctctgtgcaaactgctacagccaccgctggttccctaggtccctgcctttctcgtccatcctccaggatctgtcccctgctttcccacatagacatggttcctcagtggttttctttactcctgcctggggataggcgggtctcctctctaagaagaggtagaggggagcctggttggagccctcttgaaggaaagatggatttatgtgtgaatcttgaactttcaaagagctgtcctgagagacttggtccttggcttcaagaaactagaagagagggttgaggggatggttagggatgcgagcacttgctgtgaaatcaaacccccaaacacccatgtaaaagccaagcctggctgcatgttcctgtaaccctaggattgtagggtggcaatgggtggaccctagcaggttacccggcttatccagctgtgtttcaaaggagggaagtggagctataggggaagacactctggcctcgtcatgtcccccacaagtgtgaatatagaacccacatgcacacaatacacatacacacaaatgaacacacacgagtgcacacacacacacacacacacatgcacacacgtatacacacacatgcacacaaacataaacacatacacacatgcacacaaacacacatacatacacatatacacacgcacacatatatacacacacatacacaaacatgcacatacacacatgcacacatacactcataaacacagacagacacaaacatgcacatacacacatgcacacatacactcataaacacacacacacacacacacacacacacacacacacacaaccaggaactgaggaattcgggctgaggctggatcacctttttattcagttaggtataaatcataggtgcaaggacaagggaagggcgccatggagagcaggttcaggtcttgggacctgagtgacctcctagaggggacagtcctgctgtctccttcctcattccctgggagacactctttcttctgactctctaggtctacccc

SEQ ID NO: 28671 - DNA, 1105 bp, Mus musculus; identical to SEQ ID NO: 28670

SEQ ID NO: 28672 - DNA, 1105 bp, Mus musculus; identical to SEQ ID NO: 28670

SEQ ID NO: 28673 - DNA, 1105 bp, Mus musculus; identical to SEQ ID NO: 28670

SEQ ID NO: 28674 - DNA, 1236 bp, Mus musculus
cataccataaaaatgctatgcttctgattaatgcgattttatttaaaatatgagggttgctcttaaatcatttttgcttttcttgtagtatcctgtggaacatccagacaaattcctcaaatttggcatgactccctccaaaggcgttcttttctatggacctcctggctgtgggaaaaccttactggctaaagccattgctaatgaatgccaggccaacttcatctccatcaagggtcctgagctgcttaccatgtggtttggggaatctgaggccaatgtccgggaaatttttgacaaggtgagctagatggctggctgatgttcataatatgtgttggggcaaggtgaaataagaggctatttctccagagtcaaaaacattttatgccgggcagtggtggcacatgcctgtcatcccagcacttgggaggcagaggcaggtggattttctttctgaagcctgagaaatctagttgtgtcagcatttgagatggtctctttctttcttataggcacggcaagctgccccctgtgtactcttctttgatgagttagattcaattgccaaggctcgaggtggtaatattggagatggtggtggagctgctgaccgagtcatcaatcagatcctgacagaaatggatggcatgtctacaaaaaagaatgtgtttatcattggagctaccaacaggcctgacatcattgatcctgctatcctaagacctggccgtctagatcagctcatttatatcccacttcctgatgagaagtcccgtgttgccatcctaaaagccaatctgcgaaagtccccagttgccaaggcaggtgcagagttgtcagccataggaacttttttctgtgaagctgatgtggagtggcagaggcagaagcaaatgtattgagtggatagcccacagatctgtgtactctatggtaggaaggcacaatgctaaagtactctcttgcttccttcaggatgtggatttggagttcctggctaagatgactaatggcttttctggagctgatttgacagaaatttgccaacgggcttgtaaactggccattcgtgaatctattgagagtgagattaggcgagaacgagagaggcagacaaatccatcggctatggtgagtcagtactctttgtccaaatgtgccagttgagaggcccttctctatgatccagagttgagagtggaggtattaagaaggtgcctgatgttaaatctg

SEQ ID NO: 28675 - DNA, 1134 bp, Mus musculus
attccatgttattttcctatatagatatagcctgcacacatattcagttgtctgctctcttacctcccttcagtgctctaggatagtaagcagttctcatgcctctctgaaggataatgtggttgctgtcaagttgaaagtgtacagctctaccattgttggttgtagtgaaagcttaggctgtttataacaggagtataatacagagttgttttttagtattgcctggggtagggaaggaaggcataagtaatagctactgagctttgtattttagatcatgcggtctagtgaagaagtttctggtcctgtacttgacacctctaattgcacttgtattgctttgtattataggagatatttttcttgtccggggtgggatgcgtgctgtggagttcaaagttgtagagacagatcccagcccttactgtattgttgctccagacacagtgatccactgtgagggggagccaatcaagcgagaggtgagttactccctaatcccagttcacggttttatttggctttttatttgtggtgctgagacttgaacccagggccttgtgcatgttaggtaagtactctgcccctgaattacatcctcatctcccaaatcattaccactcaggtagtattcatgttgtgtatcaaaatgaatacttttggagattggatggccttaaattaatggaagtcgaaaaccacctaagaatttcttgaaagaacccaatcccatgagtttaagatgaagtctgaaagatgtaaatgattggcactgagtgtggtggcatatgccaataatcctaatgcttaggaggtggaggtgggaatattgttttaagtttgagtctagaatgatggtctctgaagtgatgggctgtggtttggtggttaagagcactggctgggggctggtgagatggctcagtgggtaagagcacccgactgctcttccgaaggtccgaagttcaaatcccagcaaccacatggtggcacacaaccacccgtaatgagatccgatgccctcttctggtgcatctgaagacagctacagtgtactttacatataataaataaataaatacatttaaaaaaaaaaaaaaaaaagagcactggctgttcttcaaggggacc

SEQ ID NO: 28676 - DNA, 1165 bp, Mus musculus
tctgtgtgggtaggaggtgaagggtgaattgagtcaaccagagccaaccaaccatcttttgactataatgaaagtcaatggattgtcttttgggacacaaggaccttaagtcacagcacttggttgattttcttgctcttgggcacgactgcatttctgagtgttctgcagttgtccttgacttgcatgaacctcagtgctctccctccccagataatatttatactctatggtaaggagtgtgtactcccaaggcctgagaaactgcaaaacctgcatgattacaagagagtgcaagggcaatagggtgaagtaagagctggggtgctgattcagaactggggtccagagaagaagagggggtggggtaggtggggctaggtttttgttttttggtttgtttgtttgtttgtttgtttgactcgagtttagttatgcagcattatctggcttcaaactttcaatctacctttagcctctggagtactgggatctaggatgtacaccaccatacccagctaattttaccttttaaaaaattttatctaattagttttgagacggggtctcactatgtagctctggctgggctggctggaactcttttttttttttttttttttaatagatcaggctgactcaaaagtcacaggttgctgcctgcctccgaagtgctgacattaaaagcatggactaccacattgcttttaaaatttattgaaatactgtttgggactagaattaaagatatggtcttgtatcctgggttgatctccatctattagtcttcctgcctctcatcttcccaactactaaaagtacagacctagtccatcaaccacgcccttggttggagccagtgttttaaaggagcatgaaggattttagtatggtggagtaagaggatccctaggattggcgagaaatgaacaatgtgggctattattacaacccaactaaactaataagggttcaggcctttgtgcgaggttcttccagctgcttataaactaaggagccaatcaattgaagccaagtaggagaggcctcctccgagggataaagaggatatggcctattgcctttgtcgattggtcaagactccctatccgtcgaggaagcgtagtgctgcggccaattgacgtggcgttactaggcgtgttgc

SEQ ID NO: 28677 - DNA, 1189 bp, Mus musculus
gtgagctgagtgctagcttgggctgagggggagctggagttctgtgcttctgagacctagctgaggagcagaggaaggaaggatgcaaactctgacgtctttcactctcagccatcgtcgttcttgtttttcaggtctcttccactgtatttagaaacctgtttgagctggatccatccccctaaccgcgaagccttccttgaggagtttgggacttcggtgttggagtcttgtgtcctttagcttccttgtttccaggatcttgaactttggcctctgtggactctttccttggggagggttttagatcttcttttttttgttttcttctgccttatcctctttggagagtggctggaactgattgtttctaagtaactcttttgctcctgaggctggtcctgtgaaccttgatctacttgctaccagtctagttccagagtggttccatgaacaaatcactgtctgctcatggcacttttcttccttccttcctttctctcttgtgtgttgagtaaaatcttctatttatgtcttatctgcttactacacatagttgaatgggaaggaaggctcatggcaagctagttgggtattggctgtttaagatgctctatttccaacatccgtcttctgtctgccttccctgtctccctaactcccccttccttcccattgtctttttggtaggttggattctggggactaaactgcagttcctcataaaaatccccattcctacccttttcccaccctgccatctaccgtaagagcttgagacacaagcctttctgagggaaaggctatgttaatccttctggaggagcagttttaagttactaatttatccttcttaagttactattaaaattttgaattgcttattttaagttgtatgtgtgtgtgtgtgcccttggaggacagaggcaggctgttgtgaaccacctgacatggctactaggaatccagcctgtgttctctctagctatgttatctaaaagcacagccaacagccctaggaacctatgctaggtgacagggaagaaagttaggtctggggcatgatcttgacaggcctcctaaggaagagtagtacttgatacttaaggaggtgaggacatgtggtacctggctttaatcccagcacttggaaggcagaggcaggctctacatagtaagttccaggaca

SEQ ID NO: 28678 - DNA, 1405 bp, Mus musculus
cccggactgacctgggagccccgttctgtggattaaagccatcggtcagtttctactaggcagtcccagcctccctccagcagctctcgcaggtacctgggtgtgcccccagatcggcgctggggcgctccccaaggactccaaaaggcgcagacacaagcagcagccccagaatactcaacacggggccagcgccctccatgcctggcccaccagaatcgcacgccgggtaccccgcgttccagcgctgggcctccggccgtagtgcgcacgcgcaggagaccacgcctacatcgggggggctgagtcccttaaggcggccacgcccatctcaggatgggtttaagcaatatttgcataaaccacgcccacctagcgttcctacattaattaatgacctatctatttatagctttcttaaacaattatgtctccagaatctttcaggataaagtatcatgcctaaaacaatggctcattgtttttctacctagagagaccaattttctcaccataaccaaaaaattaagcctgttgtagagtcataaattagtcgcgcctagaagctaaggcagctcgctctgaaggcctgtttcctaggctacatacgagggacatgttccttatcctttcgcctaggggaaagtccccggaccacgggcagagagtgccgcgtgcacacgcgcgtagacttcccccgcaagtcactgttagcccgccaagaagcgacccctccggggcgagctgagcggcgtgcagcggggcgtcatccgtcagctcacatagtgacgcaggcagtgcgacctggctcgcaccaaccacacggggctcattctcagcgcggctacacttttatttatttatttttgtttgtttgtattttggttttttgacagggtttctctgtgtagccctggctgtcctggcactcactttgtagaccaggctggcctcgaactcagaaatcctcctgcctctgcctcccgagtgctgggattaaaggcgtgcgccaccacgcccggccacttttatttctatacaaccttcagagccagatgtgaatgtactaattaggaaatcaaggtcaccctttcctaagaaaagaagaaagaaaacggagacaaatctgaattcctaatttattctttaatagctgtaattctttttttagactgctagtccaaagagagcaagactgtgggttttgcttttttgtttttttccattttactgtccgagcctagtcacttgttgctaggggaacttgaggaagtgaatgaaattaatgaatgaatgttcacagcgactcaaaaggcaaatatacaactaggtccttctgggtctcatgtaacctgggctggcttcattctcatgtagctggagctggcctagaactcctaaccct

SEQ ID NO: 28679 - DNA, 1210 bp, Mus musculus
tgcactagggactgtggttgggagcatggctgccctgtttcacaggtgaatgtgaaacctaggacctgatgctctttgtcgtgcgctctgtccccacacagacccttcagaagccaaacccagacctgaagcagcagctaactggacactcaaagcgggttgctggctctgtgactgagctcatccaggctgctgaagccatgaaaggtaagaagtagtgagagacaggagggaagatacgttcttgtcatggtccaatctctgcttcctggttggctctgagctagcctgtgcttctggtcctcatagatgaggtgttgctaaatgaactccccagtgcctccgagctccctgccctgcctcagcctcctctcctgccttcgtcccacaggaacagagtgggtggacccagaggaccctactgtcattgctgagaatgaactcttgggagccgcagccgccatcgaggctgcagccaagaagctggagcagctgaagcccagggccaaacccaaggtcagggctcctccctccccttccgcctgtcacagcggccagaggtctccacctctgtccctttcctttccatgaccctccccccaccccgactccccatccctatgtaaccttctcattccaggaggcggatgagtccttgaactttgaggaacaaatcctagaagctgccaagtccatcgctgcagccaccagtgcactggtaaaggctgcgtcagcagcccagagggagctggtggctcaaggaaaggtcagtactttagcaccagaggaatgaggacaaggcgctcacacccttagcctcacaagtcgctctgaagtagggacagcctaggtctaagaggactcccttcttccttctgcaggtgggcgccattccagccaatgcactggatgatgggcagtggtcgcagggcctcatttccgctgtgagtgtctaacacccagggtgtctttccgagctgggtaaacctgaggaggctggggtggaatggaccagagcaagaggcatactctaatcttaactctttgtccccattaggcccgtatggtggctgcggccaccaacaatctgtgtgaagcagctaacgcagctgtccagggccatgctagccaggagaaactcatttcctcagccaagcaagtagctgcctccacagctcagctcctggtagcttgcaaggtcaaagcagat

SEQ ID NO: 28680 - DNA, 1178 bp, Mus musculus
tcacatgcgcaagcagtaggaaggaagaatggggttctgccccagagggcactgttagagttacactcagatttgatgtctgcttcctcccaggctttgcacacccagatgctcactgcagtgcaagaaatttctcatctcattgagccgctggccagcgctgctcgggctgaagcctcccagctgggacacaaggtacgtaaggaatcgtgtgaggagctgaggagataggttaacagtacctgacactgaacccagcgtctgtttcaggtgtcccaaatggcccagtactttgaaccactcaccctggctgcagtgggtgctgcgtctaagaccctgagccacccacagcagatggcacttctggaccagactaaaacgttggcagagtctgccttgcagttgctatatactgccaaggaggctggtggtaaccccaaggtagaaaggaggcccagggggcggggagaataattgttagcacaatctagaaagacaggagctaaaggctttcttccctcatgtccccatagcaagcagcacacacccaggaagccctggaggaggctgtgcagatgatgacagaggccgtagaagacctgacgacgaccctcaacgaagcagccagtgctgcaggagtcgttggcggcatggtggactctatcactcaggccatcaaccaggttagcgcctcgggtacctgcggacacagggtaccccagagggactctggcacagaagcagtgaccctgacagtctttctccgtttcatccccctccctcagctagatgaaggacctatgggtgacccagaaggctcattcgtagattaccagacaaccatggtgaggacagccaaggccattgctgtcactgttcaggagatggtaagtttggaacatgaggagtgagtgcccttagggagctgagcttggtcagaacttcacttctttccttatcaccaggtaaccaagtcaaacaccagccctgaagagctaggccctcttgccaaccagctgaccagtgactatggccgactggcctcacaagccaagcctgcagctgtggctgctgaaaatgaagaggtaaacatggaagccatactgccttctctcaggagattccagttcatggcccttgttcccctggcagctcccagggctgtcccacgctccctc

SEQ ID NO: 28681 - DNA, 1102 bp, Mus musculus
agctctcttactcccacacaaggactttttattgttcccagcaggaatacttcctgcagatctacctcgacttcccctctcttggtgccttcacatctgcagtctcgggaggcccttctgtttactcgtgcctcacagaaatctagggactccctggccatcccttaggcacaccagaggcattccctctgaccactcctggctactcacgtgtcacagcagcccacaccaacaggatgcagacaggtacaatggaaacagtccttgcggagccaagattcacccagagtgaagtatttaccctcgtagtggcagggagctaggggaggatgagaatcactgtgttagcagatgagaattggaagcattggcagcagcctctcctggtctggggtgggagaggatccatgcatactacccctccatatagccttcccattcacaggttgaaggaatggctgttctaacacagggttgggcatctctacaccttcatccctgccctcatctttcccttaagcatcagtccatcttaccttgagcttggaagtaacacttgctgctaactcccgggtgctgtaggaacagagacaccaccaagcagatggtcctccagcctccgaggatccccttggcttggccagcccagagcatccttagggccattcctgctgctcagcgctctcagacccttcctggcttcggctcagactcctctggtcttcttacccccttgctcttcttgccttgctccttgactcctgagtttctctctccttgggctcccgtctcataccatggctgggaatgtttataaagtgaggaccctggccccctgctgaggagagctggacaggctggaactctgtttcctgaggtgagggcatgaaaacaagaggtccagcttttaacaagctgtgagagcggattcctgcccccacacagccaggaggagggaggtggccgtggaaggggcgctggactgggcacttccacagccaggagggggagggttgaaggccccaggtggtccccagatctccttgacctgcagagaggaagcattccatcaaccctccctccaccaccagcaggggtgtgt

SEQ ID NO: 28682 - DNA, 1857 bp, Mus musculus
aggagagcaggccggcatctggaatggagactgtgtttccttcagatgccagggcagggtgtccctgagacatcggaaagatggcagccctcagcattgtgaggtgaggggttcatccaaaagcaccccaaagataaacttcgcatctcaccccaagtggacagcagatgcaagcttgtcctgttcctggccatgcttctgccctgtccccccttaaggagaagcatctccaaatacccaacagaagtcaccccactttcacagagatgccccctctttcctcatgatggggcaaagccttccaaggtctgcatttctgctgactctggaggagtgctggggttcacatggtgactgctcactggctggctgaccttgcacaggtcacttcacctgccaccctgctccttgtctgtctattgagagtagaaatgccagctcatgggcgacagctcatgggctgttcttagcgccacctttggcccatggccctcagaaaatcgccactgcttgaggctaaagcacaaagacagaaatgatgtcctctctggacaacagcaagtagccgtgcccagctgaaggcttctgctgtggactctccagaccaacttctgtctttcacatgtatgctccaaggtatccctgctgcctcctaagacctgtgctgtcctgggagcatctaggttgaagggtgatgttgatcaagctgcttttcccacttccataccttgggaagcgggatcgggatcatgctttatcttcccaccccccaccccccacccccaccccccccacccccgctagcgttaggactctgctttctcttacttggattctgacttttccttcatcccctcatgtggacttcaaggcgcctttgtgaccctggtcaaactggacttcttttgttctcctgcccttgcggaggccccgaggtccagtgcttcccttcctgctcctaggacatttgttgtggtttgcgctcaggcttgcagtccccttcatccctcgctttgctccccgtcacataccacggacagacacagctcacacctggtgtgcacgcacacacacacctcccgcctgtcacctcttccttcagcagctactgtcagtacacctccaactccttagctgccttcagataccttttgccttggccggggatgtagttcagtgacagtgttgacttattatttcagtgtcccaggtctcaccccaaacacccccctccaaaactgagtgggagaaaacaggatttcttttcagatggatatctagataaaagcaaaggagaacttagcaggggcccccaggtaggctctgtaggggcgaggaggggagagcttgaccttcactccttgctgtcttggctgcggaaggggtcagacaggatcaagcttagaagtctgcttagtagtcagctcttaccactacctttgggggatcaacctgaaggctgagcatagagcgttttctgcagtagctagagacaatgcaagtgaggctagaggtcccggaggtagaggaggtgctggaaatgagactgggcggacattactgagccacaccaaactgcgaagtgagaaccagtctcctgaagcgcaggtgaaggcctgtggctgtggcgacttctggaaggaggcaaaggctgagcagaattcctttctgaggttatagggcagtggggacctggctggtggcctgggcagtgatgtgtgcaggggcatcagtggttagagcccagcccactgagtcccaggggggtagcctttggggcaaggggcaggacaggttcagggtcagggttggcacaggccacctatgcagggacaaggaaaacatccgccggagctg

SEQ ID NO: 28683 - DNA, 1125 bp, Mus musculus
ggtgaagagtcatctgcttgttctggttcccgaccatttcattgtgtctcatccccatctgccacctctgcccctgaacctctgccccctcacagtccccgctgtcttcccagcgaggttcttgggagctctcagttctctagcatctcagatacccctgaggctcagggtctttgtctgtttccaccccaccttagggaaatgttgttgccatcaaacacgtgaataagaagcgcatcgagctgacccggcaagttctgtttgaactcaaacacgtacgtacttgggtatgagtgggaggtgagggtggacagggaagaggaaatgaggggaccatggttccctggctaacgggataaggggcttatttatcactgattcccagttgcaggtgtatgtaagagaaatgtcattgctcacagtggtatttctgtatttccgtatttatttatttagagacatagtctctctgtgtaacagctctggctatcctggaacttactatgtagaccaggctggccctgaactcacagagatcctactgcttctgcctccccagtgctggggttaaaggtgtgcgccaccatgtttggcctctgtatttaagctttagggctgcccattctcttgttttgtttgtttgtttgtttgtttgttttgttttgttttggtagatgagagatgtccagttcaaccatcttactcgcttcatcggagcctgcatagaccctcccaacatctgcattgtcaccgagtattgtcctcgtgggagcttacaagtgagggacaggggtaggagactgtggtagggtgggggtggaggttccaaagtcaccttgtgtcaaagggtagcccgtgagactggggacagaccctgatctctaacgtgtcactgtcaggatattctagaaaatgacagcatcaatttggactggatgtttcgctactcgctcatcaatgaccttgtgaaggtaagtcttccccgccatgtaaaatgtctcagtccctcaatcttcgctgcagtttctctcctggatctctaacagccaagctctttcccagccctctcctcccgtgactgggtgatgcagcggtcctatgtcccgagaggttcttgtcctcctg

SEQ ID NO: 28684 - DNA, 1141 bp, Mus musculus
tctgcaataatggcaaacgccctgtacctacccacgtgcactaatgtgagacaaggcccattagcaaggccccccttgcccttccagtaatagttaattttgaataattatgtattgtctgaaaacggatgagtgctagtttttgtttccttgttttaaaacaaccaacaataacaaaaatccacacaaatattttgttttgctttgtttaaaagcaaggcatgctcgtgttgactgtaacagactaattcaaattgtcaaagctgctctctggtttcatgttggagagcaatctgtggcatcttggtgtcttttggtttggttttgcttctcctcaaccattctctgcttttggggtgagtatggggttgtgtcttagtcttgtatttttaaatttgttaaccagagggcagcccatgggggagggggacagattatttccacattccactccctaggtctagtttagcaagcatgtccccacctggcgttcttaggaaggagtatagaaacgcctcgattaacaacttactccttcttgagagttgccttttctctccacctctgagtgggtccagcctgtgatggaactcatgaaggtgggtggacgctgcctcatccctctttctaggaagcactcaacatgtgactgtgactttcaagggtatttgtttgtcatttgctgatttggggagaggggataatttctaacttctttcattggtacatgaaaaaaagtatggcacctttgcaatatatcaaatggattgagttcctaatttaaaaaagaagttctttcttgcccttgtcagtcattttcttatatggttagcatagatttacaacacactatagtgttcctagattcagctgaagacctggtacacagcgctccttacgggaatggcgttaggaaacacatcatgggtgacgactgctgtctcctttctttttcttttttatgtctttttttaaagaaagaaaaaatttctttctttctttctttctttctttttttaagagttaactttactcagtctgaatttctggaaaaaaaaaagttgaaagtaccttaagataaggatatactctacatcactttagagagtctaggaaaatccagtggatggaaattataaga

SEQ ID NO: 28685 - DNA, 1207 bp, Mus musculus
tcgggtaggcccaggtctcatcagaaagtagcaaggactcaaggaggtgggtgaatggaagcagttccagctgcctccgtccaagcctgtctctgtcctcacctttaacgcaggagggaaagcctttcctgtagctgtgccaacagtagccgtgctgtctagtgacataggcagtgtgtgctgtgctatagtacagaacccaaatggccgactggccagggcagtggcgttgccgtttctaatttgcattgatgtctaacatgtgtgtaataagctaagcccatcgttagcagtagctctggctcggacagtagggacagaggaaagcaagctgcctctgtggctgcctggacctgctgaaggcgcagaggctctgtgttgaaagctcctttcccttgcagattgaggcctgcaataaggaggcagagaaaatcgagtccctcatcaactccgacagccccacgctggcgtcccacgtcccactctcggccctcatcatttcccaagtgcaggtctccagcagtctcccgtcatctgctgttgtgggcaggcctctcttccactccctgctcctcctcctcagcctgggcctcaccgtgcacttgctctggactagaccctgaccacccacaactgggaggaactgcaaagccttcctccacccagccgtccaccttgtgaaagacattcaggactgctagctggtgaccaagcaaaggcatgtggcacctcttagcaccacacagtatttttttcacctgccaatattagggggtttgccttggtttataaaatggtaaattagactctcccaatataatgaagatgatgcctcttcctggtggatccctggccagttcacactcgctcagtagatggccccccttccccaaagcaaatttagcatccctgatcaatggcatggtcactttataggaggcagccccctttgtccttgggtgggtgccctggtctcctcagagttcctgtgagtgctgaggccgccatgtgcttgtttctgtgtctggaggctgagggctcagtgaaaagccgctacctgccatgacagggcgggccggaggagaaaaacatcattgaattctcactagctcataggctgactccatagaaatgtaaggcaggactctactctgcttagcaaaagcaagacgaccaagtgacactcgtgcctgtctcacacttgggc

SEQ ID NO: 28686 - DNA, 2047 bp, Mus musculus
tcaaccagggcttcttcgaagagaatgtcccacctccaaagaagtagctctcgccagcaagtgtaacgagatggagatgcatatatgaagtgcctatagaaccacaaaagcaccagcgagtgtctgtccccgtgggtgtgtgtatttatgtgtttacctgtgagcatctctcgtgacagctacacctgagtaccttctgattgaaggatggccatctgaaacatttgtccagagggctagctaaccacaattgggtaagattagttctgaaatcttttttctgtttttgtttggttggggttttgtttgtttgttttgcttttatttttgttttgttttgttttttcaaggcagggtttctcggtgtagccttggctgtcctagaatttgctctgcagaccaggctggcagagatgcacctgcctgtgcctcccaagtgtgggattaaaggcatgagccaccactgcctggtttttgtttttgctttttaaagcagacttcatttgaaactttcttccttctaatatccatccttgggctttgaggattctgaatatttgccattctcagaagtgaggtcctttcctaggcccttcctgcactgtaatcttcttgtggtagatactgaagggatcgacacgtcctttaggtgtgacataaagcagctagtgttaaaaacatttggccagctgcatctcacaggaccagtgagatctctcattctcagttggaagacatgatatcatcctgcatcctccaggattccctaatagaactgccaaagagcaaatggagatggaaaaaagagccttacattcttgaagtttttcaacctttaaagagcaaataccacagccactagcacctctcacacctcatatgtgggttgtttgtttgttcgtttgtttttgttttttgtttttaagtttcattgctcacagccctactctggctcctggggggtggggttaggtctggaatgcagccccgcccccctattcccccagtcatctcgggtgaccctcactctgtctgggctcttggccaaggccttggactatgatgaagtcaatagagcagaggtgagggtgagcttccctggaggaagccccaaagcctctgtccttccccaactctgcaggcggtgaccacccaggcctgtccccagcagctgtggctacagctgcgccttggcttcctcccggaatgtgtgacaagcccagatgctcccgggaggaggcccaaacaaggagattaggaacgctaatttgatcctgtgttttgcctcaaactatacacagtttcctctgaaaaaactgatttaaccacgtctgccagggagggatcaagccagaggttcaattgtggatccctgaaatggtggtatcccctcctgcaaggagataaaagggttgttggcctaatgacagcaaggctggctggtctttgttacactgtgaacagtcccacactgcgccacttggttcatccagggatagcaacaaacaaacgagacaataaaatcctttcctttttgtgtaacttcttcctctaatgcgattcgattcgttcttagtttatggctgaggtgatttgggactctgagcccatcttgagccacttcctcctccccagtccctcccctggggaccacactgcctaaatagctacttttggaagcatgtgacctagtagctcacagatgaatagactacctgatccgagggcataccagggacaaggaatttgagctcagacacatggagagaatttactggcggaactgaaaaacgtaccaatggtgcgagtttaaaatagaggcccagcaaacctaagctatatgttctgtagttcagttattaatggtaaaggcaggtgagcctagaatcctagctattcgcaagacgatgggaagttcaaggccagcctggacaacttatagagaatctgtctgaaaggaaggtaagaccgttgattgcaaacctgaggctctaggggcaagtaccatgcttcatgctttgaagaccaagaagctatcttgagcttc

SEQ ID NO: 28687 - DNA, 1211 bp, Mus musculus
ccagtggttgtgtgttgagtagtcgggaagagctcacgtccctgatgcccacaaatggctgttcctgatcactccagctcccgatgctcggcgactcccagcttcccctagggtggcacttccgctggctcttccttctgctcccagtcacgagttgtccccagggctcctcccctttgccagctgattgggcagctcccgtcttctgattggctgttctttttgtggctcaccaacccaaccggatatagaagcagggtttccgcttccaccttctccctcttctcgctcgtcctccggtagcagccgccagcacagtgtcggctgctgggcggggtgtcggcggatcggtcggttggtttcggcttcggcgtctctgcggttgagttgggctgtcatggccgagttggatccattcggcgctcccgccggtgcgcccggtggccccgctctaggaaacggggtggcgggcgccggcgaagaagacccggccgcggccttcttggcgcagcaagagagtgagattgcgggcatcgagaacgatgaggccttcgccatcctggacggcggcgcccccgggccgcagccacacggcgagccgccgggaggtccgggtgagagggcagcggcgttcgggcgggaggacttgtgggcacactcgggtcggtgctcttacgcggaacttgggcttctggctgaagctttagaagcgcaaagaggaagtgagaccccgtctgggtcattgcacggacctccgctgctgcagactgccggcttctgagtgctgctgggccggggcggaggggagcgcagatgcaccgactgtcaggatccgggtccgttctgtccaacttttcaccaagcccttgctgtgcctgaagcctggtctctgaagctgccgcattggcgcagtttggccagacttagagacatggctgagtccactcggaaataattgcttattaggaaaaagtgagagtagtataaactttgggacacacgtgcaaacaaaaatgtcaacgtagtttagcagttaaagatacgcaaaactttggattgtggggaggaagataaggagttcataaagatgggccggctgcggagaaagaaactgacccagaaggataggtgttacattacaagcattgcatacattgttgaggctaggactcctggcgctattctttggaaacagctttggaaggaattaa

SEQ ID NO: 28688 - DNA, 1219 bp, Mus musculus
cagccatagagacagaccaagccctgaaccaaacctgtactccgccatttcacagagcagcctgggtacctgtatctaggagagctgggcacatctgcccttgcttgtggcctgagctaggggccaatactctctggaaaaccagaatgccactaagtcaaaagtcacttactttgtagcaagttatagcaagacagccaccagattgctcaaagggtttttttgtttgtttttttttttttttacattaaaccaacatattgtgttattgcttccagggcagcagaagaagcctttgtaaacgacattgacgagtcatccccaggcactgagtgggagcgggtggcccgcctgtgtgactttaaccccaagtccagcaaacaggccaaagatgtctctcgcatgcgctcagtcctcatctccctgaagcaggcccccctggtgcactgaagagccaccctgtggaaacactacgtctacaatatcttaatcctactcagtgaagctgttcacgtaattggattaattatgttgagttcttttggaccaaaccttttgtctttagagttgatcattgtttgtgattgcatgtttccttcaactgtgttctccctggcattcagagacgagagaggaagaggaagggagaggagctcccgacagtagcctcaacctgtgcttttgtgcattattctgagaataaatttctgtttcaaacaatgtatacatgaagcatctttaattgatctgaaaatggtcttgcagcttgggggacaggtttaaaggggtgagtgattctcattgatttctggggctgagaagacacagccactgagtgtccaccgttctaaactatagtaactccatatgtctggtgtttgggggttgagatactagagagtgagtctagggtcttgggtgccatgcatggaacctgctattagcctatcagccactctctttaccttctgaaataggggtcaaatttaagaaccaggttaaaggcctctccataaggccttactcctccccacgaacctccgtggccccagaacatggcccttggttttggtactggctacatgccgtttctggggtttgcttggatatgtgacagttttaaattttgatattatccagatgaaataaactagaggacaaagtgatggctgtgagttccaaggctagatcataaagggcagcacagctggcatgttac

SEQ ID NO: 28689 - DNA, 1196 bp, Mus musculus
tgatagataccatacctgtccgtgggcacagctcttactttgtcaacaaatgggaaaaaggacaaggagatggctcactgggtcagaggtttggcttacaagcatgaagacctgagtcggatccctaagaacgcacataaaaaagccagctgtggtgctgcacccttgtcctggccatcctgcttaattggtaagcttctgatttggtaggagagactgtctcaggaggaaggtggagtacagttgaagaagacagccagtgttgccccctgacctccacatgtacacaggcgtgcacatgtgtacacaggcgtataggttgggagtaagctataacattgtataatatgatgtcatttctgtaccagctagaaagtatgtaaacctagttccttatatattcttttccaatgtgaggttagggtaccttgacgttttctgcctttgattttttattataatggacacttgttgttctccctgtgtgtgtgtgcatgtgatatatgttcacacaagtgtgcacgtgtgtgtggaggccagaggttatactcagtgtttttctctattgcttatgatttgaaacatggactctctcactgaaactgcagctgctgatttggccaaactggctgggcaaccggcccctgagagtttcttgtcttcccacatgctgcagctgcgataatgggcaaacactacctgcttttttagttttgggtttttcaggctttggttgtttttgtttttgttttgtttttgaggcagggtttcctgtgtagccctacctggcctggaatttgctatataaactaggccagccttgaactcacagacatcctccttcccctgcttcctttccaagtcctaggatgaaaggtgtgtgccaccatgcctgattcaaacctgcggggttttgtttgttttttgttgttttcgtttttgttttaaatatgggtccatgcttataccaagcagtttaaggggtgttggttattaaacagtggcaggtgtggtactgttttctgtggtcttcataaataagccttcaagtctgaaaagttacttaatagtaagaatgctaaccctgccggacagtggtggctcacacctttaatatcagcacacggtctctgagtccgaggccaggcctggtctacagagtgagttccaggacagcaagtgctatacagtgaaaa

SEQ ID NO: 28690 - DNA, 1223 bp, Mus musculus
ggctggcaatgaggtagatgaagaagaggaagaaggtgatggtgaggaagaggatggagatgaagatgaggaagctgaggctcctacgggcaagcgggtagctgaggatgatgaggatgacgacgtcgacaccaagaagcagaagaccgaggaggacgactagacagcaaaaggaaaagtacccttaagcaccgtgacctattcaccctccacttcccgtctcagaatttaaacgtggtcaccttagagtagagaagcagaccccgcccacccacagcgggcaatgccacccacagatatgacatgtgctctccaccaccccaccaaaactacaacatgaattggcaacatgggaggaaaaaagaaccagaacttcccaggccctgctttttttcttaaaaatactttaaaaggaaaatttgtttgtattttttacattttatatttttgtacatattgttaggggtcagccatttttaataataacgggtgaccaaaccagccttcagagcgttttctgtcctacttcagactttacttgtggtgtgatcatgttcattataatctcaaaggagaaaaaaaaaaaccttgtaaaaaaagcaaaaacaacaacaacaaaacaatcttattccgagcactccagtaacttttgtatatgtacctagctgtactataagtagttggtttgtatgagatgattaaaaaggccaaagataaaaagatttttttttctttttctttctatgaagttgtttatttatttttttggcctgtttgatgtgtgaaacaaatgtccaacaataaaccggaattttattttgctgagttgttctaacaacaacaacaaaaaaaaaaaataatttgaacaacttttaatctgtatctcttgaggtgggaagataaacctgtaatccagaccacaccttttgctggtggtctataaaggaaacagaaggaggaagcttgctctcactctatggcaaatccattccttcattggcattaaagcctatttcgagattccagcttatactgaagacatccaaccttgtgtcatgaacaaaccactggactccttgtctgccattagtagacagccattatgtattttttttcttacatattccacaagttcttttcctctggagaaccgtgactggtgcactcacggagtccaattacttgctgcgatgtcttagctttttttttttttttttggtaca

SEQ ID NO: 28691 - DNA, 2439 bp, Mus musculus
ccaagatcttgattttcagttgttttttgccaaactagtgatagcaagtcatgtttatgaatttaaacaaagaacaaagtttattaaaagttactagtgggttgtcttgctttgttttgtttttgcatttttgttttgaagcaagttctcacgtacctgaggcttgcttgactcaggactctcctgcctctgagagttggattacggcatacaccaccattctggtttaggatgtgttcgtaaagaactagaatgcaaagaccatctgggaggaacaggagaactgggcgcttcactgcatgagacatggcttcagtgagcgtcttccctcttgtctttcagggaaaccgtacctgcccaatttgccgagctgatgcttcagaagtgcatcgcgattcagagtgaccagcctaagagcacaaatttagtttgggtgttcctcatcacatgtatatatggactatccatcgaacttaacctgtgtggcttccagccctccctttaccaaaagggtcaatggacctttctttgcactgtgtgacttaatcaactataaaagcttacaattagtcttcacaattatgggattgttatactaactgtgtgattggaactccaaagaccttttctttagcttaattttgtgtgtgcactaacattccctggtttttgtgtgatcattccgagtgttgctgcaagattacagtggacgtgatcttttagcatgtgcttttataaaaagtggtagctccagatgatatagcaatctaccttatatagagccttcagaaactgtgagtggaagtgagtgaagcgtatgactgctggtgatcagtgaatctgtgagagaatgtgtgcaactacatgtgtgggggcatggtagctactgtgtgtgtgagatcctatataccagcatgtaccaagaatgtgtgtgtagttttaattatgctgcaatgtataatctggtgtgttatttaaacagcactagtactgtacactggttttcccttgtgtttgctgttgcacactgattgctaagggtgcatccattctaagcattgaatactccatccccttcccgcccagtgaatggaatgagaaaagccttcttcctttgcttcaggcagctgtccccttctcttccttggtgatcctgagtgggtcacttaaggaaaaagtatcagattctcactccatgacctgattttttttgttgttgtttttttgttttgtaattttcaattctattgtaaaagaaacttaagtctccaacttgctgtttccaaaaagaaggtgcaatatcatatacatcattagcaatattagcatttcaatcagcgatctgagtgttagttgtttttcctttacatttctagtagtttccttacagaaaggacctgcatttttattaatgtgtagatttatggtctgatctgaagatgtttgagtaatatatttttaagaacaccactggtcctgtaagtcttgcctccttggcttctactagagcaaaatctgctgccaagtcagcctggtttctggttgtgttcttcactcaggcctccatgggcaacaatggtttcaggagaactgtttgtttctgtgtgaattgagttgacacactccagtcctgagctgctctgctgccgcttccctcagttaaccttctcaccgaaaccttagttcaggatggatcaagtgctgtgacagtgacagctcatttctcaggcctggtttgctttgatgtattactcttcttcttttaatttatgttagaacgagaaaagcttaatacaacaggtgcccagaatacttgcagtgtaaatgaagattggatttttgtataaaaagataatgctgtcaaacgggaactgacctttattgaatctgaaatgatacatagctgtgtgtgtatatatattttttaaaaataggttcattgaacataaatcagattgtttgaggtcatttttcagcaacattggattcctttctcctcggtgtgctcagccttctctgcagcctctgtgagttttcagcacgtgtgcagccacacaggctgcaaccttccactcgcagccgctgctgacacctggctgccgacctcactcagctcacagtgggctccaggcccgtttttactcagacagggacagtgttcacctacttgatactgccgtgtttcttaccctcccttgaagtttctctaagctcatcacagcctagagttcaggaaagttaatccacacagaagcacaattttgtcctcttccagacactgttgcctctacctagttagacaaataggatttgacctacattctgttgcccctaggtttgtgttagtgtcagaaatacttaaacagtggtaaatgcacatgttacttttaaatcattaggataactcctgtctggttcctaatgaataaaaggtgtgtt

SEQ ID NO: 28692 - DNA, 2323 bp, Mus musculus
tggccattcacatttctttcttagcatcctcatgtacatgacattatagctgccctttgtcaagattttatccctgggaaaaatgagccatccagtattttccattcagtgttctgtttttgtttgagacattgtctacctacatagcccaggctggcctagagctcatagtatagccttggctgcccccagcttaagatactgctgtcttaaccatccaaaatgctaagattatattccgttaatttcaaaccattccccccaagaagggggcagctcagcagaattgacagcttgtaccttaaaggactgatgaaagatgtgagcattcctttagcttttaggatccagtgtgtgtgtgatagtgagtgtatatttaaacgtaactttgtaagacagagtcaggaatgtagaatcagtctgcagcagtgttatctcttttaagtttttataccgaactcttcggtctgagttccatttagtctctctcttgtttttttgtttttgttttgtttttgagacagggtttctctgtgtagccctggctgtcctggaattctttctgtagaccaggctggcctcgaactcaccgagacccacctgcctctgcttccaagtactgggactaacggtgtgccatcactgcctctctccccttttctttctctttgtggttctggggagtaaacctagggtcacagggttgctggcacagtgctcttccctctgagtgacatttccattctccagcctttttctcttgttttccttgttttgttttgttttctaagtcagagtttgggggatgggttggggaagacagggtattgctatgtagccctagctgacctggaactcactatgtagaccacgctggtctcaaacaggtccccttgcttctgcctcctgagtaccgtcattaaaggtgtgtacttatccctagctctatttttttcttgttttttaattagcttttatttatgttttaacttatattggatctcagcttcaaatagaaacaactctaaattatttttagaaatggttggaagtggggtatgacataggacatcagaatacagttatcaaaatatctttgttttctcaggaaaatttattatttgatgaaaatcataagctaaagctgattgactttggtctttgtgcaaaacccaaggtaagtatggaaataaaaatgcatttatgtctataactataactataaatatctatgtgttatttttcacttaatctttattgtttggttatgtccatttagaggaatattaaattttatccttagcattaatagttttataagtatgctacataattctgagatggaaccaagattgtgagtccccccagggaagctatgagaatctcgagtgacaggtaacatgaagccattatgatacgatactgaatcatgtgcttgtagtttgagtattttgccactagatgatgcctttgttcatttgtgtacaagttgagaattgagtgtgtatctagtttttgttacccaagtggttatataactaggggtaagttatacgccgaggtgatcctctttccttgtgaaagaagaggggagtggatggccatgggcttctacagtcactctgctcaggagtcccctcatttgcactacgtagtaagtgctggtgttcttcagcgtaacttctctttgaggtgactttgaacttctcagctctgccgctgccgctgtctcctgtgaggctgctggttggaggcttccttctgggttctctaatgatggcgctgcgctgctgagatgagctgtctgtactcattaagaatgttgaaattgcagactcgtctcagccctttgtagtcccatgattatttcctgcccctcagaactagcaaggtgcagagggaagcagattttgcctcttcagttctgaatgtctgcttctttctgattcttctcccactgatgtctattctgagatcaccagtgggggcttgtgtcgggaagcagatgattcagaaggcaggtttaaaaggttttttacagacataaaagcttataaagatcatcctttggcatgtaagttatattctccacaggaggtagtggggatgtttgtagaagactcccattagcttttttggtttttggtaatggctgccacagattcaactcatatagacagcatctaaaaaatggggaggtttgggaaagattggcctcagttctgtggggctctcactgcgtcaccacggcctggctcatttgtaaacagagtcttaaggtttcttgatcctttgcctctggtagagctcagcccaggagtgc

SEQ ID NO: 28693 - DNA, 1101 bp, Mus musculus
acatagacctgtatgcagacaaaatactcttaaacataaaataaaaattaaacaaataaagttttgattgagattgcataatgtatgagtgggggtatatatccatgccatggcagggtttggaggtcagaggacagcttggtggagtgagttctttccttccacctccatgagttctggagatcaaactcaggtcaccaggactgcagggcaagcgcttttacctactgagctacatgctggctcctggtaggtgctcctcagtgtcagaggttatgtcctttccagcttctgctttggtgagattatacttgtgaatttgcaaacgaggtgtctaatattgctgtgtaatagtgacaagctaagtcagtcgcattccatataacctctagcttgtctctgtgtctgcttccagactttctccctgtgcttgggatatgctgctgtaaaattggaatccccatgttgttattgctaacttcttttgcctttttgaattaatagtcaaagaatctgagcctggaagatatgagcacaagtgatgataactgtgtggctggattgatagactatgaattgtgtgaagataaattattagctcccaagacgccacaggtgggtagttttattactacttaaagcagaatgcatgtcttaattataaacacatctagcccaacaggaaatcaggtctgtgcttgtaaatttatttactctctaagccactgaagacattaatgagagattattggaatattaatgagggggaagtcagtgatttccaagttaagaaaaccaagattccattctggagcacttcactgcctctgccctctttgatgaactggaatttgcctgtagttaaatagttgaaattcgcccttagagtgtttagctctgtgtttaacagtatagagccaccagaaattgtgacacagtaattctgttgccctctcaagggtctcttgtgtccttctgtgaacgcctttcctcttaactcagggcagcggcagcgatgtctcctcctctagcgttcttgtctgaagccgacttcacgtttgttgttggacttctcaggtgtgtggctcagagtttccacca

SEQ ID NO: 28694 - DNA, 1176 bp, Mus musculus
attgtcagtcaaaaacgaaggtgtgctttagtgtgtcctagttgtacattaatctgtggtgtttgtggtttctctaatgatgtcatttctccgattgtaatttatatggctttcatagggccacagtcttactctgccttacttggttacatagttggacacagaagagaggtaaatataaaattctgggttcatgcacaatcccagatgggaaggaaagtgagctgttagagatgattatagaatataattatataatcctttattccatattttaaaagctaacagtaaaatctgacacttttatactacttggatatatatagggttttttgataaaaaatggatagtagtaaaattgtcagatttgtatgtatgtgtgtccaagaaaatctatgtcagactgttatctatatactgtttattgaagcagtatttacaatgacaaaggtaaccaaccaggatgtacattgacagatgaatgtataaagaaaacatgtcctgtatatactatagaatattatttggccacaaagattgaaatctggtcatttacagcaacagggtagaattgcagggcattgtgttaagtgaaataagcctagcacaaaatgggaaattttggtggttttctctcatagatacacttacaatctcaagtaactgggcaggggggagaagttcctaacataaagaaacctgatttgaccattgacagtgtagatggacattaaattatcacacctttaaaaatagaacatgttcatatactggtaagaaaaatatgtcaaaatgcaacgaatcctttttttgatatttttataaaaaatggtgttggtcattgaggtaaaattggttttatttttcatttagattggtgctccaatagtttatagtcaacatattgtaattataatatattaaatgtataaaggggattggcagcccagtagcttttctgtctcactaggttcaggagttacttggtagaagtgggtatccaatatcacccaccatataaaatgaaaatttatattcatgttttcagaggtctataagctaaattatcttactcataacatggtaaagtttagcttgcttttctgtgctcacccttcaccctgtgacttcctacatctatcgtgccagctccaggctctccaagaactctgttgc

SEQ ID NO: 28695 - DNA, 1236 bp, Mus musculus
taaagaaacacagaaagaaaagaccaggagtagagaaggcaagacgcacaggaggggtcaccagcctcggggtgaggatgaagacttccccaggggctcaaaacccaacgcctctggctgcgctaacaaccagaagccttctaagtccctccaccatgcatcccattaccacaggctgagagaagagcggcttctcagggagagcaagcggagcaagccaaagaaaaggaagagtacagaggacggcagccatgatgatttgtttcttattaagcaaaagaagaagaagcctaagccgagtggtctctgacctggtctccgcgcttcagtgtcctggaagtgcttaagtacctgttaatgagacgctgggattgaatgctgagttccggccatgcctggagtggctgtacagagaccacaaagagttcaggtctgtgtccacaggctgttcctaggtaggaaggcaaacttgaggtagaaaattgtcttttcatgaaaacctttttaaatgctttggaaaaattacaagctcatcagatgattttatctccaatgtttgaggacttaaaagctcattggaagaaagtttattgttaagaaaagtcatcacttttttagctttttttttaagaacactggaaaaatcaatgaaaatccaagcccggctttgcttgcatcagaggctgttggaatctctctctgtacagaacagcatgtaaaatgaagctgtcaccattgaattctggaggaggtggaggagaggacatagcaaatacacaaacaaaatgtgcgcagtgtgggcttgcaggacggaggtgtgaaaggcatcctcaaacttgagtgcaatggcagggacattttgttcgcactgttaacagccatagttcaagagacagggatacataccatcaacctaacttgtcctcgtggatccttttaaacacttcaacgctctttagaatcttttgtacttgtgagccttttttacccttgtgaaagcctaatgttagaataagaaaaataaaatgcctgaaaccatgtgtaaataaatgtgtttattgttacaaaagacaaagagagctcgggtaccagagagcatagttgagtagacaggtcgccacagtcacgccttcttcacctgtgggcatagagataagtctgttttctgttaagggaagaaaagaaaaagaagccagttcctgggtctttatacccaagagtcaggtgaaaattgtc

SEQ ID NO: 28696 - DNA, 1270 bp, Mus musculus
ggaaagatgccggagtgtgaggttgcttgctctttgtgtgcgatggttattgagtgacatgggggtgggcagctttgcaaagcagcggatcccttcttgtggtcagacacaattgttggataacaatttggaagtttctagaatcatatttcataaagtcagtgacatccaccatcgccaccaccaccaccattataactgtgcagtatggcctgaggacttgtagaataaaacctaattcaggggctggagagatggctcagtggttaagagcaccaactgctcttccaaaggtcctgagttcaaatcccagcaaccacatggtggctcacaaccatccgtaatgagatctgatgccctcttctggggtgtctgaagacagctacagtgtacttatgtataataataaataaatctttaaaaaaaaacctaatcccgggtttttctttcagctccatatatcttaaagaagctggatagcatctgaggacgggcagtcaggtggatgcatggcatgaagacctggtgacggcttctcctcctgtctgcagctgaattggcccagaaaggtgtaaggctgattaaacggacatataaactacttgttgagaacaagtaggactttgagaactgacctccatagctgaaatataaagccacttgggaagtgcaaaaagatgtcttgtgttcatggtgcccttaggcccatgaactccacccctgtgagtgttgatggagtggttaataatgtcaggctctaaggggagtcatttctgtttaccacttctgttcaaagtgttatttgtgaagtctgtttggaagtcagcatacacccacaatgacatttaagcacagtctatatttttaataaacattctgatgaagaaagcgtggttttgtgtttttaatcccactttggtcatggccatccttggtgggactgttacagcactgcgactattgctcctggagtttggtttgagcttgagaatctgttaatcctgctatgtggaattatgcttcttggccaaagtcttcatgaactgcagatgactgactgcttagtgctagaaatacaaagaccatgaaagtggggaaggggaggctgcattttaaactccaatagttctctaagagtgttggctgaagagggctatcagttctccagagcaactatccatgctcccctctgtttggctaatgtatatgggttttgtttcatttgtaagattgtttctatttgatgtctatatgtgtctgcctgcttgta

SEQ ID NO: 28697 - DNA, 1221 bp, Mus musculus
ttttaaagttcagttttgtaacattttaaagcaaattttccatgaagtagtatctgaattaccattgtcctgttttcttttgaatatggatatcatgagtttttttcctctagacaaacatgtaatttgttagtactgatagaacattctccggtgatgctgtttgtttttatatccacactgacgtgtgcagttaccactagttacgtgtggctgctgagcagctgaactgttgaagagtggaattttatatatgttaagtagatacaaggctaaattaaactacatgtaagttgggcagtacagtcttgaagattgttcttaggccttggaatggctcctggttggagggtttcatggtgtgtggtgggagggctgaattctgaggaccatcagtcccttagtgtgacagctgtgggtccctggcattcttgcccatggatcagaaccagcagcagcagctgtaggttgtctggatgaagggaactgaactttggttttaatcttacaggttggagatctcatctatggccagtgtgtggtcgctaataaagacatggaaccagagatggtctgcattgacagctgtggccgcgccaatgggatgggtgtgattgggcaggatggcctgctcttcaaagtgacgttgggcttaattagaaagtaggttatgctgcttattaactgccctgccttctttaatgacctgtttactctgagaatttcgtaatggtgttttgttggtcatacttgctccccattctctgtaactccttccaggttccttccccactttcctcccctctccaccctgtctcctaagtttgccctttttaaagacaagccactgagtcaaatctgtgctgcatgtatatttgtaaaaaatggggcctactaccaaagtgtgaccagcctaccgtgaaaggggcactgagctgggcactgtgtcccagctactcgggaaggcaggagcgttctcacacctacaaatctgagacttagtttacatgacctaggtagacttcctctccaaatacagaggcattgtgtgtgtgtgtgtgtgtgtgtgtgtgtgtgtgtgtgtgtgcgtgtgtgtgtgtgcgcgcgcgcgcgcacacacgtgcatgtgctcaagaccgggcagagacatcaaagcagcagagacatcaagtcttgttttgggacgatgctgagcggactttgcgtagtcacagagagcca

SEQ ID NO: 28698 - DNA, 1173 bp, Mus musculus
tagggtctttccgctcataggccaggctggccttaaactcactatatcatactggctggtcttgaacttgtccttctgcctcaacttgcttaatgtttatcctgtctttgtgtaagatagatgtcatatctgttttaaggaatatggaaactgttaagctaacaaacagattttccaaggctttatattcaggaagtagtagaaatggaatcatacatggtcccatgagactgcctcaggcatagctgtccagaggtggggcatacattttctggtttcattctgggtagtcattttgtacattcttggtaatgtcttttagtttgtgttttagttttatgaattgttaatcttgtgaaataataatgatagctgaaaatattttctgttcatgttttaagaaaaaatgtttaaatacatctgctatataggcttatttttaaagatttacttatttttattttatgtgcattggtggttttgcctacatgtatgtctgtgatggtgtcaaatcccctagaattggagctagagacagttgtgagctgtcatgtgagtgctggaaattgaacctgggtcctctggaagagcagccaattctcttaacgacagagccacatctctccagcccctaggcttacttcttattcatgagaactttatatttaggtataagaatccgtgtaacagtccaggtccctatagttataaggttgtaaagagaaagccccaaggtaactgtaagagtattcacttggtgatgtgacaaagccagtgtagtacctacataagcctaagtctgcttcttcctccgcatgtctcttgtatacttaatacaatataagacaaatccagcatatgccagttatggggaatactgtatatatttgcattttgtgtgtgtgtgtatatatatatatatatatatatatatatatatatatatgtatttgtatatgtgtgtgtgtgtatttgtattttacatttatatagtatttcctcataactagcacatacacacacacacacacacatttttttttcatgtgtaattccacaaaaccctgaaggtgattttggagaattggtcaagacacatataaatcattggcaatagaggatctgagagagaaaacctcagaaaaacaaggtgatagaaataacgatacagga

SEQ ID NO: 28699 - DNA, 1119 bp, Mus musculus
gggttttcctggtcattttgcatgtggctcttgttctccccatccctgtctccaccattcctctctgcctccgtcctcgtttttgatttttggtatgaattttatggacatttggcaggagccttggttgggatgagaaaacccatggcactagtgttaaataaaactcagaagttggatgttggcacactggtgattgaaaaagttcatcttcatttatcagtatacttggcctttaaagttgctgtcagacattgagcacagtaatagcattctcataacttttagaaactcttgcaacaagatagctttttaaagtttcctgttaaaatgacacctttatatctcatgtgggattttgttgtgaaattctagaaaaatattataacctctctttgtaatttattttacttgtatgaatttaagatctccagcgtgtgtctttacttggtattctgttccggtcagcagcattggagaggaaaggaagagccataagcctggtcatttccgttgtccagaagatttatttactcaggaggtcggcacagcatccggccagtgagtgaggagattgatgtgacttaggttggctgtgagtcttttaatcacacagatggtgtgtttatagtaatgaagtgggagggaaatcaagtaaagattttattgtgtttgttccttcaaccagggatcagttctcagaagggagctagagtcctctttaagctgctgtcataaacctagagtcagtgacctgactgacactgctgtcctgtgtttggctatggaaggtctgggagacaacgtgtaagcccaggctgctccagtcttaaatgggcgatgtcctgccaggctctgctacattggttggttggtttgttgattgactgactgattgataatttaagccatgcagcagtagccttgttctctttggtcacgtgccctttaggccagtgctcctttaatattaggatgcagtacaatgtaccctgaaggactagtaaaatgtgctggaccttaagactgatttaggcagggaaagaacagaactcttatgtaaatggaacctcaaatctgcatccaggtggcctctaggccatagtttaaaacacaact

SEQ ID NO: 28700 - DNA, 1099 bp, Mus musculus
tatataaggatcaaattgatactcaaaagaagattccataaatgatatcagtttgtaaagagttctatgtcagatgttatacccacatgtcacctaacgcaagccagggacccttgaatcactgttgctgaatacctactatgtgttgaagaatgtgtctgctttaatatactatgggcccctacaaagacccttacaaggtaggtggaatgagcgtcaaattatgttgaaagtagcagtgtgttaaaaaatgaagtgacgtgccttcagccacaggtggcagaggtggcagcactggattcagatggaggtttgctgtcagttttattgctgagactgcactgactcctctgcgttttgccccttagttcatggaggaggagttacactggtctgctggtccatgtgcttgctatcttctgcaaagtttgatcacacagttggcctcgttcccttgagtactgcataaaagaacatttcaagcactgatgttcccatgagactggagagcataaactcaggccatttctaacagaaaaactatgcagatgagtccccatggtggcgaaaaagtggatagtcagccttgtgagaagcaaagccagacagatgagaagtgacaagagccagcaaactgagcagggatccgttgccctctctgaggaacagtcaggatcaagacaaaatcagacagtactaagcaaggaattgaacggcctcagaaaaacctgttctattgggaagagttacatatcttaacgtccctttttgtttttattttgtttttggctttttgagacagggtttctttgtatagaccagactgccttcaaattcacagatgtccacctgcctctgccttccaagtgttgggattaaagacatgtgccaccacagcctggccttagggtctcactttaatagtctaaaactatgttgttttttttttactgttttatttagtcatttttattataattggtagaaatatattttaattgataacgaagttattactgttggtaaagcttcctttggaagagtctattaatgggaatgctatgttgaatgacttacagatgtatcaaatatacagtag

SEQ ID NO: 28701 - DNA, 2517 bp, Mus musculus
tgaaataaagagctaaagtaagaaacttctactttaaaaaaaaatattatgtgatcacaattcgggggccaggggaacatatgcttttaattccagaagtggggatgcagaggcaggaggatcttctgtgagtttgaggtcagcaggtctacatagtaaggttctgggctagccagagttatacagtaagaccctgcttattaaaaaaaaaaaaaaaagtcatttttttcctcagaacccaaaacatatgtatattttattttttctccccattgtattcctaagaaggcagcatagcaaaaaattttagaaaacaacacaaggaaaatataaatttcatattctctactcctgcatcgaggaccaaatcacattttttaaggctgtgccctctagaaggtgagaataaagaaatacatcaagaatcttttagaaggtgggtgtttctaatactggagtatgcagcagtgtccataagagtctgttacacttggcttttatttttatttattttttgagacaagatttctctgtgtagccttggctgtcttagaactcactttgttacccaggctggcccacaactcagtttcccttgcctttgcctaccaaatgctgagattaaaggtatgtacctttaatcgctggctttcatttggcttttatgaaagcaggagacatggcctgataacttcctgatgacaatcatctttatcctgtaccagtggtcttggtccactcagtaacaccttctgttggtcatgaaggaatccatatatatgacttctgtttagataactaatgcatatctttttaagtgccaaaatttaaaaatttcagttatttttttgatgcaagtctccttagggatggtagtctacctccctgcctttttaaacagcttgctcagtcgaattcacttcatcatgaagttatattcatgatgttttattgcgcatgcccagtgcggtctggtccacataaaacagtaaaacatttcatagcacacaaagggctataacagattcgaggaatatccacctagtaagtgattccctcaacgatggaattatttccctcagtattagctttaaaaagtgtttgatgtctgcagagtaatgcattctatcagtgtgcctgtttctaacaggctcccactttcttctgtgctgtctcccaagttctgggctgtgacatgaactgaccagttctggtcagtgcctacaaaataactggaccaaagctcccagttaaaggtggggctctaaccaagtaaggggaggaagtatgagtatacactgctgctgctggagtggagtgtggtgatgatgatgcctctgcagggaggcaggccttcatccttttaagagcaaagaagcgtgcagaagagaaaggaaggaaaaggaaaatcgaggtaggccgaagactctgggagatggcactgaataaccattaaaatgtactcttgattaccatgttaaagtcagtttagtgacactgtagagtaaggctgcactatgtgtacatcctctggagaactcgagactgtgtatatcctgagaactgcacccctccgaatggtaatggaaatcagcaccaagaggaaagtctccagtttgcctgtgtgctgctgtcttgagttgtaaattacctgagagaggtttaatcaaaagtcccagggcctggagaaacggctcagcggttaagagcactggctgctcttccagaggtcctgagttcaattcccagcaaccacatggtggctcacaaccatctgtaatgggatccaatgccctcttctggtgtgtctgaagacagctacagtgtgctcatacataattaattttaaaaaaaaagtcccaaggagcacatctcatgcagacattttttgaatgtatgtatatataaatgtcactgtaagtgacgcttacccctaagaataataaagtaacattcaggatttagatctggtcccaatctgtattttcccctatacaaagaatagatgtttgaattttcttttaaatttggctgcatccttcatttccaaactctgcttctttttttgggggcggggggcacaaaactttaggtttgtatttttggcaagcttggaatattctagttaatatgctgtcagctagaacactctcttagcaggttctaaggtgctattgggtcttctgctagactgtgcgctccttgagggcagggctatctttattcttgtatccacggtgcctgggatagtatctgacagagtagttgttcaataaatatctgttgaatgaattgaataaaccttcactacgtgtggcctcaagttctcacgaatccagaatgtagtggaaaatgataatgattaggccttggcttgttttgacttttttttttttttttttttttttggataattaccaggataacatcatctgggtatttcttagtggttttgaaaactaaattaggaccctacttttcattgaacatggatttgaatccctactgtatgcctgg

SEQ ID NO: 28702 - DNA, 1186 bp, Mus musculus
tataaaggcattacaatctggcttgcctacttcatgtaaagttattataggtttaaaggttcgttttttccttgcatgataaagggtttgcttctggtaaactggtaatcactagaaaattttgcctctaggtatggctaatatagctttacattatgtaagaaaaattttattgtctctgcttctatacaagaagctaagagtttaaatcttttagtgtatattgtttcctaagtggaaagtattttattaactaatgcttctcaagggaagtttaccttaaatccttgctctcacccaaaagattcagagacaatatctttttattacttagggttttggtttactacaaaagtttttacaaaaaataaagaaagcttttataattgttattaattatattcattggtaattaaatattagctgtgccaagacaattctttggccagaaaaaacattattgtaaaatcatttttctcatcctcccagccgatcattggcccacgtgggcccaactagctgctgtggggtggagccttgagacacgcagtttcccctgtttcagcacaaataatctagttgtgtgctgtagatggtgttttaaaatgctgaacaatcaaaccctaatttgtatattaatagtcaatgctatatctctgagctcacaattgcttaagattgttcgtccctcagatactaataattcccaaatttgcaattgcttatgcatatacaactcatagaaaaaatgctgtccttttaagaaggcggtttttagacattgattaaattgttctaattgcctggacatttttaaaacaatgccaggataaattttatctcagacagtccataggccgtccatataaaatagattggatatataacctcattcgttatatatccataacagttatggtttaagataatattttagtattcttaaaaattgtgcatgtataattctttccttttagtgtcctcagttactacttgtttccacataatagtgctaattcttgaggacttttacttaataattgctacaaataaatgctcttatttctagttaataaataaatcatgcacatgtgactcttaataacttttcaagctttctagttacaaccactccttaaaaaaaagagaaatgattaaaagtacaattagtcactgctcctttaca

SEQ ID NO: 28703 - DNA, 2344 bp, Mus musculus
tgcacatcctaggcaaatgctgtcccactacactccagccttcccagttttggttttatttggttttattttattttgagacagattctcaacaggtagcccaggctcgtcttgaactctcctggctctgccttctgagtgttgggattaaaggcgtgagctgccggacctggcatccccagtccttaagaataggttccttcctccctccctccctccctccctccctcccttccttccttccttcctttctttccagagctgaggacctaacccagggccttgcacttgctaggcaagagctctaccactgagctaagtccccaaccccaaagataggtttcttactaagtttttcattgggtaattgcgtgtgtgtgtgtgtgtgtgtgtgtgtgtgtgtgtgtacacctatgtacctataaactgaaatcagaccctcagctgcagtttgagagaagtttctggggaaggtaatccaaaacagctctttaactacactgaagctggttacataaagctaccatcatccagctgtaacagttgggagcctggtaagcattggggtggcagtaacggaggtcagcggctttggagcgacactggtggaagtgcagtgcggacattaaggggcaaatgtgaggactcggcagacaagaatttgtctgagatacatctgagtactactgtcttcagttacaatttgaaggtgagaagtctcagaaacgagagatggcgccttgggtcctgacccctgtgtccacgtgcagcattgcccagatgcagcacaggggaggggagttaaccagggattatactttaatttttgtttgtttttgttttttcgagacaaggtttctctgtgtagccctggctgtcctggaactcactctgtagaccaggctggccttgaactcagaaatccacctgcctctgcctcccgagtgctgggattaaaggcgtgcgccaccactgcccagcccaggattatacttggccttgttttctttacactccgtgcaggtggcgcaagtgtcggctgtaaagcgctcctttgagggtcaccaggctgttaagggcaaggctttggctttgctgacttaattatgtgacattttaaagcaagattaaacttcctaatgctttttaacttttaaacactttgtcacccttagagctcttaaagactagattgcagtgtattacagaggtggctctgtctctgataaatttaagtttgacaaaaataaaatcagagcttgtaatccactttgaacttctatgtcagaatgtaattaatagtcttaactagtgcggtgatattttttaaaggcaaaaaagactaaagaactctgaaaagctttaaagtggcctttgtgttacatgtgtggcacaggtggctcatgagtgcaggacacgagtgtcccgtgtgtcctgtctgatgccactagaaacctacgagttttgcatttaacacaccagtgctgtaaaccctcaggacggtagcagggtcaacacagcctttgcattgtggcaaattggggttttgcttcctttgtggttagagacagatgtttgtgcctatcaacgtttatcttgtggttggtcatataatcacttgctatatattgtgaccctgtgcaatgaagcagaattgtacatacatagtattatttgagtacctgaaattcctaagctcaaagacaatatagataaacttgtaaggtttagagggctggcctcgtgtaagtggttaatagagagtgaaccctggtttgagggtggtgagagctgggtggatgtggtcaccgctgggccagactgttgccaggaaggcattcatgcttgggttccttatgtcaaatgtattttttctcctatataaataaatgcatatcaaaagcttgaatatgttctctctagatttaaagatttttttacttttttatgctctttgtataaacttaatgctctttgcttgccaaactgctgaggaggtgggtctgcatatatttcttcttttcgttattaaaagtagctaaacacaaagcttcggttgctctttggagttgtggctgtgagtttgagtaatgttaaactttggggtgttggtatagaacttgtgtattgtggttgggtagtctcttacaattagcagtctctgtgtgtgtgtgtgtgtgtgtgtgtgtgtgtgtgtgtgtgtgtgtgtgtgtgtgtgtgatgtgctatgtgcctatgtgcgatgtgctatgtgcctatgtgcgtgcgtgcgtgcgtgatagattagcccaccagtcgttctggtacatttagtgtcctggcccagcaatcctgaagactcaac

SEQ ID NO: 28704 - DNA, 1193 bp, Mus musculus
cgctctctcatctcctggggaataatcaatgccacttacgagtttttgttaaagattgtatgatgaaatcattatgtgagatgttattctcatctaactagacctaaggaaaatgcaatttggctttgttcctaattggcttaagtacagtttggtgtccaagaccaagccataacttgcagacagagcactgacaagaacagagtccaggtttcagtgggcaggtgtcagggttcgggtgtggtcattactccagagctttaggctgctgttgcccgggaaccagcctgcaccgctgggctgtggcctccgcagccagagcgcgtgcttcgcccccagcccggggcatctcaggctcattctcacctcatttactttgtctctgctcttaagagggccataatcattagaccccagctctgcacggaggactggagcagaggtgccactcagtgccatgcctgagctccatgatgaatggttggggttagctttgaaataagtgctgttgagatagccgcgatctaaactttctgttcacatttgatagagttgagcagctaatgaacgcttccattttgctgtttggctttgaacactttctgtttaattctgagtctgactttaagcccttccagaatgtccttgtgctgtttttactgaattcattgccaaaagatagggtgccctagttaaattccgttgtgtgcttcatcgtggtaagctggtcactgcaggctctgctattctgcttgcttctttgtgctactgctgtcgacagccaaccagtgaggacactgtcccttgtgaatagtaactgtcatgtctgtcctgctctctggtactggactttaaacaaataaacacttccataaagttttatttcaggggttttaatgcaaccccaagtcttctttttttctggtttctcagtgctacagagtgagctaaggagtggagggtgcttcccctctggccgcccgtctctttctctgggaagaaagatttcagggttctgctactcaggagcccagttgccactgtgccgtttaggaatgtctgctctaagtagcagccctgacttctggtcaggtaggatccaactggcaggaaccaggccaaggagtcacatagctattttctgggtaaatgctgtaatggaaataccatcagtctgggaagtagcttagaat

SEQ ID NO: 28705 - DNA, 1202 bp, Mus musculus
cagggatgactgatgaggtcgctcctgccatccttcctaaaagaagccaactcctcttcccacagctccaaatcctggcgtgttacactctcgtgggtgagtgggctctgggctgcagggtaccaggaagcatcactcagctccacagggttgaagagtagcccggcaggacctctccaggagagtcttgtatgttggctctttaaagttaatctctgagccaggtgggaacaggagggtcacttggcccaatgtggctctgtgcaaaagggattcaaagacggcatcggttggtaagatgggtcaggtacgagggctgttcagaaccagaacacatttgccacttgctgctcacagctggcccaatctctgaagacagatatgatgacagtgagagagtgacgttaaacgttacagtcagagagctgagaaagcactctgcagggcagccaggagtaggaagacgtcctctttgcacatccacaacttgtctccttccctcctgtttgcctgcagaattccagaggcaagagagcgtccggtcacagcacaaaggcatccagttgtacgacaccccgtacgagccggaaggccagagcgtggactcagactcagagagcactgtgagccttcggctgcgggagagcaagctaccccaggatgacgacaggcctgctgatgagtacgaccagccgtgggaatggaaccgggtcaccatccccgccctggcaggtaggagcagtgtccctgcttgggaggcaggtactgaacagaagacaagtgggtctagcctggccaggtgaacaccagttgagttgggctgttctttttcttaatggcaccacaaagataatccgggttcctgagggaaatgaggccaggccagagagaaactccagtctggcatagagggttcccagtgcaatctcaccaccttcagagctggttcccttaggcctcatggagttgcattctgtagtctccttcagtcctgcatagccctcagggtccctgtgaggaggagacagtataagacaggggaaagcccagcacctgcctgtggtgctgactcatgcttgggctcatggtgtctgggagagctagtctggcaccaccttcctcagcttggtctcagaacatcagtgttagattgcctgtgggctgcccagagatctagcaccttgggccagtgagtaaagata

SEQ ID NO: 28706 - DNA, 1191 bp, Mus musculus
aggagagtgagagaaattttgtcaaagctgttctctgtgttagttccccagaaggcttcattgtaacacttccttggtcacaaagtcctcacagccagtctaggttctaggtccagatactgtgtcagctattgctccatcccatgtcattccagcctcagaggtcagccaactttttttttttttaaaagggccagagccaggcagtaaatgttttcaggtttgagctggtctccatcacagtgggttagctctgtcattgactctataggcagccttagagaatatattagtaggaatacttgtgttctgagaaacctttatttccaaagccaggcactgagcaccgagcgtcattttcagtcttgatggggctcactctgtttagggtactctcaagctgtgccaatctgctccgtttcagtatggcttggcccctcattcttcagcatatgcgcctgtggcaggacagggttccaagaaagggcagaagcccttgaggtttcttgaggtttgaaactgggacactgttcctttaaatgctgttgaccaaagcaagtcacaacacaaggccaagattcaggaagagaggttgaattgtggggcaaggggcagggatggaggcaagacagtctaggcttttagggctgttcgtactatcaactcaccctgaggtttagagacatcagtgatggacctaatgtcgtagcttttaaggatgacaacaagatgcacaccgtgcattctgagtccactcactacccgtgtgctttctactaaactgcttcactctttcccagcctaaccagccgtgagaaagagggccctgatgttgactgatggctgtcatgtttcccctccccccctgctaccagatattccccttagccctttccttgttttgacccacagctggactctctctcccatctgctgccgagttccataaagaagatgttaatgctgcacttgggttattttatagagaaattctgcacgcagagtaggcgcatcccagaggacagctacacaaaaatgtgtgtcttgtaactgtcatgtcttctcattctaacaccagaccttccctccctctaggatcggctaggctgtgtgtgctctgctttaagataaaagcgggtggtacctctgcccatatctagaaaggacataagtttcctaaaaggaggtcag

SEQ ID NO: 28707 - DNA, 1132 bp, Mus musculus
ctggcagtcagccaggccacctgggccaagaaagtcctccccagggtctggaggcctgttctctgctccctgcatgtgtgctgcacatggaaacagtatcttgcttttctgaaggtttaggaagcgaagttgtatttcacaacttatttttttcacattctgctttcagctggccacagagtcagagttgtcgctcctgtaaggtttcttctgggctataatttgcaagccagaattattgtaatgctatagtattatgccaagagcttccagagtccctgtgtaactgcctggcccctaaacactgtatataattaaccccagtcagtatccctgcaatctgatcttattcctggtttacagatggggtggctggcctaaagtggtatttacttgatacaagcaagatgtctctgggtgttttcctttgcgtatagagacacaccttcagagatggagtcagaaatagtaattctgaagagaaacataaaatcttcaggaagataatggagaagcatcctgccttgtgtttcagggagacagatgcttgtaggaaaatcatcagagtagccagaagatgagctctctctctccagtcacagcttccaggattcacagaggagaaactgggaccagtggcagagaaacagtcaagaggaactgctgtggggctggtgagatggctcagtgggtaagagcacccgactgctcttccgaaggtccgaagttcaaatcccagcaaccacatggtggctcacaaccatccgtaatgagatctgactccctcttctggagtgtctgaagacagctacagtgtaattacatataatcaataaataaatcttaaaaaaaaaaaaaaaggaactgctgtgattgatagccatttttctggttgtcacaaaccccaccctatgtcatgctgtaaataaagcctcccccctccccccagtgtcagagacccataacaggacttcaggacttcatacttgctctactgccaagttctactgctaacccctggtttgacattgacacctcctttgacaggtttggcattgtcccctcctccctgcactgcccccagttctcttggaggatggggtaggtgaagatagccatatttcagtttctg

SEQ ID NO: 28708 - DNA, 1176 bp, Mus musculus
tgccctgtagtctactctggagtcatcctttcctaaggctttcttcataccccccccacccgcccccatctctttcttacctcttgtttattgcacagattgcctcatgtctcttctacttcaacccttctctcttcctgtttactggatatgtaacaaaacattcaagcaaagctctccttggtgagcagttttaagttgtcaacttgttacaacctggaatcatctgggaagagtctcagagagactgtctacatcaggtttgcctgtgggcatgtctgtggggaagttgtcttgagttaattgatgtgagaagacgcagcccatagtgggcagcaccattccctaggcagggtatcttaacttgtatgagagcagagagatcatgctgagcacaagtgagcaaatgagcatacacacattcatttctctctcttttccactgtggatgtgacttgactagttcaaactcctactaccgtgacttcccactaaaataagtcctttctcaattgctttttgtcaggatgttatattatagcattaggaaaggcaactaggacactctcatttgagggctagtgattacctcattttaataaaccttgtcttcaaactccatccaaacacacaaggccatagcttgaattctatggccgtagaatggcaaaaaaaagtatattttgaatcctcctcctccttttctgcatgaattccaagctcaaatgttgacacgtgctgagaaaagagttggaagctgtaggtcaaaatgacaaatggtaaaaatgtgtgctgtcactactcagtctcagtagtgagaaatggcatgtttggtgttgtttcaaaggaaacggagaactgagatttatatacgaaacttctcactttaaaaatcaccgaggatgtagttcaggaatctagggcttgcatgcaaaaagccctggggtcagctctgtaagcaaataagcgtaaataaaacgcacgctctgtgtggggaaggttgttaggaaacgctcttattggcagcctggtacaaaacctttccacctggtgtcacctgcaccagctgacattgattttcaagtctcactctctgtataggctgaaagcagggaagagtccgatgagataccctatgaagagatggagttcttcacaactacaagtgggaacact

SEQ ID NO: 28709 - DNA, 1182 bp, Mus musculus
tgcctagcctcctggcctttgggcacatattcttatcccacgattcttaagaagcacacagagccacacatagaccaaatggctttaatattattttgcagtttccagtgatgcagaatgcagctgcagttgtgtttcaaggagaagctgagtggggctggctgtccctgcagcttggtgccactcctgggcccgtgtgcagcctcagtggacactcagtgctgaggccccgatgccacctctagttaccctgtactgtccatactgttacagttcggtgtgcaggctttctcttaagtcagaagccccctggctatgctcaacagcttttgagccttatcattactataatattggctgaatccctaaggaaaataactccccaaaacaacaaaaatactagtttaactggcactgtggtctattaaaaggcacaagaacagtgtatttgaacatttttactggctcccatggtgttaaaaaaggaaatccagtaggaacaccaagattaggtttcagagtaatcccgtgtgttgtttggccaggatctcctaattccttaccattaagatgctgtactctgctgtcctctagaggctttgtttgtaggcaagagctctgtgtgatttgatttgtctcataaatgaccaggcaggcacttggtgtctgtaagcagggccatgctaaataccacaggcatggtggactggaaattcacccaatggtgttgatctcacataagccattgcccactgtggtataggaagatgtttttatgtggctgtaagttttctttttttttccttttttttttttttttggtttttcgagacagggtttctctgtatagccctggctgtcctggaactcactctgtagaccaggctggcctcgaactcagaaatccgcctgcctctgcctcccaagtgctgggattaaaggcgtgtgccaccactgcccagcggctgtaagttttcatccatcatgaagttggaattcaataaagaagaaatgatttctgactgcagatgagtaccccgcaggtgttcccacagcactcagaaggatgtctgttgcctggtgtggtgggttttgaaacttgaaaattcaccattgcctttttctccctctttatcttacctggcaaaaggaatcctgtgtctttctgactcttagaaaatt

SEQ ID NO: 28710 - DNA, 1493 bp, Mus musculus
tttgtttcagaaaagtgattaatacagaagtaattatccttaaagttcaattctttaagcctctgaatctcccagatttattagctcatttaagaggtaactgagagcccctagtcgtatagaaatttctaagtgtgttttagtctgcagagaaaaggttcccactttctgacgcattggctccctagacaagctggtcttgaaaatgtcttgtgtcctgactttgcagacacgctttgcagctgtcagtagtgtagctgtggccaatggctggcccctgcatcaaggctttaagagctgggcttgggtttacattattgtgtgtctctccactctttcccctgcagtgttagaatgctgagccttctcaggaaatgtgtgggcatgggtggtctgtgagggacacgttctgcaaggttgcttgtgtttgctttctgactgaggcctcttctgtgtccgcagcatcaccagaccatccagcagtacatggtgaccctggagaacctgctcttcacggccgagttagaccctcacatcctggctgtgttccagcaattctgtgctctgcaggcctaacactcgcgtttcttccctttttattatcttgaaataacttgtcttatttttgatggtttgaatgtttgctttcttgtagtagcctttcacttcctgatggaaatgggggaggagagtgaggaatatgacgtgacccttagttgccctgcagggcaagtgtggcttgctaacagcgatgttatgttgaccgtagagttgtacatatgtgagcacaactttcctgtgataaatttgatactttttctccttagggcacaaaacaacagatttgaggtgtgtgaaatgcaaggtcgggcttgcaaaatagtagatacaaccgagggactatccccagggagccaacttttctctgctcctgggaacatggctggaataaactgcagttatggtttttaaactctgggagtcatggtttatcatcttagtctcttttcttactgaagctgtcttttgcaaatacttttcttaagtggtatcttatgattacttgttcggctaaaggattattaatactaatccccaaatttgtctaaatataaatccacccagaaatcttgaaagttactttaaactgcgatctcaaagtataaagatggcagcagtttttcgacttctcagatgactacaggtgtgtcagccattgctgaaagcattggtcaggccctgcacctctaagaaggatttgtccaagatcctgtagtgtcaccgaccgagctgacgtggacttggagttcagtgtggcttggggcttgtctcctaggtcctggagtctgttgaggctgaagcacaacgcctgttgtgtaaataatgcagaagcagttatctggcatcccggattgctaggatttttaaacttctcattaaacctcaaaaacatccactaataatgatacaattactggtagtaattgtatgca

SEQ ID NO: 28711 - DNA, 1193 bp, Mus musculus
aggtctggtgagatggatggctcagtctgtggtggtgatgccaccaagtctgaaaatctaagtagaatggactctaactgtggcaggaacatggccacccatacatacaaaacaaagtaataagtgtgaaatattgtatgtacaaaataaattttttttacaggtaacctgagactcagaggtttgtttgtccaaaggcatacagctggtgatgggatccgccttgctggaatcctcccttccctgtaactctgattcctcggaatggcaggaagggagatcagggtgagtttttttgtttgtttgttgcattttagagctagggtttctctgtgtagctctggttatgcttgaactctctatgtagaccatcctggaactcacagagatcctcctgcttctgcctctggagagttaggattaaaggccaccaccacatccaactctgttggttttggtggatagttttactaaaatcgtccaggctgtaacacttggtattctcctgcctctgcttctctagtgctcagagtacaagcgcaggcctctttatacatagctgatgatcctctctctctctctctctctctcgatcctctctctctctctctctctctctctctctctcgtgtgtgtgtgtgtgtgtgtgtgtgtgtgtgtgtgtgtgtgtgaacttgctctgtagaccaggctggcctggaactcccagagattgcctctgcctctgcctctcaagtgctgggattaaagtcagatgctaccactgcctggcctggctgatttttgtttttaatttttgcttttaccccttatacatatagacatatacaataaaatataaatacattattatttatttagacagtgtttcactgtgtagtcctggatggtctggaacatgctatgtagagtagagccggtcttaaattcactgagttctacctgcctgcctcttcctccagagtgctggactttaaaattgtgcaccaccaggttaagtttctttggttttggtgacagagtctcactatgtaaacctgtatggccttgaaatggcttggtctgtaacctgcccctggaattagagagatgtgctattatgcataactttatgtaagttttaaagggggaatggggatgacacgatttttcagaaataggtgtgaggactcgtggatcaaagtgataataat

SEQ ID NO: 28712 - DNA, 1192 bp, Mus musculus
acgcaataaatcagtggttcaagagaacaagggggcccagtgctttctccatcaaccacttgttgcttgtgggcgctttaaaagtgtagtccctaattcacgtctaattccatggctctggccagacgtagtcaagaggatttaaggtgaaaatgagtactctacctaaatttagttacttcctactctattgatttttgtggctgactagagtgaaaagctcaaggcatgaactcatcgtttcaagttcaaggaagaagatggtctaacaactcaatttcccagcacgtggtgggcacaaaatgtctgacggagggatggaagggacacgtgccggtgaaatgttcagggccccgggaacagggacaccacccaatcagtcctcagggaccgccccacacttctgcggggccgacctcaaggcctgtggcaggcctttccaaacacaaagcctcgggcacgccaccgccacaagttcccaacttgttagccatagtcacctgagggcgccagcccaggccgcctgtcccgctcgacctcgtgggcccagggtcgagcccacgcgcgccgcagcgcacgagagcggcgtcgggcccgcggcctgcgcacagccggccgcagaggccgccgcgtggagcacgtgcggggcccaggccgccccagccccgcgtcggccaccgttgcccttttaagaagggggagggcgcccgcgaggggacgaggcggcggtggccgagcgccgcgcttccagtgcgcgcggagacgagccccgcggggcgggggcagcccggggaccgacaggcagcgcgagggcggccggctcacccggcggaggaagacggcgcccgccaacatggcgctgtggcgcgccccggctggcgcgcggagccgccggccgcccacaccgaggggccggcctccctctcgggcaaggccccgggcggcggcgcgggggagggcgaagccaccgcggcggtgacggtgccgggccggctggcccggggagcccgcgtgggcaaggccgagggcgaaggcgagccgggcaaaggaggggcaaagttggatttttttaggcttgaaaaaatggcgggaagcgcatccttttttcaaacttggcctcgggaggggcggcggttgcgccacctccgccgccaggcccgcccctcccccgttccgcgccaggccgcgcccg

SEQ ID NO: 28713 - DNA, 1153 bp, Mus musculus
tttgttgttgttttctgttacagtttttaaagcttcttcctatttttgtttgtacccacaggttcgagaacttgtcttggacaattgcaaagcaatggatggaaaaattgaggggttaacagatgaatttgtgaacttagagttcctcagtttaataagtgtaggcttgttttcagtttcagacctcccgaagctacctaagttgaaaaaggtaagtattctttcattgttaagaggatgattgagaaggaggaatgcatgggtttctgtgtgctgtaagcacgtgtgttttagtggcccacgacactgagattgggcggctaccttccgtcctaaggtggctcagcttcattttcatcactggtggttacacttgaccctgcaatgttgcaacagtgttttgaaaataatgccttattataagagagagttgctttataaataattggttagttgtcaaaagctttattttgttagctactttttgtgcttatgctatgttcaggagacacaagagcctctcactttctgtgctttaatttgtatgctgatgagaaggaaagtgaagactgactgtggggtgtgcgtgtggtacctaccctccaaaggcatctcagatgagggggcgaagttacaggcagtttacaactgcccccatgggtagtgaaaatcaaacccatcttctgcaaggacagaaagtgctcttgactgctgagccatctctagctagtcctgtcatgaaattcttaataactagtttgaaatgtgttgtgattgactagaaagagctgtgtaagaaagcctgcgacaggccaaatctggtggtatctgcctgtaatccagctcttagcagaaacatgtaaaggactgtggggtccctctagacagccactgcctcctatgtctgtgtccccagccaccaccaccacccccaaaaagaagaaaacccacagaaaacaaacctacatttctctctccctggtcttaacccattgttgatggtttaccttccctatagtcaccctgtcttgccctctagttacttccagaaagaacagaatatggaaaaagagtttctcttgtctctgtatttgtcaaggaaatagaaaaaaactttgctcctgtgcactgacaggtgtagccataggcccag

SEQ ID NO: 28714 - DNA, 1212 bp, Mus musculus
agccagcgccagcttacagaagcagcagtttctggagagccacatttacagactctggggccttgcacagggaatccgatgccctcttctggccttcgcagccactgcatgcacatggtgtgtacatatatagcacacataacaaatttttaaaaaaacaaaacaaattaccatcttttggcatacctgcctaactcatcccaaatgtttctgggatgtataaacttcataatttggatttaatcaaataaaataatgtttataacctgatagaaacagggcttctgggagaggcgggtctatccaggctgcatgtgtagaaatcaagagaatgacgaggagagtctcgggtttccacaagtgggcgccagggttgaacttgatcagtcttggcagcaagtgtctttacctgaggagtcacttcaccagctcttgtagaactttgctgctactgtttggttttgttggaagaatttgctttttaccttaattcagtagtaagtgattctctgtctgtgtttcctttagcttgagctcagtgaaaatagaatcttcggaggtctggacagactagcagaagaacttccaagcctcacacatctgaacctaagtggcaataacctgaaagatatcagcaccttggagccgttggtgagtggtggggatttagagtgggttgttgtcatctcattgtcatatttccagtgggagaaatgattggcttcatagagtggcttgtaaagtctctccagtgtactcctgggcctctgctctcctgactgaaactgatgtatcatgcatggagaattttatggttatcttagctttaagcctgtctgctaattttttctattagactagccaggctaatctgtactgtaacataacagtctgtcttgggtgttacatttcagagctgtaagtagggcagtttgaggcacaaagggtctcgtggttggtgatcttagacttacctacatcactattttgggtagaaacaccttcctcagtcttacttgtaggtaaattaaagagaccaagttttaagtgccttttgggtttaagcgtggtatatgaatgaccctcagcaaactgaaccgagagggctttattccttgccttacttaagtgcttagaggaaagtcaaggagtagattgtttgtacattggggactgttggaaggggagcaagctcagcagtgtgaggcgcag

SEQ ID NO: 28715 - DNA, 1243 bp, Mus musculus
tgtttaattttgggagagcactaaacttaactattagacgggatggtgcactctgggctttccatgctattctagaacgtagcaggacggtgtatataacaaggccttttaagtttcctttagagagtctggtaatgtgaacctcttctagagatctttaagacagaggagtgtagatgttcctgaaatctaagctcgtgtatacccttctgcccatgcctcatgccagttctcatttcatctctatgggcaggctctgtgtacatctcatctaggtcacactcctagtgctaccaggaaaagacgggagctagagcagaaggggaacgtggcttgttaggaaggcaatgcaaaactacagagttttcctgtctacagggatgactagctaaccagtagggaagcctagagttttgcctcttgaagctggtttggtgatatgctccttttatttaggaatcatgttttttggttcttcattttagaaaaggttggattgtctgaaaagcctggatctgtttggctgtgaggtcactaaccggagtgattaccgagaaactgtcttcaggctcctgccccagctgtcctatctggatggctatgaccgagaggaccaggaagcacctgactcagatgtggaggtggatagtgtagaggaagcccccgactcagatggagaggtggatggtgtggacaaagaggaagaggatgaaggtgggtagactgggcatcctttgacctgacttctgctcttccacagtcctgttgggtgcttctgctcagtgtccttgagtgtgagtgggtatgcatgagtgggtgtgtgcgtgcatgagtgtgtttataaactctggacatttaaccctaaaatgctcagaaatgaaatggttttattagcaagtgggtattgtatatctatttggtcagtagctatttcacacaagccactagaatcctttctgtgcttagagttcatcattttcttgtctccctggctctgcctgctgtcctcccgagctcagtgcctgagctacaaacttcaagatatattcttagttgttctttctctctctctctctctctctctctctctctctctctctctctcttctctctctctttcttaatttataaaagcatgatctcaagtatacgtggaattaatggaaagagatgtttttcaggtgtgtgtagtggcacacttacagagttcggttcacaagttgagctgttcttattaatcaaa

SEQ ID NO: 28716 - DNA, 1412 bp, Mus musculus
aaagtggggagataggattcctagggtttttaagtcacttgcctaaggttcacttgtgaagggtgtggcttagaaacaggctgggtaagcagagttgttgctatgtattaaaacctcagttcgatagctgtgccagttgaggtgctaccataccacctgcctctctggccctggcgtcctatgcatttggtgccgtgcagcacatcgttagtggctgcctcgttagcagggttagcggagcccttcccatgttcttacgctagtttgtttttcactgcagaggaggaagaaagtgggaagggtgaaaagagaaagagagaaacagatgacgaaggagaagatgattaagacccgaaacaacctgcaagaaacagaactgttgagtattggttggactgctcatggatttggtagctgttttaaaaaggtagctgtgatacaagccccaggacacccccacccaaagagccaaagaatagttcccgcgacattccgccttcctccgttagccccttggtaatccaccaccaagcctggggacttcgccccaacaaaattgtaaacgttgttaggttttcgtgtaagactcttgctgtatcgtgacagctgtgattggtgagttgaccgtcctggctgccagttacactgcgattgtaacaacatttttactttctgtacaacaaggaaaagctttgtaaataaaatcttaacattttgggtctgttttctcatgcttttctttctttttttttttctttctttttttaaagatattaggacattttgtgtgataactgccaaaaccgtattttctaagactaagcaaaataaatgcattactctttggtaaagcctagttgtactctcacatttctaaacaaggctcctaactagcttgtgctgtgtctggtacagaggtggggggcagtctttggtatattagtgatgaggaaaggcaggatctttgaccatcactattcgaactctcgctgttagtgaccccggagaataagtaagctacttcttaaaaatggtttggaatctgcaatagtggcagagcgcctgcctgcatgaataagtccctgggtcagctccagcagcagaaaatgtcatgcagcagttgagtaatctggaacccttgcaaaccagtacatgcatgtgtcaaggggaaagaccctaccatgtattgacttctgggtcccttttagtgtaaagttaaagggctaaggccagatgacttgacaagcctcagtgtgggtgacccatgctcccatggacaggaaatactctaggtaaaaaagtagacctcaccaagactagagcatgtgtgttaggctgatggctggcctgtcttgaccgccgcttgtcaagacgggaattctgacataagccttgccaacaggcagcaggtc

SEQ ID NO: 28717 - DNA, 1083 bp, Mus musculus
ttaggagtagcccatgtacttgagcagtatgtctgtgtgtggagtatgcgcctgagtgtaggggcccggatctcttagcgatggcatcacaagtggtcttcagccacatgacacggtgtacatgtgcacacacctgcaatccctgggacccacatggtggagggagtgcttttcttttcaatttttctcttttggttctcgtgagacagtctgtatgtaccgcctggctgtcctgtatataagtaggctgagatagtatacagagatccacctgcctctgccttctgagtcttgtctttctcttttttttttttttcttacataagaaatatttggttcatgtctttaatcctagcactaaggaagcagaggcaggaagatcactggtctacatagcaagttccaggccagccaaggctagttagtgagaactgtgtacttattttttaacttttaatttctttttttacaggagtgtggggccgactgcgctaagtttcagaagagcgagttggagttcaagtttaaccggaaggccctggagagaccatatacttcgaagcattcatgggggaagacgtatggggagcacaagcggcatctggaattcagccacgaccagtacaaggagctgcagagctatgcgcaggagatcggcatcttcttcactgcctctggcatggacgaggtgagctttggctgcccagcggctgtgagtggagccatgggatgcaggcggctctttgtgtattgcccattccggctcttgttcacctgtattgggtccaagaccagaagcccagagcaggggttctgagagagggtaccatagtttaaaactaacctctggatcagagcagccacgctaaaccccaaggtccttcccattgtgggaacctggtatgggttgggagcataccccttgccagctagctctgactggctcactctggtgctgctggtatcacccacaggtaagtggcccaaacgcttgctgtgctgacatccaagaaggatccagctggtattgggcctcaggtccattttgcaatataatttcttcttccccccattctatgcagc

SEQ ID NO: 28718 - DNA, 1213 bp, Mus musculus
taatatcagttgtcccccaagtccagtggtcagagttcagttcccaggtccttcctggtgaaaggagaaagcaagccctgggggctgtccttggatttccacgtagctacacgtgcgccgtggccctcatgccatgctgctttaagtaaacacatacggaaaatttaaaaactaaacgagccggatgtggtggcgcacgcttttaatcccagcactcgggaggcagaggcaggcggcgttgaggtcagcctggtctacagagtgagttctagggcagccaatactacacagagggaccctgtctcaaaaagcaaaccaatagacggatggatggatggatgacagacggacggatggatggacagacggacagaaggatgaggggaggccgagagctcaggtttcagctacatcacccttttcctgacaccgaggttcatccatagaacttgaaggagctgcttctcttccgtcatggtaggagagggggtaaaaagcgaaccagaaaaagtgaaaagacctcccaaagtgttgagttcagttcagggcagcttccctgttctgttaattaaactttgggacattggaattggctgagggaaatgactgaatagagagcattactctattcatattcttctagcctacacaaacaaataaaatacagttttaaaaagttaaaaaaaaagagtgaaaagactaatagtcccagcagttgggaggtggcgtctagcctgggcagcccagcctgcaagctggaagcaatgctgctttgctgtgctggaaaccccgctcggaggctcctcttcatttgtttgaggctagttttccggctagcctggggcagtgagacagagacgggtaggagtacctttacaaaagacttaagttgattttgctttgccaagccagcatttcctgccaggcctccttagagctggcttggttgggttctgtctgtccttccgtgtccaccacctccgtttcagtggcaggtggttcccgcactcaccttcctgacttccttctgccagccatcattttaacgagttctgtcttcctctgctgtgcaggatgttccgggcggctctgtgtgctcaggagaggttaaggtgtggcaggagtttatggagtctgaaaaagttcgtaggacacgtgtcaggagggtgtgcagaggaggtggattttaaccaaagaaagcttagtattgagg

SEQ ID NO: 28719 - DNA, 1194 bp, Mus musculus
acggtgggcattagactctgcctgagcccctgtgggcagagacaagctctcccaactctgtgagcgaaggcagggacagagcgttcaccccctttggcagtgtcaccgccagaggcctacggttcttagcagccagtccctttctcagaggcctgtcctcagacatcaggtgcacactaacccacggtacagttggccaagcagaggcagctgtgagaaggggaatgggaagcagggaggaacacgggtctggggggtggggggtggggtggagggggtggagcttgttcatcttaaccatgggggaggtgcagacatcagccctgccgtaagcaccagggtcttgtcacatatgacagattacaaacccagacaaaggtgctattgtttgacttgtttaagggcatgaactcttaccgaggctcactgtcacattcactttgttctttggaatcaatgctgagattaatcattttgttctttttaagtatctccttgtcttcatcttatttaaaaaaaaaaaaaaccttccactttttttttttttaaagataagatctcactctatcctggctggcctggaactcaccctgtatacccgactggactcagaccctgagatctgcttgcctctgccacctgagggctgagattaaagctgtgcgccaccatgtttgacctgtacttactttgatgtgtgtgtatgtgtgcaggagttacagaggacagctaacggaggtcagttctgaccctccatcttgttgttggtctcgaggatcaaagtcgggcatcaggcttggtagcagtctccttcaccagctgactcgtctcgatggcccactgatctccccctcccctggaagtttccgctagtttagcattgtagattgggcagtagctgagggatggattgtgtgcaggcttgggaaacgtccaggagctgggaagtgatggttggtaggagtggcatgtggagagggctcagagccttccaagttctttagggagtggagagccaaggattcagttttgtttttttttttttttttctttacatttgttttgcctacatgtatatctgcatcacgtgtttctggtgcctacagaagccagacgagagggttcagtcacatggaactggagataacagctctgagccaccatgtggttgctgaaactgaacttgggtcttct

SEQ ID NO: 28720 - DNA, 1205 bp, Mus musculus
gagaagggctggtgtgtgggggcgggcaccaccgatgacgtgtgtgcagagtgcagagggccatttctgcagagcccttgctctggccacttggcgaggatagctggagtctgaggcctctctcctttgtctagagtttgatttgtttttgcaagtttctgacatcccaactcctctttgtttgcagacgccaaggagaagtcattgccattcctctccctcgtgagagtaagaccgtcgtagataaggctcgagatccgtgctgagtccctctctgcctgagcgccattccagcagtctggagaggcagcatggtgcccagcttctcgccgccgtcagcgtgccagtggcaggcgccttggcccagcatggtgctgtcccggtgaggcccggccccaggcctccctgccctacaggcccgagaccatgactcggaaggagggtggtacgtgtctgtggcgagggctggctgtagggctgacacaggggctgacgcagctggcgtccacgcctccaatggacgggaggtaggcgtggtggaggatggggagctggagggacagccggcgctggatgctgcagggaagacagggagagttagtgagggctggctgctctcccgaaagcttcttgctcctattttgacaaaaaaaaaaacaaaaaaacaaaaaacaaaaaacaaacaaacaaacaaaaaaaaaacaaaaaaaaaaacccaaaaaacaaaaaaacccacacacaaaacaaacaaacaaacaaaaaaccctgaggataggagtctgtgtcccttaaatgcaagatctgttggttcaattgtttaagcgcgtcttcagacatgaagcaggcatttgacggggtcctactattggaaatagcccagaagagtagcagtaccaagattcaatcttgctacctccctatcttcccaatgaggttcactggttaaactatcatggcaaaattaggaggactcaaccaatgtttcacacaatagcactcatctcaagttacacaagcctccgagtgatgtggctttcagttcctgcccccttcccgccccccctcccccgcccctcccccgtcccccagctgcttattccctcctccctgccctctgtcctggctgtaaccaacagccaatccttcccagcaggttcctccctggcctttcagattctttggtgattaaccttgtcatccctacg

SEQ ID NO: 28721 - DNA, 1181 bp, Mus musculus
cacacgaggccagctggcgatgggtttctgactcaagattcaacttgtagccagcccagggctgtgaggacatcaagacatgcaaaaagatagaatggatgtgggttttattcagccagcctctgtctctatctggggtacttgctaccctgcccttgagtttccccatggctgtgtaaacgcacacagcaggtgcatcttaggcagaaagatcatttctcatttatttccagctgatctgttattggttcatttggcgtttcacatggcagttcagagacctccattaagcatcccctccaggatatgagcagtggccacaaatatcaccttagactctgacagtcatcttgaccttcccctttaaagtaatgtgatcatcccagccaggtgggctgtcacccttctgcaggcccctctggggtcatcttatagccgctaaatgttccccttaggggttttcctcttgtctggttcagctggccatatcacactcctgcattagttaccttatctgatgaacctcaaatccttgaccctgctagaaagttctggaaggaaggtcctgtccaccgagaggtaggtgtggtggctgagcactttcggggcagaggccctggtttttattgtcattagggaggaacagtaggactgatagaaagcacatttgcccctgacctgctgagtggcggggcgtgattggctatgtcccgcttaaacactggaagaccgtgttccctggttaatgttggcaggctcgttgtccgggaacatagccacactttccctgtcacttgctggattagccagttttgtgtcactcctaacaaaatgcccaagacagttaatttataaagaaaaggtttattctggttcatgggtctccaggttgttgttcaagatggagcggtcccaagacttccaacctctggtgaaaggatccaaggcataggcagagagcaagtgtccaagaaagtgcttaatccaggaggcaaagccagaggcccaacctcccctttcgagggtcacatccacaatgaccagtaggccctacccctagtgggccacagcaccttcctgtgaacaagcctgtgcttgtgagctgtagggtgatcaacacccaatgagactaggaagcctaactgcctgcctctttgttccccagaaataaagaaattgtc

SEQ ID NO: 28722 - DNA, 1208 bp, Mus musculus
tcaggtggcttactaccatttgtaactagtttcaggggatcttactccctcttctggcttctgaaggcacctgtacacatatagacacacacacagattaaaaaaaaattttcacaaagatttttttttaagtactattttcttgtaacttccttattgtatgagaatggttgtcttgtactctggctattcttcaaaagaggattaaatgactgggaacgataaggaagacacagaggacagttatctgtactgtagctgaggaagactttgcatttgagcatgtagtttgcgcttaattttctagcagcaaagacagatgaagatgaagctctcctattaagaattcatgaacaatgctccccctccatcccactccaccccaagcttatagtagtcaaagaatttccaaggggtaaagttattgctggacttggcatttctgatttcttgttctgaggctcaatcttcaacactttcctcgggttcagtttagaacccactgacactatccttccctatttaaggctctgatccaagtgtggacatttgaatgcctaataccagtggaacagctgatgttaaagctgggacgtctgaattaagctttgctagaggctagaggataatggttagagaacaacatgaaactatttgggctggcttataaagacgttttcctaatgttcttaaattggccagtagccatctggcagacatcatcaaagaatggtcaccaaagatgaacagaaccagacatgtttttcttctaacaagtccagcgaggccagatgctgaaagtgtctttgctttgggtttcctgtttgaaaagtgacttctgggtaatgggtattaaaaatgattattttaggagagataacatgtacccagagtgtgttcttctgttttaccagttttatagtaaccctgggatatgcacattagcttgaggagtattctctattcggtgtatcctaaaatcttcctgcttcttagtagaatccttctttgtgtaagtactctgggaaatgaatgtgatttttactctttgcaatttacgaagatattgttcccttttaaattttatgtatgtatctgtttatcatctgtcctttattgattgattggttgtagttgttggctactttaagtccttgtcagagtttgctttgtttcaccaacaggatagacctaaagcttaccttatt

SEQ ID NO: 28723 - DNA, 2054 bp, Mus musculus
tcaatgtaagtaagggtttgttgttacagttgtatcacctgcttaaataagctcttgtgctataatcaggtacttttggggcctttgttttcagttttttccatttctaacccttcgagatctgctttatagaaatccagggaccaatgtattttatcactaaaactgtttttatataattttaagaccataccaaaagttatctgagttaaagttgtaatacgtttcttactttcttgcaaggaaatgggtttttactgaagacacttctcatgatatctgaagttgaagaatcattatgtttttcttacctaagtggataaaatgtgctttgatgaatcagggaattttttaaagttcgaatttagttctaaattgagtttacatgtttacagctaattttttgtgtagggatagtttgattctctaggtggccaatactgaatataaaaataacttaaaaattgagataggtcatggttaatgtggctataactatatatacatctaattagagaaatatttctatgtaattttgtagtgcagtctgttgtttctattgccaatcaaagacttccccccagccccaaagtgtagtatggctaagacatatcttctgacaaattacatattatcttgtcaataccctggttaagctagcatgaaggaagtatgacttactgaggcttacacaacttgagtcccttatatcttcagctctgtttttcccactctgcctttctgctgccccctggctcagagacttagtgttcctgaccccacctccagcctttggacctaagagctgcttttgagacctaaaatgaagtgattgatggaagctgtgtgacatttttccacttccttgagtcactgggtgttatgagggagtgatctgcaaattggggtagggggtgcccctactggtagccctgctttgatgtcagctctgggcaaagattagggtgacagctaagtggcagtggaagttggcctcagaagtagtggccagctgtgtctctagtaggacagtaaaggcatgaagctcagcctgtaatcctgctactacagtagtactccagaagtgccttgaggccctgtgtggggctgtggccatcaagaattccagattttggttctcgctgcagacttaagtggccatgtagccatttttgtaatccatacatgtttgactcttccctctgcaaattgtcagatacgtaaaaccaatgacaaactactacttaacatgcacaccaaaatctgcccagaagacattgtgatttcattccatgcactgaaggaatgattgtaaatcatttctttgttccttggtcatgggagtgttctggttctacattgtggagattccagctgttgttctgttatagcccagcagaacaagtcgacgtgttgaaattctgaagaatagtttgggagtgcagtacagcttcatgtgttggatgttgaaactttcatgggccctctttagaaaagcagaggactgtcagcacattatttttaatcctgttatgcactcgtacttattgtcagtaacaataagtacgagtattgaaaatattgtcagtaacattcagtctctttcttaaagtgaatttgcttatttttcaatgagatttgtgagtttaatattatgaactgtgttttgataatccctttttcacattgtgccaatggaatggaatatttgatatttctttatatgtcaaggagatgcttcaatatgtcatttgctttaaacttaaattacctctcaagagaccaaggtacatttacctcattgtgtatataatgtttaatatttgtcagcatccaccaggtttgcaattttatttctataaagtgtgagtgttacgttgctaagttactcagatggtactgtattgtttatatctgtaccccaaatgacatcatctagactttgttttctgtgtcttattgtatttgtgcagtcctttaaccctgttggtgtgattgctgccctttcagatatgtgcaggtgtctatagaaattctcatttaaggtgaatggt

SEQ ID NO: 28724 - DNA, 1198 bp, Mus musculus
gtccggaaagagaccagattatgcccctatggagtcctcagatgaagaggatgaagaatttcagttcattaagaaagctaagggacaagaagcagagcctgaggaacaggaggaggactcatccagtgacccccgacttcggaggttacagaaccgcatcagtgaagatgtggaagagcgattgactcgacacagaaagatcgtggaacctgaagtagtgggagagagtgactcagaagtagaaggggatgcttggcgcctggaacgggaagatagcagtaaggaagaggaggaagagattgatgatgaagaaatcgagcgacgccgaggcatgatgcgtcagcgagcacaggagaggaaaaatgaagagatggaagtcatggaggtggaagatgaagggcgctctggggaggagtctgagtcagagtctgagtatgaggagtacacagacagtgaggatgaaatggagcctcgacttaagcctgtcttcattcgaaagaaggatccggtgacagttcaagaacgagaagctgaagcattgaaagagaaggaactggaacaagaagcaaaatgcatggctgaggagcggtgcaagtacaccctcaagattgtagaagaagagaccaagaaagagctagaggagaacatgcggtctcttgctgccctggatgcgctcaatactgatgatgaaaatgatgaggagtacgaggtatggaaagtgcgcgagctcaaaagaatcaagcgggagagagaagaccgagaagcgcttgaaaaggagaaagcagaaattgaacgcatgagaaatctgactgaggaagaaaggcgggcagaacttcgggcaaatggcaaagtcattaccaacaaagctgttaaaggcaaatacaagtttctacagaagtattgtcaccgaggtgccttcttcatggatgaggatgaagaagtctacaagagagattttagtgcaccactcttgaggaccatttcaataaaaccattcttcctaaagtcatgcaggtgaagaattttggacggtctggtcgcaccaagaacacccaccttgtggatcaagataccaattcctttgactctgcatggggccaagagagtacccagaacacaaaattctttaaacaaaaggcagcaggggtacgagatgtatttgagcaaccatctgccaagaagaggaaaaccacctagt

SEQ ID NO: 28725 - DNA, 2610 bp, Mus musculus
agtttccagcctttacttacaatgatgtcaccttattcttccaaggtctatacttggctacccagtgctcttatctaagctgacatgtggaaatagccacagttgctccagggaatctttaattatgatcctgagttgcactgaaccaccctgaggaagccgtatgttcatggttaatgcagacatttacccaggtcctatggattcagtaataccaggcagctagtcaaccaggaaaaggcttatggccaaggaggttaaggcgaccagtcacttatctactgttttaccttggttaggtgtctgcctgtatcccggtgttcaaactggccagacggcgtaagagggtcctattttactgtcacttcccagatctgctgcttactcagagaaattcagctctgaagaagttctacagggcccccatcgactggatcgaggaatacaccacaggcatggcagaccgcatcttggtcaacagccagtacactgcttccgtctttaaagaaaccttcaagaccctgtctcacagaaatcctgatgtgctctacccatctctgaatatcggcagctttgacttggctattcctgaaaagatagatgacctcgtccccaaggggaagcaattcctgttcctctctatcaaccgatacgaaaggaagaaaaatctgcccttggcactgagatccttggtgcagcttcggaatcggttaccatctcaagagtgggataaggttcatctcttcatggccggtggttatgacgataggatcccggagaacgtggagcactataaggagttgaagaaaatggtccaagagtcagaccttgagcgtcatgtgaccttcctgcggtccttctcggacagacagaagatctcactcctccacggctgcttgtgtgtgctctacactccgagcaacgagcactttggcatcgtccctctggaggccatgtacatgcagtgcccagtcatcgctgttaataacggtgggcccctggagtccattgtccacaaggtcacggggttcctgtgtgagccagacccagtgcacttctcagaagccatggagaagttcatccacaaaccatccttaaaagccacgatgggcctcgctggaaaagccagggtggcggagaagttttcagctgatgcatttgcagaccagctgtaccagtatgtcacgaagctggtgtagtcaggagagtacagtgtagagtctgtatgctacatgcactgcgatccctcttatgggttgtagaaacgcctttgaaaccaaaagaaagggggaaacaaaggagctagaatctagtgctagtgagattttcttttttaagtagacttgagtcttgaatgtgagccacctgtccaccacacctacctgtcatttctgaaatattcttaatgctgtaatcattccgtatctcgtgagtgttgttgaaagtatggtaggaatctgctgctagcagactattttaactctattttcctggattattgttcctttatatataaaggtttgatcatccagtgccttaattggctttagtagtgtaggtcttaccattgtcacagtcaattgatttgacttcagagcgtaatgggaacgaggctgctgcagctcccaagctcggtttacttaaagtgttctctagtagctgctagaaaatttttgttagaattttggctggatctataacaagagtactcagtattatttattgttttggtttttgttttgttttgttttttactgcaacttgacaataaaatatgtttggcatcagaagagaatagaacattagatctgagcccgatgctctgacttcatcttgttaaatacataaacctgaagtcagaagactaggataaatgagatagtttacatgaaggaacaccatcacacatgttttggcctaccgtgtcacgcttggccttattcctttgagcctgtgccagaacagtgtattgaggcagggagcaaagacaaaaagggtcccatatccctttctagaaaatatcccttgatgacctgattctcttccactagccctcactactaaaagtcctgtcacctcctagtgtggctctcagtgtgggccggggaccaggcctcagggcacaggcctttgggaactgtattagagttctctaaaatagcaaacagcacttaacagaatgaattcccagaagaagaagaacaaatggcgtacaggcttctgtccagctaatccaacaatgaacagaaagtccagaaatccagtagttgttcagtccaggaggctgaatgtctcagctgatcttcagtatacactggaatcccaaagtaggctctgacgccggtgaagggatggacttgccagcaaggtaaggacaagcaagccaagagcaaacgctccctacttccatgtccttgtataggctgccagcagaaggcatggcgcagactagaggtacgttttcccacttgaagatcagaattaaaggaagacctgccaacttcaagttaagcaaaaatccctcccaggtgtgccctccattgttagattttagttcaatccagatggagtcaagttgacaaccaagaatggccaccaccggggacactc

SEQ ID NO: 28726 - DNA, 1104 bp, Mus musculus
aacttgtagaaggtaaatgagcttaatgggtggggtccgagatgttcagacttctgtattccgcgagtctataggcaggaatccctctgagccttgtctgtctccttgtgtataaaggatcaatacttgtctcactcatgagatgcgtgagcttctgcaggttgaattcgatcatagattcacaagcattttgtgctagttcacctgtatgtctcatactgtagtgagacggaaaaggttgtctcaatacatgttaatttgagaaggtttgcaaatagatttttttgcgcataagagtttgggaaatttttctttttattgtagaacatattaagtacacaaaattagcatatctgagggattatctctaggacatccgatgtcgtcgtttgtgtataatgtgctgccctcggcagtcgtgagtattaagcctaccttgagactgaagtaagcatgacttctcttctcattcccaggggccctgtcccagtgctggtgatgagtcttctgttcatcgctgctgtatttatgctgcacatttggggcaagtacacgcgatcatagattgggctacatccatctgtcatctgaagaagaagaagaaggaaaaaaacccaacatatcttggaccaaaagtgtagtgattttctgttcacgtgtattattttacagagaataagaattgactttgagaaatcagttttttctatggctaataaactttggaattgctttatatggagactggttgcctgtgctttattgtgagggccctctgccttaagatgtagcagtgaataggtctttcttacagagctcattctttgcaggattggcagttcctcctacaaccatgtagtcactcaaactcaagatgctctaattggccttggcatgtttttcccaaggtatttctgtgctagtgattgtcattttgggtacttggttttcaagaagtgtgccttggactgccatcagggatctgtatgtgagacaggtggtgccgagggtaaagagtcaaagaaatcagaaaccaagagtcttggctggggcgtcggctcattctgttgttttgttttgtttttacttttttgagatggggtc

SEQ ID NO: 28727 - DNA, 1168 bp, Mus musculus
agtgagtggaataactaataaggtttctgtaattgagttatctcctaggaagcttaaagccaaaattttaatcaccaaaaattaaatttgtgaagtgtatcagctttattttataactgctgcctttgtttccttttctgttgtaattgtttatctcttatttttaatttattacattttatattttatatgtttaaagagacttttaatccttatgaaaaatatgggctacaaaagaattagaagttaaagtgagaacttaagggaactgttgctggccaggtttcctttttatccagcagaccactcttgttaccattccctatctctaaattaaaatgtgtgcatgttcactgccaatgattcagtagtttgcaaggggacgcagaaacatttaggctgcctggcagagtttttgggtaaccttttttatagtctttgtaacttgcacagtgctttgcacatagtgaactgttcatagatgtattacaaatacaagacatggacaatttcatcgtcatttcagatatattgcaacagagctgggcacggtgctgcatatgtgcaatccggcacttgggaagttgggctagggtgagcaattgggacttaaaggctatcctgggctatataagccttttcttataaatcaaatcaaaccaaaaataaaataaaataaaaaagcgcttcagtcacttctctgcataggtagtgctaaactgtaagtgctcagcccttagagactgtgtcgtgctttttggtagtttgtcattactcttttcacagttctatgtcatcactaccatattggtacagaggagatttctcctgacctggagcaagagctgctgctcaccaggccttctcagcccatgtgtagatggactcacttctatactgagacctatgacagtgctgacagcagtaacagtgacgattacagcatttcctggaaaggggagttggcaccagcctcctatcatttagcttcagatggcttatctctcgtgtttgtgtcggaagcaagatacttgaatccatccaggatttctctcacaatagtaacatagaattgctttaattttattttatcattgcattgtgtatgtttattcaagtgcaactatttgtggcctgtgctcttgagtatatattaatggggagttat

SEQ ID NO: 28728 - DNA, 1223 bp, Mus musculus
agagtttcaccgtgtgtttgtctcttgttggcgcataagtgttaccaaagttcattacagcagtgttttcctcatctcagccaggttttactgagttctggcactgagatagttgatagagatccgcttcattaacagagtagggtgactaatatcaaggcagtccctcttagcagtcacttgtaaaagtgaagggttaggaccaagctacgttgtgctgtctctatggggttctctaggaggcaagggtgtttagtgttgcttccttccacatagcctcagtaactctgacaggcccagagtcagtgctgctgtggcagccatgccctgcctggacagtgagttcagggatgtttgaagaaacaagataatctcttcaccttgacatatacttttccctttttatttactagtaaataagtaattataaggccactgccagttacgtaatagtaatgtatgataactccataagatattttggtatcaagattcttttcttcttttgtagcaagaccaggatgtagcgagcagtcctccagagagctccttccagaagctggcgcccagcgagtataggtatactttattgagggatcgagatgagctgtaaaaactcaagaatactgcaagcctttccacaccagcagaggcttacgtggtggaaatagtgaacctatattttcataattctatgtgtatttttattttgaataaactgaaagaagttttgggtttttaatttttttcctccccctgactcaattgcattgtcatttaatacagcctcttttttacaaaatctgctagggttttaaagaacaaaataaaaaccagaggcctgtctccactttaaatctgtcctggacagtctttatcatgcaagcggaaggtggcattgccggaagcacgccgttaacttacactgccactgcacaggcaagagaatcggcctgctccctgtgtgctatctgctttttctttcttcttttctttgcatatggtcaaaatctattggtatttttattatcacatttctaaaagctaaggggatatatattctaggggcttgggagggaaataaattaaaaatttcacactgtgtactgtgttgtactgattggttgggcattgcttatgagggttccatagtggttcttcttggattcctaatgtgtaacttaaacatactatgaagaggaggagagccataagccagagca

SEQ ID NO: 28729 - DNA, 1177 bp, Mus musculus
ccaagaaaacgcagcagcagcccggggcggtgctctccatcctacccgagccgccgatgctggaccgcttcctactcacccctgactccaagaatggcgtcccggggccgccccaggaggcacaaccctcacggggccgcccctaccgccaagccaggccactgcgcccacaggaacagaccccaggacactagagcccgggagctctgaagaagtagcctggggctccaggctgcacagccctctgggaattgtagttcccgtcccggaggcacagaggtacgcggtcccttccaatcccgaagagccccgcgcacagatggcttggccgtcgtgggcacagggcttactgggaaagagagtcccagctctccgatgacatggtcaatgaaactacagtatggactacatttcccgacgtgcttcgagatgggcaggacccggaagtgagggcgtgagaggcctctctggaagttgtcccgggtgttcgccgctggagctccgggtcgagaggacgaggtgccgctgccgccggccccggagcccagcccttttctagcccggtccagtcccagccgccacctcctgaccccgccgtcgaccccgtcgttaccatgaatcctgcggtcttcctgtctttagcagacctcagatgctccttgctgctcctggtgagtgtatgtcggggtgacaaaccctccgactgtgtccctgaacgcctcccgccctccgcgagggggaacggtgcagccccctgcttgcctcgactctcctccgctggcgaggcgtgcacccccgggcactaccttcactttggccgttcttttggctccttaagcctgcggtccacaaggcctgcgaaagcacagtcagggcttggaacctgcaaataggagaattcgccttggggggagtgagtgatccgtgggagggaggtcaccgctgaggcccctggagttcgtttcagttttgtggacgttgaggacctgcttggggcaccagaatcctaagggacctagggtacacctaatgttttctcccacatggaggggcgttagaagccgacaggtgttggggtcgtgtgaatctctctctggatccttgaaaccggctggcaaagccctctgttgtggcttaatgtgattggttggaaacccggaactggagtctggtttgg

SEQ ID NO: 28730 - DNA, 1202 bp, Mus musculus
gccttttgtttttctctgcagactttaaagagtggcagtgttcaggagcagtggcttacagacttacattactgcttcagcgtgtacatcagtggccatccccaagggcctagtatattgaatgcattgtattaaagaagcaccatggtacctcctgtttgaagttaattgttcatgcacattcattttattttgaagaaagactgatgtaacagatgtttgccattaaacctcaacttttaaagaagttcatgagcttccttcatacagaagtgggaaaataaagtttaagagcttttagtgctctcacactgtttgcctggaatagtacgagatgcaaagacaggctatagaacagtttgaatttctgaggagctaaatgtttacaatacatagagtgagctacgatgccttcattcacttaccagtgaatctttgtgatctcatctagataaacctgtcttcatcattttgaatataatttactaaaccaaaagtctaggtagttaagtgaggtaaacacttgcttcctgaccttcactgttagcacagtactgacctgacgtcgtcgctgcctctgtaaaagcccgtaatcactagactttatgtgagccaagtagtcttagttagagtgtgggttactttcacaaaagaaactgcttttggggaatgctacctattcctgcaagttggtcagaagatgcagaggggaagagaagcctgagttggttggtgcattctgctgtaagccctgtcttgctgacttttggtgctgtgctagcattggtgccactcagcagtgaaagccgagcttctgttctctctggaccaacctggaaactgagcacggtaaggaagcaacacaatgtgcttctcagttccgctctagtacactggacagtttctaactgcgtgcactaagccaccgtgtgcatctaaagtttaaaatgtctcttgtgattttcattacagtatgttccagggaagtaaagagttgagggtggttgttgtggcccaggtttcctatctcattgaagaaggttctatcgagtgagaaacctaggcctatgccaggtagctgttagaaatcccagcccagcagctccttagtacaggtgttgtcaggatgagtgtggcagttctcatttccagccatgctggcttgaggtgaagcacacagctaggcagtccatccgagcgcc

SEQ ID NO: 28731 - DNA, 1121 bp, Mus musculus
gaagagagaactattatatttttattaggataagatattttaaatatgaaagtgtttcagatcttagaaaagttagccaacatttggaaatacttatacttgaacaaggacttcagcttatcatagttttagttaaaaatgtttgcttgaatgtgatacgtattaatgtccatacctaaaatctgtatttgtgttataggatttgctgtcacagatgcatcactatagtggtggtgttaaacaaagtgctcttcttggacttaaagaccttttgtctcaatacccatttataattgatgcacacctctcaaacatattaagtgaagtgactgctgtgtttacagatagagatgctaatgtacggttagcagcagttcaacttcttcaattcctggcccccaaaatacgaactgaacacatttctccattttttcctttggtaagtgcccatctctctagtgccatgactcacattactgaaggaattcaggaggactctttaaaagttctggacattctgctggagcattatccagctctcattactggccgtagcagtatattgcttaagaactttgtagaactcatttctcatcagcagctgtccaaaggactggtaaatagagacagatcccagtcttggatactttctgtaaatcctaatcggagagtcacttctcagcaatggaggctgaaagtcttagcaagactcagtaaattccttcaggccttggcagatggatccagtaggttgagagaaagtgaaggacttcaggaacaaaaagaaactccccatgccactagcaactccatttttatcaactggaaggatcatgccaacgaccagcaacagatccaggtttatgaaaatgggggttcacagccaaatgtcagttcacagttcaggctacggtaaggatttcagttacgtccacactcagttttcctatattgaatttttaactactgacaattaatggctaatggtggaaacacataatacttgtctttcataattttcatgtagttattaatggtgagttgattagatgactcccaatggcaagagtcatttgaaagtgttttcatttgtagcaaaagcctaattagtagtaaaattt

SEQ ID NO: 28732 - DNA, 1112 bp, Mus musculus
aggagtggaaggggttcaaagctagactcttgggagaacaatactgatgataatactgagatgaagatgaaaatgccctctggcatatttgacctgattcatgaaagaactatactgatgataatactgagatgaagggaagatgccaatgccctctgggatatttgacctgtcctcctaggcacacacactagtatttgttcccagttctttgtctatcacgtctctgcagcaacttcctccttgtcacctaccattgttccttccacctgttcacgtgaactggccttactcggtccttggtcacccaacttatttggcactgcctctgtcaccaattcctccattgccgttaggggcacctcattcagtatcttctactttgggttgcactaagacgaccggaggagtttgggggtttatttgtttgtttttgtttttatccaatgttgaatagcaaatccctggctggaaaggattgattgatgacttccatgtatgcacagcacagctcctttgtaaaactcaagtatggaatcctcccccatagggatcctgcccagtgggtccatgatttaggaatgtttcaagggggatgccaggacaatctttaaatgcatttccttcttggttccacttcaggaggcagagatgacatggtaggagagtacatttgagttgtcaacagtctctgcagtgtcaggtcaattacatcagcacttggtctagaccacaggaaaggaatgattgtgcctcctgggaatgtcacaaggacctgataattatatttggcaaagctatgaggagtggctctctaatgtcattgctaagaattacccttttagtagcatctctggatgcccaagcttttcagagggatggtacttcaagcttttcagagggatggtacttcatttctgtgccttccccccccccccccccgctgggcctctttccgggtggtcggtcctcttactcctccctgcccttggtagttatctgtattctcttgtcttccctccaaaccccatccccactcctaacctaccccccccagccccccttctgccctcacaatagctttcgttctcccatggtagaggtggaaggta

SEQ ID NO: 28733 - DNA, 1112 bp, Mus musculus
tttttgtacacgtgtgtgtgtgtgtgtgtgtgtttgtgtgtgtacacaggcaccttctgaggccataagagggtattggatcccctagagctgcaggctgcaagtacagagagttgtgagctgcctaatgtaggtgctgagaattagactctggtcctcctgacagagtggcaagcactcttaaccacagagatctttgttccagccatgtcccttccccttttaaagtctgtttgcatgtcagatgagtgcatgccatgacccacgtggaggtcagagagaggatagctttgggtgttagtcctcactgtccaccttgcttgagacagaggtttctctgtttttctttgtttgtttttctgctactgtatgtgctggctgcctggtctcgcagtctcctgacgttgctgctcatctcctcatggagcacggggattacagacctggtctaccatgctttgctttctgagggttctggggatttgaactcaggtcctcacacttgcttggtaagcactgtactcactgagccccacacccccagcctcctttctcctcttttaagacaaggtcttaccaatttagctgaacctagctttgaacctcctaccctccagcttcagcctctcgggtgctaggattattggcatgtgacatcattgtctgacttgccttgctttcttggggagagtatgtacatttcagcatattcttgaagtttcttacctaatttttccactggctttcctggccgttgtcaggagggcagagaagtgcagtgctgattttccatgggagtatgagctcagaagcctggagaggcttgctgtttgtaggcctttgacaaagactttatttatcctttgtgctgtgtgagggttctggtgtggcgtttttctctgttagacttgacttcccactctgccttgtactttgggcttttgtgtttgtttgtaaaatgagttttctgggataggaagatagctcagttggtgaggtacttgatgtcctcctgtgtggacctgggtttgatcccaacccttaggtgaaaatctgggtgggatggtgcaagtgtataaccctagccctggagagggagagacacacaggtt

SEQ ID NO: 28734 - DNA, 1147 bp, Mus musculus
agagagagagagagagagagagagagagagagagagagagagaagtaagaaaaaggagtaggaagaggaagagaaggaggtagaggaggaggaggagaagggagggagggagggagcatgggaacgaattgggaatgaggaatggtgtggggcttttgaaagcctgaccacagtggtgcatctccaacaagaccacacctcctaattcttcccaaacagttccaccaaatggggacaaaacattcaaaagtaggcgccttcggtggccattctcattcaaaccaccgcaagttggggggcttcctgtggtccttcattgttaggttaatagcagtctgaggtttggatctgttattcacttagagctacttgtgaggatttaatgtattgaacttgtgacaggcttgattagtcgtttgttaaatctaaataaacgcaccagctttagtttaagtcagtgttttcctaactgctaagtaaactgttgagatgaaatggcactttccgtgcagttagaggaatgaacgacaaaggttagctttgtttgaatgatagtccaatgatgcctttcaagcatgcacaccatttgaaacatttcaaagggttccctccgtccagaccttattttgattctgtcagcagtgttaggacgtattgttccaattttaaagactggaagctgcaatttaccaaaatcatagccctaaatcataggagtcattttatttagtcatttatttacttacgtatgcatgcatttatgcctttgaaactcacagtgtgaggaactgaaaagcacagagaggctttgcaggggaaggtctcttcctcacccatgttcccagtcactcagttgccttcaatcatcacgattcgttttgtttactcttccgggggtgttccgtacatgtccaagcagatacacagacacattcattttcttttataaaggcatcgcagcacaggctgcgtgttacttaacgtttttattgtaacatctgtattatacccagaagtgttttaacccacatgtgtaatttaggcaactactgtgtacctggctgtaaagtaaaaccttgccagcgttgtagtatcagcctcatcggggaatgaaagggcagtagtgttgccagcgaagcttgtagaa

SEQ ID NO: 28735 - DNA, 1145 bp, Mus musculus
ccaaagtttcagaatcccttaacttgctctatgccagtgccattgatctaccgtctcataggctccaggtaagagatcagcttcacccctccaaagacagttttaagtacaccatctctgtcacagggccaacttccttctggacctggcatttatagcttagcgaagatgtttttctttttcagattgtttttactgtggccgtagttcacagtggccgtgttctgcagctgtttttgtgtgctctctgtctcacttgtctgcctgcttgccgtgtttgtgcatggtggcttgccagggacctcacatctcgcttaccctctctgataagtctcccttctaaattgcccagcgggtgatggcagagcgaattcatttgtttctgagcctttgaaagggtttgtattttccatttttgttttcagtattcagtgagctggtttgtgttcttttaagatgcaggtgatgaaagggaagatgtttatatcggaagccacatgccttgccctgaaaacctcaatgggtactgcatccatgggaaatgtgaattcatctactctactcagaaggcctcttgtaggtaagttggcggctcatgagcagggctgagagactttttccattggtcattactgtcttatagactaaatagtaccacataaattgtgttgtctttaaaataaaccaacagatcatctatacatcgcccaaactctggcaagaaatatgcaaagataagaaacaggctgcataagggtttgaaggctgtgagcttaccatctttacgatggcattttaatattaatttgccatattccaacgctattttgatctttcgacaatctgtcacaaggtggttgaacgactgaagaatatattacgaatagagaagggataactcaaataaaacatacactaaaatagacttctaaaaataaaggagtgggaatgaggagccaggtgtgaattgtgagagggaagtgggaatcgtgtcagtcttcagctcctgtactccagagacattgcataactcgttcaaggtcagcagcaagttggaaatagagctgagaagaaagtagacctcagattccctgacacacaacctgaggatttcagtgcattttgcaggtgtgtgtgtgtgtgtg

SEQ ID NO: 28736 - DNA, 1836 bp, Mus musculus
gtgttgtgctattgctctccgtcagagaagcttccttgtcgccttggcgctgtgataatgctcaggaaaagtagtgaggtcagcatcttttcaccttcacagcgatcagtctcgggaactgaggacttaccgggccagagaggccgacgtccctctcagaaatgtgtatcagcagtgtgtgacccctcccaactccagctatagagcaaagaacaaccagtcattgtgccttgaattaagtctcttacttccttttctaacgggtgcagtgtgtgaactgtgcgttactttgacatagtttaaacatccttaactgattttgttttttaatatctgtattttcaatgcaacaggaaatgccccaagaacaatagagggcggaggcagaagcagaacctgggtcattttacttcagacacttcatccagaatggtctgagccgcggacttttatatgcgcactgaccacgtgatgtacatttattatgtctttttttaaagaatggaaatatttatttcagaggccttatttttggacatttttagtgtagtactgttggctcgtatttagaatatttagctacaacagtttttgactgtttagtagtctctgttttatgtttttaaatacagaaattggcttcacgaatttgtaacacatggtgatactactaagacttgttctttatccatggaatgtaatatttttgcagagacggatggacccacttcacggtggtcataaagtcatacttcttccccagtgaccacagcaaatgacaaagcatgaactaaagtaaagatgtttacagattacttttcttacaaaaaaaatctagaggacactgtgtttaaatagatatttaaatgcttttgaggtttagtatctgattttttttagacacttcccctattgcatgggctgccaagctgtgtgtatgtgttagatgtcacatatttataagctgtacaaactgcagttgactatttctctccttgaagaaataatcctaatcattttaaaaggggcctgggaattaacggtggaacaggtcactgaaaataggtttagatattgtcaagatagggcgtttaatgagcagattgcaataaaacctacagtatcagctaaactactttaatacacattcatttttaaacattgtatttgttttaatataaatgtacaaattatatcagtgtttgtgaatacaatgcagaaataattgttaatgattggtgctctgaaagtgagcttaaaaatgacctaagacctctaattcaaatctgtcctgtagtagctctattaatagatcgttggtgtttcaaagtctgaactgtgagtagaatgtatcgaggcgtttaacatgtagtttagccagtcaaaagtatgcatgtagagtttaaagactatgtttaaacttaaatattaattttaataatttgatttggaaaagcatgttataatataatgttttcactatacggtctgctttgtgtgctcatttattgtattatttgatattggtctgttagtactaataataggaacaattcataggacaagaagattgcagttcagaattctctttccttttacaaaccaccccctgaaatgatccaaagagaaaaacttagttcagtgtttgaagcaacttggcttgcaggctcagtatgagtaacatagtggctttagtgaacttcttctcacagtttccccctcccacccacacagacttatttgaggtccttagtcagtcggcaagcatgtttggaaccggccccggtgctttgcaagggctcatgttgcagggcagtcacgtatgggcacttgtgt

SEQ ID NO: 28737 - DNA, 1222 bp, Mus musculus
ttgaagtagctgtcctgaagtatacaactcagtgcttagatacagaaaaggacattccagtgctctcttggggcagtagaactgtaggtggaaagtagaaccaggcaggtaggtgactgctctttgtgtgtgtgtgtgtgtgtgtgtgtgtgtgtgtgtgtgtgtgtgtgtgcaatgcatatgcacatgtgtgtatgtccatccactgtacacatgtagagagatcaaagaagggcacctgttctctagctctattttaggtccttgagacaggatctgccactgtacttaaccagcaagcacacagcaatcctatctgaaccctctacagtgttgggattgcagacacgcatgaccatgcacagctcttcacacgggcactgaaagagtagtaaactcagtgctccaaggtatgctaatcataaaacagatagtgacattcctccacccacccacttcctgagtttaaggagtattcattcaaagaaagtcaccctgaccattaccagaacctgcaatgcaaatgtgctattgttaggggctcttagaaactgtcttcagagttaacaattaccaggtattctttgtgacacctgtgactttgtacttccttgcgactcttatctggtatttttggtattttccaacaactcccttcccacctccttgagttgtggttttttcctttaaatacccccttactcagctactcagggcgccacggtcctctacccctgtgtggtgtatgaccatgggcccgagagcgctcttgaattaaaatcctcttgcaatttgtagcaagaccgtttctcgtgggtgattttggggtgtcgcctctcctgagtcagaacgtgggggagtcgtcacgttgtgggtctttcagcaccaggaagatgagcttggcactcatgcttgtacagcaggcattcatacccactgagccatccccacactcccggctcctgccctttacataaaccctctgcttaggtttatttaggacatttttctgtacagttaagaaacttctgacaatgccaggcagtagtcgcacacctttaatcccagcacttgagaggtagaggcagatgggtctctgagttcaaggccagcctagtctaagagtgagttataggacagccaaggctatacagagaaacccccgtcttaaaagaaagaaagaaagaaagaaagaaagaaagaaagaaagaaagaaagaaag

SEQ ID NO: 28738 - DNA, 1354 bp, Mus musculus
cattaggatctgggcacttcatcaatggctgtgtcacccttcacgaggctgactgtctcagcagtaccaagctgttgctgagagcctgggggattctttgaaaagcctactgaccttcaattcatgctggccgcctgaagaagctggttctaatatggacgaaaagatgcagcaatggcaggaacaagatggatgtacttgtcagtcgagtgaaggcaagcaggtggaaggaaaatcagaccttccttctgcatgggttctgcccacatttactgtgcacttccctctcgagagacaatctgcttaagaaaatcccttagtggagcggccagctgcttgtcttttagttgactccagatcagtcagtgacaaccaagattaaccataacacaaaaatactaagtacctcgggcttcagataagaggccattgcaaagatgttttctttgcctgtcatacggttaaagtagtagtttcaataaaatgttcttattaaggctcaaagatatggggctattatatatacaaataagaaaatgtatagtgagaattttggtgtcttaaaaagaaacacagaaatactgtaggtgtggaatctggggctgcttcagacttgtccacagcagctgactaatttgccttgtgctctagcaggggcttgattcttccagctgcagatggtttctgtgattgtgtgaggttttgaattctgggggttcttcagaggataaatgttagggctctaagaggcgctgagttgttgattgtttgctgttggttgtgatttgttaagcactcgtgaacaaagaagaaacaacaagaagaaattagatgtcctgatgcttgccccaaggaacttgatgcccctaatgggcagaaagtctaatagtaacattatcccctttcccctctatccttttttctgtgctatctagttttagggggttgaaggagtagaagaagaggagtggagaagggcggaagaaaaagaacccacaaagtagccaaaagaccagctaccaaacaaaatgtattagatgtctgaaggaaacgtgaacatctggtgcacattatagaaagttccactgtgttttactccataagtaaaggtggaagaaagggcaacgtgttctgggttcatctcttgggactaacggagatttgttaaagggtaatgactttctttctgaatgaaattcacttttatgtatcactttattatttcttttaaaatgaatattagaaataaaaacaaaatgtctagcagttattaagttttaaagtgttattgctagagtctacatagatctgaatcacaaaattggttgttatataaaaatcatggtaggaagat

SEQ ID NO: 28739 - DNA, 1172 bp, Mus musculus
tcccacttcttacttaatcatttgctgtaagagttcttaatgtatgtatgcaaggccaagtagtgtttctcagttgccatccactttgtcttttgagacagggagcccactaatattaggctaggctggctagccagccagctatcctcagggatccacctgtctttatctttcctgtgctgaggtgacagcatttgctaccatacaaggctttcttagaagcaggttctattgatcaaacttagatgctcatgcttgtgtgacaagccctgagcacctgagcacctgagctgtgtccttagtctcggttaagattgttttttttattttctttatagaaaaataactaatgaactaatgtgaacttagtgaatttaatagctcgtctgtttttttgtggagactaatgattctgtttcctgaggtaggaggaattagacattcgaacactgcaatccaagaatcgtaagctagcagaaatgctagatcagcggcaggccattgaagatgagcttcgggaacacattgaaaagctggagcgacgccaggccactgatgatgcctcactgttgattgtgaaccggtactggagccaggtagctactttgtctcttcacccctattcagatcagccttctcatccttagagcgctcttagtttctcaacttttgcccttcatggttgtttactgcatgtttccttctgtagtttgatgaaaacatccgcatcatccttaaacgttatgatctggaccagggtttgggggacctactcacagaaaggaaagccttggttgtgccagaaccagaacctgactctgatagcaatcaggaacgcaaagatgaccgtgagagaggcaagtgtttgcaaggaagtctgtcactgccttagttacctgggttttaaggttgagctttgctctgaggctctccagttgagcgggacagtggattttgctatttctagctttaaaagaagattaagggctcctttttctctccctgtgttgttgggaggtattctgtaactgtattagttactagatttttgaagttgaactttgctttgaggctttccatttgagggaaaatttgctatttccagatttataatttgggggggctttttttctccccatgttctcaggggatgggcaagagccagctttctc

SEQ ID NO: 28740 - DNA, 1209 bp, Mus musculus
gattaacaaataataaggatacttgaactaaaaggaaaaacttcattaacattcttggggagttaaatcaaatggttgcttaggaaaaacataaccattttttgctaccagtcagaattattttctctgtggccattaataaagaacagctagttactggggtcttcatctgtgacttagaacaaatgtcctggtcaggtcaattccactcagctcttctagtggcttatatttgagttgaaacaatgtaaaacacatatcaaaatagttctgggtgacctggtttactcagggattgggttttactcagaagtggtagtctagacttcataattttctgagtaatggtttcaagtatgtggaacattggtgagttactctcccatggctctgacttgtgggacatacatgtttcactctgattctgacttgccttttcgttgggccttcctaaggtggaattgcggagtgcagtggaggaagtggttaaggaaaccccagagtatcgctgcatgcagtcacagttctctgtcctgtataacgagagtctgcagttgaaagcccacttggatgaagctcggaccctgcttcatggcacccggggtactcaccagcgccaggttgaactcattgaggtaacagcgaacttttctttgtttcactgcatatggatcttacatgtggggagatcaggcagatactgtgccattgtgtgtgattcaatggaacctggctggcactcttatcacaaagccaaccattccctctcctgcattgtcttctctatatgattgcctgactaatggattttgtggttttactttcatgtatagctaatatcccattcatccagtgggtatatgtataagacaacagacctcttcctgatgaggaagtgagtggaaagtgaaaagtttgtcgatagaagtaggcatgtgctccaacagtgacagccatcatgaagctgtgcatacggatcttacatgtggggagatcaggcagatactgtgccattgtgatattgaatgcacatttaggcaaattattttgaaggaataacttttactttggtatttatgttcacttttgtgttttctatactccttaaagtagtatttagggaagttagtttttatgtatgttggctaaataaattgatactagtttatgtttacatctggacagtttatggttagttctctaactgaa

SEQ ID NO: 28741 - DNA, 1169 bp, Mus musculus
agttttaagccagaagtcttgagtttggattttgtctctgccaaataattcaactttgagactcaaagaactcactgaaacactggttgtttaggtttatatatactccataattatttactaaatctaaactgccccactttcctgtaatttcagagttaacaatcaaattagtgaagaataggttactttgaatataggagctaaggatctcagtttagttattggttatacctttaacaataaatatgtcgttcttttgagtcttggctccaagattaccaaaaaaagaaacaatggtcgtgccaaaaaaggtccgcggtcatgtgtagccaattcgctgcacgaactgcgccccggtggtgcccaaggataaggccattaagaagttggccgggcgtggtggcacacgcctttaatcccagcacttgggaggcagaggcaggagaatttctgagttcaaggccagcctggtctacaaagtgagttctagaacagccagggctatacagagaaaccctgtctcagaaaaaaaagaaaagaaaaagaaaaaaagaagtttgccattcggaacattgtagaagccgctgctgtcagggacatatctgaagcaagcatcttcgatgcttatgtgcttccccagctctacgtcaagctgcattactgagtgagctgtgccattaatagtgaggtcaccaggaatagattccgtgaagcccagcaggacgggacatccccatcacgattcagacctgctggcgctgcacggcgacctccaccaaagcccatctaattaggtggttttgtaagggtggaaggaaaactaccgtcgaaaaataaagtggaagttctactttatgtggcaaacaaacaaacaaacaaaaaacaataaatatgtcaagacgaaatgcatcctgacttctccaggaagaatgacagccaacattcacaacattctgaattcacacttggatgcttatcttcagagtaaagctcattgtcattttaaaatggggcctctcagaaaatcctagaggtagttttgagaaatgtgaaacttgacagacttacaataataattctccagacaaagcagcataaaatttccttttcctttttatttttaaatttatttatttatattctttaatccttttttacagtccaga

SEQ ID NO: 28742 - DNA, 1154 bp, Mus musculus
ctccaagcttgccacaaaacctatgatccacaacctgatctgtgcagcctgcaagatacactggggcaataatagatgaatcttgttagagtgaccaaccaatgattagtctaatttgagacctgcatcatgggaggtagcccatgtctgatactgcctagatgagcaagatctataagctgaatagctggatgactaagagacctaggatggaatcaaacatgactcacaaagaggaataacatcaatgaaataaaacatttcttaataatattctgctatatttgtaaggccagggaatagtacaattatcagagatacttgctccagtagctgatgggagtataaatagtgacccacagccatacattaggcaaagcttagaaaccctgtagaagatagagaggagccagagggattgaagacacaggtcaaaaaatggcctacataacaaaactaaacaagggctgtagggtctcacagagactgaagtagcaaccgcagaacatacatgggtctgtggtaggccctctgtatatgtactgtttagctggaggtttgtattggactcttaacaatgagagtgaggatatctctaattcttttgcttgctcagaccactttttcctccttttgggtggcctagttcagcttgatgtgagggtttatgtcttgtcttaatgtactactaggatgtctgctcttttctgaaaggaaacagagatgcagtcaatcttgggaagaagggagtggagaagttggaaggagggcaggaagaagaccctgtagtcaagcaatattgtatgaaagaataataatttgtttaaagaggaacactggaggaaacctctcataatgattgggctagtaactgatatatgagtactgcagagtatgatttggaattatttcatttattttattttattttattttattttattttattttattttattttattttgttttagtctatcatgtatggttctctcatggtatctgggatgtccagaaactgatgagagtatatgtaatgacccatagccaaacattaggctgagcttatggaacactgaagaagaaggagaaagcattgtagaagccagcagaaatgaagataccacaataacatggtccacagcatcaactaac

SEQ ID NO: 28743 - DNA, 1150 bp, Mus musculus
gatgtaataaaatgtgagaagtagattcacccagctggatagacagaggagcgtgcccaggttggtagatgaatatgaaataagttctaattatctacccgtactattttatattccttttctctcttctgtaaaagaaggctaacaaacacaactcaaggtatcatagtggttcacagagtgagaaaagagacaaagcactgtgacctgatatcgcttcaatggttcaatatttttagaggggcctggacaatgtgataacgtgcatcattccattgaaataatattgaaacctttaaaatgttaaaaaaaaaaaagaaaactgatatctgtgccctaagtgactaggactatataaaatgcataccagcagaaaattctctcatatttctctcatattggattcaatatccattataagttgctatcacatacatttgatttttgacacatcttccaccttgttaaagagcaagcctcactttaagaaagtttgatgctttgagagattcatttctcactgttaaaatatatataattgatacttacctggcaggggagacaccatgatcacgaaggtggttttcccagggcgaggctcacccattgcactttggggtgtgctgacccctgcgatttccccaaatgcgggaaactcgactgcataatttgtggtagtgggggactgcgttcgcgctctcccctgacttaaaaatatatatatatatatatatatatatatatatatatatatatatatataattgaattccaaaaacaataagatgatgctgtgtttatcacccacagcagaggcaggggacttctcaggagtagtgggacaacacagaattgatgttacaccttttgttgttgttctgtaattttggtttgttaaaagttttactttttataatttgattaaagaaagaatatgaatttgcgtggatagagaaaaggagatctaagaggtgtgagggagaagaaatatggtccacatatatagtagaaaattaaaaataaattaaaaaataaacattatagttaactaaaaggatataagaaagcaacacaaactggaaaaaattccaagagttaatacttatctatctttaaataataattcttctattgaatcttactgtgagtt

SEQ ID NO: 28744 - DNA, 1159 bp, Mus musculus
ataacgacttctacctgtttggttgtgttttcctgtttttctttaaggacttataactctttagcagtgttctcctgtatttctttaagtgagttattaaagaccttcttaatgtcctctaccatcatcataagatatgcttttaaatctaggtctaggttttcgggtgtgttggggtgcccaggactaggttgggtaggagtgctgagttttgatgatggtgaatggtcttgatttctgttagtaggattcttatgtttgcttttcgccatctggtattctctggagctagttgttatagttgtctctggttagagcttgttcctcaggtgattatgttagcctctatcagcagacctgggagactagctctatccttagtttcagtgttcagagtactctctgcaggcaagctctcctcttgcagggaaggtgcccagatatctggtgtttgaacctgcttcctggcagaagttgtgttccactcaccggaggacttaggatcccgtggtggatcctgtgtgggtcctggcgggtgtccagagaatacccgggccagggaccccggtgctgcatttggccagaagggacttgagccccggatcaggtagggttatctgtttccttaattaatgcagtctcaggtcccgtacgattttattgtagcaggtgctgtgttccactcaccagaggtcttaggatcccatggcggatcctgtgtgggtccttgagggtgtccagagactccccaggccaggtaccccggtgctgcagtgggccggaagggactagagccccggatcaggctgggttatctctaactattttgataagtacaagaaaactaaaatcaatcaatcaatcaatcaatcaatcaaacaataaataaactacttggattctagtaggaggactttataaaaactagcttgctcaacctacaaatcattatacagaaataaatatttcatgtaactttcttattgttgattttggctctactccctggcttggtagtatagataacctataattttgatttttgttgtttactatacttgtctcagtttctcttctttcctttgatcataactgtctcatttataaaacatttttatttatattttgttacaagtttgtgtaatgaaattgctaactg

SEQ ID NO: 28745 - DNA, 1101 bp, Mus musculus
tactgctgtagatgaattcttacctgtgaggtagcatatctgcctagacagaaatggtgttctgttccatagcagccaaaatgacaatgtaaataataggttctgcagtggaacaaaggccactgatacccaaatgtcccaaagggtcccgctcagaacagaagcactagatcactgcagttattctacaatctgatgtcatcatcttaattttctccctaagaaagccctgaaaagtgaattcatttctatttgccccgtgttttgacaggagtaataatgtccgtgtctagtgccttagtctctttttctattgctcttcatggaatatcttgaaagcaacctgaaggagaaagttatcaaaggaaagttagagcagcaagaggttgaattggctactcacattgcactcagccatgaagcaaatagtgatgaatgcttgtgctcacctcactttctggttcagagggtagcccagggaatggtaccaccctcggtgggtgggcattcccacctcagtaacctagtcaagatcctctcacactgggacagatggccgtagactgtcttccaggtgactaattctcatcaggctgataatgagatgaaaactcaagcagccggttgggtctctaatatccctttatcataccgattccttaactgggttgcataaatcttcttagcctttcctatctttcttctagattgtctggtcacagtacagtcctgtactgtgtattacttccctcccagatggctcagggcctgacaacctacatgtttctcccaaatctgaccttaggctgcactcctatgtgtatacccccaagcccctgtcactaacatctgcagagtgtgaccatggtccagtgtactgtctttctccctacattgtcaggccatgtatctctgtccataaattgagacattgtttatcaggggctaaggccactttgcctttttcaggaaaccaaactggatccctagttttgtaaagcattctcattcactgcactggtcaccagactggctgtatcaatatcactgagcaagttaggggaatcagatctctatcttacatataggtggtaattatgt

SEQ ID NO: 28746 - DNA, 1121 bp, Mus musculus
catgtgaggggcgtaccctgctactgagctactgctactgctttgttagggcagacataaccaaacttatgtgttagagagattagaacaccaaagttgtttccattaaatggaaaattttcagaaagagactggagagatggatcagtggttaagagcacacattgcttgctctttcagaggacccaagttcagtttttatcacccacatcaggtggcttacctttaagttcaactcttggggatccagcaccctcttgtggcctcctcaagaactgcactcatgtgcatttaccgccacacagggacacctcacctgcatgcacataattaaaggtaaacaataagtctgtgttaatttattgaaatattttaattgcaattcagaaaatagctggcattttctaactattataattcatttgtttggagctcttaactagggtagtatactattcatctaacattaatgtttggtaacctctctaattttagggacccagagaagaactggaatcgaaattctgtgaaaggacttgtagcttctctgataaatgtgaaagataattctacagccacagctctggaagtggtggctggggaacgactctacaatgttgtagtagacacagaggtaaatggatgttaattaaagaaaatttaaaattaatattctgcctaaaaaatcatataatggtagaaaaattctgtgcttttgtagtcctctgagccacttaagctttttagttaattttttgacagatttaattttcatttatttttctgttctgctgtcaaatttatatttatttaaatttgtaaactaatctcacaatttttttattacagtaacattggatttatttacatttcttcagatttcactgttcttgttcatgtaaattaacctcatcacaaacattttgtgatgtatcttttagttttctgtgtgttcttcgcatgtacacacaccatgcagaaagcagaagaaggcatcctacgtatacatggtctttccagatacagctcccttttctgattgcagccttgcgccccttacctccttctctgcactttctccctcctcacaaacctcaccttctagtctctacatcagcttc

SEQ ID NO: 28747 - DNA, 1830 bp, Mus musculus
agaggaaaagaacccaactgagtgcatgccagttcagagtacagacttctcaccttgacgtttttacacatgaacttccaagaatttgggatccaagttgtttatataataatgttaacattattttcatatgtaattctttttagcacttttaaaattgcagattcctcttttcttacctagtgtgattatggtccaattattgtagttgtgattgcatgtatatcatcaatttttttcttacaaaaatcttttgtatgtattaaagaacctgaggtacatatagttggtaaattgtgtatgcaaatgcccaaaatacaaagaaacagatgaagttataggataaatatagctgacagtcagcttttaactagtttaatttctaagtacagtattaatgacttttcttttgcttataaaatcattcagatacagaatagttgtaaagaaagtcactggaccattaaagggaacacatagcaattatgcatacaccgagctacttgaggtcagtcctgtggagacagcatgccagatccttggctgggaaatggatctggagagactttcacgttagtgaggttggactatcatgtttatgtatgtttaataattgatctccacaagcttgaaatttgagtgttttttagctttgagtattttagtaggagcttgggaagaaatgtgttattacacagtattacacttggattattctatctacagtcctgtaatattttgtaagatttctatcagacttctcataatctaatcaataattttttggtgaatgtaggacctagcagattaaatgaaaagtatattttataagagtctggtaaaggtaactaagtctgtcttctctaccaaaaaaacctccaaagcttcatgattgatgaaattcttggtgccttctgcttgtctgggtcaaaggtaaaactcctttagaaagcaggaggggcccagtacacaccctgagatcctgcagctcttactgtctctacgtacatttccacatcagcacctcatgcccgtaatcctcagagcgctaatgtgatctgattggattggacagatggggcccatgtttcgtcctgatacttaacccttagttccttgatgttctactttctttgttgtgtcatacaggccctgagttggacatttctcaaacttatatatgtggtgttatatagaccttaagtcatttgtaccctggaacattttggaaattatttcatctggagggaagtggcagtaggctgaaaatactgactgatgcatagtagaaatctcagataatggacctacacaatgttttgttttccaaggggttataaactattggtcaaaatagttgtgtttatttaccctgtctctaatagtggtattctaatttgatcacaatctagtcaatgccagctgttaatattttgtattaggcaattataaaatagcgttgaattgctgtcttaagcttataagtgactattttgtgtgatttcctttgtctataaattatttccttgtatgcctttctgttttgttttcttttgtttttgtattttatatatagtttcactcatatttttgtgcatatattaaatttctgtgagacatgctaaatttttgtagtactacagtttttatttcaatatagaaaagttgttaaatagtgacttttcatatattcataagaaggtgggttaactaacattaataacttaagccaaacatttcttttgtttgtttgtttgtttgtttggttttggtttgggttttttttttttttggttttgggtttttttcaagacaaggtttctctgtgta

SEQ ID NO: 28748 - DNA, 1151 bp, Mus musculus
taagatttcagatctatttcaaattatgtttatataatgttatgtaattcattgcttgaaaggaaaaatgacaagtttgatactaatgtcaacataggtttctaaaatgataaggaaagtgtgtttccagtagttattggcataccattcattttagatatcaaagataccgaaatcaaagaagcatgtctttatttttcaaaaacaaacttccgttggctttctcagtccattatcaccatgtacagcccttagaaaaatccttgttttaattactcagatttttgaggccacaaaacaacaacaaaagtaaggcaccatttttgaaaacaaaatcaattgagtgtagatttaaaatcttttctgaagctagagacaatctgtagctattatgttaccttttacactatctgaagagcaatcttcaactttcctgtttaaacgtaattattttagaaagttaaaaatcaatcctatcttcaaataagaatttcttagattccctatggagatgtgcattgtgagttgagaaattctcaagtgcaaacacttctggtttactttaaaaaaaaatagtggaaaacttactaactgtgaatatgagaaagacaaaagaaagtgagtcctctcgctagatatacctagcataattcattatgaaacaaacaaacctcaaactactgtattttggtgtctgtaccgcaagcatatgcctcatgactataaatgttacatacatcatttgctctctgtatagtaggcattgacttaaagggattgtttgttgtcttctcatggttgtatatatcaggtaaaattgttccaaagagccatgtgttatgtaatggggaaccactttgatactgaattactaatttgtactttcattactatttgctggtaatagtgtaacgccacagtaatactgttctgattcaaaactgttgcatccctttttgtagaacatttatatttccataaggattcggtatgttcttttccctcctgccctaggatgaagctggttttgtgctttttctttatcattggccctcattccaagcactttatgctgtctgtaatggatctatttttgcactggaatatctgagatttgcaaaactagacaaaagtttcagagcagatttcta

SEQ ID NO: 28749 - DNA, 2124 bp, Mus musculus
ttctcgagagctctccctttcatgggggatttctccttcaagtacttactcaattctgtgttctcctaatctcaacacaaggaaaaatgccaccataaataaaatgcagctacaacaacaaaagattcagtgcagaggccttcatgaccgtctgtcttccttttgccaggtatttgtgaactttgccaaggaccaaagtgatgatgaccacttaaaggacctgtcactgcacaaaaaccagacagttgtggatgtggccgttctcacatcctttttgcaggatgagaaagtgaaagaaagttatgtatgaagaatcccgttcacacagggtgaatgaaaggaaggaagagcgaggtcttcctttgcactgtgtcaagtgttctagaagaaagcgtcctgcgtttctgtggagaagaacaaactggatactgtactgacactattcaatgcaatgcacttcaatgcaacgagaacacaattccattacaggggcagtgcctttgtagcctatgtcttgtatggctctctagtgaaaatgacttgaagttagttcattaccttatacagatgtgaaactctggtgtggaaccaagcagactctgggtttggattcatactttttttgttcctgtgtattctcactaggattgcaacaacagtctatcaaatagtcatggccagtgataatcaaagtcaaaggcacacacatcctcgtccattaagccattaagccatgctgaaccacaaaacaggtttcccggtgacacatccattgctggcaatgagtgtgccagagttactagtgccaagttgctcagaaagtctgaagcactgagtgtgtcacaaacacttttgtgaaaaccgccctactgtcggttgacatcattaaatatcaggtgacaaaaacggtgccacatgtgactaaatccccattttccttctctctttgatgagctgctgttgtggctgtcttgtacaaaatgtgcatctctctaacccaggtacttggttctcttgttcagtgttgcccatgcccctgtcatggcttgccatagcatctttctgagactttttcaaatacattagatcctcctaagcagcaaagattagcagccaaactgctggggctgcaagcggctcagttcagggtgtggcatgaaagatccagtgcatttacacgtggcaggtctgggttggtttgtgctgactgtctcctaacacaagatgggtacactacaccttgagatccttcattatttaacagaaatctagttctttctaactgtttgaattaacctagaaaatgaaagggtggcatttcattttgacaaaaatgtttgcattgttagtattatttggaattttaagttttatcaatgcttctggaagcttagaactgtacacgtgtgatgtcagtcacatagaggaatgtgcccggactgcctcatgcctttattttccttggtaaatttgaagatagaatgtctgactagcgcagtgaccagaaaacaatgtggtagtcaacatctcaggccatattttaagatcctgtagagcactattcatttcaggttgcagatggagtatttttgaaacatcattactatgtagatgcttggataggagtgagggggagctagcagatttcctgtgccatttattcagctgattgatgtacagatgtaggtttattttgtaaaatccactgaaagaatatggccacacccttgcctacttgatagcatcaatacagaagccaagaaggaccactaagtaaccccctcttcccagggagagcagctagcttgaaatctctcggatacaatcgatgcgtctgacctttgggatcctcaccatatgggcaaacaatgggctttgcaggatgagagacacccacttaaacctctgacgatctcgaatggttcatctcttccgtcattaaccagtcatggaaaacaatcaacaaactctgccacgtgaaatattttttcagacttttctaacccaagcttaatttgttttcatctgcaagcaacgtggaaaaaaatagttatttcaccagtgctcaatgtcatccgtcttcatacaaaacaaaaatatgagtaagttcctgtattgggcaaa

SEQ ID NO: 28750 - DNA, 1205 bp, Mus musculus
tttaaatcagttgaatttggggtgtatctatcacagacatcatgacattagccttggaataatttgcattaagagcagtgaccatggttaattactcagaaccaattaccaaggccattctcaggccacaacattaaagacatttcttcagcacccaggaggacacttaccctcttgttccaggaggtaagtcatctatttttatctccagtttcgcatcattaggatacaggactatttctatcaaccctgagttcatggagggtattaaaatgaaggttttgtagaaacatcaatactggagtgtctatattgagttcgtgctacttgaagtcacaggccaatggaagggcaataaaagctacagtcttattctgcttcctacatttctgcacaagataattcttcacagtgatcaatgatgttaacacttctgggatttcctttcctcttacgagttgtgacattctggtctccctggataatgagaccaaagatagttgcattcagaatcatgagaattttaccaatgatgaaacacagtgttgtatgtgcttatagttccagatactaatgaggtggaagttggggcctcatttgagtgaagttaaaaaagaaaaaaagaaaactttgtgatggcctctggtattgtgtgattacaagtaacctctaagattcagctctgaatctggacacacacacacacacacacacacacacacacacacacacacacacacacacacagagatttgtacatttgagcttcacctccaggtcaaagccactcatgttcaaggatttcctttgactgtttcactgtcttgtgggatattggcatcttataaaatgttttctaatacctactcaacagtcagcaagcattgcaaaagtattcatgtgcacaaagaaaggtgtccccaacatcctggcatcaagacacacttaaatatgcagtagctgagggcagtagctgagggcacagttgaatgctagtgtatggttgcatatccaagggcatgggatcagtcataaccaaaataagaaagaaatacaaaaatagataaaatgggtcctctcatacaatgagcaacaatcaataaagtaaatattaaaatccatatgttatatttcaggatggaataaagaatttcagtgttttagtcacttttctgttgctataataaagtacactgagaagagca

SEQ ID NO: 28751 - DNA, 1183 bp, Mus musculus
ttcagaggacccacactgggtgtctcacaacccctctaactctggctccaagggatctaaggctgtcttctagctttcacaggtacctgcgtgaacctggtacacacacataggaaaataaatatttttttaaagaatgaaattttaatgtgtttgaatttgtaatgactacggacctttttatattctatctcattctctacgctatctatctatctgtctgtctgtctatctatctatctatctatctatctatctatctatctatctatcatctatctttctatccacctacctacctatcagatatcagagtaccctatagtaagcagaagatggcatcagttcaaattgtttctatgagggattcaaatgtttctgctaccatactatgtagggaagcctagaataactccatatgtgcagactcaggcactggaaacaatagggttgatgggaaaagagagttagggtaggacactaaaccaagaaagcttaaagaaagtccagtaattgctaaaagtacgaatgaataaacagctgtctagagttatgcctgttgtttatctaggctcacactggggaaggtctgtgtcatctcatgttatggaatcctgtgtcctttgagaaggaagtcttgcttctgatacatcatttcataagaggcaaagggctggtctagtgtacagcctgattagttcagacagagaggaaggcctgggcatctccttctgcatctgcagcccacattgaaaagaagtcagtgttctgaagccactgagttggtcaccacataagctccgggaagtcatttctgtagatctccagccatcctcccacccaaggttgtcttctgttgccaatgctttctctttaataatagtgaaaaaaacttacctctgcttgaacacatcagcatgctgggaaaaatctcctgggagccagtgtgaccttaggacataatgctgactgatgccagttgggtatgaggccggaaacactgtagagtcgactgtactgctgccctcgttgtttcttaggtctgacctgcagctaggatcagcttctttgcgattcttgttcaaatagatactcagggattgcagatatggttcagttgtaacatactggtctagcaaacatgcagacctggggttttattcctaatactgcacgtgaagat

SEQ ID NO: 28752 - DNA, 1230 bp, Mus musculus
ctttgacagtgaggacttagtttacgttagacatttatactgagattattatcaccattaacattgttctagaagattaattagtgcagtaagccataaagccaaaaacaagaagaatgactgtaagcggtgagttaggaaacaaaatcaactacatttattaataagttctgtggaacacagtagtctgcatgtgtagttaagtaagaagttgtttattaaaggagtcattgtgaatcaacaaaccatttattagttattagatttagttaaaagctttggataacttaaaatgtgaatcacagtaaatcctaagaaatagatagcaggtagagacaatttcaaatagtcaagggacttaaaagcagcgagggaaagaaaatctgaagtcagcctgacttgactatgcagaactttatttttacataacaaatgggatggtaaagtgagtcactgcatgtgatcctgttgggatttgtccaaaggaattaaaaaaccagaacagtcagatgtggtggctcacacctgttactccagcactcaggttgtggaggcaggatttattttttttttttataggttttctctgtgtagccctggctgtcctggaactagctctgtacaccaggctggccttgaactcagagatctgtctatttctgcattgtgtgccaccactgcctggctggtttgtttgtttgtttgttttcctttccctttgagtttacctttcattgtaggaactaggcttcaattggatttctgtagaatttatttgcaagctgggtgtgatactgctagaagccctgtagttgtttgatggctgttccagggaattattactttggtagttgcttttaagggactaatggagataggtcttaaaacagaacagggcttgtaatggacacagagaggcctgagtgtaccctggggggtggggtggtggggtggggtggggctggcttcctgaatagggtataaactagtcagtaccaggtctgagacttactagttttggtgacagtcaaaaatggcttcttaggggtggggcatgttaatgactagttatggagattgatagctgcttgtttttttgttgttttgttttgattttttcgagacagagttttctctgtttagccctggctgtcctggaactcactctgtagaccaggctggcctcaaactcagaaatccgcctgcctctgcctcctgagtgctgggatt

SEQ ID NO: 28753 - DNA, 1172 bp, Mus musculus
tggtcctaagtgggacggagactcccttcagcccctggacagcttccccatagtgtactcccagttcaaaactgctagaggcctctctaatcaatgagtgttctttttatccaacagttccttctgccctgtgtgccttttgagataattttcacttgggatgtttatattgtcatttgctaataacacttttctcattgtcaaaatataattaacatcttgggaaacaattctccatattgctgaataatatattaagaaatagaatatcattcctcttacttgttcatttgttatttttgcttgtatttaagacttaccttttaacaatgcatgtggtattgaaaatgtaagtgagacacactctacttagacatgtgttagacagtgacaatctcactgactagcctgtagttaaaggagggaatcatctcaagtttgtttttttgagcatccatgagactaatactaacaataatggcactaaaactattggctccaaagatatttgttagccgtgcttctttaactagagttctctatgctagcttctagaggaacggggtggagattgtgagtagccaatggttattctgccacaggtccgaccttaggagcttcagtcaacaaaggagatgaaatacaaaggagcacttcccttgctttgaggtggtagcatatagctctcccaacattgctcagactgataggcatgctgtgcaattgaaagagtcttgtcctgactgacagtttgactggtaattagtgggcagagggaaggtcttcatagactgaggaagttccattagagttgtgcaccattgtgcggtttgggttttcaccacttacagactcgatgctctcctctcttcccctcctcaggtcattctcttcctgatcatgctggttatgcgcaagcgtgtggctctcaccatcgccttgttccacgtggctggcaaggtcttcatacacttgcctctgttagtcttccagcccttctggacgttttttgctctcgtcttattttgggcatactggataatgacacttctcttccttggcactactggtaagaaatgcagtttcttcccccgttcatgaatctaatttgtacccgtacattttaagtcatcaaagaggttaggggtgtagctcagtatagaatgcttgca

SEQ ID NO: 28754 - DNA, 3038 bp, Mus musculus
ctgcttgctgtacaaggctaaggtctctctgggctgtgggctgtagtagtatgttgtgtgtgtctcactggtggccctgaagtatggcctgcagtatcccagcatcataggctcaagaggggagtctcaacctatttttgccctgttgctgttgtgaccgtgtgtatatactaatagcatcattcatatctcctttcaatggtaattttctaagattatactctgtatggctttgttttctaggcttcgggagcaagttctgcttgaacatagccgacggttatggacccccattgacattccaaaacaatatatacacataactatgtatttgtgtgtgtgggtgtgtgtatatatgtatatgtatgtgtgtatatatatgtatatgtatatacacacacacacataatcagccaaaatcagagaaaaaggaacagggatttaataccttttttatgcttatttttgtcaaacatgtacgcctttcatacgggtggcttttacaaggcaacttccgtcatttaatgttttcaattgtaattgtcttaatggaaatgttagattcatatctgattaacgtttttaataactagaggaaattttaactttagttacttaacctagataaaattatcgtaccaaattcttgtgtaagtttttgcaggggtgatttccctggtgtctgtttaaaatcagtgtcttattttactgatgcataagtcctagtgtgtcagactaggcatgtgcgttcagataaataagagatttctccagtctgttttctccaatcaaagaagccatgccattttactttgagaagcatctgagtgggcccgttacgggaaatttcataatagctcatgcatttgtcagccgacattcaaaagtaaccaactcctcaggtatttgtagtttaccctaatgcttctatagaaggaagtaggaacaatagagagaaaggggtagataatctttattatgcaaagttttttcttgtattttgtctctttcctcttcacttttttttttttctttttttttagtagcatccaccacacattcgtgtgcctgatctgaaaggaagctggggcacccagcaagtttagcctttctgggtattgatttccagcttaggtaattctagaaagaattaaagagagagaaacaagaagcatgaagctgagagtttcagcgctctgcttctgtttccaaggcaagtcgggagcttagggttaaacgaccatctattcaaatgcttgctataaatctgaacacacgggcaggtgccccactccttggtattcgttgtatccggagttctacaatgtgtaactgaagaatcagttggtgttaaccctcgagtgtgagtgtgctttatgtttgggggtacgtttgggatttcttgttttgctgggttgttggctttttttttttattcctaaagcttaccagatatgaatggctaatattccattgttctgcttattgtaatggtgaatgctttaagaaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtaaaataataataataataatgaaaaagcctcagcatttatcattccatagaaggaaaatcttttgaaagaaagcattgcctatcagaagtagatcgtgaattagactggtgttatgggattgcatacaatgttctgagggctcaacgagcagctatttgctaatgtgcttcctttcaaagggttggacctttaaattgctgcaaaaggtaaattgtattttcttttttaagtactggtgttctttaatctagctaggctaaattttgctaaatgccttggtttcttttcaaagctcatgaatatttctgagccttcagagtttttgcaataagagtctggattaaaaacaacagcaaaccacacacacaaacacacacacacacacaagagtgcatgtgtaagcaggatctgggaagccagcattgagagagtatagctattgtgaaataatgattcaccagaaattaacatctaacatctagtgttgccaaatagtgtcactgtacttctctatcatttgaaatggaatttaattatgtaactaacaactgtcctactaggtgagagaggaagattatgtgagaaagtcagtataccatgtaacttgtagccacacagattttcgacattgagaaacattgggaactaaattgagaatgggccagagcctggaagatgggtctcacaccagaagacattccaggagctagccatttaggagatgtcccttcaaagtgacgtgatgatggacttgcacttgggaatcaggttctgctcacttggacatccctgcatcatggactcttgctgcccctgttccatgtgctcgcaattccagctactggaagccaccaggaatgctttctaattatcatttgcaactagaactgtaatcagaaagaaaatttgtatttttgtataacttgattgtgtgccattttatataacaggtcctgttttacaaataaattttgttttactaactttgtgtttagaaattatgctctatgtgtgtaaccatgtcatttgagttcaattaatttccaggctgtttcccctaagtaagtttgtgtgccatatagtcatatgcaaatatgcctatctactacacgggtgcacacagagagatatttgatgtatggaatatcactctgccttgagctccattctttgattaatttgagaaagcctggcagaggcgttttagtgacccgtaagtgtttcctgcttgggtgttcctgctgcctctcccgttcatttgcaagtccttgtcctggctatgggctgcctccctgccatctgctcaccccctcaccgcttccatcctctgcccaagtgagaagaatagaccaagaacaaaggtgatctgtgaaa

SEQ ID NO: 28755 - DNA, 1189 bp, Mus musculus
gctcattctcttgatgtgtttactttccagctcaggaaaaggtgacctgtctctgcagattggaagaatggactctaaggaggctgtttgcacaaggctctccactcaccagctgttgagtctgtgcggaagacaggatcttattacttcaatggcagcagcgatcaagaaagttctccaaccttgaacagccaaatggattgactacagtgggggcagctaattaatgattaatcagaagcatttgataataatctgccttgcagccacgccttcaaacttcattgttgctttctcttctggccttgtaatgtttgagtcaagccctgcttctcagctagtgagcatcagcccaaagtcagaactcacaggggattctctgcattcatcccgggtctgtcctctctgactctgctacatacagggtccatgtgggctgataactagtaccaggggcctgctgcatgctacgcattgggatgggtgcccgacataatactgaatcctcaagaagccttgtcaagtttgtaggtatcattgacgttttgacgatgaggaaaggagatgctcagagagagagagatcatgtgttgtgagtcagatcacacagtcgataggatcagtatttcaattccagagcccctccactctaacgctatgctttgcttattattgctacagagataactgccctgtagtatcccaatggatatcactcccagtctcaaattgggctgggtatggcggtgtatatgcatgggaagcgtcttggggagggtggtagaagcacaaaagaatcacagaattattttctaagcaaaataacacttgtttgtttatggcccatggatcatagcttcctgtccccacctatttttgtaaataaagttttatgggaacacaaccacatccattatgcgttgtccgtgactcctttctttctgtaatggcacaatgacataattttatcaaagaccctataatccccagtgcctcaaatattgatgctgtggcccttgcaggaaagtctggggccctggcctagatgagtttggaaggaagctcacagttttcatcaggacgaatttattacattttccctcgactgaaaacggaaaacttggtaatacctgtataatcactgttctgatcatgatggtatgtgggtagacaaagtagtgatgggcag

SEQ ID NO: 28756 - DNA, 1899 bp, Mus musculus
ggttattaacggaaaagtcttttattacaaagtcaattaaaacttttcattcaaggtttttgagccaaactagaagttgagattgtaaaactgctttaagaactttaaagaaatgaatatttgatctctgattaatttttgagacttctaaatctcttcttgttttaagtttcttggacttctgacaaacttccctggagaagtgttcatttttgttttcttcatgtagcttgtagatcataataagtatttgctcttaaaatttactacttagtagcatgattatttttgttctgttgatgaagcaaatttgacagaatattatttctccatatcacacatatctacactattatctgataacacactggtagtttttaagactaaggcagtttatagaatgaagtatatcaatattcttttggtttcccaaagcaatattttacttttcatttattatagtttgaaagacatttttcattgttccattacctatagaaatggtatttcatgacctagggaaaaaggaattactcctttttgtagactcatacctgaaagcagtgatttactagaattgctttgtgtggctactaagtttattttgtcaaaaatgacaaggaaaaagccagctgttttcatagaccttttcattatgatactgtatcttgcatagttgaatcttctcatttatacagtgcctttttctcatgctcattgtctactgactttaaggcaggcaacactggaccatagtggtgcaggccttctattgaggccagaggagcaagtgtgcttcttccttgtccttgtcccatcattgagaccttcatctacagtttccaaacagtcattggaaaacgcacgacagttacccagaaggttttatttctcagcagatttgtagaatgaagtataacgtcagtgaatgagagtccaagttcttatcacacgatattaggtactaattataccctcattgctttaaaatacacatcagggtctcttttaaaaatagaacaaatctgtagtatttaagtttaaaaatcttaagtttattatgttaaattgaattttgtcaacccttctttttaaattaaaataattgaatagagtgcctagttaaattttctcaaagcaaggtaactgctcagctcagtcagctgtggcaagctggccagccctcttcactccagcgttcttcactgctctatgtctgcttacacagcttggacatggctgctttccatgaaggaaatataggggaggtggactgtaagggatatataaccagtgtgaagaactgcttcataaaatatgtattaagtattgtatttccctcttagcagttgaatccaaaccagtttcatttagctggaagtagacaggaaggagctgccttaagcactttagaaaaagaatttgctacaattcatttgactcagctgattgtgtcacatcttttaaatactggtaaatatggatataccaagtatttaatgactaatgcacatagaaattaatattaatacagtgatcttttgaatgttccaggtataggctttttaaaaagtgttaagagtgtctgtctgtctgtctgtctgtctgtctgtctgtacgtttaattgatagcacctctgccgtgtgtcatcaactactagacagccaggctaagccttctcattctgttctgaagattctaaaaaaattcgaaccatcaacaatagtatgtataatttgaacttccatgattgatccttgatataaataataaaagaaaatatttatgatgaaatattttaattaggtcaattatctagaattacctagttttgtctatatatcttttccatgaaattatagctatctatgtatttgtagttgtttctttcaaaaaca

SEQ ID NO: 28757 - DNA, 1161 bp, Mus musculus
ctactaaaatctacatataggataatcttaataagatttaaatcttaatggttttgaaaagcatccattgtcttacagtttgctgggctgggtttcctgatgtttgcgttgtggtgcgggttctgttaaagcatttttaaagccataggagataacaattgcaagtttgcttttctgttcctgctcctaacatccacttcatggacatcagtgagagaacgctaaatgagcattctcatcccatggggagaagtttgcattaatttttagagtccttagggacagtctccattctccacagctttcttttgctactttagtctttccgtgctaccttctgttcactactctcattaaaaatgttctagcaaaaaggcaaggataaaaacatggcctaattaatggtataacagctgctttcatcttgtcactaatatttggttttaaataatcatgcttgatccttgtcttatgctaggatggctggtttcggatagctgagaatatggggtttcaatgcctaaagactgaaagcaaggatcctcggctagatggaatagactcactttctgggactgaaatccctctgcactacgtctgtaagctgaccactcatgccatccacttggtagtctttcatgagaggagtggcaactacctctggcatggtcacctacgactcaaaggacacatggataggaagtttgttccttttcgaaagttacagtttggtcgttatcctggagcctttgacaggtaaatctataacaataaacagtaataagtcaataatatgatatgtttatatttatatatacatgtatgtatagatacacacattgaagtattataactcagggaaatccactgtgattctgcagtagtgtggatgggtcccacagtggtgagtgtctcaaggcaaaaaagactgacaggatagaggtatactgtgttcgtggatgtcttagtcagggtttctattcctgcacaaacatcatgaccaagaaacaatttggggaggaaagggtttattcagcttacaattccacattgctgtttatcaccaaggaagtcaggactggaactcaagcaggtcaggaagcaggagctgatgcagaggccatggagggatgttctttactggcttgcttcccctggctt

SEQ ID NO: 28758 - DNA, 1282 bp, Mus musculus
atgacaagcagcagtctgttaggatgcagcctctctgtaggaatattgtctctccatatgcatctcatcagattgctgtaattattagcaaacttgtacccaaataacagatcataatcagttctttcctagaaaataagtccatagaatatgtatccaagttttagatagccaaccctatatatttttatgcacctagaaacaaaacaaaacaaaacaaaaatcaaaaacaaaacaaacccagtaacaacaaccagataacagtgtccttgaggacaaagccaccctatctggagagggtcatttgcttgtactcaatatcaaggagtaggcgtgtttacatcacgttccttgagagctcccaccttctgccaggagatcttacccacccctgctccaggttcttctctcacgtctatcattggagggcaaggtctgctagtgtccagaatacaaactctcttggtcctgtgcagaggttctgcagtcttccctccatagacgatgggcaaacttgtcttcaccctggtttagctttagcttttaggttctgccccaccttggagaaagtttcccagaatttgcaggtgaggtttacgtctgaaaatacctccatgattcagtcatactgaagccagtgctcttgaccttggagctctgatgagtggcccaagaccttgggtcgggggtgcccagcacctgactgaccctttgcagatcagttttcttccctccctgagtacgctaactttattctcctaacgcgactactgtctgctgccatttgcctggcttgcttgaagataccttttatattaacttgttctcacgtcaccgaggatagtcccagggagaccctgagaagcagacacgttgtcagtttctgacagccagctacttccctaagcatggacaacttgcctcgccttctcttggctacagttaccgaccttggccactgaggtaaaataatagtaactgaaaccgggcatccctaagagtagctgggatcaggtctttgtggagcctccatggcacctcagtgcgtgatgagttttccagcgtctcagtggcgtgtggggacaaaattgctgagcagagatattccttcttctccagaatcctcaggctaccttcttaccttgattgggttgggtgggggagacagtttctgtctgaagacattacctgtggtttctgactcttgaaatgtttaacggattaaatgagatgtataaggtgcttccattcaggaccagggttaagtaagtactcatgagac

SEQ ID NO: 28759 - DNA, 1772 bp, Mus musculus
aacttggaagaccgcacaacagagttgcttagaaataaaattggagctgaggctctggtgagatggcttagcaggtgaaagcactgtcaccaagtctgacatgattttgatccccaggacccatatagtggaaggagagaacctcaaattgcctgtcctcaaatacacaggctctgatgtgctcggagctcctctccagcacaagaggacaccaaacacacacacacacacacacatgagtaaataaatataaagaaaagtttttactgtatctaagcattacaggtcaaattatgtgatttatgaattcagagtcattgctacgttacctccccctgaagcagagccggccggttctcatttagttgatcaagttgctgtcttctagtcctaacgcattgcactgtttcctttcaagcccagtcagattactcttaaactgtgtgcctagtctgatatggacttgcctttctgtaatctagctttgggcagcaagcatcactatatataatgatttgcagaaccaaagattttggaatgcttcgttttatttaactacctgctctgtatgaaatgtggcttagtggtacactaattgcccagcatgtgtgaggtctggattcagtacaaagcaccagaagtcagagaccgaaggcttaccacatgcttgggctccctagtgaataccagcctatcctgggctacagtgtaaggccctgtattgagggaggacaaaggaggggagagaaagagagacagagatagaatgagaataaatctgcccacagatttaggtttttatctaagctaggcaaaatagcaggatatataatgctattttaagtagtcagttgtaggcggcagaccaactcggtgtcaatgccttttgtgtaggaccaatcggcaagtatacattccctgagaagtttgttcccacaccttcagaacacctaggctaaaatgctgcttctataattcctggacctaacctaagagaatttctctgagggcccatttagtcatccagacttctgtctacttacgagtagctttcgcagaagggcactgtcatataaagtagtctgtcatgcactttacaaattataagcttgtacagccttatgacagtttattctaagcatgaaaactggttcatgagtttattaaatgtagctctgtcagcctgtggcatatgactgtgacacatgtatgtgaatcttctggacaaggttatgttttaaacatgaaatttcagtatatgcttaccagtttaatatttggttttatcttcaggtatagtttatggtactactgaaaatagttttaatattattactctgatctgaatttgtaatatacaatctactttgagatgattaataaaaatttttaatctcttgctcttttgtgtttgtttttgaaagtttaactagaaataaaaagcagttgcattggaaactggtaaaatagtaattgtgccacaaaatatgtatttctaaaattcaagtctggaaaccctggaagtctgtctacacacatacactgagatcaaaacttctcagtgacaaagtctaccacatgacacctctaatcatgcagagtgtggcttgtcagctcaggatagccaggaaaaacaccctctgaggagaagcctgtcatactttagcatcagagatctctagaaaggtcttttatagtagttgagtgtaagcccaactactgtaaaatatatatacctctggaggaagaagtgaaaggtctagtttatgcaa

SEQ ID NO: 28760 - DNA, 1266 bp, Mus musculus
ggtcgccctgggcgtcggaggcaggaggaggagttacttctctcagagtgtgcccgtggttctgtgaatgatgtgagagagcgcttatgtgtaagggtggaggagacaaaagaggaagtgctttggttcagggacaccgctcgctctgctggtcgtagctcttggggtcacgagtgtatcatgtgaatttatttttctggtgtaagagattctcataattatttggatagttttatattgataaaagaataattttttaaatgttacaaaaagttcacttgttactgcaaaattctaagaatttaacaaaaaattcagtatttttttttaccttttgaatgactataattgtgttttaattctgcagaattaaacttttacttcatatttccagtataattcctgtatatagaagacgattcctatttaattttgaacatggagaacttttcctaaatactttttaacctaaaataaactaatagtgtacatttggtgtatacagttatttattttatatatcttgcacacattaaaaatacctgaaattgtctacagccataccaccctgaacacgcccgatcttgtctgatctctggagctaagcagggtcgggcctggttagtacttggatgggagaccgcctgggaataccgggtgctgtaggcttgaaaaaaaaaacctgaaatttattttagtttcaagtattatttttcattatttttaatatgagtctcagtttgaagtttatttcttgcccttgttttaaaaactactttttccttagaaaagcagggttacaatttgtgtgtattgttttctttttgcaacaggagtctcactctgtagcccaggctggccacagaccttctacctcagcttccaaagtgctgggattatgggtccgggccaccgtgccaggctagcggtgtagtttttattgttaataatcctgtggttggaacctgggctgttttgtgtcaccagctggagagagatagtcttcacatgttgtatgtttctcctgactcagttggtctgaacaggctggtggcatgtctctgtgactgaacaaaaagtactgtcatggctgaaacggtgtcctgcacctcttccggcgatcattgcttcacgagtttatttgactgtctcttcttgcaagtttgcatttggtatctctgctcaatagatatgtgcgtgtatttctagttttatctgaaatgaaagttgttttcctgtgaaaatgctcagctctcctgaggactg

SEQ ID NO: 28761 - DNA, 1226 bp, Mus musculus
tttgtttgcttcacggcatttaagggtgtgacagggtaccctagttccaagcaaaatggcttattttacagttctcggctccattattagtcccttgagggcagtggtggcccttcccagtattctgtcatttgtattctcagcttacctacaagacacaaagcgaaggcacaatagagcctgctgcttcattagcccacaggagtcccataaaacagttcagagaaatatagcacactcctagtctcttctcaatttcagcaagttggaagcagcatgattagaaaccaaaagtcttcaactggagtgtgtaccacagcattagcccatcggtgatcccaggcttaccgtttaatctaggccatgacactaggcttgcttaacgtcggttcatctatctcacgccaatgaggtgataactacaccctagctgcagtgctctctcgctgtctgagacaagatgaactctcgggaggctgagacaggaggatcgcttgagtctcggagtggcctgccgcgcactaagccattggtggctatactatgtttggcatcaatacggtaacctcccaggagtggagggaccaccaggttgcctaaggaggggtgaaccagcccaggtcggaaacggagcaggtaaaatctcccatgctgatcagaaaattgaaatgaaaacttggggttcaaaggaagtaaatctcaaatatcgtacaagagccattcaacagtagcaggcacagaaattttcttttacctgctactcagattcagactcctggcccttcaggtgcagcggcagccacatgccaacggcagtggtgaagagagagagcagaggctgtgggcggcgcaacaactcagatgccagtgtacgccattcctcaatgggaatccttaatgagaagacactctgactcttagggaccagcataagtgttgctcttgatgtgggagggccaactaccctccacgtcctctgtgtgctttgacaaggcttccaacatggtacctgagaagtctcagtcatccctcagtttaggacttctcagaaagttcagctgtacagatcgtagctggaagtttcgtcatgtaatatcaaccgtgcaaaaacatgaaatataatcatgtaattttaaaatggttatcatttttaaaggctgttacaaatactaattggaaattatagctatgatgttacatataacatattacttataatatgtaca

SEQ ID NO: 28762 - DNA, 1113 bp, Mus musculus
agttcaaaaagaaaaagtctaaggagaagtcagaatcaatagtaagttatctagaattctgaatgtggtggagacactcaaaaacggtaccaacttttgaagtattaatgtttccttgacagatggcatttgaagatctatcaaagcagaaaacatttatctgagttttctttcctttgaagttaggaagtcaaggactttgtctctattatgtctgattgcctctccttgtccggtgttcgagttggcaaagaggagcaggcgaaaggtagtgatgtttgagttcattccatgagaagatctgttgcctctttgtgtttgtggtgagtgcgatcctcacaatgctgtgttctaatctctgcctcaggttcctgatgtgagagggtagcccccgatcatggaggtgcttcagtgcgatggctgtgacttccgagccccatcttacgaagatctcaaggcacacatccaggatgtccacacggcattcttacagccaactgatgttgccgaggacaatgatgacgagccactatctgggtccatgaatgctagtaatcagacagaggtggagttctcttctataaaggatgagtttgtgattgcagaggatttaccaggtaatcctaccctaaactcatatgtctgagaaagcttgtcatcatatcatcatcatcatcaccatcaccatcattaaccataggtcttatgttaggtttctgaactttcttactccctgcaaggcattttccctacttaggcatcatttttctcttagttatcttaggctattgtccttttagtggccctgtgtgttcctcttctaatgttgaaaacaaaatgtctcagaaagttctagaacaaatcttacagttgatgaaactagtctttattctgtatccaaaacagtctatgatatcttcattattagcactgtgtgagcagccttcagtgcatctccagtcatcatgcctgttgaatgtgatgcttattcgagagtaactgaaatgatggtgctgttttgtgtgtttgaatttcatattctctttcgctttacttttctcatttcaatcttcttacatattctctgcaggtcaaagtgcaactgcgttgggg

SEQ ID NO: 28763 - DNA, 1769 bp, Mus musculus
atttcaggggctccatgggcaactccatcatgagacctaattcttcttcaacttccaagttttcttcttctatgtcttaccctcagatgaagccgaagtcacctcataattctggccttgtgaacttgacggagaggtcccgttacggaatgtctgacatgacgaattcatctgctgacctggacactaacagcatgctaaatgactctagctctgatgaggacttaaatgaggtagacagtgagaatggtttaagtgttctggatcaccaggcgtcaggactgtctgcagagcagctcatgggctctgatggcaacaagctgttagagaccaaggggattccatttcgaaggttcatgaatagattccagtgtcccttttgtcctttcctcaccatgcaccgccgtagcatttcccgccacatagaaaatatccacttatctggaaagaccgctgtctacaaatgtgacgagtgtccgtttacttgtaagagctcattaaaactcggggctcataaacagtgtcacacgggtacgtcggattgggatactgtgaattctcaaagcgaaagcctgtcttcctcgttgaatgaaggaatggtatcttacgagagctccagcatcaatggtagaaagtcgggagtcatgttggaccccttacagcagcagcagccaccacagccacctccgccactaccaccaccaccaccaccaccatcacagccactgccgcagcctccacctccaccgctgcagtcaccacaccaggtgccaccaccaacccagcagccacagccacccacacaggccccacctttgcacccttacaagtgcaccatgtgtagttattccaccatgactctgaaagggctaagagtccatcagcagcacaaacattcattctgcgacaacttgccaaaattcgaggggcagccctcgagcctaccactggaaaatgagacggatagccacccctcttccagcaacactgtgaagaaaagtcagacctcaattcttggattgtcctccaagaataactttgtagctaaggccaataggaagcttgctagtgactttcctcttgacttatcacctgtgaagaagagaacaaggattgacgagatagccagcaatttgcagagcaaaatcaaccagaccaaactgcaggaagacgcgatcatcaacgtcgaggacgatgaggaggaagaggatgacaacgaagtcgagatcgaggttgaactggacagggaggaggaggcaacggaccccatcatggaggtgcccactgccttttcagcccaacagatctgggccagagacgctagtgaggcccagaaggagcccaactacagaagtatcactcatgattacactgccaccaatggggcggagatcgagctcacgctttctgaagacgaagaggattactacggctcttcagcaagcatgaaagatcaagtgtccaatgcggctctgctgaacacccagcccgctatctatgggacggaacccagtaatgaaaataccgattttggggactctggaaggctttactattgtaaacactgtgactttaataataaatctgcccggagtgttagcacccactaccagcgaatgcacccatacattaagttcagctttaggtatatcttggaccccaatgatcacagcgcagtgtacaggtgcctggaatgctatattgactacaccaactttgaagacctccaacagcattatggtgaacaccacccagaggccatgaatgta

SEQ ID NO: 28764 - DNA, 1113 bp, Mus musculus
gtataccacaggccaccctcaaacatacagatacctggtggcccaggcttccagaatattgggattacaggtgtctgctactgttcccagatgctctgtgacttgcttgttgttattacaatgtctttagttgccttttgaaaactctgaattctagagtttctgacaaacactgttttgcaggggcagggcaggcatatcttcctgaggaaccataaaccactcacatctaaaaaaaaaaaatcacagtcccctctatttatttattcaaaattgatcctagtcattctttctccattgcagaaagtttcgataaccaatcctgatgcttcctcccctttctgtagctgctaacttcatccttgcgacttttcctgttgagtaagtttccctgagtatgtggcggaaggattttctctctggctgcttctctctataagtttgtgactttccccccttgctttgaaggctgctttttaacatttggattattcctttgtcccttttctgaggtctgtatttgcccttgtagctccaccatggctccacccctgttctgagtgggacagttgtgtaggcacttgtgaatattcttgtgaatgaatgttctggtttcctccttggaagcttcctaatcttccattcggtccacggtactgagtcccagtgcttaccgcactccacagagctgtgtgacctagcgttcgttcctatccatttaagagaaagtttcaaaagacaacaatttgaagatgaagccctagggactgttctcacagggagatgttcccacggagcatctgatgcaactattctgctacagtgaacagatcttccttgacgtagcatttgaaatattgtcattgtcctttgtggaggaggggaactcaagcttgaagaaacgtgtcgtaagaaggtggctgcgtggcaacactgaagagagatgggcattgctagaagcttgccaggcagccgagttgcttcttggagtcagtacatagtcgctcctacagtgggcagtttcttttgtgtttttcaagatgcaatgttttgggggaaaaatgaaatccaagctccaagattctgcatagactaaaacagactaataaaaac

SEQ ID NO: 28765 - DNA, 3028 bp, Mus musculus
ggcgggccggcgtgggctgagaagggaggggacagacagaggagagaagaagacagaacaaagctgcttttaggactgaacaatctattttcaaagcactggtacctgtgtgagtgagtatgtaaattaaagttatttaaatggttggaatatgtggctcctttcctgtcacgacatccttccttccggatcttcaccacggagattttcatctgctgcggtttgggaagtacctcccgtgggcacggtggtctccgtgaccctctcggacagtgtgtggaaaccgaggctcccggacacagaagacttctcctaggggaacaacttttgggcgcacaactttctgtgcgtttttctagttttaataccttaagctttttcaagacctaactgcagccgctttgggagaaaaaaaaataacaaaacagaaaacaaacaaaaaaaaactgctttgcataaaacagtcacctgtttcctagtacctcagacttaaccaagggaattctctgcatttgtctgtactacctgtggcccttgtggttaaatgtagagagaactgctggacaggatggtgaatggagaaaaaaaaagagttttaaagaaaggaacacaaattgtgcttaaaatccccacgtgggttttatttcttaaaatactgtgatttttttaattattttagtaaaaaacaaaacaaaaaaaaaagaaacagactttaattactagataactgtgtgtgaattgtcatcttgtattccaggtaagctgtttattagtgttcagctataatttagaatttggtaggttcatgtgaactaattttatggtgatcgtgggatttcgttggccacatgtttatttttttctcgatttgagtgttacaaacacagcacaaattcagttgttctttcttcatatgagttgttctctgtgtgtttgtttaatttgaggtcaagggagagttagagggtgtagggtgtgtgtgtgtatgtatgtgtgtgtgtgtgaatttttataattttaaacatgaacataacaaagaggttaacttccttttaaatttgtttttgtgtttgtttgctttttaatttaactaaagaaccaaactccgagcacagctatgcagtggggggggccagacaaggaggtcccgtcacccttttgggtttgtttgttttttttttttctcaaagcaacacatttcgtctccccaacgatttctgttacattgggctggccttcgtgtgtgctgtgaactctgttttgtttgctttgtgtattgtgaggctgtctcatttctttggggagccatcccttccgtgagcttggacaggagatgccgcatcctgcagggagcctggaaaagtgctttgtctgcgcatctagctgctctgtttccccacagtggcttcgtttattttattttatttttttccaagagcagcttagactgaaagcaagtctacatttatagcacattatgattgtgaaaatggggttttgttccaaaaagtggaaaggaacattcttgaagcttaggggcgtgtgtgtgtgggtgggtgggtgtgtgcgcgtgcgcacatacgtgtgctggtgtttggatgtatgtgtgtgggcaaatatgagtcctaggttttgtttcttttgttgtccttgtttgggtttttgtttgtttgttttttttaacttggaagggttgatggggtggggggcgggccagaagggaaagagggtaaactgaggtgtcagtgtcccacacagcttcagagaaaatccatggaaagatatcgcatttgtgaagtaagtacgtacttgaaaagcatgatcttggttttgctttgtttttattttttatttttgtttttatttttgatttttagtttttgctattaagaatttttatttgtaggatgtttaatttaattttgtttttagggatggggccgtcatgtggaaaccagaacagggggaagtgtgaaatatctagacagattcttctgtgtccttactcgcttttgattggcctcatttcaaatgtactaaacagtttcatacctggactggatgtctgtgatggttaccaaaaacaaacaaaacaacgaaaggaaaagagaaaataattgtgacatgcttctatcactactttatttttcaaataacatgtaaatattgtaatccattggattttgttttgctaacctgataataaaaatatgggaccattatccttttaacaaggctaggatgtcatttttttgttttatttttcaaacatatacctgatattttgtggccgcacattttggacgcattctgttttctgttgactgtaatgacatagaatttacaaaattttttgttgttgttgtttaatttatacagaggacatttttttttccagagcttgagagaagaaaataaatagcaaaatgataacctattgactccaataatcagtgtttcctgaaacttgatgaaagatagggggatcctgactccttgaagccaagggtttaaacacaaaaaaaataaaataaaaaaataaataaaaataaaaaacacaagtaggttattcaagttgtttgcaacatacattttgtaatgagatgtgagaaattaataaagaatttttttcacatgtatttatgtgcatctgttaagttatttgtgggtgtgattacagacaggaagactggcaatgacaagaccagtttcaccctatgtgctgaatctacccaggcatggaaagcagctaaaaccaaggtgaggtctgagctagagtttaaaatattagcgttcctgcgttcgagtatacatcgacaatgaaaagctaatggaaagaatagtttccaccaaaattgagcatcagttggttgtggtacctcacacatgaaaccgctccattttcgaggctgatgcaagaggatcacaacaactaccccaccccaaaatgtggatcagtagacgaggcaaatcgaggatcacttcataagaaccatattcttttcatcgagttctcagagatcctttt

SEQ ID NO: 28766 - DNA, 1172 bp, Mus musculus
ggggtttcctcctaagatacagagtgtttggaatgttcgtaggcagcctacttcaatcccaaaaagttattttgctaatgcttttaagtggcaatacaatctttataaagttacaattaagatacataagtaaagatttgtagagaattatatggtacttttgggtatgtgtattctatatttaaaacagtgacttgtttggattcttttcatattgaattgtgaagactgaaatgagcgtctaatgctaattgcagtcgatagttaagataactaagttatcataggtacttagacagagatgttcagttcactggttattgggttgatttgtggctgtcaggtgacttacttactgtgctgtttaacacatccagcccaaagcagtgaccacagcagtgccagctacaacccagccatcaagtactcccagccccactgcagtcagttcttccccagcagtggctgcggcccaggctccagctcccacccctgctctgcctcccacttccactcctgcctccactgctccagcctccactacagcctcttctgaacccgcacctgctggtgccactcagcctgagaaacctgcagaaaagccagcccagacaccagtgcttactagcccagcaccagctgacaggtaagggctacggtttaagaaggacatcaaaagtagccatattttttaatttttaagaatcaaacctctttcatttctaaatgaaatctgaatcatgcacttgtgtctgtttttcatgtttgtgcatgtatatatgcacacttgtgtgtaggatgcaggttgatgtaatttctctccctctattgttctccaccttatttatttatttatttatttatttatttatttatttatttgtttgtttgtttgtttggtttttcaagacagggtttcaggatttctctgtgtagccctggctgtcctggaattcactctgtagtctaggctggcctcaaactcagaaattcacctgcctgtgccttccaagtgctgggattaaaggcgtgcaccatgactgcccggtgttctccaccttacttaagacagggtctttggctaaatccaaagcttgccatgccagttcagttaggctgtccagtgaatctttgatatccaccacttaccaccctcacagtgctggaattac

SEQ ID NO: 28767 - DNA, 1099 bp, Mus musculus
cataaagctactacttattttgactagagatgtttaagaaatatataataaaagtaatgactataaagcagccagtcattataacaaataagcagttatttgttgtgattgtggccgttgttctgtgaacagaagcatccttccatatcagtgaataatccagtttttcgatgcactatatttggttctgacgtttgttaactgtgataagcttagaatggcatagttaagatctttggtgttttcctcatctttaaaatgtgtgggtcaaagtccgacagtctaaagcaggtgggaagtggcacgtgtgcacagagactgctggggaagagtgcagtgtagctgcttcctctgacaccttttgttgagccaacagctagctgtgaacaatgcggactcaattattcagaagtgctgtcacaggagctgagtggtacctgtagcttttgtataacactctttgccaccacctcctcgacagagctgctccctcattactgccaaagtgactgctcactgagacccagtgagtcagatgagaggggggattgcagtgaagattaatgagcaggcttcttggacaggattgtggttttgttttttgtttatttgcttgcaggcagtggttggttggtttttattgataatgataatagccaaggcaaatggttctggcatagtaattcgcctaaaaatcatagaagggatttcctgctttatctaaaatatgacttctattactgctactctgaaactggcactaagctattttttgttttctgacttagtacaacttgtaacaccagtagcaggagctgtgtgaacttagaatcagagccagtcacagtggaaaatgggcagtaattggaaatgctttgaaagcatgtttgaaagcaattatttatggtattcatgacaatatacacatgtttgccccttatacaaagatgtgttccagatgtccagtgggtatgatgttttttccttaaataaacatgctcctgataaagtgatcaggcatactaagacattagtgattaatgatactagaacaattaaaaaattactggaataaaagttgcatgtgggccagctattg

SEQ ID NO: 28768 - DNA, 1147 bp, Mus musculus
gcaaaactaaaataaagttattcttgaaagtagaaactggtatatttgtgattgtctcagtggggtaaaagccttgggcagggaaattacttagttttttttttttttttttggtttttcgagacagggtttctctgtgtagccctggctgtcctggaactcactctgtagaccaggctggccttgaactcagaaatccgcctgctgggattaaaggcgtgcgccaccacgcccggctactacttggtttttatatattcttttgagatctttcctcctttacatacttgctgttttaagtagaaactgtaaacgttacagagcaggcttggtttagctgtgataatcactgtgcttgagtacagcttctgttcttaacaacgttggaaggagggatgctgagatggctcagtgggagagccactaggttccaaaccagacagcctgagtttgatttacttgccctagcccagagggtagaaaaggaaccagctatgattatattaattgtagttatattagaaacaaccagtaccacccacccaccccccagagctcttgtctctagctgcatatgtatcagacgatggcctggtcggccatcagtggaaagagaggcccattggtcgtgcaaaactttatattcctcagtacaggggaacgccagggccaagaagtgggagtgggtgggtgggggagtaggtgtgggagggtgggggggacttttgggatatcattggaaatgtaaatgaagaaaacacccaattaaaaaaaaagaaaaagaagcacaaacattgaatgcatctctcagtagttcttatatactgcactgttatatagaattatgcatacatatacataggatatttaaatgaaattgtctattaaagtaaaaagtaagagcaagaaaaagaaagatagagattatgggaaaatattcatattgtacacagtgcacttttatgaaaattctaaacgtatataaaactgatatatttacagaatttaaaaaaaaaagagccagctgctgctcattttcctttacccactgtgtactgtgcatataacagatacacctatgaacacacatgcatttaactcaaaaactgaaattggaaagaagtataaatgtatggagtgcatgtga

SEQ ID NO: 28769 - DNA, 2122 bp, Mus musculus
atttaattgcttcctttttttttttttccagttaaaggcattaggatttcctgaaggacttgtgattcaagcatattttgcttgtgagaagaatgagaatctggctgccaactttcttctacagcagaactttgatgaagactgaagggatttttttgtacctcacactcacaccagtgcattacactaaccttgttcactggattgtctggggtgacttgggctcatatccacaatatttggtatacggtagtaggttggtgggggtgggggtggggagctaggatatagggcagggatacatacagttgcatgtctgcttcaattagcagatgctgcagatccacacagtgtaaaatactatacaaccaaacatccgcctttacaggtcgttattcttctaagcagtaggtaacttttcctgggtttcattctttctagtgtactagatccagaaatttagtgtgatgccctgctttctcttttctttgacttaacattggtttctgaaagaatctttgctacctagaacctgcagtctgttttatggcaacactggataatggctttttgaaattgagggggaaaaattggagcatctgtaaacagaaatgccaaattattgatagtcatcgttgctgcttcacattagtatgagactgatgcagaaggaagcccattcttcgtgttcagtgctggggatggggtggggacttttcttaaaacgaaaataattactgctattttaaaatgtcttgattattgaatgtgagaccctctgacatgatttgagaagctgcacacataggcagagtcattttcctgtttacattgtttgtttggggaagattggtaggggtctaattactgttcacttccttgttgtattgcagtaaaagatttaaaacaaccattgcatgtttgcttttgatgtatccctttgtgaaatcagcacttctggggccaatgaagaaactgtgcagcattcactcccctcccccctcccctcccctcccctccgtagagatgtgtttgatcagcaagtcaggagtcaaactgctgcctttaaaaaaacacacaaaaagctgattcagttcaaaattaatgcaaatctttcaaaactgggtttctgatacttgtggatgtttttcttcattagataagaatgtattaccattaaatccattagtattacattgctttcaaagagaaggtgggtggaactataattcagcatcttttactgcatttaaagatgggagcaaacttttgtatggttgggagatgtggctggaaagtactttggaaaatatacaatcaagatatttcgtctcatattaaaagagaaatctcaatcacagtgttggcttttatttggattttgctcatctcggtctttgtttggaaactccctcatcgacattgctattggattgtaaagaggggcccagtatcagtttgttgaatttgtcaaatcttttcctggacataaatgagactattgaaggaagtaacgtcccaccgtcgtgatgctgtgtgagaagatggctttgcagacctcctgcgcagtctcttgcactgtgtccatcaccacttggtgaggactcttaaactctctcctcatgtgcttataccctgttccatgaaaataaatgagaccatgattttccttcatgatgtaccatgtttaactttcatgtattattctgcaaacttggtaggctgttggatgttatattgcccatgtgctttacagtgggcaatgtgagatgtctcagaatgaaacggtgcatctttcagggcagaagagcagtgggttggggagaggggtaaggtccagtggagtgggggaatgcttccatttgttctgccctcccttactgcccagaatgttagcataaaacaacacaggaagctgataaaaatagcagctgttgtttctctttggaaagtgacagcagaagttggtggcatgggactttttgtccttggacacaaacctgcagatcctaggagtaatagtttcccccaaggacagcccagcccatggaccacttcttcctcagtggagataccacacatgagtggagagatacgttagatagctttggtaaatatcttt

SEQ ID NO: 28770 - DNA, 1180 bp, Mus musculus
ctgctcaattttagcagggagcactaaacagtaggccagaacactctagtttcatacatttatatttatacacatagacacatacacacacaaacgtgtgtgtatatgtacatgttacattttgtctttaaatgaaattatgaatcattttctgtgcaggcctggccttgtagtccccacagaatctaagtaacaaaagaaccttccccaggcaaacaaccctaagaacagaatgtagttccacagtgccctcctgaggattaagggcttcatttatgctgcatatattatccctaaagagatccaaaatatactatctacagagtatctcaaagcttcctgaatgtctctgaaggcatggaaacaatttaaaaattactcaaaccctgaaggacaggactgtgtagcccagtggtggggtgcaactgagcaaaaccctggagaggtagccacctctccaggttgaagcaaaactatttttagctgtcacaaaatggaaaagtctgtgtgatacttgtagacatgttaatggtggtgtgggtgactcagaagatgaaaggagcagaagctgactggcttattctttagagtgcttattaaccatccattgtacctagtgcctggagttgtatttacaccgtattatgctttataaatggaatttagaaacgtagattcacaaggagctcatgggagatcggcaaagtagtttctttgacttttaagaggccagtgtgattgaaaccacagcatgtgtctttgcttaaaaggaaacaggtgcatcaggaagatggaattttatgtggtcaagaatatattcaaagcaaagctaatgacatggaaaaatgttcatggtatgttaagtggagaaggcaggatataacacaataaacagcgagactccaattgtatacttgagtttgggcttgtctcctgtcacccaggctggctcaatcctaactctgttgctgagaatggccttgaactggtcaccttgcctctccctcccaaactcctgggttatgggcatgctctagcaaacctggctgtgttttgtttcctgtttggttttgtccttgctttttgttgtttgtttgtttaagtaggtttgcttattgtagctccaggcaagcctggagctccttgcaactcaactgtccttttaacccagggactctct

SEQ ID NO: 28771 - DNA, 1982 bp, Mus musculus
atataaagtttgcctgtccaatgggcctctctttccagtgatggccgactaggccatcttttgatatatatgcaactagagacaagagctccagggtactggttagttcataatgttgttccacctataggattgcagatccctttagcagagccaacttctaatccagtccatttccagtgctggttaggctcgagagtgaaaactccgtactgtgggggtggacgctttgagagggtatctgctttttttttttttaagttactaactactgtttctccatgagtttaaactcataacacatgtcattcctcttcatctgaaattcagtatggccctaaagtgtcataaagacattcctgaaggttttttttattattattattatatttttactttcttgaaaggagagagggtggggcatgcagtagaatttgctctctggcctctcccttttttttaagaaaaaaaaggggggtggctaattcttccttctagcaatggcttcagcagcccgttctctttccctttacaggcgagaaaccttaccactgtgactgggacggctgtgggtggaaattcgcccgctccgatgaactgaccaggcactaccgcaaacacacagggcaccggccctttcagtgccagaagtgtgacagggccttttccaggtcggaccaccttgccttacacatgaagaggcacttttaaatcccacgtagtggatgtgacccacactgccaggagagagagttcagtatttttttttctaacctttcacactgtcttcccacgaggggaggagcccagctggcaagcgctacaatcatggtcaagttcccagcaagtcagcttgtgaatggataatcaggagaaaggaagagttcaagagacaaaacagaaatactaaaaacaaacaaacaaaaaaacaaacaaaaaaaacaagaaaaaaaaatcacagaacagatggggtctgatactggatggatcttctatcattccaataccaaatccaacttgaacatgcccggacttacaaaatgccaaggggtgactggaagtttgtggatatcagggtatacactaaatcagtgagcttggggggagggaagaccaggattcccttgaattgtgtttcgatgatgcaatacacacgtaaagatcaccttgtatgctctttgccttcttaaaaaaaaaaaaagccattattgtgtcggaggaagaggaagcgattcaggtacagaacatgttctaacagcctaaatgatggtgcttggtgagtcgtggttctaaaggtaccaaacgggggagccaaagttctccaactgctgcatacttttgacaaggaaaatctagttttgtcttccgatctacattgatgacctaagccaggtaaataagcctggtttatttctgtaacatttttatgcagacagtctgttatgcactgtggtttcagatgtgcaataatttgtacaatggtttattcccaagtatgcctttaagcagaacaaatgtgtttttctatatagttccttgccttaataaatatgtaatataaatttaagcaaacttctattttgtatatttgtaaactacaaagtaaaaaaaaatgaacattttgtggagtttgtattttgcatactcaaggtgagaaataagttttaaataaacctataatattttatctgaacgacaatctctttgtttttttttttcgaaactggaaaagaactttttaacggggggggggggggggccactggtgagaaccacactgtgaagccaaccttaccttagcaagaggatgtaggcaacttgcttttttagactactcagttttacatgaagtagtgttggagttgagagctgtacggatgggaccttaaaaaacatctggttcatgtttgtttagtacgaatgcagaagtatacctccttacccaaacgcacatttccaggtaggtggctcagttattcttt

SEQ ID NO: 28772 - DNA, 1945 bp, Mus musculus
gctcctctcactttgctataaactactgaagaaggtgaggttgtttttctgtattcagctttattaacttagaggaaaatgacagtgtgcacgtttcactttgcagcttgttttcagagcacagcagcagctaactgtcttaactctttcctccagatggaaaataacagatggggctctgcgacgaacaaagataccatggatggtcaaaactgagcagcctggggttcatctcagggataccatgtggcacagctgacattttaaaacgcaaatgatcctttgtactttcataagttcatcagtcttttaaagaggatgctgaaatctttttttctgatcttcagattagacagtcatgttgctatggtggttgctaagattctaacagcagtgcaatttgaaaacaaacactgtgctcagggtgtttttcagcacacaccaaatatcccaactgtcttaatggcggctgaatcccaaagaagcaattgcaaatgcacattctccttggcattcttaactggtttttaagcggattatttacaacactaatttcagcagaaagtatacagtggccttgttgaatgcagctttttttttgaggcctgtggactcttcttcatttcttgttgaagcaggataaggggccgtcagtgcctggtcccagatcacacctgttagcactgctgcttctaataagtatctcactggtaaggctgtgaggctgcacctgtcccttccctacttctggaaggaaaaaccacaggagtcactccaaagaagcctggagcaacttcagaagaggagatggtttttgttagctgtagtaagcacagctgaccaggcagccctgaataatggatggaatcctaagtatttcttactgggttaaagacacgtttgaagtacccttctcagtattgaggaaatgacagctgcagaagacagaacatcggaaccaagaggctgtttagatcgcagacacctgtacactgtattttatgtatgtggaattggaatgctcattttaaaataaatatttttagtctttttaactttaggatttaaaccttttcttgggctgggaagatgactctgctggaaacctgtgtaccttgtaagctgtgtaatgaagcaaggcaaaggttgcccaggagatggcccagctatctgctgtactgcagactatcagaacgagggccgagagagggagcatgtgcagtcccagcgtgtgctatacagaaatctcacctttagctactgtcacagctgccaacataaccaggctttcaaaagcctagtcttgcaggcagctgttacagggaatgattgaatggaaccagcgtctgtgaaaagtcaggattggtaccaacacgtgtgagtgaaaactctgggatttctttttaaactgagaagcagaatgctaacttcactgggttctcagtgttgctatctcagtgacaaagcagctccctcaacaaaactgtaaaagaccatcaaatatgtggcaacaataccattatctctgacgacaaaatagggtttattagttagtattaaagatcatgtgataatataagcttcaataaaaatcgtacattcaaactgaactcataccgactggcttaattttgatccattatcaaaatctgggggcagcatactgaccagtgatacaattagaaaatgccattccaatctgtacgtttccacgtgctgcatctgaaagtgcttctagcgtggtttttactctgtgatgccaacattctctcaacttgcaataaagctagcagaggaagatacaaccagtgaaacagatatggactcatagcacgagtctctgagaatcctttctgctactcagaaagtgaggatctgctgctgtgtgcctagttttcagcctagcatgttcccggtagatggcataattaagggacagctatgc

SEQ ID NO: 28773 - DNA, 1152 bp, Mus musculus
tatggcaatatactcccaaatttttgttcctgcaaagagtaactagtatttattttctatttatttatttatttattttatcagtttctagtctttgctcattatgctatcaaatctgttaactcactaaggtctggggaaaaactaatatctgaacccatgaaacagccttctcaatagcttaagacgacttggagaattgtaggtagagtcttctcaccagtgtcacaaaagcttggtgcctggaggggctgttgtagtcaggttatgcctttgttttagacaaggaaaccaatgtgtgggtaaagtagcttacgcagcagccagttagcaaccgaattcagatggaacaggtcctctccatcagcctgccttctgctcctcctgtcttcctcacggctcagtcacttttgtcacacataaataaaaaaagagaaaagtggaaagttccctatagcacttgtatgcacagttaatagagttgtaagagaaaagctgccgtgggaggggagattccatggtcaattaaaattgaggaatgctaacttatttcctttccctgggctgtctgagtttctattatgccatgacacattttgatcttaggaggggacagactgttgcacttgatattgttctcctgtcctcgcccccatttctctgagcatctcaaccagtttttggtcaagtttacaggtcttctagaagacgatttccagtgaaaatactggcagtgagtttgttatggtgctgcgatggcattggtaacaagccccagcggtgcaatgagctaccagaaagacttagctgcccagagctgtccttgcaaggagtttctttcccacctggggcacacaaagtcagtatttgtgtttgattttgcaagttacccaagaattaattaactaatggaaatgtattggtgatgttgatactgcagcttagcaatgcttctgtgtggcactttataatcttcaggcgcctttgaggactccctgtgagccaggcagtatcgcagtgactgtatggtcagagtcctaggagccctgaaaaactggttgctgattctgtctcttccccctcctgccctcctctctccgaagtttacatcctaaaaggatagagccagaacttggttacagagtctctgac

SEQ ID NO: 28774 - DNA, 1372 bp, Mus musculus
cacccccctcagggctctcagcagaccctcggattccaaaggtaaacgaccttcagctggcagaatcgtgcccctgcccaccatgagacgagtcatagtcagctgctgtggacaatctgaagcagccccatatcccacgcctggggttaaaactaaagcataatcacaaaacataactggggtttttcatataagaaaatttaaagctaacagagcactagttagtctgtctttacagggtctttactcttcctttttgttttattagcatttctttaaaaatgcaactagatctttctacaactgcttgtcttgtaggattgtgtgatatatctgtaatatgctttatattataatattcaaagaattgcttcatctcactgaagacatgtgagagggcattatcagtattaatttgtgcaggtgtcctccaaacttctgttatttccaataaatgtgcaattacagaaccagcttttcggaactcaaagcagttgcacattgggactgaatatgaatcgtgtatggtgtgcaaactgtagtgttagaaattctgcaaaatggaacacatcatctgtctgccagatttcatttcctttagcactcctaggactactcggcaggtaatgaagtttggttatacagagaataagtaaggcatttttttatctcctcggcttgttgccaaatcatagaaaaaaaatttaaactttgattgttaacatggtgggtttttttcatgaaattttgaggcttctaatacatttcccattgataattggtcaatttcttcatttccttgtgccaatagactgctcaacctgtatgagactgaatatgagtctcatattcaaaaatacaatggaaagtgtctatttctgattgccagttgcggttgcacaaataagattaattctgagccatccggaacaaattcagcagtttctatatacagaacaactctttctgcatactgagagtcagtaattgttaagagattcagagaaatctagcactagggttgcatacagctctgacttttgaacggaatttcgtgggctttgggtcactttgcttattttgtccgacttacagccttccattctcaacttacttgcatcaggatagaatgtaggcgcctcaggaactggccttccctttacaatacttgggagaatccaattagttctttttgtaaattgaagatgcttgctttggagatatttgttaatttctcccaaatagttgttacatgctttgcaaatcttcattgattacacatagtgacataatctcagcattagtaaaaggcaccacaattttggctgtgtctgttactgataattcatatagtcttattctaccttttata

SEQ ID NO: 28775 - DNA, 1131 bp, Mus musculus
gcagaatgcatttcttatggctttggcagtttcccagtcctgttagcagaggttctcatttattcgatacatgtgaaagagttgtcctgcttcatgacgcaggacatggcgtcacttgagcccagctcctagtgttgagccctttccagctgttgttccagctgttgttccagctgtcctgggcagcagaaggggttttgatttgttttttgaaagcacttaagactaaaatttttcttaaaacttcttactaactttataacttgattgattaataaaacccacacatgctgggcggtggtggcacacgcctttaatcccagcacttgggaggcagaggcaggcggatttctgagtttgaggccagtctggtctgcagagtgagttccaggacagccagggctacacagagaaaccctgtctcagaaaaccaaaataaataaataaataaataaataaataaaccccacacatactgcagtgccatctgacttgctatgtatagtatggctcatgctggtttcctggttgtatcatgaatccttcaacattatgacctgttaatccatcatctgttagatctgaccactaaaccacttactctgttctttaataagttggtcatttgctcattaatacttttcttgagcattagtaaattctaggcaccatgccaaggaccacaggtggctgtgggcgatgactcccacgatggcttctctcaccttaaatgccagccagatcatgtaaatcatactaaatctaaaattcttgcattaaaatggttgaggagagaaaccaagtttttgtttttaaactatattgtgataagtttataattagcacatgctcataagcagcaaatatacacagtgagtttgtatacatctacaaattatgttgctccagtgtgcttttagccatgtaaaagcaaatttgcaaaaaactaagtttgagctgattcatagttgttggtaggatagttctcaatttgaatgtgaatttctaggggaactctgagctctaagtttagagcttcctaaattagtggtaatggtataagtctgtcctgaaattttaagagcagaagtcccccaaaaactcaaactaccccattgctacagtgaatcc

SEQ ID NO: 28776 - DNA, 1194 bp, Mus musculus
gacactcttacacatacacaacaacaatgcactaaataaataaataaatatttaaaagaaaaaaaaagaatacaaacacataagctggacacaatagaaaagttttagtaacaacttttaagatagtgagctgttatttaactaaaaagctcaaacaggctctaccagtcctctaaaacagaagcctgtgttcacttacttatttgggtagacttttaagaagattatttttcattttatgtgtgtgggtgttgggtgcatgcttgtatgtattagcaccacatgtgagcagtacctgcagagacttgaagagtatgtcagatcctggggactggagttacacgtgactgtgagtggcatgtgggtgccaggattcaaaccagtgccctcccaccagagccatctctccagctgcagtgggtgggggtcgtgcttgggccctgctactttgtaactgttgcccgggctttgattgcttctcttttactcctctattagctttggcagcaatccttggagctgtgccatttctggggacatattgggcagcagtacctgccgttctagacctgtggctgacacaagggctaggatgtaaagccatcttgctcctggtctttcatctcttgccaacatacttcgtagacactgcaatctactctgatatatcagggtaagtgttctccagttcttgctcagtcttagggtgtttggtttggggaagggttggggatggagtagtggcaatcagttgggtagccttttgtgatcctttcacagtgaaattcaacaatgttgaattacattgttgtggtaaatttctgatcgttattatgtaagtataaaatccaaaattaagaccaaaattatgcataattctgttttgagttttgtggcatttagcctaggaaaaaaagtattactaagcatatataaaatattttaagtacaataaagagttagtggagggggctggagagatggctcagtgggagcaccgaatgctcttccgtaggtcctgagttcaaatcccagcaaccacttgatggctcacaaccatcagtagtaataggatctgatgcccacttctggtgtgtctgaagacagctccagtatacttacataaataaaataaataaataaatcttaaaaaaaaaaaagattgccattggaggcccacttgaactacatagc

SEQ ID NO: 28777 - DNA, 1175 bp, Mus musculus
taaaaattgggactgtttatatatcctcctgtgagtagtgactaagtgcagtgaatttaataaatgaacacaacaccattgaatgtaagatggtgacaaacactagagatagaaatgcttatgattaaaaaaacacagattttatatttcatctctgtgaatggataggaagttatagaaaaaaatgggaaaatggaagcagttattttaagaaaatggaactacaatccaatgcttgtcttttaaaattgtcttgagagcctggcgtggtggtgcacgcctttaatcccagcactcgggaggcagaggcaggtggatttctgagttcgagaccagcctggtctacaaagtgagttccaggacagccagggctatacagagaaaccctgtcatgaaaaaccaaaaaataaaataaaataaaataaagttgttttgagactagggagatggttcagtttgtaaagtatttggcagtttgtcttgcaagcctgaagacctgcgtttgttccccagcacctatgtaaatgaagctcagcccacatctttaaccccaggacaggcagaagcaggtggggctctgtgagttggaggccagcctggactacaaatgagaaagatcttatctcaaaacaaatgaacaaaagaaaagccagccacaggtaatccctgtgttgcaatcccagtgctgagaaatagaggcagtaacatctttgggctgctgactggccagtctagttgaatctggtgagctcaaggttaatttaaactctatctcaaaaagtaaagtggaaaatgactgagggagacacgcggtgtccatcgttggttttgacactcatttgtgcatatgtatgcccatacacttatacatacaaaaatcaaaatctcttaagtgcccccccccccccttttggcctgtgctagggattgagcaaggtaagtgatctcctcctgagctctttgctctgagctttacaaatgtctctaataaggaaataggatgagacactacactgagtgtaagttgtgcctgctgtgtcaggttcccagaagtctgtcctgccagccctgcctgtctcagcagactcagggagagatttgtgcttgtatgtaaggtcctaaattttacttaagagtcttaaggcaacccttaattggagtaatgcaagacttaa

SEQ ID NO: 28778 - DNA, 1193 bp, Mus musculus
tcactcacctcctctgtccatgtctctctctttcactcacctcctctgtccatgtctctctccttcattcacctcctctgtccacatctttcttttgctcacctcctctgtccacgtctctctctttcactcacctcctctgtccatgtctctctccttcactcacctcctctgtccatgtctctctccttcactcacctcctctgatcatgtctctctccttcactcacctcctctgtccacgtctctctctttcactcacctcctctgtccacgtctctcttgctctctttcattcacactcaccagttgctgctgctttttcgtcattcaactttactggcctattgtttgtttaagtgtgtgtgagtgttttgccttcattactttgtatgtgtatatatgtatgtatgatgtatatgtgtgtgtgtgtgtgtgtgtgtgtgtgtgtgtgtgtgtgtgtgttatgcacatgtatgtatgatgctgtcggaagagtgcattggattctctggaactagttaaagacagtggagctaccatgtggtgctgggactgtgcaggagctcaccctgcagtatgcagcaggttggaaagaactggagcctctgaagtcttaagcttaatttctgacaaaattggagttaggaagattccactctacttaaaactatgaaggcttgagtttggaactgtgctggggctctatggaatctcatggtttgtatgttaatgccacctcataggaggttagggctccatgctttctcagaagattatttttatttaaaaccatgcttttaaggatgtttcttttaatacttttgcaaactgttactcatggaaacaaatctggttgtaactctgaaataagcttagtattgatgatataatccatactcctggtttacagagctttggagaggaaggagtgaggtagccctttgctcagggagctaccccgggaaccctagggcccagctgcttcctgatgcaaaacttgtcagttcattgattttagaacttatcttcgagtaagacacctgaccttccataccttagaaccccgttgttgtttgtttttgtcttgtttaatccctgcgttgtctgatgctttggtagcatgcactggagcttaagtcttgctttgaagctcttgagtgtcaacatcctagattaactttttgtgtctg

SEQ ID NO: 28779 - DNA, 1242 bp, Mus musculus
gctcagggtctggctttgagaggtactgtctgcaggtttatggagttggaacgatgaggtttatctgcaaggtctcctgatgatgtatgtcagtcactcaggttatatttgcagaaggcagaagaggactcagggaaggcgggtgcttggggacttagctgtgtactgtgggagttctggatacagttttggggcctgttgggtcctttttgaaactcgagttctaacctagtgatatttcagagaaacaggctggttccctgacttcagggtttgtgtctacgactttgtttgtcgtggtgtcaggtgctgcataggggtgaacttgagtttggggtaatgtgaaacctgtgggtatgtgggggtgcatatgatggcctggagattgacctcttaagggtaggttggcacatgccttcatcctttgagagcaagggtgaaattgttctttcgttagagtctacctgtatgagggccttttaacaatgtttttccctgtgaaataatctcttaattttcctgtatatcaaattgttctattaactgaaaacatgacttcttactacttttcagcatcactggctggctcatggagaattccagtattcctggttattgttttcctgatgtctgtgggcaccctttatgaaaaacagaatgagaaggagtcggctggtaagacagtcttttatgagtgcgttcttagtgttttggaaggatagctgtctgtactgctgtgataaataccatgacaaaagtggcttggggggggggggggaagggtttatttcctcttctaactctcaagtcaaaggtcacactcattgcagcgaggtcagctcaggactgaagctgatccagaggccataaaggactagcttgttcttcatgacttgctcagcctgctttcctacagctcctatggcatctgcctagtgatggcaccctccacaaggatctgggccaccctacaccaataatcaatcaatcactctggtgagggaatgctctcaattgcggttctgtcttttcagatgatcctactttatagaatttatcaagtaccttaccaaacaaagcacaataacttaaatgtcaaagagaaatcttttaatgtattaaaaacccgaagtggtttctaaacagaaaattaaattatctaaaatgttttaggcatctttagaccatgttcctattttgtatctttttgttattatggttaatataaaattggccatcaac

SEQ ID NO: 28780 - DNA, 1104 bp, Mus musculus
ggccctgctgaggcgcccagcccgcggggctctccccggccagagtcccgggccccgcgcacggtcgggccgggcgagaccccgcgtaccgcggcgctggcgctgcgcttcgataagcccatcaagcaggctttctacaacacgggcgccgtgctgttcgtgtgcctgtgctgcggcgccgcggtgctcgtgtacttcatcctcgaggccttcctgcggccgctgctctgggccgtgctgtgcggcactttcctgcacccgttcaagagctcgctcacgcgcctgggccgcctgtggctgcggcgcctgcaccgcgcgcacacgcccatcgtgctggccgcgctgctgctgccgctctgcttcgccgactacggcgtggaggcgctgggcgagcaggcgctgcgccgccgccgcctgttgctgctgctgggagcgggcggcccgctgctctatgggctctactgcctgggcagctacctgggcgtgcaggtgctgctggcgcacgcgggcgcgctcatctgccgcggcctcgactacttcagcagcctgtgggtgagtgagatgggggagtgcgtgcgaggttggcgggacccgggacgccgcgacaaggcggccaaaggtcctccagtgagcgccttcccacggccgagggacttggcgcgcttccttccagagaggcgggtgtgatttgaaacccgccctccgctagggaaaaggtcctttggctgagttcagttctttcaccctagtttgtgtgtgactctgggcgctttcgagaactgtattacttatgtgggggccattgcgacccggtctacgttagcaatggactgcgttaaaggagagagataccaggtgtcaatcgaggaacttcagaattggaaggaatcgcaaagataatcttagaggcgaattcctgactcagactacgtcgcaggctggttagttcacatatttatcgggcaaggttaaagtgaagtggttatttaatgcttaagaatcttaagaatgttggttggtaaactaccacaggggctaagaatgcaacgctggaatagcgagatcctagacagcgcgagatctagcgtgtatacaccccatact

SEQ ID NO: 28781 - DNA, 1606 bp, Mus musculus
ctgtttcctttgtgtatgcatgcttgaccacgctcatttctgaattgtcttccattctcccagtaaccattccatctgcaaacaaaacaagccatgttttcaggatgacaggccacactggaaaacctcagccagtggagatggcagccactttgactatgtccaggaccagaaccagaggaacttaggaggggcgtacagtgtcacgtaccgggacaaactcatgaccgcactttgagagactgaagcctcctccggtcaccaccatggtgcctttgcattccatgaggagcgtcctggcatcgcatgaatgtttttgtacaagtgtcattagtgcttttcgtgtccctgtaaacatttgaagataacagatagccatgatttactgtggaatgcattctcaattatgaaggtagctaaaggctcaggaatcgttttgatatgctggctttaaaactgaagtcaaagtctcaaccatcatgctgtgtatcctgatagttttgtcatttatccagtggggccacataaagcaaaccagcaagaccaaagcttgggaaaatagcttagcacataggactgtttgtaggagtggaaatcgacagggaccagcctcccttgccgtgtgaccttagctaaatcattcccctttctttgatttcatttcctccctgaaaagaacgggctgggctaagtgatctccaaggtcttctattctgtgatctgttaagatttcacttctcatttggggtgagagcatgcatccagactaactccccataaggacgactataataccccttctgtagcagaagctcaataaagattacaaaactcattaggtattcatcaatacagggaggcttggagttttccatctgtaaatgggttagcccgtgtggaattgagcctcagtgctgatcaccagttgcatagcatgtttcactagaatttacttctcaaacgcaaggatgctttgtaatgtctcagtgactggtgctgctaccctgtgtgatcagcgtagaggctgggttccatcctagacttaactcctttgaccagcagcatgcagttgagatatagtgggggatcacaggagagcctgccgggtttctgcaggtcgtgccaaagcactgtgttgcacagagggatgcatatgcccccctccttctgtaggaccccaaagcaacatgttgtcttttagggtggaacttgtaccaaagtatttatttaccccgattcaagtagcacctctctaacctcgttacgtcttcgtaggcagtcccagggtgctcttctgtttgtgtttctgtgcaatcagttaattctgtgtcactttgatatatgtgattataatttggctccttttaagccctttgggcatgtgtataacatcttctcttgctaaaatctggcctttttagttctatgaaagtctcttgaggaggaggggatcagtcctctgcacacttgcacaagggagtagaccacctacctataacctccccacaagatgcatgtttacaggcgtgttccagttcagcaggtgttctcatccccagtgtatgtactgcatccatctgaataaacgtgttctgggtctcttcat

SEQ ID NO: 28782 - DNA, 1207 bp, Mus musculus
tgcagacgtacagtcaatgtgccccgcccactccttcacacgcagcctgctttctcccagaggaagggcagggggaacaagcttttcctttgctttaggcccctgctcttgttttcttaggttattctaagaaacaccatcctgtggtcttccatttccgttaaccgtgggtgcttggagattgtttcccatccttacagacttgcaccctccattgctataactattgtgtgaccctctaccacataacgggcttttcacgcccctgccggtgtgtgagtcctaatttacatgtgtctccattggtctttctaaggggaaagagccctgcccaggcggaactctcctatctgaacaaagcgaagtggctggaaatgtatggagtggacatgcatgttgtcagggtaagaactatgtatgtttgtttcattttattttgctgtttctgaaaaaaaaatgtatagcgtgccaacaaagtaaattttggtgaggaaattgtttttacgttcttctctgtgacgacctgttagaaccctctaccgactgtcacttcgtttgtttgtagggaagagatggctgtgaatattctcttggactgaccccgacaggcatattaatctttgaaggagctaacaaaataggcttattcttttggtaatttagttttgtctaatattaaaaatgtcttttcctattttcttgtgttggaaagtctatgtgatggatgattttgaggggaatttgcaacacccagatttgctttaaaaaaaaaaatcacaccatcctattgtgcttgtggatgtgtggccagtgcactgaacgtctagctaatcgtatttaaacgaatgagtgatgattttcttctcttaccaatctaagcttttataagtagaaaggaaactgtttgatgtgtagacggattggctgtagactgccctttttaaaatgctttctctctgaccaggcctaagatcaccaaaatggactttaaaaagagtaaactgaccctcgtagtagtggaagatgatgaccaggtaggtctcgctccccagagtcctccttgctgccgctcactggcatccctgtgacctttgctccctccctcaggggcgtgagcaagagcacaccttcgtgttcaggctggacagtgcgcgtacctgcaagcacttgtggaagtgtgcagtggagcaccatgccttcttccgtc

SEQ ID NO: 28783 - DNA, 1765 bp, Mus musculus
gagagaggggcagggtttatttgagctcatcgtttgaggttttggtaagggcagcatggcagctgtgctttcagcgatagagcagagaaagaggaacgccggtccttagctcacacagctccccacttggctcagcagccagctagcttcccctcggcccacacttctctgagggtaccccgctcactcacccagtctgtgaaggcttgagttcgcctctgtctttcccagcaccgaggcccagcattggctcacagggagtgaatagaatagaagtgcttcatagaccctctcaagcatggcgtgcaagaggcagcactcccagagccctggccttgacagctttctcttctcttccagagccaatacaagtttgtgtgtgaagcgatccttcgagtgtacgaagaaggcttagtccagaggctggatcccagttaggacaactgtgaagtggtcgttcctccttccctagggcgacttcctgaagaagggggcacacattcccctggaggcccccccagagatgctggtcactgtgggaaagggatgagcttatctgaacccaggcactttaaatttctgtggaaaagataccctgtacataaggactgatggtgtagatatgcatgcagctatgactcctttggcccagagagaagcaacaggggatctccagttgggaactgtgtttctccctacatatcaccgtcccctgtcatccatccttgagcaatgagaggggacaccagcagtgtcctcccgccagaagccagacaatgtggctacttgtggttgctcaggtgttttgtgtgttgttctgtgtgggattccaagggctgaacttccttggcaattcctgtccattacccctgacaccaagggaaactcggatgaatgtaccacaggcagggcacaagggacttcaggctggaggatgaacaggatctattctgcccgccctccctccctccctccctccctccgcctcatctctaccccttctgcaatccaaagcaccccatttcccccaccccaaattccttttcttcaggatcacgcccagtgcctgaaccagcttcatgatgtatgttcaggtgaattctctgccgagactgggaactaggctctgcataaggctgagtctcagcttcggaagcaggcgagcctctgctcactccttgtatactcggacgccatgactggattcgccgactactgaatctctggattgctgctacttcaagctctcacacttgaaacaagacaattttcttggggggtgggggatgatagcatccaaatattcagaattttggacccttcttagaaatgaccttctagtaagtgaccatgagaaacactgcttctcaatcaagggtggtgtgtgtgtgtgtgtccgtctgtcattgtgtctctgtgtgtatgtgtgtgtctgtgggtggctgactttctcaggattcctaacttgattcaaattactgttgagtttatgtaaagaattcatctctgtacagaagaacaagtgtgttgttcattcaccctaggttacaatggtctccatttcatttcagaggagagaatcagactaactgaatataaacacaatttgatgttaatttattctaagtactctgggattttgattgtcctaaagaattctgctctgtgaataccatgttattttttttttttaatttgtggcaggattgtagcgaattactatttaaggaaaataaattacatgaatgctctaaggtggtatttt

SEQ ID NO: 28784 - DNA, 1184 bp, Mus musculus
agagatagttcagtgatcatccaaaggacccaagttcccgtctcagcacccgtattagaagcagctcataacaaccagggcctctacaccctccttggcttccatgggcactgtcatcataaacaaaagctcacacacagacatatgcttaaaaataaatcctttttaaaaaaatgccctaaaattgaccagctctaatcttgacaagttcgtttcagcagtgagcagagaacttgaatgggcttttctctaaaggtggatggccaaaaagcattgtgtgaagggactcattcactgttgtcagtcattatggttgggaaaatccaagccatgaaatactactgtatacccaggagaatggtcttagcccaaagaaaagggaggggaccccctaagtgttagcagggataggaaacattgctagtagaaatgtgaagtggtccaggcgtggtggcacacacctttaatcccagcactcgggaggcagaggcaggaggatttctgagttcgaggccagcctggtctacaaagtgagttccaggagagccagggctacacagagaaaccctgtcttgaacccccccccccaaaaaaaaaagaaacgtgaaatcagctagggtcggtaggaaagttcaacttgcggaggaaagggtttatttcagttacgcttccacactgaaggaagccaggacaggttcaaaacctggaggctgatgcaggagaggtgctagttattggcttgcttagtgttctctctttcccctctctctttctctctcatccttcctttcttttatctttccttccttccccccctttcttcctttttttttttttttttcttcttttttcttctgcattttcaagaccgataggtttctctgtatagccttgtctgtcctggaacttgcttggcagaccaggctggtatggaacttaacaaagatcttcctgcctctgtcctgcctcctgagtgctgggattaaaggtctaagacactactgccctgctctgatatcttaatagatcctagaaccatcccagagatagtaccacctacaatgggctgggccttcctccatcaatcactaactaaaaaaatacactacaggcttgtgtacagccagattttaggaggccttttttttttttttccagttgaggcttcctcctctctgatgact

SEQ ID NO: 28785 - DNA, 1196 bp, Mus musculus
ttcgatgggaaaagctacttcccctgaactagtaaaatttctagtctgggaaaagtactgaagtttccaggcatcgatgagtgagatgctttcccgagcatcccggcatcccagggaaggaacagtgaggtgatacctactctcagctttctttctctccctaaggtgaacctgggcaggtcttccttcctcaggagcccagacagcacaccagggcttctcctggcagtttgctggtattacatcaccaatgtttaaggaacaactcggcccctgggggctggattgggagcgcaagctgtaatggaatctcattggcttcacatcagtgggttcagaagttctcagaaaataagatctgagaaataagaaatggtcaaataggacagaactcaggacttcccatctaaagctgggctgcttgctgtcaaactgatttgacctggtggagagcaatcagtaattttgcactacgatgacagagaggacgtataactctgctattttctgcacataggaacaaagccaattgcaaataccttttgattcccctcttcccttctcttccatgcagtcgagttctgaaagcagaaagttggaagtgagggagacaagacagaataacggggtggtctgagagaacaatttaaatcccacatgtatgcacatgtatatatgtgtacgtgtatatgtatatacatacagagtacatatagaacatttgtatgtgtatacggtggtcacattcagggccttgtgcatgctaggcaaacactgcagcactaagctatacccagccatatatacatatatgtatacatatacataatattcatatgttgtatgcacttcatttggaaagatactgagagggggctgaggagatggctctgagttagaggcactgggtggtcttctataggtcctaggtttgattctcagcacctacatggtggtaatatatatacctacatgctcataaccaggtatgcctccaatcctaggtatctaattccctcttctggtttccattggtatagccatacatgtgatacccaggcatatttgcaggcaaaacacccatgcatattaaaatccccctcccttatttttagagacagtgtttccctgtgtagccctggctgtcctggaactcaaactgtagaccaggttgtgtggctcagagatctacttgc

SEQ ID NO: 28786 - DNA, 1113 bp, Mus musculus
ctggaggccaactgctgtgattcctctgtggatggaacttacaacggaatctcctccccagagcctggtgcagccatactggtaagcagcttaggctcgcctgcccactcagtcaccgaggcagaacccactgagaaagcatccggtaggcaggtgcctcctcacatcgagctcagtagaagcccctccgacagaatggctgaaggagaaagagccaatggacactccactgaccagccccaagacctgctggggaacagcctgcaggcacctgccagccccagttcctctaccagctcccactgctcctcccgagatggggagttcacactcaccacactgaagaaggaggccaagtttgagctgcgtgccttccacgaggacaagaagccctccaagctctttgaggaggacgagcgcgagaaggagcagttctgcgtccggaaagtgaggccctccgaggagatgatagagctggagaaagagcggagggagctcatccggagtcaggctgtgaagaagaatcctggcatcgccgccaagtggtggaatcctccccaggagaaaactattgaggagcagctggacgaggaacatctggagtcgcacagaaagtacaaggagcgcaaagagaaaagggcccagcaggagcagctacagttgcaacagcagcagcagcaacagctgcaacagcaacagctacaacaacaacagctgcaacagcaacagctgcaacaacagctgcaacagcagcagctgtccacgtcccagccctgcacagccccagctgctcacaaacacctagatggcattgaacacacaaaggaggatgtggtcactgagcagattgacttctcggctgcacgcaagcagttccagctgatggagaattccaggcagacactggccaagggccagagcacaccaaggctgttctctatcaagccttactacaaacctcttggatccatccattcggacaagccaccgaccatcttgagaccagctactgtcgggggaactctggaagacggcggcacacaggcagccaaggagcagaaagctccctgtgtatctgagagccagtctgcaggagccggtccagctaacgct

SEQ ID NO: 28787 - DNA, 1112 bp, Mus musculus
ggcaataattgaaaataaaaaggggagcagactcagccttagaaaggtagatggtcagaaataaggtgtttataactattttctattttaaagtgagccttagaggtggttgtggcataggatgagttgttttggatctgagagaggaaaccttaaacacatggggatagaaagagaaaggggtgagagggacaaagaaagaaaggaaggaagggggggagattatttttgcttgaacaaccagtgtttttcaggatgacaaagagaaaaatatagaaatttaagtgcaaacgtggaatcagctacaaatcctaaagatggtgtgtatgcctttgtgtgcttgtataaagcatgtgtgttggtgaataaaggtatgccagtggggtgtgtgtgtgtgtgtgtgtgtgtctgtgtatcgtgacacatgggtgtacagtatttcctccatagctgcctgtcggcttcaggaatgaatgacaattttcttttttatgaaaagggatataacggcacagggcggatgcagtatttctattattgagctgacctaacacggtatttgcatgagttgcagttgtgaagttttgagcagttttgtattggtaatttgacatttagaacacactttatttattctcatgctttgtgtccctgcctcgtgtttcacagaggataccagcttcactcttcctgtcacttcagggaatatgatagggacgctcactaattaggtgccccgagtttctgaatgagaaaatgtttcatttctggtggggaaggggaggcgggaggagggggagaaggcgtggaaggggaaggaggaagaaaaaagaactaaccagccttcattatttttcctttattttaaagctatttcttacaagcaataattaaatccgaccttgctaaaattcatttttgtttttatgttattatgtcataagttctaatatgttattctaataagtatcgactccacaatatttatatgtacactccacacgctatctttgctttgcttttgtttttgtattaaactagtattgactttggggaaaagcttattcactgataagtagtgggcacaaaataaaaagatggagttgtcttat

SEQ ID NO: 28788 - DNA, 1529 bp, Mus musculus
atgaagtggtcttttggcggcagtagattgagtgggaagttctgaagtttgagggaatagactccattagtaggtgagacaccctgtctcttcccgctcacagggcttttatcgctggcctctccatttcccagttgtgctcttttctctgaactgccctccaaagatggccatctgtttcctagctttcctccctgacagttctagtgcattctattaagatggaaagcacagttccatcagagagccagcttttctctgtgttctttgagggtattttaaaaaaattttttgaggggcgggtgtttgttttttctcattcaggaaacatttgagccattgctttggacatatcactgtgctaggctctaggatcccacgtgggccccagtcactttcccaggatggagctgatccctggaggaaagtcttccttccctgccccttaaccctgagatgaagaggctcgacattagtccagcctcggatgctcggctctaccctgcatcagcacatacgctgcttagtctcagctgtaagaaatatttagcttctgtagatgttaaaaaccttcctgaaggaactccacactgcagtgtttatactccagagcactttcctccagagcctgtgacttgacagcctggcctttctcctctagagatgagggatgcagggtctgtcggtggcagaggctgggtggcactgggactacatggtgcatgtcccttcctcttacccatgcatgctgcccaccctaggcaatggcatagaagcagtatatagatcagtatccactcacacacacttatacacatacacactcggtgtgcttgcacacacacacacacacacacatacacacacacacacacacgaacaaggaacaccaaaacagtgttgattgttgtgtttaaagacatgtttttttttcacctgaagaatggacttaaactatgtatttaaaaaaaaatagcctcagtgttagagatggtgaatgtatccagtttcagttacaaaaacaatttcctgaattttaagcattcagtgagctgccaattttgattttgtgttgctttttatccaaatggctttctcttttcttttacttttttcttttttctttgtaaattggaggaagtggggggcggggagcagcaatattgtgtttgaaaaattatactctgtacctggctttcctgtgttatgttaaccacttcaatgtttttattctgctttggttttatagtgtctgtgaggcattcgatgcaactatacagttattttctcattaaaactcaacgtgtatagtgtttttcttttttttttttcttttttccttttttctttcttttttcttgattgaaggattgctctttgttttactgtgaaaggaggttgggagattggttgtcagtctctgaggggcatgccagtggccttgatccctgcctctgcctccccacgtactgaaccgactgaaccggaagaagcaatagtatctggcaaaataaccctacgatgctatg

SEQ ID NO: 28789 - DNA, 1205 bp, Mus musculus
aggccaaggcaggaggattgctgcaagtttgaggctagcctaggacatatagtaacttatgagctaacctggattacaaaggaagaccgcatctaaaacaaaaccagaaataacacttcagccaaatcacatatagtgcacatgcagaaagcactgaggtcatgtccacacaagtggcgtctccctgtctgcattcaggatgatagagttgtagtgatgctgtaatctcagcacttgggaggctgcggccagcctgggcacaggttatctcttcttactaaattaagaggtctttatgtttgggggaaattttgctggaaccctggcttttctccagatttctttatttttgctattagtcttgtcttttggtttgactttttgggttgtcttttaaaaacttatttgagaaagcttaaattaaacctcccccattctgcattctctctgagcctcttatagaattacagcctcttatagaataatggcattgccctggctaatagccctttcatctctcaacaggtgggggagttctccggtgctaacaaggaaaagcttgaagcctctattactgaatatgcctaatcatgctctgaaaagtgtaaccagctaccagctgtttaaaacctgtaccttttttaatttgcaaaaaactatgaagtgtggagagtctatacccaactgccatctgattataaatgacaataaaatattaattctaccctttttaaaactgcctgatgtgttttaatataaatgagaaatggcctgatttagtcccctaagccactgctttaaggcaaaaagataggagctggagaggtggctcagtcgtttagaacattgcctgttcttgcagagggccaaagttcagttctcagcatccatacggcagctacctgttcctccagttccagggaatctgatgtcctctactggccaccatgggcaccaagcatgtctgaagtacatgtacattacatgtaactaacatacacataaactttttaaaatctttttttaaaacttaatatttagttgtagaaaatctcgtttattcggttacattaaaagtcttggggggggggtattttaccttaataaataaacatggtccagaccatgagtgtgactgatggttcacttgtgacgaaactgttgctctgatgtgagattcctgtgccaaagattacagttagctg

SEQ ID NO: 28790 - DNA, 1207 bp, Mus musculus
aggagtcggactgatgctcaggtttaatttttgtcaggttttatcctgattgtctcgcctctattttatttttttctgattaaattgtaaataagtatatcctgctgccccactccctagcaaggggaaaacctggtttacttctccttcatgcccctcttcgaccctggtccctgcttagcaggcaatccgctgtgttttatgaaggacgggcttttcatccaggaaagggcctgccttgctgggttaaagtaaaactcatagccaaccctccctcgaaggccatctgattttcttcctttaaggagtcacctgacaggttgtgcttgtgggtaatggactttcatcaatgttcagactccgtgttcttctaacacacaggcttgtgcgcatgaagagtttgtaggcttatgaataagatgcctgcatactagatctttgggcattctttcagggtttcatttgtgactaattttaatcctaattatggttctctaattataattaatgctgagatatatacatatatgtatatataatttatatgtatatgttaatttaaaagagcataggaagcgtcacctggccacaccggaaggactattggacacatgttttatgtgtatgagtgttttgcctgaatatatgtctgtgtaccacttgcatgcccgctgcccagaggaggtcagaagagggcatcggatcctctggaactggagttacagatggttgtgaaccaccatgtgggtgctggggatcaaatccaggtcctcggatgtgtagccagggctcttaaccactgagtcatctctccagcctcacctgttgctctgagcactttgcatgacagacttactctcctgtaaactgctgtctgacttagtcaatccagagtttattgccagctccctcaagagagccataaattaactgagtatataaaacacttagatcagaactaagtgccagactggttgcacacattagaataataatagtaaaatattttaaaagtcagagcccagtgggcttgacatgatcagtaaagctgaccttagcgtggtgaaacttaacatagggacttgatatgaaacctcctcccgcccctcccctccacaccccaaccccagaatagctcagcttggggggggcagtgatgtcacatatggatgcaaagtgcaggaggaacggtcagtggtagctcagg

SEQ ID NO: 28791 - DNA, 2862 bp, Mus musculus
gtctgctggactccgggattggtcttgttattgctggatgtgtgctgcccgcagtgcgatgtcctggcctatgagaagttcttcctcctcctggccgagttcaactctgctatgaaccccatcatctactcctaccgcgacaaagagatgagcgccaccttcaggcagatcctgtgttgccagcgcaacgagaaccctaatggccccacggaaggctctgaccgctctgcctcctccctcaaccacaccattctggctggagttcacagcaacgaccactctgtggtttagaaggaagccagccggcctctgtggatctgtgaaccccaccctaccccccattgccagggcaaggtggggagccagaggagatgaggacactcctgtacttaacactaaccaatggcagtatttgtccctagacccaagagacttgaggatgaatttatttggcaggccccatcttctcctttggaaaacagaaggggaccgtcttgtggtggaattgagaaatggactctggggtgaccgtgtagcattcactaactagacttaaaagattttatgtggtttggcttaagccaggaaaaaaaaatctgctgaattgagtatacaatcgagtatacacaggcttcccctttaaagaacaaacaatacattgcatttattaatgagtatgtttatgcctgacagcatgtttgtgatcgaaaagactgctaaactgacatagatgagttgtttttttttttttgttttttgtttttttttacatgatggaggaaaagtataaattagaatgatttttgtgtttgtttagaaagcaagcatgtggtgtgtgtattcagtatgcctttctttaaagataaaaggccactattttaaatcttctagggaatagaagaatctagtaaaaaccagtattcatttaggctacaggaaaaaccatatcctaatcaattaccttttaattaaagtaatgaaatatacatgaaaggcaaagtaatgtgagcttgtcacccaaagagtgtgtgctctccaaacgctggaggagatgaagctgtagcgttgtccctgcatagtgaagatacccacgtgcgttctcagtgccagaccctcagtgggacttgttttaaagcctgtggttttccaagttagaaaataatacctacttactatagaaaacttgaaaattgcagaactgtgtgaaaaaagaaaaaagaaagaaagattgctgatatacgacctggaagtagccatctttccctgctcacccacgtatgcctatagacatatattatatacctttttttttttttacataatcgggttgatattgtaaaatgttttgtaactttttctttcagaattgccaggtttttctatggcattttttttcaaaaacagtgttagcggctatataatattccatttaatggatgcagctcagtttatttaaccattcctgtattgttgactatgtttttaatttttttcattattataatattggaagaatcttgtgtatataaaactttgccagtatcattgatgatttacttgggctccattcccatgaaggacctacttttaaaatgtgaaatgtcctcatgtgttgtcactttataaaaagggatattctaccctcaaactgcaggggtgaccatgctgacaaaaagctcagaaattacctttttacaaaagaaacacagtggctactttagttgcgaatgggttcttgacaagatgtttcccaataacccagacccttaacataactagcaaatttactttagtaggaactggtgatccctttctggacacaagaaaacacaaagacatcaagcatcagagtgaatccagcaatgcagtaccaagcagcctgggtggggtgtgctagcaactggctgctgtgtggtctccagcaatcacccaatggacaccctgtgttcagagatgcccagtacagtgtcctggagactaaggtctctaatgtcatgctatgaggaacaaggaggaagaagaatagtcctgaagcaggtgtggagaggtcaggaggacgtctgagagaaggcagtcctgccaagagtggcattctagggaggaggaaggcagggtgtggcttgtgtctggacagtcagtggtaggcatgtgacatttgcctggtggaaaaaaaataagtaggcggagatccagttagcaggacaaagattttgctcgaggattcacaaaatgcaaagaaatttatactggaaatgagtgaaacgaacttggacttttattgatgccctttttatgggggaggtaaggactatttgaattgaaaagcatactaattgaaccttaataaatcattctcaatcagtgtttggcgatgtgtggttctggtctgtgctttttttctattttcgagaagcctctggcttgtgctgtgatggcttctctctctgaccttctttaacagtctgaggcagcccaacaactgttcctttagctcagatactggttcctcatccatgagattcatgagagacgtgttacctcaatggaatgagtactagagcaaggtatttagagagattttttttattatttatttatttattttgaataaaatgtatgtaataaataagataaaacaaaaactagcacatcagaattgggcaaaaacaaacaaaaggaaaagatcctacaagaaagctcaagaaacagagatccacttgtttacacactcaagaatcccataaaacccactaaactggaagccacaatatatatgaaaaggacctggggcagacccatgcagaccctgtgcatgctgcctctgtctctgtgggttcatgggagagttggtcatgttgattt

SEQ ID NO: 28792 - DNA, 1206 bp, Mus musculus
caggctccagagcttccagaggtctccacacgcatggtgtctactcacatggacaagcatacacatgattaaaactaaaaatctttctttaaaagctaggcataaacaaatgaatacattatttccaatgtacaggaaaaccaatttatgataattaaggttagtcttctaggaaaagcttttgactcaaaaggctatcccaaattgggactggcggcacagtctggagtcccagctgctcaggaggctgggcaggagaattgcaagttgaaggcccatgggggatagaataagttcagggcccacctggtagcttgataagaatttctctcaaaataatatttaaagacattgaggatataccttagtataaagcatttgcttagcatccatgaggttctagattcaatccccactgttgcctaaaagcaccccatgtagttacatcaaaatgacttcatatagttacatcatatagttacatcataatgactccatatagttacatcataatgacctcatatagttatatcataatgacccatgtagttacgtcatatagttacatcgaaatgactccgtagctacaggacaatggataagttttattttgtctatggttcactacctgagcttcctttaagatacgttagttaagaactgattcggcaaaatcaaaatgtccttcagagatggactgaaatttgactgtattctgggatgcaactggcctgtctggatggaatacacaaattcgacagcactagggggaaagtagcttctgacatcctgatctgagaagtgaagagagtcaggccttgaagatgctaacttgggtgtagggctagtgtaggattgtcctactttgacttgttccaaatctgtggaattcctgagtatttttgtgaaaaccaatttttccagcccagactggcaatgctttctaccctgctcacccagactcttgggctccctaggaggcttctctggccccttcttagctttggttttgtgttccatatgaaagcaaagaagcaaagatcaacccattaggaaacagcacttctagaaaaaacgactgattcagagagcaggcagtgaacgccttgcttggagggaaggtgtggtcacgtgactgtgctctgcagctgggacctgttgttccaaagctgcccatttcctccctgacccttgcaccagcattcc

SEQ ID NO: 28793 - DNA, 1138 bp, Mus musculus
gccttcttttataaccggagtgggaaatatctagccacagaatggaacacagtgagcaagctggtgatgggactgggcatcactgtttgcgtgttcatcatgttggccaatctcctggtcatggtggcaatctacgtcaaccgccgcttccatttccctatttattacttgatggccaacctggctgctgcagacttcttcgctggattggcctacttctacctgatgttcaatacaggacctaatacccggagactgactgttagcacgtggctcctccggcagggcctcattgacaccagcctgacagcttctgtggccaacctgctggctattgctatcgagaggcacatcacggttttccgcatgcagctccatacacgaatgagcaaccggcgcgtggtggtggtgattgtagtcatctggactatggccattgtgatgggtgctatacccagtgtgggctggaactgcatctgtgatatcgatcactgttccaacatggcacccctctacagtgactcctacttagtcttctgggccattttcaacctggtgacctttgtggtcatggtggttctctacgctcacatctttggctatgttcgccagaggactatgaggatgtctcggcatagttctggacccaggaggaatcgggacaccatgatgagccttctgaagactgtggtcattgtgcttggtgagttctgtattgactgttgccccctttatagcttttccaatgttgtcaaatggccacatacatttatgatcgtagtaaacaagaatgtgaacattcaccaggtgtctatgcagaattatgagtggacagggaaatttcattttaaatgtctatggcaatgtcagcttactgttcttcctatagttatagaatatgctaaatattggtctctgtgctgttgtataaaaatgaggaaaacaaagatatcattgaagagtgttccttctagaattaagaataccaaaacattaacgatcccacaccactaaacccaaaacaaacaaaagcctcagaatacctggttttatttagctttaaaaggttgttttatagtttctattgtaagactctcactcttaggactttgcttcacagatgttcaaatagatagtg

SEQ ID NO: 28794 - DNA, 1187 bp, Mus musculus
tgaatacttaagacattgggaatattatgtggaagaaggataattccaccttctacttattaaggcattacatatcaatgattgtaaacagtttaattatcccagtgtatactgtttacttcagaaaatttcatacttgaatgtcctatgacagttaaagcattggattagaaaacattttaatacctttggctaaaaaaagttaaggtgtggtatgaagaaacttgaatgttattcatagtctaatgttgatgagtacacggaaggagattggttttgtaattgcttgctgctttctgttagttacctccatgagggaagggtagtttttatgtgtgacacattggctgtaattaatctgagaaattttttgcttatatttgattttagaaaatttgcagtctagtaggaaagaatagttttatatcttttataccctagacacaggtttttatcagtttgcaaatggattgtatccaattgtttattgttggtatggaaaaattgaagctaatttaaattctttctgatttgttttagagtcaaacatgaagtttctggagagacagtggtatttcaagggggtggccttggcaaaacacctgatgggtaagtgtgctaaatctaaacacattgatcaactaagggagaataggaatattgtttgttgatggataaataaaaatgacatggaaaaaaaccctactgtcttagattaggttttcttggcctctgagatagagatttgtatgttggaagattattggagaatacccttaggattgtctttgggagcagtgagcagtgttggcctgaagccatacctcactggacactggattcctgaggagcttcaggctaggatggcgtggcccttcaggggtgtcgagccacagagcctgggcctcttgccatacttcttaggcctttatgcctggccagtgagtaatcatttgtggcaggctgctttgtgggaggccatgacctcaaagaccaaagttagttctcggactgatactaggtctagaactgtctgcttctaggaagctgagtcctgaatagacatcttgcaacatagagctacgttaaattcatctaaattttttctgggaatactttctgtgtttgactagtctgcctgtttagtattttaaattaattttgatgttgtccctctttaattatta

SEQ ID NO: 28795 - DNA, 1173 bp, Mus musculus
aggtgtcccagctgagtaggactgttctttctttccctttgtagctttcatagtacttctggtattgtggaggctagactgcaggaagaaggatttcaggttagatccagttccaatatattaagcttgttcttttataatatcatacacatacataatactttctgatatttctctcccttgctctcttttatttcctcccatccgtattaccatccctttgccagcctctttcccctatttattatttttgtttttgttttttgtaaacatttagtttaaccaaggccatatgtattgtaactgtccattgaagccttgcagagtcttttttttaaaaaaaataatagcttttcacattattttttatggatatcaatagattgagtgttagactatcatttacttttattaagtgtcagatatcagcaggaagatgattatgcatcatatatctacttcttttctctattgctcagagtctgatgagtagcagtaaagaagaaatgcgtgaattggcggctttgttttattctgtggttgtgtctacagtgtccggaattgagttaaagtcaatgatagaacagctgataaaggccacaaaagacaatcatgtatgttatcagtttatctttactcttctttgttatttaaataactttggaattaaaaaaaaaaacccgcaggaacctgtctctgaagtctgtgcactgttataatcataaaggtgaggtttgtttttccgttcctacagatttatcacacttcagagctaagtacagttatggccagaacttaggtttgctagaaaacatcagttcctcctttgagcctgtaagacagtgaaaaaatatatgaaattttgtttttctttcagttctgaaaataggtgaatctcataggaccatcttcctgaattagggaatttactgctaaggatggatttacctggttgttagatctttttgagcctgcgtctcatggtgtagctgattctgcccccagacttgagatctttctgccttagcatgttccatcatagcttggccccattctttttcagtaggtgatagggttttacaaagtatttgtactagtttttagttttccatttgtaaagtaaacttataaattcttagcctttataagtaatacttgagataaatgtgctga

SEQ ID NO: 28796 - DNA, 1641 bp, Mus musculus
cctgcttggctaattactcatggttgaaagaataagttcaagactctcctctgtaaaactatttccccagtgcccacttacagctaacggaagagcatagggggtgtacctggttcctgaatgcctatatatttctgtagtaggcagagtcaaaggctcatgttagttcttgtaactttttacagggcttggtgatagaatgtgggcacttaggaagggaaaggtatggggaggcctcgtgagaatggatttaccctgcacagaagcttctgagacataaatcaagaaagaaaaatcagctttccgagctacccgggaacgggtccatacggcgttgttcttgattcccatagtaacttaaagggaaatttacacaatgtccggagtccttgacgtcttgcagatgaaggaggaggatgttcttaaattccttgctgcaggaacccacttaggtggcaccaaccttgactttcagatggatcagtgcatctacagaaggaaaagtttcggtatctatatcataaacctgaagaggtcctgggagaagctgttgctcgcagctcgagctattgttgccatcgagaatcctgctgacgtcagcgtcatctcctccaggaacactggccagcgagctatgctgaagtctgctgccgccatgggagccactccaatcactggccgcttctcacctgggaccttcactaaccagatccaggcagccttcagggagccacggcttttagtggtgaccaatcccagggctgaccaccagcccctcacagaggcctcttatgtcaacctgcccaccattgctctgtgtaacacagattctcccctgcgctatgtggatgttgccatcccatgcaacaacaagggagctcactcagtgggtctgatgtggtggatgctggccagggaagtactctgcatgcgaggtgctatctcccatgagcacccatgggaggtcacgcctgatctttacttctacagagacccagaggagattgagaaggaggagcaggctgctgctgagaaggctgtgaccaaggaggaattcctgggtgaatggaccgcaccagctcctgagttcactgcagctcagcctgaggtggccgactggtctgagggtgtgtaggttccctctgtgcccatccagcagttccccaatggaagactggagtgcacagccagccactgaggattggtcagtagctcccacagcgcaggccactgagtgggttggagccaccactgagtggtcctgagctgctgtgcagacgccagagcaaagggaaaaaagatggaaggaaaataaagttcctaaaagccggaaaaagagagggggggggggggagatctcaatgataaaataagttggttaatgccattggacccatgaggaaggccctaggcagggacaaaattcagaggatggaggctttagataagtgtttgaccaggaaggaggaaaggatttgaatgtattgagataattttgtaatcactctagactcagggtagagactcaagatctttaatactgttttttgtttgtttgtttgttttttactctctgtaagttactaagtgaagccgttttgtagtaggaattaggataagccactgaaggaggagattgga

SEQ ID NO: 28797 - DNA, 3098 bp, Mus musculus
taatctgacaggcagtcagttgatttttatttttcattctcagggtggcacactgtgtttttcaaaacttgattatgctgtggcctggttcatccgtgaatccatgacaatctacattttcctgtcggcattatgggacccgactataagctggagaactggtcgctacaggttacgctgtggggggacagcagaggagatcctggatgtgtaagaagacctctgtgactgatggcgcacagtgtggaatggaagtgttataaattatgtttatagagacactttccagggtctcccttcagtagtttatcacatgtatgttttggtatctgctctttaatttatttgcatggcacttgcatctgtgaaaagcaaaaaaacaaaaacaaaacatgtctgtagtcttggccaaatagtatatcttgtggaagtagagaatcaaggcaattggttctaggaagtgggatttgtttttttttgttgttgtttatttttttaaacaaataaatatatatatatatatatatatatacacacacacacacatatacaggactgctctgcagcagacactatgacagtatccttcagtagggaaagtttcttacctgagttcctctgaatctgtacgggcagaacagcagctccatgagagaagtcatggcctctcccctgtgtgaagtaaatgctatacagagagacgcccgctggctgagaaactttttcatgctttatgcctacctcttgtagttgttgcagagcaaatagaagttagaagttgtaatacggtagctaggccttgcaaaaacaaatggaaaactttttaaaataataataataaaagagctggagtctagtatttatataaatctgtgaggttttttgttttgttttgggtttttttttttgttttgtttttttgtttgtttgggtttttttgttttgttttttgtttttggtctcattacaattgaaccaaaagtggttgagattggtttttaatggtaaccatgaattgaaggcatcttttggaccaactgtcgttggttctgtcttgaaccatattaatcactgtgctgtaattaggagagctgaatctttccctccctgctcccggctcacccggcctgccccatctttccttcgctttttccagggggtgatgttgtacaagtggatgttttgtagtgtaaggaaaatgcatttcagacagtcacacaggagctattttcttacccgggatgtctgtattgttaataagaatgtaatttcatgatacaagtatttaatatcttttttaagtgagtaaaaatattctagctattggcaaatagattacagtagacaattagaggatatgatgaggttgactcttccaatcaatcagtatcaagctaagtcgactgtgtgcgtgttggtttgttttccttttttttctttttttttactataacagtcttatttaaattggatttttgtattcagtttgtatgacagtagactaggccagcctagctgtaaatgcatgctacactttcctctccgtcatgcagctaagcttgcttgtcagcccgtgcttaacttgtggtgaactggacttttgtttaaaataagcaaaactgtaagggacagtgcatcggcctttccccgtcttcttaagtagaagtttgctcatccttccgaattcgagggcgtgttatccatctgatgcttgctgttaaccccagcacttggcagcttcccatccatcctgtgttactatggcttccatctcagcacacagtgtatagcctattagcaataacttcctatgtatagagaacattttcatcttactgagccagcccatttgcctaatgactatacagacagtctaaattgcaatatatctgtaaatgtgtatatactataaatacacaatatacttacatttttctgggccaaacagcatttcctttcccctccttttcctctcccctctcttgccttatgatgaatttgtttgagggcattttcttcatgagcaaaggcttggatgcatattcctaggtttgattttgtttttgttttttttctttctgtgaaatgggtattattatccccaaggagagctgcgcagtgagagccagtctagttatgacccactacgtgttgttttttacattactctttgatgagtcgcgttttgctgagcacgtttgttgtccgtcggtttgtttagtggagtttggtggatgccctttgcactgctgaagtgaaatcttgctgactacttagcttttttgttgatctcagtatgggcaaagaaacaaaatccaaatggctggacagacttctgtaaatatttttttaaaaaaacaaaacaaatgttctgtatgtgtgtgttttacgtggtcatgaagtatttccttaaagcgaagctttgagtacacagagagtaactctttgtttagcaagtttggagtgaagataaaatagcaagaaatactgtaaaatgtcaaagcaccacaccagaactgtaggagtccagatttataataaactgtctttttaaaaagaaaacaattaagtgtctagaatatatcatgttttattatttaaaatcattgtcttaagttttttgttgagagaataaaaaatttgaatacaatcaacgagagtaatggactggctttgtttacttcctgacatgttctgtctcagacatgttgccatattcatcttctttcttttccttttgttttgtctttttgagacaaatgtttctctgtgtacctttggctgtcttggaactctctgtagatcaggcaagcctcaaacccagagagagatccacctgcctctgcctcctgagtactgactgggattaaacaactcttttgctttcatttgtgctacactggacttacagtggggttcacctgctttggttgcaggtaataacacagggctggagaaaatgaggacaggcacctcacccacacatctgcattagtcattctgggtggggctgcacttggagaattacagacccttgatgactgacctctggtacagacccagagttccgtttgggagctcattcctggctgggcggc

SEQ ID NO: 28798 - DNA, 3101 bp, Mus musculus
acgtttcagatgggttaccttcatgttggttgaatagttaggtatgatgattttccagtgggtgttttcccacttacatctgaggtgtattttcacctgaatactgaataagggagggaaaaaattaggactgtctccccaaatttgcttttttttcccctcacacagacattatcttaattttcagtggcattttaaattggattgcttcctttattttgagttgggaactactatgtaatttattaattcatggcactcatatcatccagcataagtgtagcaaaagtttttgagaatagaagggaaatcatactggtgttgaatgtaattctgaagtagggatggcctttaaatatgagagagaacattgaaatccttttcagggatttgtgtagatatgtgtgcgtgtgtatgtgtgtgtataaataagtgtatatacatacatatactcttttaatgttatatatacatgtgcacattacatacattttaatttattgacaaaattaacagtgatttgggaacgtaagatatgcttgttttaaaagagcatgtttgaagccatcagattgtgtctaaaattagctgtagcatatggatgctgtccatatttgagctctttactgtttattatagaggtctacaatatttgtgttggcatagttttaaatatcagggtggtgggaaaattcgatctgtgtatttttattttagcatgcagtattcagtatcttttaagcagtggttaatttgtgctgttgatgccttgctgagttaatctactttatttttcacttttcaaggtatcctgacttttacaaagcatatatattcaggacttagaaaatagcagtacacatttaataatagagttatatatcaagatgttttactttgggatttagatgtgttttgtgacagatgagaatatacaagtcatgcattctcttaattgacaatttgttagaatttcaggattacctggtatccccatagaatgttatgcgatctttgggactaaatactacaagcagctctttgtagcagtgtttgcactgaatgttttagagtcatggttgctgtctttttagttccttctttgtcttttcctactgtggtgattaagggtcctgttgtggttttggaattagcccttatgatccaggcatagtagcacacagctgcaattgaagcactggaggaaactgatggttgtgactttaaacccagcctggactgcagaccatgctccatgctagtcttgctaagatcctgtgtccttccctttccccagttaatctactatcaactttaaagtcttcatgtcatcaagcagagcatttacttgagtatattatcgtgcagttcctcatctagtcccataatgatcttttgtgcctcagtgaatctacttgtaaactccaagcttatctcttagaaaacccagtgtgtactgctatttttagaaccaaaaagcatgactatgattggagcatttttctcagcctttcctttgtcttgatctattgtcaattcgaataaaactgccagacttaaaatactcactatcgtgctaaaacaaacagtttagattgtacataactttgcagtgtaactcagctgtctccttaaggattgtgttagatataagactgtttgcagtccttttttcagagcaaatcctaacaggtacttgtgaattgttttaaaaatagaaaattacagaaatcttaatttggggtgggagcttaaagggagaaaaacaaaacaggaccaaagtttatgtgccttcttcagtagtcttaattgaccttttcctatttgagactaaggtagcactggtattttggttttcaggaaatatctactatatagattaagagactattgtccctcaaactggtcatacaagtgactagttatgactgagttaaaaagtcagctacacttatgccttcagcattatgtgttaccagttgaagagcagaactgctctcggtctttatggtagtcaccgtagctttcgcagcttgtcaggggccttggtgttgatagcagtcataaccgaaagctgctcatagcaaatttcacttcacactgtcagcagaggtttgttggtatgtcctttgtaagaacaggtattttaggtaggaggtttttggttttgtttttgttttggcgtctttaagactatcatcctctagtcttttttgtttcttggttgtcttttgttatttgtttttttccttgccactcattgttacccagatctttaaaaacacatcccatatccaggaagtactaatcaccaagattgctgaccacaccaagttttacactgaagtttcacctcattgctctgaccaaagactgcttgttctggttttaactcaaaggtgaagcattttccctgagctctttcctaaaagatcccatgcagagcggccttgacttttcctttcctattggtgaatagactacttagagaaaatgggagttgaccatgaacagagcgagacagaaggatggacggttgttttcagaactgtatttgaggaaggaatagcacagctagacgcctcgaacattgtctaatgttttacatggtctgttcataaaattcccttttctgtttgtaaggatgttcatctaacagaagaaaatgctgtaaatatttgtaacaacattttttaaaccaggccaaaaagaaaaaaaaaaaaggttttcgggaacaagttaacatataaagtggttttatataaaacagcgattgtcttgtatattttgataagcagcagtaccagatttcatttgtaatacagtttgtggtattggaagaaaaggattctgtgattgtctaagtgaattatgttataaatgcaaagaggagaaaatattaaaaaacgtattttctaactgtgtagtgcatggttaattcaagcttctgtacactacaatattgattccgcttcccttaggtttgtatatttgataactgttccttggaatctcagcctcttttcctaacacatatagcattgtagcatgccttttaataaatgtcatggcatctgtactctcttaaggtttttctgtgt

SEQ ID NO: 28799 - DNA, 1161 bp, Mus musculus
atcatgttttaaatttcaaaatgacactgtctagtaatgtaatgtgatcttggaaaattttaaaagaaaaataatcctacttttttataattgttttcagaaaaaaagtttacagtcttaaggaaaaatattcaggtctatcatatggtttgacagattttttaaaagttatttttggtaaggtcttcttttagaaaaaaaaatctcaagggttttttgtaccactataatctctaatactcagaattactgtgtatttacttaatttcttattatgtgccttattatgtgcttaagatacaatagattagaattttatctaaatatctagaaagataaattgtgggcttggtgagcattctgttattttttcctgtcttggattttaagggttttggttgtttttgttttgtttttttctttttttctcgttgcaattttaagtggttttcaataagtaatagtttctactcagatttttggtgctttgggatagtggtgggatagagaagggtgagtggattgggaataaataactcagtgtgcacctgtaggcctctctaggttggctgccgccagccgtcagggaagtctgagctgtagacctgcagactcggatctctgtctgtctgccttcactgcccgttagattttgtctcaggattacttgattccttctcagcactcaagtgagaacctgattttctctgttaatgcgacttcattacagatagcccacatatttggagtatgagaaagtgggttatttttttatattctgaccctcttacttttttggttgaatgtaaaaagtacatattaatgttgcttcaatgattgtgtcatgtaaaattactttttaatatgaaactgcttttgttaattatttcttcaatgcgtgattggcttttaaaatacagaatttgtcagaggaatcaattttgtccaccccttctcacttttaataatctcagagtggatcatctcatctttttaaaatatctcagtctttactttcagccattaatttgaacattcttttaaaaaaaaaaaagaatgaaggaaagaaaaaaattgtataagctgaaagataattataggttgaagtcaaatcagaattccctcaatacagagcaactattggtaggctaggcagggaaa

SEQ ID NO: 28800 - DNA, 1019 bp, Mus musculus
tatagttgacactctgatattttcacagtccttctgtcacaatggatgacctgaagaacctgttcacagaagctggatgctcagtgaaggcttttaagttcttccagtaagtccttgctttctaaagtaacattttatttaacatggattgctacttttttttaaagtagtttagcaaagtccaaaggaagggaagatttaaaagcaacattaattctaagtatttgtgtattttgtcattttaggaaagaccgtaagatggctctcattcagttgggatctgtggaagaagcaatccaggctcttattgagcttcacaatcatgaccttggagagaatcaccacctcagagtttccttctcaaaatccaccatctgaccttcccgtgaaattgtctccttatactggaccacagtttctgtaagatcttcaggcacagactgaagcagctcaagaccatttctgcctcttcacaaaataactcttcgggaatttgatattcgagaacagtcaaaacaagagagagtccttttcttcctctcgttttccccaacagtgtatgatcaaaagtttgctttgcctttgtattgtggtttctatgaaaataactttcggggggaaaaaatcaggaaaatctttttaaaataatttaattccctgaatgagatttaaaaaggacagagtttctttctgtttgggtccagagcagccttacatgacatttctaaactcctttgtactttgagaaatttaaacatacagacttttacaatttcttgatgtaatttaaatcacctacaaccaagtttttttaactttatgattcagaagtttccctgtagaaaatgacattcattcacttataaaaattataccagatatttgcatctattgatagttattatacataactacatggagatatattggaaacaggtttataaacgtgcatgctttctttcagatttcttttttccccccactgtagcacactcctttaaataatgtccatcttctct

SEQ ID NO: 28801 - DNA, 1166 bp, Mus musculus
caacctgttattggctaaaggttgacatgtgaaacctgaatgtgttaaaaataatagcccagtctggcatgtctattgaaagtatattgggtcctgattttgttggtgctatcttaggaagtatagattttcttgaactttcttgtgataacaattctttcattcttgtttgtttaatctgacatcttttctgcctttggtactttattcagaaagtccttccctaccttgagatcagataaatagttaggtgatgtggtctgtctcagtgacagagctggcatagatcccaggcatttgcaatgattttaaaaaaaaaatttaaaatagttgtctggggctggagagatggctcagcagttcagagcagttgttgctcttgcagaataggatgcacttctcagcacaaccagtcataactcagccttcagaggatcctgtgctgccgtctgcatacatgcatgcagccaaaacacacacttttaaaaatagaatgaagtaatttttagttacctgttagttcctctgcttcttctgtgtccccctttccttcgctctcttttgacatttaaaactctaaggtagaatatattggggcgggggtaagagttgatgtcattttctgcaaggttctagaataatttattgaatagttcccatttccagtgatttaatgtatcacatttttgtttacaattgattctgtttctagtttttactttcattgttttctgtgtatttttcttgttacaattttaccttatgattttgttatgaaacaaaataggttcagaaggaagtgcagtagtctcaattgttcactgtcctttttgaaaaattactaatgtaaaattgagtttaatgagcttctaaaaattaataaaggtgtatgttgtttcctgttatttggttcacgatgacacaataattaatggtttattttgtcagaaatagaaactgagttaaactggaggaaaaaattaattgccttatagatcttcaggcaagcgttactccagggtacagatgccatcttgtttctgctgtctccaacctgggcttccttaggacagatgtgcttcatctccacctcctattctaagtgtgaagttagttgtgctagctgctgtcatgtctgttagctgatagaacccatgtctcaccag

SEQ ID NO: 28802 - DNA, 1686 bp, Mus musculus
tcttgactttaactatgcttttttattgtgagatgtattagaataacctctagtgtaactggttcttaataaatgtcactcagtttccagttatgcatggggaggcaaactccctgcatcttataagtattggattccagttgtagctcatggaccaaaagggggtttctgtccattggcattctctggagatcaaactgtacagtatctgtattattggcctgagacgtagtttgtgcaatctatttgggacaaacctccagtcaaaaggattgcatttttatcgacctaattaagattttctaaagtgaatttgttttgtgataaagggaaggtggtagccgatgatacaggtctctagcaggagataagaaaggctaagcgtggtccttggattagcttgacttttttctgaaaagaaactcaaacataagaaatttcccagacataattttaaaacttatcagaatcagtagagacaatagcaaattttaggatttttaaaagtaaagtgtaaattacttgtctttttacagactgtttgtcttgatatgactctggagttagcatttctaccattctgcatttgtttccgtgggagctttaagaatgctgtggcctagttttcttgtttgtgttgggtagaactaggaagccatcagttatctagactcctaacaattattgtgcttacagtgtttatagtggccgttggatttctgtgttacaacattttataaatcacataccttagaatactttgctattgatttataattaattatttatactgggtgtccatatttagtattaatccagacagataacctttatctaactgaacttttatacctttaatccatgttacaacttttaaaatagcattataatttttaaaactttgctttataaagcatttgttaccaaaaaaaaaaaaaaaaaaacccaaaaaacaaacaaacaaaaaaaacccttgccaaaaaccattacaattctatgcattgtgtgataacggagtggttccacggctttgcatgttgttctaggtgctgtttgcggagtctgtaacgttgttgtgggatcgttacccatcgatactgtcacttactgtagttaggctgtgccacccacatgtgtgttacgtgtgacctgagaaagtagtgcttcgtctagtattttgagccagcacttagcggcttcttcggaaggaaatgtagtcaccgtgcagtgccaagctgctgttccgcatgtgttgttccgttccagagagagccttcctgccacacacctgcagaaaagagaacagcaattctgtttgccactgagaatcttcttcttttaaacttgagcatttttatggcaaagtccagtagaagacagtggggcagcagggcctccccggtcaggtatttttagtttgaatggtgtagcagcagaagccttcgaggtgcacacattgtcttaggtgtcagcatggctcacatagaattgcatctataagagtaactagtaacttaggggctggagagatggctcagtggttaagaacatgtatggctcctctggaggacctgagtttgagtcccagctatcatatatatatatatatatatatatatgatagtcccacatatcaggtgtctgtaattctagctacaggccaaaacctctgcacatacttacaca

SEQ ID NO: 28803 - DNA, 1185 bp, Mus musculus
aggcactaggcacaaacatagaggacaaacatacatgcaggtaaaacacccacacacataaacgataaataaattgcagttgtaggtgctacctccctattgccccaggcctctctccggggaatggtttgccaggtaataggttatcagcaggagatcccactggacacgaagaggttggcattcagctgtatcttaggcatgcaatgagttttctttctttctaattaaaaatgtcagtaacatgcttcacttatttcctccattgctgagattctgttccttacattgtaaacttgaagaggaaaccaaacctgataatgtggtccagtgagcacacccatgcctgtgaattctacctccagcacaaccaagcctgatacctcacacaagcaaaaacaagagaaggaagaccagaggggtcttcagaggccacagtttttccattgttttctgtgttttaaaacagatgctgtatctaaccaaagctgtgaaagaaatgttctctttggtcaagtgacatggtccccattccttggattctgttctactttgtcagctgagacccataaatggcgtttgggaaaaaaatgtgaaattctattaccttttgcattaattcatcttattaaaagcgtaaagcatttcggcatgttcagagacacaccattaagatctgaacaagatagtatttatgtggaaactgaaatgtcctgacagatcctgggcgatgattcacggctcacttggcagccagcttctgctggcaccaccctcagctctgctatggtatctatctctcggctggctcatctccagggttcacgagtcacactgctagtctagaatttctcagtatgctaccatgccttcttgagagatcttttttttttttttctaatttccaggtttccagtttctaaagttaatttgttatctctagacaacattgctaattttgtcggttgaagctaaaggtggccatattgttaccactcaaatgaacaaaatggttatatctcatcctttcaagtatccatcttttatgagacactgattactctttaaggggggtgagggcgagcttactttatgtatggaaaatgcaaactagtaagacctcaaggaagttggctgatttgccctagacaagctctgctgtagtctaagctaaggctgagcctg

SEQ ID NO: 28804 - DNA, 1152 bp, Mus musculus
acagggccaaacttgaacaagaacagaggtgcttatttatatatgtacctcccactaccctccctttgccctatagaattagagtttgattaaagtgtgaaaagtatggcttagggagtcctataataccttacacaaaggtgtcatgattaaaattctattttatgagggagttactttgtaaggatcctgtcatttttctgtacccaaggattgaacctaggactttaacagttatggatgtgttttaccgagcctcatcaccatgggtaactgactgcatctccatcctctctgctgttgggggaatttaaacatctttagttggggcaatattcagttttactcccttctgatagtttgctataggtgttttcaccagccacatacgccgtcctgctcagtgcaagtgaagcagcagtgagcagtcttcctgagtcatcacactgctccctgtgtctgctgctgacccagggacccccttgctcctgcccctcaaagggccatccagcttccctctgcacctcctagtagtcttcctcgtcttgcatttcgctaagttcctgtgcagtgagatctgtgcctgcctgcctgcctgcctgccatgcttctgaacctgctactgacgttaggcagagagaagggtttctgctgttgaaaccttgcctgctatgtgactttgtaatctaggtgcttgttttcccttcctgggtcagatcaaatacccggatgaaagggctgatctagattcacagtttgaggcacagtctgtcatggtcaggaaggtcaaggcagcaggagcttgaagcagttggccacatctcctccacagtcgagaattcgagaacaaatggattctactgtgctgtctttatgtaaccagtattctagccagggagtgatgccactcatcagtgggtggagcgtctacctcagttaatactatcagtaattccctaaggcatgcccagaggctcatcttgtagtggttctagatgttgtcatgctgacagtccagtcccactaaccaggaggactttccagtggtcctctgcttcgggtacgtacccatttctgtgggtacctattaatatctactctggtatatgctgtgtttgagggacaaaaaggtcacagagacctgcatatggg

SEQ ID NO: 28805 - DNA, 1190 bp, Mus musculus
attgtttttgttttgtactttagctcatatttgagatcagcaattgctggtatcctcccagggatgaatggtgtatccaagaagagatagcagtccataagtaaaaatcatattttggggtaaattaattttatttaacgttggtttattattaaagtggcattattatatttcagagaactttaaaaaattagcattagggtagagcattaacattttccacacacaatggtgttttgttatcttttttctagatattgcctcatctagatctaacatgtagtatgctatcaaggtcattgttctggcagaatatggtagttgaagcaaaatgtcttccttccttccttccttccttccttccttccttccttccttccttccttccttccttccttcctccctccctccctccctccctccctccctccctccctccctcccttccttccctttttcttttccctttgtttttgtttttgtctgactatgtagccttcctggcctgggactccctatgtaggctagccaggctatcgttgaactcgcagctttccttcacatctgccttgagtgccttagactgtgtgccgagggagcagtgttctgtggtctctgcttgactggtcccttcagcaaagcttgtcagcatgtgcaacagggaaacaccattcctcctcgccgatttgtgttggttcagcagtatgtgaaattacattattcaggagggaaaaaaacctacaaccctttcagagttaagctggaggaaattaatcaaatgttctagacaattctgaagaataactgagtttcatttcctgagggcaggaaaaaacatccccctcaaaaaaaaaaaaaaaagaaaaaaaagcaaaaaacccaaaaacccaaaaacccaagccaaaccaaaggtcttatgtttcctagctcctattgatgggtggatggatcgattggtttttaagacaaagggtttctctgtgtggccctggctatcttggaaattgccttttagaccaggctggccttgaactcagagatctgtcagcctctgccccctgagtactgggactaaaggcgagcaccactgtgtcaggctccatcctagctccttgactgtgcagcctgctggtaaactgccattcagctgtgcatgggcggaaggaggggtgtcttcgccttatttgatt

SEQ ID NO: 28806 - DNA, 1221 bp, Mus musculus
tatagggaatatgcttttatttcagatttcagaccaggttaagaagctaaaagcatatgtaacataaaccccaaactctcaagtactgtgtgcaatgtcagtgtttcaaaattaaaccccgaagtttccaatagactcttgtaacaatttataagtaggattttttttttgtagattccaacatatatctgtatagatacttgaggttgtttgtttgtttttgagctagggacctattatgtagctcagcctggctttgtaacctggcatgatgtttagtttttcttgccgtaatcgtctgaatgttgaggctacgtgtgtgtcacagtgtcaagttcactatggttgggattcatttccctaataattgtggtgggcatcttttcatgtgctcattggctgtttgtagatctggggggacgctgccaacattgctccacctctgagcttcatcactacccctacttgtccatttttaaaatgcatttttaaacatttaaaaactcaaacattgtttcttttattgtattaatcattgtacatgtggacataggtctggcacataggatgtttcttacaggtacatgtggtctcctgaacaaatccactccaccctcatcagcactgtttactctcttacagattcatgttgtctacacatatgtgattttgcttatgtatgtagaaaatctagatgcttcatacaagagaaaacctgtgatagttgcttttctgagacaggcttgattcactcagttgcctgtaatgacataacttctgtggctgaggaagaatcgatgtgtgcacagcacgttttcctcgtcctttcttccctgccacccctagcttagccgttgggaatcgtctgtgtggtgcactggcttacagtctttctagcagataccctgctgcataacagggttatttagcagatctgctttcagtttttttaaatggatttttatgcatggattaaacacattagtgactatctctgagtcaccaataatgcatcggtattgaatgaaggaaagaatgttcccttggtgtgatttaaccaagaatggtccagatttgaattctctatgttccccgagtcttctgtcctctcttgtgtgatgtgaatctgtgcctgcctgaaagctgtcttgttaatatgtccctgtgtctgtgtcttctgagtctgtcagttgtatgagctgcgtggctatgcttaaacaa

SEQ ID NO: 28807 - DNA, 2630 bp, Mus musculus
gtggagagataaagatagcttttgaagcttgaacacatgccagtgagatgaaagttggccttagcaactgcccaggtcctgagaaatggagggcttgttcatggggttagaaacctgcaaaggcagccgggcgtggtggcgcatgcctttaatcccagcactcgggaggcagaggcaagcggatttctgagtttgaggccaacctggtctacaaagtgagttccaggacagccagggctacacagagaaacttcgtctcgcaaaaccaaaaccaaaaccaccaccaacaacaaaaaacaaaagtccaaaaaaccaaaaaacctacaaaggcaaaagaggtttgagagccgtggttgtttaggacagttgtggtttgtagcaggaaaggacactcctgatgttgggaatttgcaagaagaatctgggctgagctgcttcaaacaaggaggctttgctctggagtgaggagggagtgacccctcagcctgtgtagggtccagttttatgctctcggaaggctcagcagtgattgctgccgagtgggaagtagcttctcccagctgttcctcacctcaccagatattttcccaaagccgaaacaagaaaagtcagcatgcctggggctagaagcggaatgtaagatacgtctctatgccaaatggagttgtagaatgtaccctctcagcccataaacaggaggaaaccatatgtgaacactacagcctctggcgagggctctgtggagattttaattttagaagggggcatgatggcagtgtttctcttttaggacaacacccacggaacactcaaaggctgtgtgacttgtcctgtcctgtggcaccgaagccctaggtagctggctgttttgatgaggtcatttgaatcatgggagtgtccttacactacactatcctgagctggttggggtgggtagaagaaggcaaggactgcctgagaggctgcgttgaccctactgatgtgggtcttgggatgggctggaacagggttcctgcctgagtaggtggaactggcaaccttgaagggtgattcccccccacccccagaggatcagctgcctgtggttgggacagggcacaccaccttccctcagacggtcttgctaagtatatgactgggagagtttggtcatttttgtgtaccctatggtgggaatgtggggttgcctttcaaaagccttcaggatggcaacagattggatgtgctatctcagtgcctgcaggtctctctgctcgaggcagcagggggcgctttgcagtatagttgaggaaaatgaccgctccttgaccaaactgagatgcacttggtgtgtgggaactgattgcttcctccctgtttataattcagtgaataatcacgggcccaatattttactaacccactctgtaggttgtcagtgttccattttgaaagtgtccccgtggttgcacacttcagaggacagggactctgtgtgtctaagaaggctgggatgagggctctgttacagggcagactgttctctcatagtcttatctgtttgaatattcctgggtatgactttatgtgtggcaaaaacccacattaccaaagtagtttttaactactgtaatttgtaaataagtgttgtggcaggtgggaacctttaaaagatcagtaagatgtttctcatatttatgaacttagcacttgaaaaccaacacactcagaaaaagccacagattgttaaaagcctaattgtagttcgtaacaatttgtcagtacgtactaattgccttattcttcagctagtggtttataaagaggctgcatagaaagttttacacatggaagcagctgatgtagagacttcatataggcagctgcagtcctaaagtctcaagctagagggtgggggccacggaaggaaggcagcctttcaggtagcaagattaaatattgctgttgccaaatagtatttgaaataataccagaaaacggggaccacagtactgttcgatgttttcaagtgagaaagaggaatgtagtatgctttggcatagtttgggagtggagaatacagacattatcagcagtgacaaatcacatagcttcaaaaactcctccagtttgtgacaacatgacaggtgtgacagcatgacaggtttgctctgcttctgcagagtgggccccagaggtcacttaggactgagatgctccaaagtttgaagtgccaaataacatgaaacgtgctctgtcgactcaatattaaagccagggtgaagagttgcaaacccctctgtccctgcagtactgcctgagtgtgtggtgattctgggctctccacaaccagctcaaagcagctagcacccgtgctcactgttgttggacgggctggtccacagcctcagacccacgctctgccgagatactggacgggaggaaggatttttcctagactgcggattggcgtgacaaagcaatggctgtgtcagctgggccttcatccaggaacagaccaacataaaccagcatcttctaccagttagcactgtcctcctggaccatgctgagggttgggcctctccctcagagtcctttctcactgtagttctgtgtgcctgttcccttcatgcctgagtcaggaatac

SEQ ID NO: 28808 - DNA, 1141 bp, Mus musculus
actgctctggttctctcaccctcctgaggagtggccctgtattctcttgggtctggagagggtgtgcttcctgttgaacgaccatggagcccactctgtggccatggagcctgctgaggagtcagagccaggcctttccaccaaacaccacagagccagaatcctcctctctcctgtcctggtggacaccaggcacagggagaggcgaggcctggaggatgtgtggagctggttgtgccctaggcaggatgcccaaagcccagtagaccctggggatcagggcctgcctgccaccaatggcccctttgccatagtgagtgctactgaagcttaggttgtaaatgtcacctcatgctcaaatgctcctcccatcccaggaggtaaggagctgtgtctctttccccacctggaaggtattgggaagttcctaagagagcagccctcacccgtggctcctgtgcctggctcacctgggacctaacgttctgaggaaataggtgtattctgctctgtctaggtcgtagtctctggtctttggttcattgtcctgtgatacaatttctaagggctgtttagtaattcttttgttcttctgggagatagcaagaaacggggagcagtgttaataaccgggcctctgagcaggtgcagtgaaggagcccagaaatgggtatgtgtggaatgccaggaagcctccctccccatccaggtcagggggcagtggtcgggccaggcccctggaaagctgtggtgcaggccttgcaggctgggacctgcagcaggtcctcctgctgactgaggactgcagccagctcatggatgttagatgggcgggggaactggactgcctcacatcctttgtaggttttccaatgcctcgccctgtgatgtgtcatgctgctgccgcacaacctggcttcagaggtaccagggagcaggatgatgctgggatggtaaaggagagcatctctgcaggcaaacagggactccactgctgaccccagcctctgactcccttcaccttgctgccagggctatgtctgagtgcccacactttggacagcccctggaatatctggctgggctcattttgcctctgcttagcccccctcccacacacacacatccactccccacatca

SEQ ID NO: 28809 - DNA, 1347 bp, Mus musculus
ggtggtaattggctactttgtgatgctggctgtcatgtcctacaacacctggattttcctcggtgtggtcctgggctcggctgtgggctactacctagcctacccacttctcaacatgacttagtgggccagagatgtgcagtgcggagggctggagagagctggggcctctgttccagacattgtacttcagctgcttttccttatggtggccattgctcacctctttcccagttcctggagactttgagatgaaaccagcaaatggtccctggagcttagaagccattgaagctacctccctccccagcctctctagggcccaggctcctgtggtgccttaagcaagtagctgtgaccaaagggaacatggagagaccagaagctggaggtagggtggccagcctgtgacacagatctctgactgcaaattaaagttttccaaagagcttcagtggtcaaggccatggaacctggatactctcttctgctttgtgccttaatgtcagggtcatctccagcctttaggggacagaccacgccagctccttgttctcacctttttgccttggaacacatgaggattgtcattgacaaaacaagcttttcattttcaactcctggttggcagttttgcacattcatacaaaacaaaatttctaatgaactcattgtattcaggatggatggcagtgtctgttgagacttgtctccccttctcgagggaagactgatgctgattaaaggcagagacccaggactgttactgaggctgtgggcttgtcctgtgtacagatgagctcttcctgtctgacagcactgcctgcagcaggttagtggtcagagccttgcccgagcctcttgtgtgcaccagagaggacagcatctgataacagagctgactgccccttatatttccttactgctaactcctaatgatctggtaggaaatgtgagtcagtcactttagtactgactcagcaggggtgtgctggggctgggtactgactgagggtgcaatagcaatcaaaccaaagctaggtcattttaagagtttggtggactccagatatttgagccttttcactttacacagaaaagttaagacaggaatggggacatatacctgtaatcttcaggatgtgggaggctgaggcaggagattgcgactttgaggccagcttgagctacatagagagttgcaggccagcctgagatacacagtaaaacacacacacacacacacacacacacacacacacaacaatcactgctacatactttataatgtctgtgttcaagtacctcatgggcccaatgaaaagatggttttaagaagttttggga

SEQ ID NO: 28810 - DNA, 1326 bp, Mus musculus
cacagcaaattctaggccagtcaaagctacatagtgtgaaacaaaacaaaaggaaaacagtaagagttggacatagtgacaggcacctatagtcctagagcatggggtgtagacacaggagtatcaggagttcaagatcattctctgttaggcacaaagttggaagccaaaatttgagctacgcaagctcctgccacaataaataaacaagtaaggaaggcaggggtgatgaattcctgtagtcctttcagatggacaaattttaacctctgaaaagcactgagaaatgtgctagtgagtcttgggattgagatcagctacttctagagcccagttttcttcttcttgtctactggacactatccagaacagactccttatttgggttatcactcttcagccgggaaatcgttgcttttatcttgtgttttttcatgaaatcttaagcaaaattgaacagaatggacactgtagcttgtagtgttgacatgctttcttgtattctgataataaggatctcttatttatggtttaagctatctgtgttcgcttaaccacaatgtgctgttagtaatatctttggcctgtgactggtgatttgaatgaaaatagcccttacaggtcccaatcatacatttaaatgtttggttcccagttgatggaccttttaagaagggctaggggtgtggccttgttagaggagttgtgtaactgaggtttcaaaagcccacagaaggctgggtcttgctctctctgcctataacttgtggatcagatgtgagctctcagccactgctctaggaccctgcctgcctgcctgcctgcctgcctgcctgcctgcctgcctgctcccatgcttcttaccacgatgactggggattgatacttggaacctgtaaggaagccctcagtgaaatgcttttcccccctctaacagcaatagaacagtaattaagacaaccaggtatcatccagtgagctgtgccttgccctgcacaacctcctcctgtttcattactgtttctttcccactgcgactgcattcattgttgtggctatctactaatgacctggtcatggtcaacagcctggaacttcattgttctccatgaaatgtgccttatgagtatgtctcctgtctctagttttatctttgtttttcctctccttttcctttatcttccctactgcaggcctactggggtaacccaaatatactctttttccgcattggtactattcagggataaaatggtgactataacatagtctatagaccagagacatcccaacagaggtttagctacctcagaatcccttgagaaa

SEQ ID NO: 28811 - DNA, 1166 bp, Mus musculus
atatataattaactaaaatttaaatataattaattaaaaactaaaagttactttattgcataataattaaaatttataatgaaagaatatatttagaaaaggggtattttccttatatattgctttataaactgacttttaaacttaatgttatatcataaatgcctatgtgaatgtcaataatatatgtaaagtgtattgctttaaagacaactaggtggccttctctctaccataattccctttactctcctgatagacatttaagttgatttagaattcagtaattatcaaaaagtgggcttattttcccagaagacaatatttggtgctggggaaagctctaaagtataagaataatccagagatgacagcccttgaaccacagcacagcaaattatagtcatatgactcatgtcatatgacatcttgtctttgcttgaagcaggaatacagggcagctttgctcagagttaacagttttggttttatgaatttttaagaatcttttaatagtgagagctaacagctgggtgtggtaacacacactttaagctcatcactttcaattaaggcagagacaggaggatctcggagtttgaggccaacaagtccccatagcaagtttcaggacagtcacgatgcatagagaaaccttgtctcaaacaaacaacaacaaaagacttaggacaagcgtcctggacagacatgaccaagccagcatgctagtgaggtgcagtgacttgctctgctctgtccagttttctgtgggtgctctgaggtctgagactgcttggtggaagagttgggtagctgatggtggttctgtaggattatattaattatttgatatgatttataggaagaagatctcttactcttgcataattgagttcttcctttgtacaactcatatccctgacaactggctttctgcctgcctttccttcctctttcttgactagaaatcctgtattgtgagccgagttagagacaggcagcctctgtcttcagctaaaacctacacatagtgatcaacccttgtgtttttttcaggatgcaactgttctgcgaggagctgggcagtcccttgtgacaccatctatccagccttctcttcagccagctcatccggtattaccacagatggcctcacagggtaagaa

SEQ ID NO: 28812 - DNA, 3001 bp, Mus musculus
gacttaaatttcacactagaaatgagctccagtcttaactcagtgaatgggaaacacatgttcctctctccaggttacactgaaacctgtgtagtgtgtacagagtgggtagggactaaacacaggcctagcgtctatgagtctgtattcctgctcagtcatcaacttgtgttcctattgaacatttgatcagaatgaacttgccaatcaaaacaaaaacaggacaatcaatttaagacaacagaaatagagattgttaaataaaaccattagtattttactttgactcagtaccttggtttgtcccaactgaataagagtttgtattgtgtgtgtgttccttgaaaccaatgattttcaaactttacagcttcagaatcacccagagggcttgttaagacactacttggtggacctcaaccccagaaccaccaaatttggcatttctaagttcctaggtgatgttctactcacagtcagtccagaggattaccttaagagtctctgcattaaactagaaaagttgcacctagaagggacagagggtggggctacctgctatcaggcatgaacatgtgaattgctggttagtaggtggtatgccttgggcacatgtcacatctaaatgctgctggtcgatactttatcattccacaaacatttattcacttccaaatatgttttatgtatacccacatacagtgtgtgggattacagccaaagtatacttgtcaacatatacgaagtctctagtcctaacttttaaagatctaaggttccttggaagttatttgaaggccaagagacctttgctctgctgtgtgagtcagccagtcaaaagcccagaaaggcaaaaacccagctttcttgtttggagagacatggggcatgtgtctgccaatagccagttgttctcagtgtgcactatgtaggtccccatccactacttgaccacctttatcatttacggggatttacatagattacagtggccaagacccctttctcaatgaaggatctcattggacgtcctgtcaatcattaatctacatgcaggcttgttcccacactacctctttaaagcgattcttcctatgctggtctgttcaatcctgccctctttggtgctagatccagttgtgcctcagagcagaagaaacaaacctgctgtcttgttggcccagtgtttcagttttgaagtgtgtactttctcctctgtgtgtgccaattacatattagagaacaaggaatgtgtactttggtggctttgaaccaagaaaaggttttaagcctactggatggagtctaaaattcttagaaatcaactttagagctttgcttttctctgagttcatcctgcagtgaatgacaggtactgacagcccaacattaaggtgcaaatagcctgtttgtcatatcagaagccatggaataataaacccaggggaatccagaaaccacacttagtggtaaccctggtgctctctagaatctccaaatgagctgctataaaacacctttcaggggctgagatgcagctctggtgtgagtcacttacctagcttatgtcaggcccctaaaagtaatgcataaactgtcagaatcgggaccttatcgttgaggtgaaaagaaccaaggcccgtaggaacaaggtgctatgaatctgaaaccaagagaaacctcagtttggcatggttcttcagggtagcttccgagtagaaatagtctgctgcaaatcctaaacttaagatccctgcgctaggttgctagagactgcggttagtgcagaacagaggtaagcctaagtcccatcctcatgaacttcaatgcccagcctttgtgtttattttatctaaatgtctcctttcatctgtgggaaagctatagctgagtgtctttagcccctgccctacttttccctctctgacttttttcccaggtagcttagtgtttaacatctctctcaccatcctgatgcagtagcatggctattgctgaggttattttacctaataattagaactttgtatttacaaagcaagtagaggtcttaaatttgcttcaagaagcagttgctccactggaatttctataaagctgggtaaagggttagcagaattacagatcttaagtactaactgcagtccaagatggaagagtactcagcagccactgccctcatcaggaacctcctcggcatccatcagtctcctcactgctcctgtgcgcagggctgtccctcccacactcccttccaggccgtggccttcgcttcctcattagaatcaggagagtgaggcacagtgtccatcatgccatttaatcttgtgcctgccctttccagcctcttcaaaagatgcatccaaacaacaggtctgcatttgatgtaatgccttaattactggggccacattcacgttgactgtctcagagactgtaagctcccggagagcagggttgctgtaatgggaatgtttaagtgttgtgtgcaagaaaacaaaataaatattttgattttcgtgattctatgcatgtctgtctacacactgtccaaataagctggttctgggacgtcagtctcctccatggcatggccttgttgctctcctgccactcttaagcagacctggtgcctgccacagggtcagcatgaccttgtgcatagcacatagcagcaaatatttcagtataggagcgattcttaagttcagaaactaacctttgccgcctttcatccgtagttcataacccctgtgttcatgccattaggcggcagcactagcttccaggaggctcccgggcagactgtgcccatccctgtagcagaggggaagtattactgttagtggtctaaccgctggcccatcatcacctcttctgcaatgctgtggtaaacatcacctttggggacagctggctcaaatctaggctacaccacataggaactgctatcctaactgtctcaaagccattgatagtcaagtgtggtgacacatacctg

SEQ ID NO: 28813 - DNA, 1128 bp, Mus musculus
acccgattccaaagcaccgtgttttggagcagccagaaagagtggtctctgctcaggacttaagtaagagcagtgcaaagagagctgcagcacacgaagacatcaggaaaaggctactaaggtccacactagggtccctcagctttcctcctcctcggcccagacccgtaaggtaacggccctttcccacgggaacccccggcctctctagggcaggcctgagcttagatccagagctccgtaccgtggaggaggctcgtgaggaggccatgccgggcggcggagacgcgaggccctagccaaatccgcgttctacttttcagaccgggaaccgcgcgcctagcaaagtggaagtgcgtcactggccggaaacgtatcagaaacgtactacgtgcgaagtatcttgggaatggtagttgccaaaggtcggctggagtcgaggggcgtggccttacagagctacacaacctcgcgggagaagaggagcatgggaagagaggcgcagagcagcctgggaggtgtagtttgggctgcgcagcaatggagtcatggtgggagttgaggttctggggaactgcagaggcctgaaaagaggtaggtttgcggatcgcaaccataatctggaacaaaacgagggtctctgttatccttcgggaggccttccgccatttcgaagctgaggcctgtgttgccatggaaatctctccctagacttctgcagccttggagctgggaaagaggactgttgtccacgacggaagtccttcgggggcccctcgtaactcggtggctacgtaatcagtttgggcttcaagaagatattaaactctaagaccttctaaggctaaaatagagatgtggtggaggagctgcggcctagtttgttgtgggtttacttgtctacagcctattctttgtctgtgttctttgaaataaagggtccatgaaggctccagataaagagcatatcagcagtagtagctccaatgaatgttaggccatcagagataaggttttttttaaaaaaaaaatccttacatgaaagttgtgggggttacaaaaatatgcgcgtttgccgagctgaacagactcacttccacactcaaggccctgccccgaacaactcca

SEQ ID NO: 28814 - DNA, 1188 bp, Mus musculus
aaaaactgtagatgttgtatagactcaacacttttcagtgccctgcctcctccctcacactcaggattgtgaccgttctttcatttttgttttttttatttggcattttgagacagaatctgtaagtatatccctgactgtcccggaagccttacattgtaagtaatcctcctgtcctgcccttcgagtgatggcattatggaaatgtgctgctgtgcctggcagttgtatttttagtgcttgaacttggctctctataacatggtatgtgcttgggactacgggtgattcagcaagcaagatagctggactggctaggcagtggtggcgcatgcctttaatcccagcttgggaggcagaggcgggcagatctcttgagtttgaggccagcctggtctacagagcaagttcaaggacagccttttctctaccctgtctcgaggaaaaaagaaaaaaaagatagctggactgtatttgaaatctccccagttatgaggacatgtcaccaccatttgtggcgagctcctttcctgacgccgagaatgaaaccagagccatagactgcagctgtgtgatagctccacagtaaaaaagattttccctttctgtggtgttcacgaaggatgttcactgcagctgggactcagaactgcacacttggccttgttagagccaagttagagcctcttccttttggctttgaagtttgatatccttcatgacaaaacaatctggccattgtatccagattcaaaggggttttaaaaacaaacatgatgtctgtgttgtacagcctccttcctgttggttatttaaagggtgtaccttatgtattaaagaacacttcatgtcaaaggaactggaaaaaatcctaatttatgtttgggtgttaccaaacataaacttttatatataaatacacacacacatacatacatacacacacacacacacttgctgagagtaaaatcttactataaaaactctttgaaaggattattttctatttcagcattttgtgaacctaaccatttgtccaaagagatccccttctttagttttgagatctaatgtaattctaggcctgaattgttccactttctgttactttattcagatgtttattgtggtgttttttgaggggggaggaagtagcaggtttttgtgacaaagggtcttactgtgtag

SEQ ID NO: 28815 - DNA, 1178 bp, Mus musculus
tgaaattaccattttcttgacatcttacagtgtttgtaaaatgatgagactggcatagagccctgcattcgggatctggcacatttgagttctctggtctgaaccttactaggaacttaattttcggttgatccaagagagcattcgagttggaaatgttccatgtaagccttaggccgagcaagtgtctggggaagtaatccatttcttcaaccactgtaagaaaatagtggattctgaatggcagaaccactgtcatttaaccctacctcagtggtgcatcaggcacattaagagaattcattcttttaaggttgctgggtggacttgaataactgctgaattacccagctgtaagcagtggaactatgtgaaccagtatgaaatgattgcacagtgctttatggagaacgttggccattggcaagaccaggaccgggcatgtggcctgattgctgactggtcagcctttttacctctctgcctgtggatgccatggacaaatcactgactttatgaacagtggacttttcccactcctgtgtcttgatttggagcttagcagagttgaatcttaggataggtgatacttcttaggcaccgctgcaggcctccgtccctaatctaagcacacccagtggaagtgctgccaatgtaagtgggtgagactgcttgctaggatttgattctgaaatatcccggcactgttgtgccattaaaccctcaggacataggacctggctggtacaaataagtcaccaacacagggttgtcggaagtttttagcccagcttctatctccagctgccctctgcttcctggtatgctctggtgtggtgagcatctgctacaggctcctccctgtgctctgtaccctctgaaaccttgagccccaatcaacctcccctccagctgtctctaacaggtattgtggtgactaacactgccccaaggttagaactaacaaatgctaagtaagagctaagatcctaaccctctgtctcaaaaaaaaaaaaaggaaggaagaagaaaagaaaatctgttcagtataacaaactactagtttttggtactccccggcatcctgagaatgtaagttgtattctgaaggaaagggactccaaggttaaccctaggctgagcctcggctccagcatctgcttccttgggccagggtc

SEQ ID NO: 28816 - DNA, 1159 bp, Mus musculus
ttagtacgacagacactgctaggaatagaaatataacaaaggacatggtgtttgcaactcttgtgtacggtgtgatacaagatggctgcccttcatatacaagttagtgtgtcctttacttgatgtaattcactctgtggcagttaaatcctttagactttgcacagactttgggctctgtcacacctggcttccaaacatgggaggagtggggggggggtgtacattctttttcttttttcccatgctggggattgaaccctgagccttgtacatgctaagcaaacactgtgcctctaacctacactcccagctctgccttcaaatggcaaatctattagttgaaagtgctatttaagcttagactataggtgtccgcgtttataaaatggggagttatgtcactaggcaagattctttgggtgactgactgagatagtttgtcgtaaaacacccgtcagggttcttggcgggtggcagctgttcctcagagtttagtcacccactctcctagttttgaagtcagccacagatggtggaatgtgcttgcctgtgaggatactgcactgagaaaagggaaatctgttcccctgggttgttttgaaaatgtctcatctgttcagacagggctgcaggccaggactgctgttactcttctgagcccctgaggtgttagagcagagttcagaggccccacttagcacaggggctgctcttctggctgcttcctgctcaccagtgccagctttggttcaagtctccaaggctaaccagaaggccagcctactggtacctctgcccctgagcaccgaggaaaagcaggtggagaaggatgaaggctgtgggacaatggccctgctaacccgagcttaccagctcaggatccctgagaggagatgaggcatgaggttagccagctaatggattacagcagaggaccacctgctgtggagacctgcctgctaatgactgttttctccaggtcacacacctgtgctgggtcccgagtgagccatacatagtccagacctctgaggataagaccatcaggtgggctactggccgctgtggaggtgtttctggtgaaggtctgtggttgctgccgtgcttacatgactgtctccattctgctgcttcatgacgctgcgcccttcctagg

SEQ ID NO: 28817 - DNA, 1281 bp, Mus musculus
cgtgcgtccttccctcaggtgctcttcccagtctttgctgtggctgaccagctcatctccatcgttcgcggacctctggccacagtgagactagattcacctccccatcacccttgcaggtcaggccatgcttctaggtagtgttcttttcctcaatgacatgagtgttccccagggcaacttctggatagcagcttcagactcagacataacctttcaatgtttcatctgtggggatcctgtttcttttctgttggccttagtctcccaaactcaccatgcttgtgcccttccaagggtctcattaacctgtgcctctggcatccagtgtggtaccttgtgcatggctagtatacaacaaggtacagtgggggcaaatggctgggcaggcaggtaactggagaagtactgtagtccctcaaagtgcctcgctgcagagcagcttggactgagccttctctagcctctcagtccagtagttcttggtctcttgcatcatacaccatgtgaagagagtatttttttctagcatacgaaggacaacctgccaggatactgttggccagaacgtcgtcgtgggagtgtggtagcctcctcccgcctcctctgtctccaggaaacctgcttgcagcacacttgttggcatctgtcccaggccctgaggctgagctctagcatggacctacgtgtgagaagggtgacaaacattccccctcactgtgctgctgaacaccccatttcatgactcgtagggtagagagcggcaagcaagaaaagctgagggcaaaggagagctagccttaataaatcaatgtgcgcattattaaaggtttctaaagacttggtaatgtctttgctggtaactggctccatgctgattggcagccttaggtacatgcttagaaataagccggtcagagctccccttagcatcaagagactggagatgttactggaaccaagggcaagtcctttggccatttcttctataaggagttcatctgagaataatggtcttcttgccaggactggggatgaagcttggcggcagggcacttgactagcacgccaaaagctctgagttcaatcccaggattgcaaacagaacagtgaaaacaaattggggtggtcacagagtttggctggtggacaatcactgctttgcttcagccccttattgccatgcacaatgtggtcccaggatgaatgactgggagatctttggagaacggtgtgtgttcatatgggagtgtgtgtttgtgtgtatgtgtatgagttctt

SEQ ID NO: 28818 - DNA, 1109 bp, Mus musculus
atcctgcttccttacagcgtacaggcgggagcagaaaggcaagaaggaggcttcggagcaaaagaagaaggacaaagacaaaaaggattccgaagagcaagacaaaagcagagaggaggaggaggaggatgaagagagactggacgaggacgaccagaacgaagaggaggaaatagacaactgaatggagagagtaggcagactgtggcgtggtggaggggaccctgagatcctgagacatgtctgtgtgaaggctttccctgcaaggcagagccatcttcggcactggtgcctgagatcaaaataaaagctgaccagaaagatcaaaaagaactcttcccaggctcagagcatctgagttacagaaaccggtcatgcgtcatcagtctgcaggttaggatgtttttgaataagcgattctgagtgactacatagtttggtattgcttgtctacttaaagtatatggctagctagtttctgatcccatttccctgcccctctgaataagtaataacatccatgttgcctgcagtgttccaagtcacagaagcactaaaggctcagggggaaacaatggggctttgagcctggtcacccagtttgactgtacagtagttgaccataggaactcgtgcttagaatggctgctctctaggagatgactaaggagctgtgagcgagcgaacgaggaaatgtcttcacctgatggtagcattacttacttggtgtctggctttctagacttacttagctttgtagtcctctagtgactgtagatgctcagtcgtctggggtggctgcactcataggacacacactctttaattctgagtgttgattagaatctgtcaaaaaaggtgccaattcttaaaagcaggggcttaatcttggaggtaactcagtgcctgccatggtaggtcctagtgctacctcctggaaggtataaaatcccagatccatctcccagacttatggctgctgcttttcattccctgggctcataacaagttccagagactttatttcttccaggcacagcctgttctgtctccatctctctggcttctgcttcccagcccggctttctcctcctcttacttatttcatc

SEQ ID NO: 28819 - DNA, 1135 bp, Mus musculus
actaacaaactggctgcttacttgagctgctttctgtagacccagtctctgtcatcctcacgctgaaacatctggagttttgcctaccagacctgtagtctcagcaggctgaagctattgcaagacatctcaaagttacacttgggccaggcacagcaggggccgaggaaaaaccttcctggcttccctgctgggttttttcctcattattttgtttattcacacagtgatgggcagcgtagcgatagggttaaggtcatagcttttggagccgggccactagaatccgagtcctggttctgatgctttgcttactaagtaaacttgagcaagctcagttttctcctcacacggtgctggtaatagcaaccatcgcatgggttgttccaaggattaactgagctgtattgctagagcacccagcacatggtcgaggtgtagaggtgtctagtaagctgtgatgagaagctgtaaactgcagttagtggttgagcattgccgttgtgttaggggctgtggacaccaaggagaagtccttcccgtgtctaagtggggttgccagggaggacttgactttccacctaatctctttgtccttccttccaccgagcatgagtattgtcaagcttttgttgtggccctccatatctggactctacagcttggcttggaaggccccacatttccctataggcttcccattggctcttgctatgcaagataataatgtccatctccattccgtctacaatacactgtattcctcgggaatgtgactaactaggacatcactgagcctcaggaaggaaggctggttttgctccttgacccccacccccaaccccagagtcatcccttgtctttaaccctcctccagggtttttgggtcctcatcacagcctgaccatactgtgtcaccccgaggtttggtctctctaccatgataggagaggtgttagggtgtggtcagggctaccttactgccattgataatcaggaagacacaagaggtcaccaggccagacttctgcccaggaaagccacaccctagaggggagggatacattctcagagaacagtagctaggatacagtacagagaacaacaggagcccgggtcctttgctcctggcctt

SEQ ID NO: 28820 - DNA, 1109 bp, Mus musculus
gcatccggagacggagttccagcacagaagagggaaggagactccttaggagtcaattctagtaaaagaaataaggctttaaatgtcttacttaaaaactaatatttgtataaacagcaacatgaaaccaaacataaactaagtggaggtcattctggaaagttggagaaatatgggattactggtcctgttgtgcataaattctgctttcctcattgaaaccttttgttaataacaaaaccaagactttttaaaaaaaacaaaagaagagcgtcatgctgtagcccacgctgacctgggactcatcactttgttaactaggctacttccggccttggcctctcaaatgctagggctacaggtgtgccctaccacacctagcaagacaatattctttttaaaagactatttcggggctggagagatggctcagcagttaagagaactgactgctcttccaaaggtcctgagttcaattcccagcaaccacatggtggatcacaaccatctgtaatgagatcctacgccctcttctggtgtgtctgaagacagctacagtgaactcattcataaaataaagaaaaaaatcttgaaaaaaaaaagacttctttttcttttccaagccaacagaggttcctaagaatccaataatgtctataaaagagataggacagccagaaatgtcccactaagatgcacccttgacctagtaatatttccatggaaataaagcaaaaggagttgattttaagatatcaacttgttttctttatggaagatgtaaatttatggaaatgaaaactgaggaccaacctaaacctccagcagcccagtatgggatagatacattacattaattctcttctacaagtattacctagccttgagaagtattaagacaaggtagagcaaaattctaatatgttatgacttggataataagaaatatgcttatataatacctagaataaaatgtctcaatattacatggggaatgtaagggagggagtctgttttggacaatcttttctttctttgtttctaatttgacttgtcaggttatgtaaatatttaacttttcttttacattattaaccttattatcttaa

SEQ ID NO: 28821 - DNA, 1189 bp, Mus musculus
ggagttcttgtggtctttctaccccaggatctggactgacatctgcagtgggagatgactttcaggtagacacctactgtgtggccctaatgcacaccatatggagagagtgtgtatgtcagaggctctactggctgggtaccatcctgtccttctgatgctggtgccaggcattgggctgtttgtgggtagctgctgcccagtgccagagagcatgttacctagaatgctcttagagagaggcgtactcacaagacctaaggcagctgggtttcagcatttatgtttcttctttgcttcccagagcacattgttccattcattgtgttagtaagaggggtgtgggctctgaacccctccaggcagctgcaagcttgcccctccaccctgaagctgtgcagtctccctttggcacatgaagaagaacaccacttgcaccctaacttccctgataccctggtgcttccccccaatggactccctacatctctttcttattttcgtttctctctctctctctctctctctctctctctctctctctctccctctctctctctctctctctctctctctctgatctgatgtaggttctgtttttctgtatctatctgttgaatgtgtttgtctggtacttatttgctgatgtcttctgagaattttagaagcacctttaaaagaaaaaagatttagtctagtttgagcagaatggcttcttcaaggctgggcaggagacagtggcctcggaactggatctgtgtggggaaggtaggagctgagtgtgaaggtgtgattgggtgggtggccatggctgggcatgtgtctggcgagaatccagaaggctgaccggggaagttctcctgagtcccgtgtgtgtgtgtgcgtgcgtgcgtgcatgcgtgtgtgtgtgtttgtgtgtgtgtgtgtgtgtgtgtctgtgtgtctgtgtgtgtctgtgtgtgtgtgcacgcgcgcacgcacttatgtctgcttttgatttcactcacaaaacatttggaaggctcactggtgttataatatcagctcctttgttgctgctgatgggtcccccactgtgaagaatctgagtctgtttgatcacttacctgttcacttgggtcagttccagctttaggctgacatgaatggagcttctgagaagtgcttttgtgatgctgtctgtgggctt

SEQ ID NO: 28822 - DNA, 1148 bp, Mus musculus
gggattcctacccctaccatgctgtttagggcctggatctgcctgttgtgaccaggcctgcacagagtcaggaaggcagtcccaacactagatcagttgacccaggcttggctctgtctcccactctgtgactcagagatgctgagagcttgcctgaggacacacagctatctggttcaggtcaggaattcctgccctgggtttttcctagtcatcagatagggaaggagagagtatatatccccatgtggggaaactgaggcccaaaatgatgagggggagggtctggtttttcatttacatgtgagcctccggtgttggtggcctgtgagtctccgtaagacttctgcctgtctgtctccatctctttctcccttgatagcataactggagagattttctagtttccttcacagggcagagtagtatatgacctgtatcatgaaacaagggatctgggaaattcagaggccttccctatcagcgtatttcaagcacagtagaaagcatgcaagcttgacctgtggaaggacttccagaaattaaatattttgttcttatagctctctaagttcggtggctcctcctggaggctgctgaatagtcccgtggtgggtaccacccctgacaagtgatataatgataaacatcagcttgccggagaattgttaatgatgcttagcttggtcttgactagggcacaaagaggtggctggtttataggctaggagacagagcctggaagctcagtaggtcatctgttgaatgctcaggctgcgctggtcctgcatccaccctctgtatcagaggagcagattctggaggcccgagcttggctgaaatgcttttagatgtctgggccttggcatgttgctgtccacacctctggccctgtgaactgttgccatccagagtgagggtggagccttgccctagtctattttcttccgcccagcctggttctgctcacagtataaggcgaggcgttcagtcccagaggggcccaacctgggaaagcggaggagccacgtagcacgcccggcagtgagccaagttcattccttgggccatgggccaggctgctgcagtcaggggttggggcaacggaagaaggtagtgcctgctgccataggctaatgtgcagtcat

SEQ ID NO: 28823 - DNA, 1204 bp, Mus musculus
atgagctctgctctcgcctgctcagcttgttgcttgtccacctgtttctagaatacattagacctggaaggaaccggtgagaccacccagggcagcaccaacgctctcccggatgtgtctgtggtaaggccctgctttgctgcactctcttctttgttcatgacccctgggctcttctcagggttggccacagagaggggacacggggtgggtggtaggatagagtctctacggagaccccaccaacccagctgattgcctgctctgttgcctgtgtggcactgggcaagcttcttggaccctctgtgtcagtgttttctcatctgtaacatgaaaaccctgcaccttgctcacagttgggggccagaagaagtcaagtggtttggtcaaagcatggagacagtctctctgtggctgtcagagctttccaagtgtggacactggcctaaggaggtcccaggagctggtggccgtgatccacttctgcgcatactgcaccctgcacctcaggcaccctgctggcacatcatgcacgctgctgttctcatccctgcttaaaccttctagtgggtccactacgctcggagatgcaccctgtccatggccaccctgccaccctgtctcctcctgtcccaccccgtggctaattaagtcttgtcacttgtgatgagcccctgctgatgccaagaacttcgattccctaaggaatcgagtgggtccccagagacacctgccgagatcctggcgctcctcagctgctgagatgcagggaacagttttccactgagcgttgcattattcaaagcagtgtggccaggagctgaggagcagggactcagtctttgccgggtccagcaccactcgctgtccctctccatccactatgggctctgacttctactcttgttgggtcttttggcaggatgatgtcaaatccccctcagaagatctgcctggtatcaagccacctcctcccccaccacccctggctcaaggtcatgaccgcttgcttggccagccacggaagccagggagggaggaccccgcacctctgtcttctgctgcccactcaggcattgtcttctcagcaccacggaaccgcagcccgccgccagggactgctcccactccgggaccttcctcagcacaggactctccctcctcccccatttatgcctccatctcccatgccaaccccagttcc

SEQ ID NO: 28824 - DNA, 1433 bp, Mus musculus
gcagggggaggctgggagtcccttaggcagggcagaggtggggggctgagtccttcccatcgcccctgacctctgcccttgttctggctgggactggatgttcttgatgctcagtctgtctcctggccaccaccttataagtggcctcaggctctggagaatggcctcctttcaaatcctggcttagtcccgtcgcttgctgtgtgtcctcaagagcagttctgcctctctgagtttagatgtaggatccataaaaggagggtgatcatttctgtgctatgtagtagagatgcaatcagactttgcatatgtcatggcctctgcctgtctggaatggtctccttcccacttcccatagcctgtaccattagcttggatggcagatcttacaggaagccttccacggccctctggaaggagtgacttccagttcttggctctttgtactttcatgatcaggagaggtatagtcagtgacctctacttggtcacctgtggtttacagaagtgaccgcatctcagtcactgctggatcccaggagcttagcacacattttagcctgtgtgaatactgaagccgttattgttaataatagctgtgacttgtggagcagtctctaagcattctctaagacccagtcccagcatttcttaaacaagtcttctgtggccttcccagtgatcataaccactaaggccctcgtgttccagagaaggacactgaagctcagagaggaggagcaactcactccaagtcacacagcttgctggcgagagaccagtcaggacggggtccctggcctgcttactctgtgtggtgttgtgaaccctgtcctctgattctgcctcttcctgaaggtgtttgcccagcgtcacctagcagtcagtctgtcttttggtctatatgccatctgtctttcacctccctcgtcttcctttctgttaatctttatgggtgcatgtcacgtgctgtgtgcagcctgggtatactacagggcatcagagaataataaagatgttttcttcaactggaattcagaggacagcagggataacgttgggccgagatgagtggcaggcacaataagtgataagagctaaataaaatagtagaagggggctggggaagattggcaaggcacacacacttgaggatgacagcaggagcagcatatgcaaaggtcctgcggtttgagcatgcctcttgcatctacacaccgtctaggagggcagtggagccagaagagggcaagtgcagaaagcagtaggtcatatgctgaagagtttgactaggaacaagatgacgcgcctgacctggaaggatacagcctggcttatctgattattggatctctgattattgagactaaacaaggagtacacagacacaggaattatcaagagctctgtgcagatggtgcagccagttgcta

SEQ ID NO: 28825 - DNA, 2280 bp, Mus musculus
gggggaaggggagaaggaaagagagaggtaagagacaaggagagagcaagagggtagccaagcagtcccttttataatgggctgggctaccttgctgttgccaggtaattgtggggaggagcttacctggctgtagccagaataccaggagcttgggacattgtctacatgactgattgacacaggattatggagttgagttgatgtggtgtcaggcgcttgtgtctgggagcatagcttacggtttggtcccttgtagatttttctacttggtctcccgagtaagcctcgctcgaccagaacatagactgcctttcacggtccaacactataaggtgtgtgttgccttctagggtaagctgctgtcgcaggctagtatgacgactgatttaaataatgtgagtctttctcccacagcagaatggagggggccttttggtctggtatacagctctacccaagaactcactctgggctgtagatcgccaatattcatcagcccctagcatgtagtccttccggtaattgaacctgagccatagtagcccccgcttaagcacccagaacaggagaagaaagaaaacatagggtgtgcctttacatgtgaactctgtacacattaaattctgcaggagtccagatccaggcatggactatgcacagatcatgatcctggaagacccttggatgatgggggtcttggactggaaacagcagagaccaacctgactgactctgtaatttgagaatgtattaaaaggccctgcacagtcccaaaagtggagctgagaaactcagggtgcatctgcagaaggattcccaccacagtgacctatgtccttttctccagacttctttttcagggaaggagtacctttttggctaacagtatgccttaaaccttagctggtaggaccactagcactgtagctggtggggggaggacagttgctcaaggcattgtggggttctgtaacttaaaggaggccaggtatcattaaatgtcccctacagagccaccgtcctcctcttcctcctcctcctcctgtcagaaagtgggctgtttcctactggaaaggatgaaaacaatgatcgagggcccctgcagccttaacctctctgggttctgcttgcatggttttgtttgcattgtgcacatgggtgcttctgggacaaagaataactgtcactcctgtcctgccaacatccctctgctgttttaggatcttgattctaacagctaggagaccacataccttcgggctcggggccaagctccatcctcgagattctcttggttctctctttttctgtcaataagaccataacatttacttactgtggtttgtgttctttgctcaaacatcaatatgaaggattcagggagattccagtggcttgtgggaaggtggtggtgtctaggaggctgcttggtgtgcacaggatagtagccagcaggcaggtcctcctgcctccccaccaaggatgcccactttaggcccccttgaggggtgttatcatccacctgggttacagtcaaggccggctttgcagcatcagacagagaacttgctttgttctctgctgtttgtttgttctgtgacaggaagccactgtcctgggtagaacctgaattcagagctgaaatggctgtaattttggctggtcctgaagtcccatggcttgagcgttgtatagagtatttcctgagtccttgcgccccgcccccagagggaaagtaccaccagaatctgagcctgagggcagacagtatcgaggtaagatcccagatagcaagataaggaaaatctgcatccttgttcccctttctgctttggcaatgcaagtaccactggcagggtagttgataaggtttgtttggctggaggctggaaagcaggaagttccagaatgtcacacctgcacttgatgggagccttggtgttgaaccactgcttggtgacagattgtcaactcaggtctctcttcctcatcccataaagccaccaccaatgccacagagtcatagaagacccacccaggcttatctattgctagatacctcccaaggcctgctttccaaataccattggcatatgaatttggaggttagttttctatacacggcaacttggaggacgtagttattcattctatgggtacggtagaagccagtgaagaaaaatgaaattccaagaagggctagggagtgacaggaagtggggacctctctgaaaaaatgactaaggagccaccaagtaccattttgaaacctgaaac

SEQ ID NO: 28826 - DNA, 1197 bp, Mus musculus
cagaacccccctgttttatttagtagaagacacttttcagttttaaaaaatctgtatttttcgtttatgatgcagaaaggaagttaaagctcagaagtctcccagaagagagattaattctatgtatacatatacgacagaacgagaatccaattaaaataaagtctaagaataaaagtgttggagcccctgggcttcaaagaggaacacagcttttaagagaagggtcaagtaaacaaagtttactcagcttctttccctggtagatcttacatctattgacatgcaagggatttgctgaggattttatccagtgcccacagggttcccgttcctctcttaaagtccaactatcaaatcagcagcgccaggtcctgactaagcaaatcacttactatgtagaattatgttgaaatgtttggtttttgacagagagagagagagagagagagagagagagaaagaaaggctatttggaatgaataagatttaaactaggaatttaaaagaagaaaagtataccttgcaaaggtctccagccaggaagttcatagactgcttgctgtattaagttctgctgaacgcttgctatgtgtgaccttggacaagtctctgatatcatctgctctaggctggatgagtctggggctgtccaaggtccttcccagcgctggaagttcgtgatttgcttgaaatgtgctacccagaaggcaggtagaccgtctgatctgctgcgctcttgttcttttggaattgccttcaattaaggcaagagaattggctaaggtttgggagaagagaagcttggcactcctgggtaactttgtgctaaatcgggaaatccatgtgttacacactgtactgatgggcccggctgtcgtctctcacccccatctctcgacccaagaacaccagccctggtgtgagtccaaagggagtgggaattgccagtaggactgggacacaaacaggagcatcttgggaccactggagatcaagcccactcacccactggatgttttagtcccttgttaatacaggtagtgtgtgtgtgtgtgtgtgtgtgtgtgtgtgtgtgtgcgtgcatgcttcataaaaattaaacagccttcattgcagccccagcattcccacaggtaaatctgagtgagtagcaaattagaatctgaaatgttccagacattaagaagcgtttgt

SEQ ID NO: 28827 - DNA, 2041 bp, Mus musculus
ccctcagtcaatgggaacgcgacacatggactctgcaaggatcccatgcccctgccagctcatagaagtacacgttctgggcacaggatgttgcccgttcctggctaggtgacctagggatggagatgttcctcttcctccaagactgagaagtgggggaggagtcaggagcccagcatgggaaacagcgagctcagatgaggccagcatttgggaacactttagcgagtctcagtcatgtaggccttggggtcaccaagcgcacaccagatgccttcttggcatcacatgctcgcctggccttgctgaatctggtggatgagctggagttacttgggcttgtggcctgcgtggagggtcctttctgttgcctgaaaatccctagagaactacagcaggctccacagggcaagtccctgacttttggagtcagaaggtgagactgaggctcttagaggatgctgctccctcagcattgcctcaggctgccgatgtcacagtcctacctgcttccagtgggagggaagattctcagcagggtgagctagcttgtgagctacagtactgtctgggattgttgtctcttagcactcaggttatagaggaccagggttggaggacaggggagaggaggagtcaaaaagccgatgcccgtcaacacggcgctggaaaagaagaccctgttggcctcagactgtctttgtgtggcaacacgctttcttgagatgtgattctgtcctgctgagcagcagcggtgttttcagacactaacattgttctggaatgacatgtgatcagacactctgagcttgtgtgaagaactcagagactttcccaaagtttgaagactgtccacagccctatgcccaaagccctggtctggtgtgaaggtcttactcaaaaaccaacctttgtggtttttgtccccgacaaatcatcattataagttggaactcttccttgaactggcatatgtattcattcctgttggactcttattcctcctcaaaaccccgctctccatatccttcctgctgttctttgtctcattgaaatccccttatggatattttatgttattccacgtttctcctgtacatacctctttttctgtcaagactgtaaactcctcaaggcccaacattgtacccatcttccttttgtgaatgacctggacttgctaagaaaaaagaaaaaggtctgaaaagtcccatggattggttgccttacccgctccactggttttggcaaatgcttctggcaaacatggttgagtgataagacccaggtcaccatggacctgagatctggccttgagctgcatcactttacttgtatgtgcaccctccgattgcccatctcgacgggctggatggttttggtaatttccagctgcttgtgctgtttgttattcttaacttctgtgcacaaagtgctccctggaccccaagctgaggtgtccctggtgggagccttcagagggagcaccggcctgagctggtaacctggattcttgctgcccacctgccatctctggccggggctgtaagtgaccatggctgagtgcacaaattgattctcagtgtgtccactgactcctttatagggtgatgcagtggaccggaaccgcgcaactcaggagatttttctgggggagacaagtcctacctcttgtgttctgtgtccagaatggaagcgtcccccagccgtgtgccagggaagccttcctcagtgggatcgttcactgtcttttgagccacgggaaatgtcactgtgaagttgatccagggaagcctgtgcttgtccttgggtcacaggactcttgagcgtagggatgggaaataaaactgtttggtgagtgatggagcagcttgctcgtggaggcgtggtgtggtccttcgacattctccctgcctactggatgggacttatggggtgagcccacagtggacgtttctttgtgtgtgcctcagtttcctccctttgtaaaatccacatgtctcacctgcttcacaaggttgccaggaggctgatccatcca

SEQ ID NO: 28828 - DNA, 1873 bp, Mus musculus
ttgtgataaaggctaagccccctttcagaactgctgacacaaatggtctcagtgtctcttgccccttgtgcaattcaccttaccatcagcttaagcttcttaagcctcaacagcttaatcctgttcaaaacctctcagacctcccaactccttgttgttgataaacgccaagccagtcaagccaaagtgcgtaacatcccattaatggtgtcctgtaatccctctttgcccatttctattacccacccccacctaaaattaagtagaactaatgcaaagcagtgcttctgtgttatttaacccccctgcctttctcatcccagagcttttacttatgcagcactcttgctatctcagacattccagaggtacacttggaatctggcatgcagtaggtgctgggtggggttttatgttaagtgaataaatgattgcattagccagtgagaggaagcatctttgccgtgagactatctgggaccaaactgattcttttgcctgcccacaggaagtcattgtggggcctgacaccacctcctacagcctggcagacctgagcccatccacccactactcagcaaggatccaggcattgagtgggtccctgaggagcaagctgatccaaaccatcttcacaacaagtaaggggttcagagaggaacacagtcttaagatctgaccttgtgacagctaatcaaccttccacttccccttcaacttctagtttacattttcaaacaaaaatctgaaacgtatcaattccctattagtgcttagaagcctggggaatgtagatgtaggcatcctagtgaaatgagtagaggaccaatgagagctcatctacatccaatcctcacccccatgtcctactggatacagattagaagacacctatattccatgagccttactttcttcatctttgcaaagtgatataaaaaaaaacaaaacaaaccaaaagactcccctccttcacaagtatctcatgggagaagttgaggtatcatatttgaattcctagcttatctgtggctcttatactgttaagtttaatataagctctgtcatgaggaacacagagaagcaggggctgcctgcttgtaggaacctagtcactgcatagatgaactgaagtgtgtttggacagtagccacctcctccctccactctcacactctttctctttatcctgcagttggactcctgtacccattccccagggactgctctcaagcaatgttgaatggtgatactacctctggcctctacaccatctatataaatggtgacaagactcaagcactggaagtctactgtgatatgacctctgatggaggtggatggattgtgagtacaacagtgggttttagagttctgggacatgggcttggatgaagggaagtgtgtactctcaaatacatgtgcataagactttgcaaggtaatccttgtcacatggaagcccttcacaattatctatttaaataaaaaatagaaggcaaggactggatatgtagttcagttagtagagcgcttgcttagaatgaagaaggttttgagttcaaaccccagcactgcagaaaaacaagaacaaagttgctaactgtctacttgcactcagaaggtagaggcagaaggatcaggaattctaggtcatcctaaaatatcagttttgagccattctggactaacagaatgaggtggcaggaggaactctgctatgaatggcagtgacaatcaaaactactagttactataaccagtgttggctaagtagttactctttaccagacttctgataagaatgtcagggcttatttcaatcccatgaccatattgactgtataggattttcttttatcaataaaacgtgt

SEQ ID NO: 28829 - DNA, 1207 bp, Mus musculus
aagttcaatgcctgcctgggtcacattcaagataagcctaggccaggtggtcaaaatagattggatggcattctcagagaactaatgaaaatgtttttaaagtaaaaagaaatagaggaggagaattttcttatagggaaagtgacagacctcttttaaatactttttagagtattttattttattttattttattttattttatgtgtgttagagtttaccttgaatgtatgtgtatgaaccacctgtacctgcagatgttaaaaaagggcatcagagtccctggaactggagttacaggtggttgtgagtcattacttggatactgggaatggaaccctggtcctctgcaagaacaaaagtgctcttagccactgcgtaatctctctagccccttgactgacagaacttgtatctagtacactcagtagagctctggctgagtccagaaggttgggaacaatgtgttttaagaacagacaacttcagatctctattgtaaatagcagaagagacttatcaagggagttaagcctatagggtactacacgaatactcttgacctccaatatcctttcttattcctctcagtgtcccctcccaaagaccttattgtgacagaagtaacagaggagactgtaaatctggcatgggacaatgagatgcgggtcactgagtacctcattatgtacacacccacccatgctgatggcctagagatgcagttccgtgtgcctggggaccagacatccaccaccattcgggagctggaaccaggggtggagtacttcattcgtgtgttcgccatcttggaaaacaagaggagcatccctgtcagtgccagggttgccacctgtgagtaggcagaggattctgggtagactcacctagccttggccaagctgtgtagcactatgcatactttaagtgcccaatatatactaacacacttcacccaatgagacagaagcaattgttaaccccatgtgcagatgaggaaactgagaccagacagttcatcatctcctctcaatccccacagctaacaaagatggagttgggctttaccctggaaagtcttaggagattagatcttaatcttcttatcaccattgtgtggagttctcctctattgacctcactgtctcaggttattcctttaagagtcagtacaattaccttcatgcctgagaagcaaactgtggct

SEQ ID NO: 28830 - DNA, 1195 bp, Mus musculus
ctgataataaaagaataaaaaaacagtttgaattacttataatatgccaattgttcaacattttagacttcaaatgtagaagggttctgaataaaaagctgtaagagaacagagcaaagcggaggctgtgaaaactgttgcatactgtctgtggtatttaaatttcactctgttgatgatggaaatcactgaatactttgtgaaatacatgtctggagttatattaggaaaccagtaaagaagcagtgaggtcaagctgtacgtggtacaatgaattagcatagcaagctcaaggagtggagccaagagaagaattcaagactcatgtaacaatccagactgtggctgtgttaacaatgagaagaagctgagtgtactatacaaaaatggaagcaagggtggactggatatgaaactcaattatttgtgggggagctgagagaattggggatagtaaggcaaagccaaactctttggtatggatacacagaaacacaggtgctgccaactacataaaaggcaatagaagggagagtttcatcaaagacatctacttctctcttacagagctgctttgtatgcctggacatatcccatacttattgaatgtctgggactctgcaaaggactcctatgtaggaggtaagcaccccccttgaagcctgcaatgtttaaatggatggaagtactcaaaatgtctggaaaatatttcatcatttcattagaagtgacctaactgtgaaagtgtctatttggaaccagccccaattctcaaacttcttaaaggcttttcctcccaagaggaaagtaaagtaagcaatgttcactccaaccaccacacacacacacacacacacacacacacacacacacacacgcacacacagggtcaggaattttgtgagcatcaatgctgggaagagctaattcatctaagaaaatgagagtaggcagtaatccatggaagagtgctcctgaaggcagaacagcactgaaatggggcttgatggatcagagctttccactggcctaataatatgaactgccctgattgatgaccctgatacacacaagggggagggaagcaactcctcaagtgaaaggatacaatattagcactcccttcaggcctatgactttcattgtcaagtgaaaaatatctaaatcccagagcaaggccacagctccaccaatg

SEQ ID NO: 28831 - DNA, 1165 bp, Mus musculus
atgaggagaatgccacacctactaacattgccagttcccatgggccaagcacattcaaactaccatttgtccattaaccaaaaacattgggacaagaaggggtttcaattgagagattttcagatttttaaatatctatacatttgctgagatatgctggggatggagccaacctcttatataaactcaaaagccattttgtttattttatatcatataaccagagcctaagtaatctcatatttatttgtgcttgtgttttggcatcggctcattacattaagtcaggtatggaattattccatgcgtgttcagggaacactcaaaaagctttcattttctcggtgtattttaggttctatattttcagctcagaaacattaagcctgtgtttatagatgagttttattattatcggtttattagtggtgttctttgttcttccattagaatataagcttcagattggaattgactttgattttatatctccagtcctcagatgtgagagagcaatgacacagatgagtattgttatgaaaatagaccaatgtctaaaagaaggaaccgatacagcaaaatcatgcaattcaagagtgtatgcaccatgtgttttggtaagtctgaactccaaagttgcttaaaactatgtctgagcacccatgtgaacatatgttttgtaatgagcagctagtatcatccctccacacaccaaaaatggtgtgccctgaacctgtaataagcaaatggctctacttttaaggccagctagagcaggagtaaaccctctagccttcaggagcagtagtagcttctcacttaaaaagctgagttgatcccaagtataattcaacaaagttaactcatgtcacattggatacacacaaatggaaaaagtgagataaacagaaaacacttagtacttcctggcacagttaatgccctctattcccagtagctgtaattatcaatgattaattgctcctggatatgttactaagtttggttgcgtcaatgtaaaggaatgagatgtggtagaaaacacaactgcagaatctgagggggggaggtggaatagattgcacactgctacatttctagaaccttatgtcctgcacagtcagcactgtagcctccactgaagaggagtgacctaacaataaag

SEQ ID NO: 28832 - DNA, 3423 bp, Mus musculus
aagccaacggcggtctacacaactacaaaatgagatcaacatgggattccctttgactcgccacagttgaaactgcaacatggctaaaggtagggagagcttaaaaatctatcgccaggctccgatctccaaggtgtctcaaaacaggcccactaatttggctaaggtaagaggtaatgcaggggccaattgaacctccctcaatgttccttaaaaggcttataaaagccttcaggcggttcactccctttgaccttacccagaagatcagtggccatggcctttcataaggcagtcagctcccgatatcagaaagaaacttcagagattaaaaggtgtattacaaaaaggagacagttatgtgatctagtaaaagaggcagagaaagtgtgtgtaaaaaagaggcgggaggcaaaagaaagaaaaaacaggagggatcgtagacaagaaagaaatttgccacagtggtaggaaaaaaagaaaagaacggatctagacaggaaacctgggcaactgaagacggagcctcagctaaagaggctcagctgtgtcagactgaagtgacttatttgggatacacccttcgaggtgaaaagcagtggctaaaaaaagccagaaaaagactgtaactcagatccccaccccaactacaccaaggcaagtaagagaattcttgggtactgctggccttctacagactctagatacctgggttggcgaccttagctgcccagttgtaccccctaaccaaagaaggggaggtgtctgtgtggaccccagatcaccagaaagcctttaaagagattaaaaaggccctactgatggccagcctatgcctgacctaaccaagcctttcactctttatgtgaaagagagagcaggggtcaccagaggagtccttactcagactttgggactttgaaaaaggccagtgacttacctatccaagaagttacaccctgttgccagtgggtggttttcttgcctgaaagctattgctgccataatctgcttgtcaaggatgctgataagctcactctgggacagcaaataactgtagtgacatcccacattcttgaaagcattaccaacgctcctgtgacacatcagagctttttgttgtctaaatgagtgaccttcacttcattccacctgctgtcccactgtgtgagactgcacctactcatcactgcgctgacattctggcagaagaaatgatctgaattatcagatcagccttggcctgagggtacgagctggtacactgatgacagtagcctcgaggttaaaggtaagcaaaaggcggggacagcagtatggtggtgaacagaaagcaagtgatctaggccagcagccttcctgagggacgtcggcccagaaacctgaacttgcgactttaagacaagctctataaatggcaaaaataaagtctacactgacaacaggtatgcttttgccactgtacgggacaatatacaaagagggctgttgacatctgcagaaaaagacctaagatgctgtggctaaaaaaaatcagatggcagatctaaccgtcaagcaggtggctcaaagaacaatgatcctggcagtcaagaagtctaaagattattatgacatcagagagaccagctttagatacaccgctgaacactatcaagctatagacagtatttggcttggcctgggggccaagaaattcaaaggtgtggttaggtcctgtgactactatgttacaggactctctgacttggcagaaaaaatagtcaaaagcttcaaggcctgtgctataatgaggtagaatttctaaaagaaatcttcccaaggtaatggacctgcctttgttgcccaggtaaatcagagactggccaagatattagagatcggttaaaagttacattgtgcatgcaggccccaaagctcaggacaggtaaaaaaattaatagaaccattaagggatccttaccaaattgacagtggagactggcgctatgattagatagctctcctaccctttatgctcttcagggataaaaacacccctggacagtttagactgacccccctataaattactctacaggggggccccctccactggtaaaaatagcctttgtacatagtgctgacatgctgctttcccagcctttgttctctaggctcaaggtgctccagtgagtgagacagcgagcgaaaaagcagctcctgaaggcctactcaagaaaagaagacctgctacattagacgtctccacgcagaaaaccttgagactccggtggaaaggcccttatcttgtactcttgacagccctactttctacctttatgggaccccttttgattttgcttctgcttttaattataggtccatgtgtgttaaataggcaagtcacctttattaaacagaaatgagtgcaatgtggcttttagttttaagacaacagtaccatgccctaaagtaaaggattaagtatgtcaggaaaaaaatagtgtctagttctaagattagaactactaacaagtagaaggggggaatgaaagtataacaacgtaaaaacagaattctaggcctttaggcccaggcttgggaatgtggcctttgtaaaggtatgctaatcaaaaaagagagcaacattcctctacccacccgcttcctgggttcaaagagtgctcattcaaagaaagtcaccctggccattaccagaacctgcaatgcaaatgtgctattgttagaggctcttagaagctgtcttgagagttaacaattaccaggtattccttgtgactcttgtaactttacacttccttgtgactcttaactggtatctttggtatcttccaacaacgccctctccacttccttaagtttcggtttcttcctttaaatacccccttacccagctactcggggcgccacggtcctctacccctgcgtggtgtatgaccatgggcccgagagcgctcttgaataaaaatcctcttgcaatttgcagcaagacccgtttcttgtgggtgattttggggtgtcgcctctcctgagtcagaacgtgggggagccctcacattgtgggtctttcagatcatgataataatcggtaaattctattcaaacattcccattgtcaacaccttccttgaattaagtcagttaatctgtacaagctatctagaaaaggcagccctattaactttcaacaaacacagaaacagagagaaagagaggttaagttgttttcacctacccacactgtggtaagtagctcactgtgttccttaatacataatctgtctctaggatccaaggctgtcatcatgagatctgctaccctactctaagcccctcttctcttactgtttcctccttctttcccacatagcctcatccatctatcttcttctcctgtctctctcactctgtgctttgctt

SEQ ID NO: 28833 - DNA, 1829 bp, Mus musculus
gagacggctcctttaggaataggcacttttcttaaacttactaagctccattttgagaatgaaaatggtcatgtaccaaccagataagactgttgtgaagggtgcttagcataagcataaaggtgtattgctttaagtacccatgctttgggacaattgtgggccttctttctgttttttcactgcttccagtctttttacaagaagagagtgtctgccaaatgctcccccaaggaatcaagggagacatttggagcttgcaaagccaggaaccaaaagaaaccattacttctgttactgtaaggaacagttgagtagcataaatgtccaggcctagggtaagatgttatacctgccttattttaaaagagctttagaaaattataagggagagtgtggccaggcggctcggaccgagcagggctttccttgccagtggattgtgtagagtatacagccagtctcttgtcttctgttcgacatggcatcttctgatattcaggtgaaagagctggagaagcgcgcttcaggccaggcttttgagctgattctcagccctcggtcaaaagaatctgtccccgatttccccctttcccccccaaagaagaaggacctttccctggaggaaatccagaagaaattagaagctgcagaagaaagacgcaagtctcatgaggcggaagtcttgaagcagctcgcggagaagcgggagcatgagaaggaggtgctccagaaagccatcgaggagaacaacgacttcagcaagatggcggaggagaagctgacccacaaaatggaggctaacaaagagaaccgggaggcgcagatggcggccaagctggagcgcttgcgagagaaggacaagcacgtggaagaggtgcggaagaacaaagaatccaaagaccccgcggatgagactgaggctgactaagttgtcccgagaactgactttctccccgaccccgtcctaaatatccaaagactgtactggccagtgtcctttactttccctcctgacagatagtctagaagccgatgtaggaccgtataggtagatccagaccgtgagatgttttaggggctcaaggggagaaactgaaagtgttttactcttttttaaagtgttggtctttctaatgtagctatttttctcgttgcatcttttccactcgggcacaatcggtgtgctgggttaatggctagtactgtattgactgtggaagacgtttgtgaagagtatgtagtggcttcttccaacccattagatgctgaatatctgtccactttgcgatcccaattctgtcccaatctcaccagatgctactgtacttgaatggttaataaactgcacagtgctgttaaaaaaaaaaaaaaaaaaaaaagaaaattataagggaaggatgtgatagaattggagagcacctactgcatgccaacacatgtgtacccagagatgaaaaactgaatgagacctggcttatgagctgttagaagggccaaaagagcctctggagtctcaggactatttctccctttaggaacttgatattggctatttgcatacttttctgagaaacttactacccttaccaggaatggacggagggcaccttcatgttctgagcactttcccgagtgctctcctgcattgggcgtgcagattctctgctgatgtagctcccacagtcccagatctcaccaactgcttactgagatctgagggcagaagaaatcatctgttcaataaacatgtctgttcaaccatagaaaccaaaatgtcatctatcatctttgtcaatccagtcaacagcaggaacagcacaggaaaa

SEQ ID NO: 28834 - DNA, 1171 bp, Mus musculus
aaacatgagcctggatatgaacagctttgagatctgtgtattattggggaaatcacttgtgatatgtttgtaggatgaaggggatagtctagggagaagatggcttttagaagctaggcatgtggcttgtacctctaattacaatatcactagagagacaaaggaaggttcctggggcctgtttaacttaaagacctcaaacctatgagagaccctttcaacaaacaaggtggttggtaagtaagaaatgatacccaagattgtctatgacctccctgtatgtacatccatccaaacattcacataaacctggagatgagtcctatcagcgggcaggtgacagccctggaacatccgcaagaggccagctctatacccaggaggacccgacctttctgatcctggtagctgcaaggcagatgctagcaggatgagagagagcctatgaagcagggggtttcgacctgaaggtgatttccaaggcttgcctggcaccttctgtaaatgccacctctgggctgtggcctaggggagccaagaagctgtttgggaagggctgtttttgctctccgaatctgaattgccctcaggtaatgatccaaatacccctgtctctcttcagccttccttgcccaggtttctttttgtggtgggtgtttcctggctttttctcctctcaccagccttggatctgctttcacccttgacctctttctatgcttcactctctttctcctctccattcctgcccatccttacagcagaccattacagcatgcagctggttgtagaagaaagtaacagtcttcctctgggcagcgtatctccagcttatacctggtttctgcagagtcagggtgagctccactactcaccagtgaggcttccaatccaggcatcattctctcgatacttagccctccagggtgacaacttcatctcccatccatgtggtaccagtcttaccattctcttcataagctctggattcacctgcaactcacagctgtgtatatgtcactcctagtttaaaatggtcatcccccaggtgtccagcccatctaccacagacaacaaaaggctcccccaagcatcacctctaggcatctgtttcaatcacagttttcccctagaaaatgcatcagaattaagttacaactataggcagcta

SEQ ID NO: 28835 - DNA, 1103 bp, Mus musculus
ggtttgacttttggagccatataaaactttccataattgtgaatagaattcatcaaaatgggaagagaagaacactgtctaaaagttcttagcaatgagaaatcaaccaaccatactttatatcgctggagacatggccatggagacaggcacatcagtgatgcactgtactggtttgatcatattccccagaagacacacagaaagggcataaaaggcttcccaaagcacagagctctcagctgttttcagtggctatgttcacagactgatgttaagaagttggtacattcatgggataaggtagcttatagattcttttcttttgcatgtatttcttttttgtgtggcggtgtgtgcttgtacaccaacttgcatggagaagtccattcactctttccaccacgtggggtctggggctcaacctcagattagcaggtttggtagcaggtgtctttgcctgctgagccccatgttataaaatgaaaaatgcataatatcattggaaactgagagttttactgaaagaagaataaatatgaaatcagaaatgcaaaccacaccatccaaatttgaattataaacatgaaaatgaactcatgatgaaattttctgttttaaaaactgactgaataactccacataaaagattgtaaaaataagtaaaatcagattcagagcagcaaacccactacatatcccagggctgattctgagggcctctttgtccccagaggggtcagggctcctataggaaatagcttgtttcaggttctaagatgagtttagaacctataacatcctagtgaggaagaaggaggtagatccaggccccacacgacagcgtcccctggaagactgaaaagtgcagctgccagtgcctcacttctgtcagcctggatcgcccaggcagcagctgtttgtcaacactccagggaattttgagaaccatagattaaaaaatagtagctgttacaatgtatccagttcttgtttggatgctgagtcaaatgaattaaggaataagaaaatagggaagtgaagaagaaaagaagaaatgtctgacttgggtttttcttcagggtttgatagattgcgtatcc

SEQ ID NO: 28836 - DNA, 1352 bp, Mus musculus
tccatgacttcctggacttgtcactctgagcctttggtgagggaataatatcatggtggggacatttgataaagtatacctgttcaccctcataatgtttaggaaccatttagaaaccagggtttgggggatagggtcttaaaagtcctctttagtgatgctttttttctacaaggctccacctcctaaacacagcacaaccttccagtggtgttataaaccaagcctttaatacatgggctttggggacatttaagatccagaattcaactgtgggaagctgtagaggtaagaagttgattgcagcaaaaggagacactgacaaagattagtatttgattttcagattctgaaatctgtccacctgatgaccttgccttattaccagcatgcaaagagaatcttgaagacctcctaggcccatcctccatagccacttacctggattccaagagtcagctctctgttaaagtcagcgtgaatggaactgaccagtctgagaatatcaatatccctgatgacacagaagacttaaaacagaaaatccacgacttgcaaaccgagctggaaggctaccggaacatcattgtccagctactgaagcactctcagtgcagtgaggctattatcacagttttgtgtgggacagaaggggcccaagatggcttgaacaagcctaagggccatattgatgaggaagagatgacattttcaagtttgcaccaagtacgatatgtgaagcatatgaaaatcctccgtccactaaccccggagatgattgatggcaagatgctagagagcctcaagcagcagctggtggaccaggagcaggagctacagaaggagcaggacttgaacttggaacttttcggtgaaatccatgacctgcagaacaagttccaagacctctcgccatcaaggtacatcctattcctgcttcatcctcctcattaggcttgcaggtttcccaggtcgttgctatgtaggagcccagcagctcttgagcgaatgctactccctgggtgggtagagtataccctagggaaggcttcacttgggcttcaggcagccacacagcttcactctatgcatgcgtatgttaggagctgggcaacttctgagactggcagggcaggagttgccctcctcaggctgaggactcagtgtagaaactccacagccatcagacggtggattgcagtgtgtttactgagctgcctgctgtgtttatttctgaactctgttattggcttttgccttgttgtggaaataaaatggatgtcctaagcaggttgggaggaatataaatgtttttcatatctttaccctttaaggtcatcttagagaaataa

SEQ ID NO: 28837 - DNA, 1149 bp, Mus musculus
gcccagttaattagtatgtgtcagtagagtataataatacatgtctgtgatgtaaataatgttatataaaacatttgataactatactaagcatggttgaagacatgcaccccaagttcatcttaagaatttccaaggcatggtctgtggaatggttgaccccgcaggagggcacctggagtgagttggacactaatgctgtcatctcactttgttttctgaaccatagcaggagaacagaaccactcaggagtgagaaaactgagggtcaggaaagcgacacagatgcatcctgccttaccatcagtggacttgctggcttgccccctcccatttcctccttggtcctgcctgtggaccagttctcactcaacctgcatcctttcttctccacctatcccttccattctatggtggtgcctctatctgactgaagactttgatttgcagatcatggaggactatgctgagggtggctgcaaaagtggatatggaaggcacatggattccaatattttaggtcatgatggggcccaaactcctggtgcctctgaagagcacaccctagaagatgagctcctgggcctgcttgccactctcttcagtaagaaggccacaccgttgctggaatccaggtagacatgggcccagacacctctttacctctcgtttgaggagcgaacatactcgtttcgctaaatggactctgacggtgctgtgcagtgtacctgggagctcctgaaatggctgggaaggaatcttgccagtcgtgcaattaagtaattaggcttcgtgcttgtggctgtgaggggacttgaacagagctacacgcaggctcattacaaaaagcaagagaaagctttccccagaattattcctgggagtcccagcaagggctgcctggctgttggcagggagaggagtcggccctcttggcatctcctctggttttggcatcagcttaaaaacaccatttcagtttgtattgctgctgttttatgttgcgcttgaactaaattctcttctcgctgtatctgctaggagttgttcctatgtgggcaatactacaggttgttcttctgacacagagaaggagaaacaggaggtgcatttgtagtctgtaaattagtcctttctgagccatttccc

SEQ ID NO: 28838 - DNA, 1132 bp, Mus musculus
actgtcatcgctaactgtgcatagagagaaggaggtctctgctatgaaggatgatctgacatagttggagaaacttcacctctggggagtctttcttccagaatgctttgtcacaagacagaaacatgttagttgccattgaccaaatgcctctagtgttctgtggctgtgatcctagcacattctcattctatagaccttattctaaccttgtcagtagacaagctgctgaggatagctcaggtagccttctcacaagtctcatgcctctgccttgaagtgagacctctatgtctttgctctttcctccaggtcagtgacctcatacagcttgtgaaggacctgcacacagacaaccagcacctgaagaaaaccatttttgatctctcttctgtgggtttccagggaagtgacagacttgagttaacaaaacaagaagaggtaagaagaagagtcttgcttgttgccatgtgctaattgcatagaggatacctgacatagacacagacagacagacagacagacagacagacaggatacctgacatagacacagacagacagacagacagacagacacacacacacacacacacacacacacacacactgcatgtctatttgagggagttctttgaacttgcctttgctgtggtagagtcttgagggccccgttggtcattgagtctgtccatgtgcttcctccaactcaggccatgtcttacgtgcttgatatcctgtgatgttactgtggcctggctctgggtatttgctgcagatggtacatctgatgagtgatgtcatcttagagctctttggagaatggccatggctccagagagcttgcatagtatgcgtccagccttggaatatccataacttaaaggaagatgtctacataccccacctgctccccacccccacgtcacttctgacatttgtctcttttcctgtttgtaaccatgctgtacagggaaggaccctgaagctctgttgggagcaggagatgttgagttcctctaggcgtggctagctcatctctccagtgaaagaacccggccccatgtgtgaatcagtgtcattgctgaagccaggctgtttcaccatgaatgcaaaggatctttccttacaga

SEQ ID NO: 28839 - DNA, 1209 bp, Mus musculus
tactaacaaagaagaatattgatggtgctgggattcaccactgcctgccatcttcatttcattttctgattactattggttggctgattatgacatcagagcttgaactcagggattcacacgttaggcaagtgacccctttaaagttacttaattaccttaaagtattagaaaatccagacaaacggaaaagtcagctatactctctttgcattgaagttatttagttttgttaaaagtttgtgcttttccctcttgtatttctttgacagcactgtggaccactcttgccaacaggaccacaacctacactttgtcctgtagttttccaaaatgctgctccttgggctctgggtactgaatggtgcccatttttcttcctccctgcctggtaggcaaaacagtcttggtttgtttctgacatgggaaaccaggtccctctgctctccctctctcctaggggtctgaggactgtgaagctgcgctggtagagaaggaagccctattggccaagctacactcagaaaatgtcacaaagagcactgagaaccataggttgctcaggaatgttaaaaaggtcacccaggagttgaatgacttgaagaaggagaagttgagactagagcaggccctggaggaagcccaccaagaggggaacagaggagcccgaaccattcacgtgagtgcctcctgctctcctgacattgtgaggggtgcatcgggtggggccagcgatgctttcttctcacagggagctgaatcaggatagttctcttttcagttttttaggatccttcatactgatgcccatagtggttgcacatgtttatatttccacagcagggaataaggtatttctttccctgaatccttgccagcatttcttatgttattaatggttttgtttttgtttttatgttaaccattttgactaggatgcagtgagttcttggagcagttttaatttgtatttccctggtagctaagaatgttgaacactttcttatgcatttggtgacctgtgccttcgttgaagaacccctttattgagtggatggttggattttggcgcttaacttttgcagttctttggtggccttgatatcattctagggctggccttgtagagtcaagccttactctgaagacagtcatatccagtgttatatctttcctgtacactctcaggttttactgtgttttatagac

SEQ ID NO: 28840 - DNA, 1194 bp, Mus musculus
tcccctggacctgcaactccagttccaagggattagacatcctcttttagctgctgttggacaactttacaaactacatgatccttccaggcatatacgcatatatgtaatcaggaaggaaaaggaagaagaaggagaaggaagaaggaagaattagaagaagaaagacccccccacaccccccaatacacacacagggttccttgacatggaacttgacagtgaagcagcagcaggagacatttaaattcctggaatggctgccaaggaacaggctcacagactcaacttcagatcacaggtgtggctgtgtgcagattacagtgtaggctggctgttactcctcttggccattaaagttatttctggattggaggtggcattctcctccaggtgtaaaagtaaaaacacttactgaagaaaaaattaaaaataatttctatccttaaagaagtacaaagaagtaatataaattgccagcaaactcacctctaaatattttctccgttgatactttcatacacttatacatgcacatacagggaagaaaaaaaaaaaaaagaacttgtgcagggaggccagaggtccatattgtccatctctccatcttattttttgaagcagggtctctcattgaactcagagctcatcaatttggctagactggttggccactacaacccagggatccttttgtctccacctttgtagtgccatcttatggcaggtacagctgcttctggcttttatgtgggcactagggattaaattctggccctcaagcttaccgagaaagcactggactaactgaacaatctccccagcctccctctctctctttttttttttttttatttttttatttttttccattttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatc

SEQ ID NO: 28841 - DNA, 1189 bp, Mus musculus
ggatccataggtaacctgggtgtgctctgcatttttggctgtctttataaaggtagacattacatctcattgtactaaaacaatttacaagtgactgattgcctagcatatgagtctatgagtttaatccttagaattacaaaatatattaataatattttgccctttgtcatttaaaaaacacctttccatgtgttctttgatcctcaccctagcctccttaggaagtagtcttgtgctcatttcatagatgaagtaactgaggcacagagagtctaagttgttcagcgctataccatgcacatcatcattattattcctggaatcagttctcacctctacttcattgtcattttgctatgtgatacatataaatctactagccatgggccctagaagactggaatggaaattcccatttgtggatgcttctaatagagcccttgtatgctctctagaatactacccccccccccaccccgccataccatgtgtatatattggggtaggggaagtatgtaactcacaggcacaattcagggccacatagatactaaggactttgttgaaagaacacacatggatttctacctaaagacaagattaatgacgagaaggtaaagctgccagttcattaaaatgaatgaattcctgaattggggaggggagcagagagacttttcctagcagttgcagcacaggtgtgtattgactatacatcacagagttccaaagtgctgagcacaatggctgcctcccagataccccatctcctgccaaaataagtggaaaggagataaaagccaaacgtttgttaaacagttcacacaataaataaatgtttatatgagtttaagagccaaagtaaacagtcgagattccagctaaatagagattccatgatacagatcttaagagataacacagaaactaaaccacaaatttatcaagtacctgttaattgctcctaaatcatgtttttcacaatgaaaaaagctatagccttaaaatgtgttgtaaataacatcatttagtgaccccgttgctctgcttatacaaattattttgttgtaaagatcaaccatgaggtgatctctccttgaaagtagagtaggaaaccagaataaaacatgctgctgggttttcattcctctggagacattatcacccaatgccacgagtcctctgc

SEQ ID NO: 28842 - DNA, 1224 bp, Mus musculus
ggttttgttgtggattaattttgtttctccatctatggttattgaacgtttggctgggtatagtagtctgcgctggcatttgtattctcttagtgtctgtataacatctgtccaggatcttctggctttcatagtctctggtaaaaaatctggtgtacttctgataggcctgcctttatatgttacttgacctttttcccttacttcttttaatattctgtctttatttagtgcctttgttgttctgattattatgtgttgggaagaattttttttctggtccagtctgtttggagttctgtaggcttcttgtatgttcatggtcatctctttctttaggtttgggaagtgttcttctataattttgttgaagatatttgctggacttttaagttgaaaatcttgcttccacaggaggcctacacgccgccgtctgtgccgccgccatgtctctagtgatccctgagaagttccagcacattttgcaagtactcaacaccaacatcgatgggcggtggaaaatagccttcgccatcactgccattaagggcgtggggcagagatatgctcatgtggtgttgaggaaagcagacatcgacctcaccaagagggctggagaactcacggaggatgaggtggagcgagtgatccccatcatgcagaacccacaacagtacaagatcccagactggttcctgaacagacagaaggatgtgaaggatgggaagtacagccaggttctggccaacggtctagacaacaagctgcgtgaggacctggagtggctgaagaaaattagagcccatagagggctgcgccacttttggggccttcgtgtccgcggtcagcacaccaagactactggccgcaggggccgaactgtgggtgtatccaagaagaaatgagtctctgggcctttgctgttaataaatagtttatatacctatggaaaaaaaaaagaaaatcttcattctcatctactcctattatccataggtttggtcttctcattgtgtcctggatttcctgaatgttttgagttaggatctttttgcattttgcattttctttgattgttgtaccgttgttctctatggaatcttctgcacctgagattctctcttccatctcttgtattctgttgctgatgcccacatctatggttcctgatttctttcctagggtttctatctctagctttgcctcactttgggttttctttat

SEQ ID NO: 28843 - DNA, 1099 bp, Mus musculus
tgaactttatcagtagcccacagagtgaattaaagtaaacatttcattcagcaggagttagtaggaccacacacaggccagcacacatgcacccatgcttgcactcaagcagcaacccactcacactcatatctacactcagaaagagtgacaaggtgtggaggagagaaacactaggacaaatgaaaagcacaccatcatagcactaaaaagcatgtcttttccgtgtaatgtttataagacacaaagttaaatgtgtctttcagcttcaaagcctcccaatttagtagacagagagtggtcagtatcaagaaagaacctaaaatacttccttgagttagattgaagttagccgcccctcccctccctttattgaaggtgtggcctgtctagggctgggtaagacttttagggagagttgtgcaggagggggaggggcttccagggctctatttaaagccaatgtgctctactatcagggccatttgaaagtgagctccagcctaagagggaggcagaggcatggacctgggagcagtcatgaatgaaacaccagatgagaagcctgggcatgtgaaactagagatgtccacccagtcttcttccaagagaatgcagcctctagaccagaaggataaagagaatcagtcctctgagagttgggggaacactggcaggagttccaagtcctctcccaaaggcaaaggtagggtttaggtctttaaactactgatgggcttggggaaggtaaagagaggggatggctgcacaatgcattccattccttccctgcatagttcaaaacaaaatgtgtgtgtgtgtgtgggggggggggtcttgtgtgcctgtgtaggcctgtttttgctaatggctgtgtcagctgcatatccttgggaatatattttggagtgtttgctgaggcagcttgagaacatccaaattaggaacaaagagggaatggagaattgaaaaatagtgggggactgcatgggatttcaaagcatgcaaggagcttggcctaatggaagctgatctcaggctttcctgagaaagttgggaaactgtcaccaatcacctcttcttcctacagagaacacat

SEQ ID NO: 28844 - DNA, 1251 bp, Mus musculus
tacaacatgacactagtctgtggggaatgctctgattaggtgccttgtacatcatcttttttgcctctgcaattacatttggggcagaatttcttgggattgcgagaagggcaagtgaattctttaatatggaaatatatgccaactcacgtttctgtgagaacgtaccagttttcacttccatttgcaatatatacacaggaacggccatttcttcattctgcctccctacatggcctgttaccaagtgtgctgtcctcttacaatctactcactgtctacaacatgcaaatggttgcttatacatatttttaatgatacttagtatattttaacatattcagagtaagttttattttattttctttgagctaccttttcatgacctttgtcagtacacggcattttatctatgtggtttgttcttaaaagtttaggtagcattacaagtttttttttcctgattttcaagtcattgatttctgtttttatctatataaaggtcctctgaatgtcaaagtgaagaaattcaatgaagcgcgggtaaacggcgggagtaactatgactctcttaaggtagccaaatgcctcctcatctaattagtgaatggatgaacgagatttccactgtccctacctactatccagtgaaaccacagccaagggaatgggcttggcagaatcagcaggggcgggggagaagacccttttgagcttgactctagtcttatttagtttcttttggcctactctcaaagggttgatttcaacttagggattaccaggaacttcatgacgttgaaatggctatttagatttaagttcatcataaatttgacattaaaagctgccatccatggatttcttcacattctcagctttttctcatttctttggcacaatattgttgtatgtatctctttgggctggtaacagacataacaagaaaaagactcatattttatgatctcaaagtggtcagtccatcacatgccttcataaattatacttgacatttaaaatttagtgtatgctctgccagtgcaaaataatatcaagatataaaaacagatctgggtcgcagttaataattgcaatatttatcatttcgtcactagctccatagaagaaactcagtgtatgtttgtgagtgtgtgtgtgtgtgtgtgtgtgtgtgtgtgtgtgtgtaaattgtatacctatgtgtgaggaactaactgtaaaccctggatctgagaaaaggcaaaaatg

SEQ ID NO: 28845 - DNA, 1164 bp, Mus musculus
tgcattgaaaccacaaaatagctttaaaatatctgtatttctcatagctaactaagagggtcattccacttggaagcacatgggcctctgattggcttctagatccttgctcttccctcagcagctagtctgcttccatttaatgcacatactagagtcattccagaaactatttctaagagtaagcacttaagtcaaatgtagccaacttttgggaggtagaaattcggattttaagataaggctgtctgtacctctgtcctctctactttatagatgagagccgaggcagagaagttccttgtctctagtcctttagtcaggcctgccattctgctggtgctggctctctggagtcatgtgtgtgtgtatgtgtgtgggggtggggtggggggccgtgttttagcctggactggccatgtgtggccagtggctgctctgtgagagtcctgtatcttctaggacacagcgtattctcaacagtcaacagcttgacagtcactaggacatgcatggagggcgaggctggaggagtgctgattgttcacagggagagatgtttggaataaagaactaataactctttgagttgaaggaggtgataagtcaggatgaaagataaaagttgtaacagttgtttgaatagacaaaaggaagaaaggtacaacaaagactccttcattccaggtgatcatggagaggccaggtagcactcttgaggtccacttgctgggcatcagcagggaattctggccatgcgggagaaggggactggtagggacaggaactaatgtaggggttgtgcttgggagggaaaggtttctggctcatatcttggctaagaattcagggcagcgatggtaattttttttttccctttcactttcaaattctaagcttggtgctctgtggtaataggggatgggggaccttcttgacattgacgtttctaaacagttctattctgggtctttcctggttctgaaggtgggtccttacctctctgatctgccctggcgaaagcgtgctcagcatgtagagtcaagtttctgagagtcactgcatcacacacacacacatacacacacacacacatctgctcagcatgtagagtcaagtttctgagagtcactgcatcacacacacacacacacacacacacac

SEQ ID NO: 28846 - DNA, 1171 bp, Mus musculus
tcctcttcttccttttacttctctaccccttctcttcctcctcctcctccaaccactgccaacagcagcagcagttgcaagctcagcatctctcccatggccatggacccccagtacctctcacgcctcacccttcaggacttcagcctcctggcatcccgccccttgggggcagtgccagccttctcgcgctgtctagtgctctgagtgggcagtctcacttggcaataaaagatgacaagaagcaccatgatgcagagcgccacagaggtgagaggccgggcaagccagattaggctttgctcccatactcagacagtgctgcagagctgtgcctcgctgtggaaagccccagccccacacagagagcaaacagtgagataacaggagctgtctgtcgcaaagcttgctttccactgacactcagttcaccctgccactctgcaaggtttgccttgggcagctgtggggtttttccgatcttgctagcccgcaggcatcttgacatcttagtaactgcctttttaatcccagtggcctgtaccatattatggagaactgttaactgcttaattgggtaattttcaaagaaagtgatgtttgttaaatggggcgaaataagaagttaaatttgaaagtgaatgtgttcaaatgaaaggcttgacaattgcatctgttactagttttgtaggctttaatcctagtgtgcgttaaatattgggcaaattgcacttgactaatttttgaagaaaagtaatttattctgtcaagaaattaaaaataggctttgtgtatggttaaactgtaaatcttatgtttacaaaaatactgtaatcttcaggaaatcactgtattaggaatgtgcaatgacttatataaataaagccattttttgaaactgcctggggcctgtgttctaattattccccccttttttatttctgttcttgcctctgtgtctgaacgggcgtgtctgtgcatttcttggtaacctcgggagcagacagagagcctggcacggtaagtaccccagcgcctgttgcacatgaacacagacccacttgctttcccaagctgccttcttcgaacacaagcaccaagcagacacacagacaccccgcgtgtagtgacctgggtttctcagtttttctttttaaaaatcattttattt

SEQ ID NO: 28847 - DNA, 1099 bp, Mus musculus
caagatagtaatgagtgcactgtgattacaaggatgggggcgcctcaggaagtgtttaggacacatgtagttagtagtcactgattctacaaagattttctggatttgttctgcagtttctgaatggtacagaaacgtaactcaggaaaaattaaagtggcaaatatttaccactttaggagagtgtgaacagcaccctagggacagcagcttacatggcccctgaagttattatccgagccaaaggagaaggccacggacgtggggcagatatctggagtctggggtgcgtcgtcatagagatggtgactggcaagcggccttggcatgagtatgaacacaactttcagattatgtacaaggtggggatgggacacaagccaccaatcccagaaaggctaagccctgaaggaaaggcctttctgtcgcactgcctggaaagtgacccgaagatacagtggacagccagccagctcctcgaccacgcttttgtcaaggtttgcacagatgaagagtgaagtgaaccagtccgtggcctagtagtgtgtggacagaatcccgtgatcactactgtatgtaatatttacataaagactgcagcgcggactcgagactcgagccccgggctaccttgccagcagagtcttgcccaacacccgcaagggcccacacgggactccccacgggatcctaagacctctggtgagtggaacacagcgcctgtcccaatccaatcgcgcagaacttgagactgcagtacatagggaagcaggctacccgggcctgatctggggcacaagtcccttccgctccactcgagactcgagccccgggctacctcgccagcagagtcttgcccaacacccgcaagggcccacacgggactccccacgggaccctgagacctctggtgagtggaacacagcgcctgccccaatccaatcgcgcggaacttgagactgcagtacatagggaagcaggctacacgggcttgatctggggcacaaaccccttccactccactcgagccccgggctaccttgccagctgagtcgcctgacacccgcaagggcccacacaggattccacacgtgatcct

SEQ ID NO: 28848 - DNA, 1193 bp, Mus musculus
aattagcgtgtttgaatccttagttttagttaattctcctctccgtttacttcccagtcgtcctccccccccccccccatttcctgcttataccggtgcacgctctatccttgtactttcatatcacatgcattctactatttctcatctctaaatgtctagtctaacatctactactcccagtgaccatgtgctagcctcttgcttcttcaacttaaatagacaaatcaaaatgaaaatagtggctgtgtataagaggaaacatttaagtttctgcctttctgggcctaggttacctcacttaatatattttccaattccataaattttcctgaaaattttataattccagttttctttatagcttaagaaaatctctattgtatatgtgagccatatttttcttatccacacagctattgtgaataaaacatcaatgaacatgtttgatgtgggaatattaaaaagactatttgtatcctgtgctacgccgggcactggcagaccacatagctttagctgggtggtctccactcaatctctggccgggagctgctgaaatgtttcccttggccggtcattctcatgtcagccccatgcaaggaccgccctcccagccgtcagctgccacaacacccagtaacccggtagaaacaaaactctagaagttaataattaatcagtcagatttatataacaataaattctcatttcacaggatgccctcacaataaattcagagtcagttgatattggtacaagatgcccacctagattagacaagttaccctaattattcttttttttttaattattacatattttcttcaattacatttccaatgctatcccaaaagtcccccacaccctccccccgccccactcccctatccacccattcccatttttttggccctggcgttcccctgtactggggctaccctaattattctatccctatatgatataaatctacctatggctatttaaaaccatgcggattatgaatcatcttgcttgttgccctccatcttgcttccttctcctctctcctgagtctgtctgtctgcctgtctgtctgtctctctctctctctctctctctgcagcacttagctccgcctctcttttccctgtctaatcacaagtctcctgctgcactaatagtaattggacagggactatcctgccaca

SEQ ID NO: 28849 - DNA, 1249 bp, Mus musculus
tagcacgaaatttgtaggacacagtggatcacatgctacagtaaaatggacacgaccaagggagaaggaggtgttttttgctgttgatttcctaagattatgtttcatgttgaacagggcctcgaaactattgggcaaacatgaaacaaactaaaaatttcagcccctgaatgtaaatacatgccaattatcagtatcatatttcagattatctgcattaaactaggattattactatttcttaatttcactgagaatcatgcagttgttggatataattttacctttataattatatataaaaatatgttgatagtaattttagaataattttaataataatttaatgtaacttttgaatatgttctatattttccattattaaatgataaaatacacagtatagtagtatttgataaatagctatttgattagtaagtactattttttatttcctaacacctgcttttgctttttctctccctgtcttgtctctagggtgtggatgaatggaatatagctcgcctaaatacagtcttggatgtggttgaagaagagtgtggtatttctattgagggggtaaataccccttatctctattttggaatgtggaaaacaacatttgcgtggcacacggaggacatggatctctacagtattaattatctccactttggggagcccaagtcttggcaagtcacttgtttaatattcacacccattagagttgagaatcattgattgttgttcattattgatgagaatttacttcttttatagagtgagtgtaaggaagttttgggttgtaatcttataattattctttcctgcctctgcaatttaatatatttttaagaataactatttatgccgtgtagtggtggcacatgcctttaattctagcatgtggggaggcagaagcaggaagatttctgagttggaggccagcctggactacagagtaaggtccaggacagccagggctacagagagaaaaaaaacaaaacaaaaaaagaattattcatttctggtcatatttggaagttgggtcagatgtggcagtgtctgctgctgattatctatgaatagtgttgttgacagtaagcctgcattagggagtgggaaggttatctggatatctaacacctgaaaatttagtttattttatctgttgagtattttggagttgatattaggaaggaaaggttttcattaaattaaaaaaaaatgtcaactaatacttcataat

SEQ ID NO: 28850 - DNA, 1210 bp, Mus musculus
gatgctctcttctcctgtgtctgaagacagctacagtgtactcatatacataaaataagtaaaatctaaaaaaaaaaaaaaccataaaattctgtctgtgactttgaaataatttagttaattgttgccaaacatagttattgtaggatattgtaagttagtcgttgttagtgtgaaatacgcaggaagataagaaagtgtttggtgcatatagtgtctcaggcttttggaactggtgctttcagaatagttagttctcagagtctccactgagggattggctagtacgggtgttcttaatctcactttcgacttgaacaggaagtttgaacagttacttgctgtatatttggcaactgtatttcaattacgtgccaaattgaaattcttaaaattaagtgattttgtatgtacaaatgtaattctgggtaaatagttttgaaaagatcaacctttttgacatatatatattaccttttaaggattagtacttgggctgatttttagtcattgttctaaggacattagaattgaagtgtgttttccaaccatatgaaatgttgttttagctgactgcatttctgctgctccttaggcttcttccccagtagctcccaaggctgtgatgcatttctccggcacaagatgaccctcatttccccctcagtgctgaagaagtatggcattcccttcgacaaggttagcggctctccgactttacaagtccattgctcatatcataggatttgtatttaagaaaagttcaaaatggcaaaacgtggtcttggattattaaataatacttatgacgggtgaagagaaatttaaactcctataacatcaataattaatttaaatcgtaattaaatattttaaaatgttttactcaggtttatatatgtttaatttttgttggagtatttcatacataaatataatatgcacccactattcttcccatccagatttttccctaccccatggtcacttttttctccaaacagaataatgcccttccttccttcttccttccttccttcattcctctctctctctctctctttctctctctctctctcttccttccttccttccttccttccttccttccttccttccttcctttctttctttctttctaaactcacagtgtctatttagtaatacttacatgtgcatggctgtagaaccatgtatcagaggatgaata

SEQ ID NO: 28851 - DNA, 1138 bp, Mus musculus
catgtatcacactgctgaaacataatacacatgtagtatcaagtgaaaatgaaaacctacattttcagtatccttatggttttcaaatgtatatatccgtattatagacttagtccttggcctttatatggttcgttttttatatgtgtttatgccttagtgtgcatgcagctcatggaaggcagaaggaacatcgggtcatctagtattggaatttgttgtagttgtgagctgccatgtaggtgctgatatgccgtgcagtgccaagacccactgcaggaactgctgagccatttctccagccccatttacctagttctcattacagaacttatgttaagtatatccagttgtcattagagaagtttataatctagaacatacttgcactggaattacttggattcatttcttctatgtgccagattgctaccaccaagttgaagtcagtaagtttagggaatttgtttatatttaatgtctcctttccttaggtgggctcatgtcatatgtgctgttgcagttccagaagtgcgattcactaatgtcccagaacggacacaaatagatgtagacagaatacctttacagaggttaaaattggtgagtgtcaaagtttttttttactttatatattaatgttaatttcaacttctgaatttgttttgtttccaaatcagtatatcagatagtttcattttattctacctatatttccctgtatcctctatatatttttcttcacaaattctttattagtatattgtaagtctccataacaggcctcatttttttaaatatgggaaagggatcaattttctttattgatatgaacttgtaaacattaggctctctgatattgttcagcaattccctaacctgtcttacagaaattgcctgctgtttttctttctttactcttgtgtttcttttggtataacaaatatgttcaaccttagcagccatctctttgccaagaagaattttgctttgaatcgcagaagcttttttttttttttattacaaggttttttactcaaatgtagactctagatacttaatattcccatctcaaacttgttaccttctaatctattcagtagcattcataaaaatttcttcactgatttactttttt

SEQ ID NO: 28852 - DNA, 1160 bp, Mus musculus
acatatgcagctagagacacgagctctgggggtactggttagttcacattgttgttccacttatagggttgcaggccccttcagctccttgggtactttctctagctcctccattgggggccctgtgttccatccaatagatgtctgtgagcatccacttctgtgtttgccaggcactggcatagcctcacaagagacagctatatcagggtcctttccccaaaatcttgctggcatatgcaatagtgtctgtgtttggtggctgattatgggatggattcctgggtggggcagtctctggataaaatcatcctttcatctcagcagtgggggtgctttctaagagttactgaaacaaaatgtttctttctgatgacgaagatccaaccaattcacaattctaagtttcctccccaaatgatatatggcactctctagggaacccgtagattagcctcatgagcggctcagcagaaaatatatgcatctgccaacttgaaacatttccaaattctaggcttccttctgtctgatcccttccctctctactacacaatgaaccatgtatttttaacacctgaaagaataacagtctactttgttatcaacctcatatattctatttgttcatgtcattagaagtcatacccctaacttaaaccagtggagaccgtattctagattgaaactagactaaggaatcaggaatgaagtttggtattttattgtagactctaggtttggtcttgagtatctcaactcaatgatcacttactgaagagttgctgagttccacgctttagtgttccaacattagtttatacaacatttagtttatagttcttaatatcctttagcttaagaaatgcccaatgggatgaacattgattattcctgcattcatgttcagggctcacaggaattcccagcttttctgtggtagagactcttccatggaagaaaaactatctcagacagaaaacttaaggctctcatatgtggctcataatgtaaaatttactcttccgaaagaaggaagtaggatgtgctaggttgtaaaagtctgcccttgggaatgtgcagttattcttgagggcaggtagaagataaggttacagacaggtacatgtagcactctttaattagttaattagtatgtt

SEQ ID NO: 28853 - DNA, 1510 bp, Mus musculus
gatgatgaagacactgtaagacactgtggtaggttccttcgaccctgtgatagatcctagcctctgttccctagatctgtatgtagtgtttcagtaatatatttctcatttatacactcaataatgtatttctgcgtttagtccacagcctccgacatgcgatttgaagacacattttatggagcagatgtaatccaaggggagaggaagaggcaaagagtgctaagctccaggctcaagaatgagtatgtggatgaccctgtgtatcgtactttcctgaagagttctttccagaagaagtgtcagaagagacagtagttgataatgtgcagcagccacagtgcagctcagaccagaagagggaagacaaagggacagccttggggtacacattgggacaggtggctgggtgcttctttggtattggtaataaaccaggcttctggagtttgattaccaagcaaccaagaagagacatattagttgcttctgtaatctgatcacccctcagtcatttgtttgaccccaaagaatattcctaaattaaaggaaacagcagtgaatggcccactagataaaacaactgctaaagaagcggggttccctctctggctcaggtcccttcctcagggaacacatttggaggctcctttcccacctccttcagtggcagcctcatcacccaacagccggtgggtgtatttatatatattttccacagccagggaaagagtctcactcacatttgttttcagtggcagtttttataaaacatttttaaaacacaaatggcatgtatggtaataggatttacctgtatgctatcttcccttgtacagaacttttccattttttatattattacttttgattgtgtctgaaaactgagttggcctttataagaggaaattttttgctcttgaagaggaattcatatgaagtatatgggaattttatatatttacagaggaaaaatcttggcctgatattttgaacacttcataattcctgttctgaaatgatatttataaaatatatatttctttcattatgtgtttgtaaaaattagagtttaaagaaatatacttaatgcatagttttaaactaatgtaacatgatttttctttgcaaaacagcctggagatgtattaatatttaaaaattaaaatctgttttctcctgtcccgtcttctgtctgtcaattttctctaaattaaaacaccccttatttgaaggagggggttgctcatgaaacttcagaggtgaacagaagtctgcttttacatgactgcaaaaacagaaactgggaaggtgttcaaaaaccccttactagcttggcaagtagactttgaccaaccaagatacaaaggagaacatgatacattttgtaatgcagtggcatgatgcggtgggaagggggtgcctcagcaggtccatgctgaagcaccccccaccgttcctgatgtaccagccataggaccatgggtctactataaatgaagtttacttg

SEQ ID NO: 28854 - DNA, 2307 bp, Mus musculus
aggaaccaatgcgcgtattgcagggaaatgggccactggaagagcgactgtccgaaaaaaaaaacaagaggtaaaggtgctttctcttggagaagatgaagactagggggaacggggctcggcccccctccccgagcctagggtaactttagaagtggaggggacccctgtggactttctagttgacaggggagccgaattttcagtactcaaaacacctctaggaaaagtaaagaaaaatgaaaaaaccttggtgatcggggctacgggacaaaaatcgtatccatggaccacatcccgagtagtagacatagggcgaaatcgagtaactcattcgtttctggtcattccagagtgtcctatgcctttattggggagagacttactaaccaagttaaaagcacaaataactttcacctctcatcgaccggaggttttctggggaataaaagcgccccagactctagagctgtctttacaactaggggaggaatatcgactttaccaaaataaagtaaagccccctgagggattacaggactggttgaatcgatacccccaggcgtgggcagagacgggaggagtggggatggcaaaactggtcccccccccgtggtgattgaacttaagtccggggccacccctataggggtccgacaatatcccatgagcagagaagctcaagagggtatacgcccccaaattaacaaactgctccaacaagggattttggtcccatgcaaatccccttggaacactcctctacttccagtaaaaaaaccagggaccagggactaccgtccagtacaggaccttagagaagtcaacaagagagttcaggacatacaccccacggtgccaaatccttataacctcctcagcaccttgccacctggtcggacatggtacacagtcctggatctcaaagacgcttttttctgtttgaggttacaccccaacagccagcccttgttcgctttcgaatggcgagactccgagagtggacaagccggacagctcacatggacgaggctgcctcagggattcaagaactcgcccactttgttcgatgaagccctacaccgagatcttgctcttttccgagccaataacccacaggtgactcttctgcaatatgtagatgacctgctcctagctgcagaaacacgcgaggactgtgaaattgggacccaaaacctcctgggcgagttaggtaagctggggtatcgggcctctgctaaaaaggctcagttatgccagatagaagtgacctacctaggatatgtcttgagagatggacaacggtggctcacagaagccagaaaacaagctgttatgcagatcccgaccccaaccactgctcgccaggtaagagagttcctggggaccgccgggttttgcagactctggattcccggatttgccacactggcagctcccttgtatccactaaccaaagagaaaggggaattcacctggaccagagaacatcagctagcctttgaaactctcaaaaaggcactgctgcaggctccggcattggccctgccagatttaaacaaacctttcaccctatacattgatgaaagaaatggagtggcaaggggagtccttacccaggttttgggaccatggaagcgcccggtagcctacttatcaaagaaactggacgctgtggccagtggatggccctcctgcctgcaagcgatagcagccacggctgtgctagtaaaagatgctgacaaactgactatgggccagaatgttactatagtggccccacactctcttgagagcatcatcaggcaaccaccggaccgctggatgaccaacgcccgaatgacgcactaccagagcctattgctgacagagcgagtaagttttgcacccccagccattctcaaccccgcctccttactacctgagactgacgaggcccctgcacataagtgtgaagaaatactggcagaagagactggaatccggccagacctcacagaccaaccttggccaggggcgatgacttggttcacggacggaagcagctttgtggtagaaggtaagtggaaggctggggcggcagtagtggatggaaaggctgtcatatgggccagcagtctgccggagggtacatcagctcaaaaagtggaactaatcgcattaattcaagccttaaggctggcagaaggaagggctcttaatgtctataccgacagccggtacgcttttgccacggctcatgttcacggagcaatataccgacaccgtggactgctgacgtctgccggcaaagatatcaaaaataaa

SEQ ID NO: 28855 - DNA, 1156 bp, Mus musculus
atgtctataaaattgggggcattggcactgtcaccgtgggccgagtggagactggtgttctcaaacctggcatggtggttacctttgctccagccaatgtaacaactgaagtcaaacctgttgaaatgaagcttttagtgaagctcttcctggggacaatgtgggcttcaatgtaaagaacttgtcagtcaaatatgttagacgaggcagtgttgctagtgacagcaaaaatgacccaccaatggaagcagctggcttcactgctcaggtgattatcctgaaccatccaggccaaataagtgctggctatgctcctgttctgtattgtcacacttagcatgcaagttgactgagcttaaagaaaagattgatcgtcgttctggtaagaagctgcaagatggccccaaattcttgaaggctgatgatgctgccattgttgatattatcccttgcaagcccaggtgtattgagagcttctctgagtatcctctctttggtcattttgctgttcctgacatgagccagacaggtgctgtgggtgtcatcaaagctgtggacaagaaggctgctggagctggcaaagtcgccaagtctgcccagaaagttcagaaggctaaatacatattatccctaacacctgacaccccagttttaatcagtggtggaaaaaagttctcagaactgtttgtctcaattgaccatttccatttaatagtaaaagaatgattaatgataacaatgcatcaggaaatgcagaagggaagaatgaaagaccgtgtgtgtgtgtgtgtgtgtgtgtgtgtgtgtgtgtgtgtgtgtgagagagagagagagagagagagagagagagttttaagttattagttttcaaaatcagttctttttaatggacacaactttacacaactttgagaccattaaaacaagtttaatgagagaaaaaaatatacattttaatcagtagcacatagaagcttttctaaagtaaaccacattctttacaaattcaaaaatattgaaataatgtcttttattctatctgaatacaatataataaaacttaaaatgggcaagtaaacacctcttgtaaatagacaaactcatagagattaaaggactccttactagattactagttgctgaattcatcaaagaa

SEQ ID NO: 28856 - DNA, 1173 bp, Mus musculus
gtgaaaactttgagcctttactggtctatcttgtactaggaaacgagtatgttgagaaacggcagaatacacagaattgcaataggtaagcacttgggtaagaacatacaattacttagaatataatctctgttgattagacttcatgccaggaccttagtttgtgttagtcgggaagcttagagatccacagtttttctttaagaagactgaaatctatactttcataaagtagtataaaacagtttctaacacaccgggatgaggcagccttgacttttgaacttctggattacacaagcctctgaggcggctgcagctccgccctgttccgcccggctcctgctgcaactacatttcccagaagcgcggcggcttttacgtcagcgtgctgctttccggcagcattttacagcatttcaaagtgaaggctcggctcgctgtgcactcttctgacatggggtcctctttttcggggagtaccgagttttccgctcctgcccccccaactgtttccacagcggttcccgcgaacccacccgcgaaatccgccgtgccggcctcccccgcccgggaccctgagttaaaaacctgctggagttgtcgcgtgctgtcgggctctacactcttcggggcgggcacctacgtctatttggtggccaggcggcccctgaagcaaggaatcccacctggcccaggcaccgttctgcagatggtcatcggcatcagtgagcaggagcggggacagcgtgaggggtggggtggggtgggtgattactgggacgcctttcccctcacggccctgtaagaaagattaccgaatgatcgacctttcttcttcaaccatgagagggttaaataaaatgctttatgcagagcactgggtaaactaaaatgtaatatacaaaaggcacttttttttcttgttctttttttcaggtattgcctgttggggtgtagttgttctggtagaccccaaagggaagagccacccagttatttgaaaataccagcagttcattgttgtctatcatcactggcttctgggcagacagaacaagcgttgggttggtggatattcgttgcacacacggccaaggatgtacttaactgtaaggacataccgagaagattgtgaagatatgagctgtcattctttggccatggatgctt

SEQ ID NO: 28857 - DNA, 1134 bp, Mus musculus
ttggggtagggactcagtttgtgttttttcacgagatgaagatagagcgcagtggctgccagataaattaatttgttagatgaacacagattctaaatcttctaaagtatcaccttgaggactaaaattcctcttttgcttaaaagtcggcttgaggactcaggctccgaaaaagctactctctgagccagctccccgacaggaggctggagactagcctcagctttacagtttgcatttaaataaagtacctagagttccccaaaagaagttctgctttcctactttctcactgtctttcaagattttgtctttcaagcaggtaaatcaacattctcgaggcggaccagtggatgtgcatccccgcccccctagagcacacaggtggcagctgttacccccagtctcaggacatttccagcacgtggttttcagtctgagttaaaaattaggtttaccaagagggctagaaaagtagatatttctatattaataaagattggttttttattttgataggcaggcttagccccttagctgacctctggcttttcacccttgctgttactgcaaggtgtccttagctcaataggctgtggaaaaaacagggatgaggaggaacaacttccagctcctattttagccacaaatcgtggtgttactaacaacataattcttgcttaggctttactaattctgaggttgataattctcctttaggagctgcacagcactcagaactgtgcatactggtttgtgattgtacaaattcagtatgggcaccgcttggtgcagaactactgcaagggaaggtccagcttgaccatttctgagtttcctgtgagataaacccggtttaaaagaggttggtatcatattttggttaaaaataaaaaatattttccggctctacctcgcctccccaaaagataccgagagccacatgtgtgggttttaccagtacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcc

SEQ ID NO: 28858 - DNA, 1420 bp, Mus musculus
ggggatgagagtggcataaggagcagaaatcacatatagagtgaccatggcagagagagggaagatctatagtagcgttagacatatgccagagactttcttttctctctccttttctttctttcttcccttcttcccttcttcccttcttcccttctttcatctctctctctctctctctctctctctctctctctctctctctctctcctgttcttctatctctctttctttttaagataaagagatgaagaatgagtctaaatttgggggagatgcaaagtgggacaaaggacttggagggatggaaagagaagaacgtttggtgaggatgtgatgtatgagaaaagaataaaaggaaaaaaatcagagataatgcattttattaattagtgattggtggggaaaggcttccctttgaggtaaacctcacgcggcctggacatggacaggattgacagaatgatagctctttctcgattccgtggttggtggggtaaggctgttcttagttggcagagcaagttgtctggttaattaagataacgaaagagactctggcataataactagttatgcaacccccgagcagtcggcgtcccccaacttcttagagggacaagtggcgttgagcaataacaggtctgtgatgcccttagatgtccagggctgcacgcgagatacactgactggctcagcatgtgcctacactatgcccggcaggcgcgggtaacccattgaaccccattcgtgatggggatcggggattgcaattattccccaccaacgaggaattctcagtaagtgcaggtcataagcttgcattgattaagtccctgccctttgtacacactgcccgtcactactaccaattggatggtttagtgaggcccactggggtcaggccgtggtggagcgctgagaagatggtagaacttgactatctagaggaagtaaaagtcgtaatgaggtagtcttattcctgagcctgttttcctagattctggaagaaagaggatgagtaagccatgatgatcaagccagtaagttacaacccttttctggaaagttgtattttggccatggtgtttcatagtaggaaaaccaaaacaaacaaccaacccacccaactaagagaaggaaaaaattggcccttaagtgagagatcattatgagggcaatatgagaagtagccaaaggcagtataatgtggctggaagaaagaaaggcttttcatgaatacatggaaaagaactttagtaggatagacatctggcatgaaatgcataagaagtttctgaaaataaagtgtcttacttaggattcctattgttgtaatacaatgttgtgacaaaaagttacttaaagaagaatttatttgttttactcttctatatcatatttcatcatcataggtggt

SEQ ID NO: 28859 - DNA, 1224 bp, Mus musculus
ctcaaacaaatgagcagtgcctgtccaatttcacagtctctgttgagttcagttgtaaatatgtttcaaatgacattttcttgggaaaaaaaaatctctacaacgttgtggaatgtgaggggcaactgtctcccaggcataggcgtctcaaagctgcgtcagctggcgtcgtcatcgggcggttcatttgtgcttctgtcactgagaactttgagcaccctgggacgaggtacccccacctcaatgatatttctctgagaacaacttttgtaggactgtgtgtttctttagatacatttagtacaactgtaggtgacgagtagtcagtcattgcttgctagccacacaccagggttgatccattttaaaacttttggcatatttgtcctcctgggccataaatacagaaccttgtgttttaattagatttttggaaaaaaaataaaacgagtaaaaggaggcacatgcataatctccatgtaacaagcctttagcagtgggatgtattacaggacagttacttacttaatttctggagttcgggcctctgggataggccccagactgggccggaatgttagtgaaggttttattgtgcccggttggaggataatgttctttgtgtactttttgtgggtcgcaaatgaactcgattgccacaagttttaaactggtgtaaatcaagcttgacttaatgtgattgttactgttatatccagcctatactgctagcagctgctcatactgcagtcaattactggaagcggatatatttcctatgcaaaaactgtttaaaacaataaaatgagctatgctacagactctggcctcgtgttttatttttctcaatgtcttgatgctctttcagcatgaatgctgggtcagtaggattttgaaagttgatcctggcccttacatttggacgttgggtgacaccagcttactttccagcagctgggagggttaatatttcagttcagtgctgaactgcttatctgtgtagttcctcctcccacgattttttcagcagtgataatgaaaatacaagtgcaggtacagaatttcagacccagaacaccctttgagctgcgacttgaagacagcgtgtgccacagagaccagactgtggtctgttggacagaaagccacaaggacccacacacacacacactgtaaagggaagggaaacccttgcccctccctgtgactgtgggtttagtggtt

SEQ ID NO: 28860 - DNA, 1209 bp, Mus musculus
cgcctaccttgtagacagtaatttgtacactgtatagttttgttaagaatttttttttaaattaaaattcccatgtttgtaaagctaactttttaacaattataatggaactatatgttgtttccatttttaaagtaaacaagaatattccttgtttagagactggactcgagttaaaactctccaggctcttaagttatgtattaaaaaaaaaaaatctgtccatgttaggagatatttcacaggttcttgtgcttgaaaagcataggacgctaatccttaaaaaaaagtgtaaatggagaaaagttatattttatgaaggttattttgttgtatttagtattggaagagttggttttcagagcatttcagaatgttggaagcaccgctgtccttttgttagtatataaggccttttagcaaaggttttctccttttttttcctttttattttgtgattattccatgatggtatttaaggataagtttcacagagcattcaggataggcagaaaaaataatagtgcgatgtctcacataacgtgtcctcagggagcagaatccggatttgtgacttgtagcttcaaaaggactcaagggcagagactgcacgggaacaccttgagcagcgaagcagggcatgttctctacctagacgcagattctatgtaccgtgtgaaacgatgaaggctgcagaaagttaccccctatcagtgaacagtattccttctccatgaaacaacgctacagtcttgctggcagataggccccaagcatggcattcaatatcgcttacatgttcctgtcaaggtcttttgttcacattaaccagctgcatgcttcctggactttaaaaattggggtttctatatttaaaaaacaaaacatatgtgcaggctattcaagttcaatagtaaaaactcaaaattgaatgttctactccatgctgaaggagctgaaaactgccttcttcatgttttgcactttctagtagttgccctgtcttttctaattcctggaaattgtgtgggtggagtggatccctgcactggggggaataacatggaccactgattttgccctttgaccctgcacaatgacctttgcatcagccaaactcattgccatgacaactctttgtactgtgtcgtgccacagatctgttggtcacattgttaatagtaaaggggacaagttggagacggtcaa

SEQ ID NO: 28861 - DNA, 1157 bp, Mus musculus
agactggacaacagggagaaaggagagaaactgaagaaagaagacggtagaccagcattgcagcacttacagtcactaattcccttaaggttgagactatagtgacaggaaagggtcaatgacatctcactgatgctagactgcagcccctgcaccgtagcctttgttacatgaagtccgctgggaaatagatgttctgtctctatgacaatatattttaactgactttctagatgccttaatatttgcatgataagctagttttcttggttagtattcttgttgtttacgcatggagtcactattcctggttatctcaacaacgaaggctaggaggcggcgtcagaggtgctggggacagagccatgagccagccattttataagcactctgatttctaaaagttaaaattatatatatatatatatatatatataaaagaatctctgtagcctttagttatccgtacagatttattaaattttggcccttaacccagccttttccagtgtgtaacccagtttgaaatcttaaaaaggaaaaaaaaaaaaaaagagaaaaaagaaaaatagggaaaaaaaaaacagtttgaactcaaaggctctatggaagaaatgcctctatgtgggtaaagggttacctctgcatgcaacagtaaaaagtaatataatgttttccccacaaaagaaacacttaacagaggcaagtgcaatttataaatttatatctaaaggggaatcatgattataagtccttcagcccttggactctaaattgaggggattaaaaagaatttaaaataattttgagcgaatttattttcccctcagtttttgagggcatttaaaataaggcattaaatcaagacaaatcatgtgcttgaacagaaaaaaaataaaaaataaaaaaaatattgaaaacacagcacttaggttggcttagctgcagcctcctcagaggtcagattatttatttaaaattactggttgcatcaagaacccatagggtgtacaaacggttctatacaatctgcatcgtagagacaaagaggcagggaaatccatgtcacaagggtaaagctccccgtgtacaggctgggaatgccaggtaggctaggaaaacccgctcgctcttcagagaagtgccatcagggtgct

SEQ ID NO: 28862 - DNA, 1105 bp, Mus musculus
aactaagttacagcgacgtcaagaacagtcccctgcatctgctctacctagagctcaagtgcaggaaaggtcatgtgctcctcactggccaatcacaagcactttgtaggggtttttggttttggttttggttttttttttaccggtacagataatgaaggattttttctttctttgtcaaaaaattttctaccgcccttgaggacatttctcccactaaatagaagatggagctaagtcattctctgtgctgcagtccaactgtgttcctcttttagaaaagtattagtaatttttctttttttagttccacatctgcttaaccctgtctctaaaagctactacattccctgacaatctctgcctacttttacattaagaatcacaggtagctatcattgattgatccattagacataggagaaaagtgtatctatcaaaaaggactccagagtagccaggcctcagcatctagacagtaatatagccatagcacacactgagagacatccacaccgaaagataggttgtgatttattgcgtagactttttttaaaggggggggaaatagttgatttgaattcaattaccgtttctttcccattacttgctggtcactgagatgaaagagaagagaaatggagaaacccttttggtagtaaatcccacttctctgggtttcttatacatggacagggtgttcgttctgacagttcacaatttttatctttgtttttgttcttccttaatcagcctacacagcctcaggcacatctcaagccaatcgatatgtgggactaagcccaagagacccatccttcctgcatcagcaacaggtgggcacgtttcccccaggtggaatggggaagccacgctttgcttcggcgcttttctccatgttgcctctcagatctggactcaggatggggctcacggggcttctgagaccaaaattgatcattttgttttccaattttttttttcctcatttgtcctctgcttcttacttctctggagtttctgaaactagctcacagcctcttctgtcttcctagcacacagtgacaacactcacaggactgttgtacctcagccagactgtagt

SEQ ID NO: 28863 - DNA, 1034 bp, Mus musculus
gctgccccggctcttgtacctgtgttgccacgggattgtttcttaataattccactgcttgtccaagtcttaaaaggcaaagtgagtcatttttctcaagtaggaaaagagaggagagaataggagagagtttgccactgcttgctgtctcctggtgtgattattaaaaagcaaagaaaaaaatcaacatagaataaaagcaactaatgacacagaaggaagaaattcatcccagtcagaggtataggatgaatgggttgtaagcccaaggacagacaggaaaacagagggagcatggagttagcctggcaagtttaatcacttgacacacacctgtgccattctgatgctccaagtatttgctgtctgctccaattctcccatatccctaattgaaaagcactgcttgagtttcaataatggtgtgtactgtgggtgcctaggaagaccctgtcttaaaacttgctgggtgtgctttcattcagctggactgtgtgtaagtctgagggccttggcctgcatcgtctgctgttgtgttttgtctcttaccctaggaaacccttcactaacatttccagtgctagtggtaataaggaagagagtaggtcagagaactgtgagtcctttgaggagagggagggacatacaggcgggtgggaactgtgaggtatacttaattgtttagatgagacaacgtctacactggttcttctaatgaaaatggactatgtatctaccttaagaacaacattgcttttaatttattttagtgatttttgttttattcatgtaatattcaattttctttgcaaattgcttttaatttaaactgtggaatttttacttctcttgaaatgtactatgtactgtatttttagaaatcttatttttaaataaatatttttgaaaaacataggaatgtttttatcctcttacctccttaattattaaaatcgactaatattctaagttttagaactaccatgttttaagactccccccatcccaaactttgtgccctttgaataaatatt

SEQ ID NO: 28864 - DNA, 1894 bp, Mus musculus
tatttagctgttcttagagtctacaatattttacagtagaacatgggaaagtattagaagctgtttacatgaagtcctttataccagtattgtcaccgactaaatgaaccaatagttagcatttctgctacctttctgatggtgatgacttaacttcaagaagtggcttttctcacttcttccattatctttatgcattttttaaacaaaatttatttttaaaagccattttgttaaaaccaacaatattttgtgagttctttagatgtggcaatattatctgctagtgataatttgtagcaagttatcattattattattatttggagacagggttttactggctttgcactcagagtcctcctacgtttgcctcccacattctggggttataggcatatgctgctgtgcctggctcagtgcttaaaactcttaagtcattggtaatactgatttttcattatcatatcttttactatattacagctttcccctgtatctaccctagagttcaggtaccaatgagtaatgagtatctaaaaactagattaagaacattggggacgttagtaagatggagtgaaggctaagtggacagaaatagccagcatctgaaaagagctgactagagacagctgtgatagccagcactgtcgctgacgccacgtcactgtagaggtacctgcacagccattgtgggaagcatttggtttgagctgtttgatctccacttaatgttctttctccttagctggccagatgctcttgagagattatttttgatttcagataattgtgtaggataagttaaattcaagcatttttagcatgcacatgttaaaaataacatagaagtgtagctgtaatacaaaggagaagtgattgcttgcccaaagtttgaaaagatctggaacctgtctgaggagtcttttggcaaagaaatactgagtcaccagagaaaatcaacgactcagttatgaaggaagggatctgttgggcttcgtgagaccctagaggtcttcatttctgaagcccttcatttcctcatgtgtaaaagtagtgtttcccatagttgctcaactgtgtaattaactaattgcacgtataaaacctagttttcatctcactagctttatagggaaagatgtagcccgagcttccggggccacaggcatgcctcctctgggctttgcttgcctgtttcactcagcacagggtctggttgtttgtaggctgtcggttagagggaagatgcatctgcatactgatagctctgtgtccacaccagtgtggatgggtgatattttaacctactcgtgcctgaaattagtgttttacaacctgaacaattaaaacatcctggtgctattcactttatcattgagttacatttttaattcttgaaccaaagaattagttttctttttggttgactgagagcttctcacatctgtgtctgaagaagtgaacagtctattgacagcttaatttcagcagagtcaattgtgaatgaatcttagttagacttatttttttctgttatgcatattagtgtgggctttaattttgtactttaatgtaacatggctactatataaggtattttaataggctgaagctactaaagattattgaatcacttttcaaaagtctcaccaaccccccttggtcttacttcagcagtgaagaaaaattatctctataagcaaagtattctattggatacttttaatgactgctcaaccaaatgctaaaataaagggcaaataataggtccattttacattacaagtcaagaatttagtacctctgtgtgggggcagggtataaaccttaatggctttaaataatgatacaggtatttacctaatgagaatgaaattaaaggacactt

SEQ ID NO: 28865 - DNA, 2387 bp, Mus musculus
gggatgaaacaattgtacatacattttcttcagtactcaaagttttttaaattttaatttataggaaatttgacatgttttatgtttacctttaagcagtcctaaccaaatctgaatttaattcttcaagtttacaaaactggatacactttgttatgtataagttaaaatgttactacttgcttttatatgtgctgtaggcttttacagtgcagtgagcaacaaggggcagtgcctggctaggagcagctctctgatgcccttctttctccttctcaaaaccacagacgactccccgagtgtagtgcaccaactactaccttactgtgagggaaaaactatgtttcccttctgctgcaatcactgattgcttttagaatatttgctcccaggagaaatgtgtgaccagtcaggtttatattcctgttttaccctaagattctaatgactgaagagggtaggaagtttgcaataattccagttacttcttcaagtgcagttatattagaaagcagatgttttaaagtgctaagctgaatggtgtgtaacagtgtaaggaggagaactgtgcttttaaagtatggatacttttatttatctgccattagatctcactgtacacattgaagatttatatattatagaatcgatactggtcaactcatatcaaagtgtaaaagtgggtcactaaatttatataccagtaatcacccaagttgaaattgaatttccacttgtaattcgcatcactctagagaccttttattaatgtcaggaaattactgtaaaatagaatgatctatggtagtgatggtctcttaacaaacatgagccttttgtatacaaagacattttgtatgatttaatttttttcatttagaatactgcaattccatatgtttgtgtgcttagtaatcttttccctgaaaagagtattgaacaaatctaccatttgtgaaccatctacatacttttcttataagtagttgtaaagtaaggaatcatagctgggaaatactgtggctagttctttcagatactgtaaatgtcttataaaatattctgaatagaataatctctttgcagaaatattaataccatattttcatgttctaattatgtttatttaaaaacttagaagtggcagatgaaaatatttattggtgctaagacatatagtaagtttaatataagaaacatttataaaggttaggaaacataaaattagtatgttttagtaagggcgaaggggttgggttttgtgtaagctgattgactaacttggccaatgacagttactgaaggaagtggtgtacatagactgttgggaggtagaagttgaatgccttcagctgtatatattcagttcactcaagacctggagcatccaaagcagagccaaacgaaagcccagcgtggagctttgtaaactgctttatacttctggagcagtagtagctctgacacaaggtaacgggcgtgatcccttccccatgctggagttcgtgggtttggtctgcttacatgtaccacttctgggcacattatctaccctttctctttactctccctggtcctgacccctctctgcagtttcctaactagtcattgtacttgatgcactagtttgatctacagaaatgctgttattgatgtatttacataagaatctatattgcagtatatctatatatacttacatagtattgttaaatgtatatgtctaacccccggaggggtttgtaatcactctaaagattcctagagaaaaacctgttggccatttcctagggattaagctcctatgttctttctgcgccctcttttggctaattgatgtaattatcctggctcttgaggtttttactatcctgttagtgggttgtatagccaatctgtgaacatgccagaggtatacatgccagtgtatacttataggaacatatgtataaaagtgtaaagttttataaaaattgaaaatgaatgtgttattgttggtgatgttccttcttggtaaactgcctggcttcatgtatgtatattcttgtacactttttactgtcagtcacaaatttcgattagtttaagctgtttcatgtattttactttaaaccttattttggcaacttatcttgttagcattataaaaacttacttaaaatactattttactacaaaacaaaacatttattacagttgctgtggtaactgttattcggtatgttttactattttaaaaagtacatttaattttttcaattcaattttgggattgtccccttccacacacacacaaaggttcaattaccttaaaataattagtaattggttaataatattatttttctttgctttttaaaacgcttgtcaatgagagttaaccctgt

SEQ ID NO: 28866 - DNA, 1134 bp, Mus musculus
ggccagcctagtctacagagtgagttccaggacagccaaggctacacagagaaaccaatatatatattggttttctgagataggggttctttgtgtagccttgtgtgtgtgtatatatatatatatatatatatatatatatatatatatatatgtgtgtgtgtgtgtgtgtgtgtgtgtgtgtgtgtgtgtgtgtgtatgtatgtatgtatgtatgtgtgtgtgtgtatatatatataaaatggaaggtaactcgtaactctcagactgagagagattatcatttcaagatacaacagtagtaaaatcctatagttttcaactttctgttataagttctaaagttatttttaaatttttcaaatatttatgtgttgatgacatggaacaaaaggaggaaacagtaaggggaatacttatgtgccatgtattggctctgatttcagtagtcagcaatactgcaagtcatttaaaagcctgtcttcttctttgcaggatctctttgttgttcgccatgagctggctatcatgagactagctgccttcatgggcatcactatgttagttggaataactggactcttctatacacaactgattggcatcatcacagtaaggagatttttaatgtaaaaactgacaagtatgaacagatggtgtaattgtggacttaattctaaaatgttacaggaaatttacaaattaatggaaaaaaattacccacaattattatgtgttaaatgtacataaaaatttgcatccctcattttaaaatgtgcagagtatttttatatagtagaccttgtgcttatgggcttcatgattacatatgttttttctgttaattagtatctagtgtggaatcattttttttctaatcttatttccttttataccataacaatcactttgatttctttattacaaataatactttgaacatcgtttttttctttaaattatttaagatctatttctgaagatagacttgctaagacaagactacttttagtagtaattaaatcatttcttgaatgtcctaatggatttatcaatgtgcaaactaacttagtaagtgattatcactgtttagtatgcctgaaagactgtcagttcctccttctatatttgata

SEQ ID NO: 28867 - DNA, 1219 bp, Mus musculus
tgcgtctttgtaaagagatgctggagagactgacggagtcatccatcaaaataaatttggatgaactatttcatcataccatgtaagatacacatgaatagtgaccttctctaaagctggtgatgtctctgtatataaggaaaatatcagcagaccctaccctagtatatatacaatagactccactatagggaaactttttatatgttaaatgccataaaatgaacagtaataatgtgggagaatatttttctttattgtgcctgtaataaagtttaaaagttgtagcatctttatagagcaaacattcttaggctggtagaaaaaagagagagataagctattcatgaatatataagaaatataaattcccgttaacatgataaaataaaaatttaaactgagagatcttccttctgtgattttgcttcacagacaaggtgcgtttgctagtttgtttcactgccagcacagttgaaaacaaaatgtgcgtctagtcttttaattaaaacgttggaacaggaggagttgtctgtacggatgttaggtgccacctgatttagaatatcttagttggtaaagcgctccccataactacgagaatctgatttccatctctgcccccaggtaaaaagcagatgagccggtttgctggtgtgtgtgtatgtgtgtgtgtgtgtgtgtgtgtgtgtgtgtgtgtgtgtctgtgtctgtgtgtgtgtctgtgtgtgtctgtgggggtggggcgggttgcctggggagatggctcagtggttaagagcactggctgttcaatccctagcactcccacagtggttcacagctatctcttaactccagttctaagggatttagtgccctcttctatcctctacaggtaccaggcacgcatgtggtatgcagacacatgcatgtgcgtatgtatacatatagaataattttttaaaaaatctaagtgtagaggtgacacctgttatcccagtgctgggaagcagaggcaggagggctgtgggcctgctggccccgcccacatggcaagctccagaccaatgagagaccttgtctcaagaaacaaggtggagtttgcgcggggtgggggtgggggtgggggtggggggcagaaggtaggtgttttcttctctggtgcagcttcaagtaaataagttgcccttgcttaaggaaataatcctgaatgcaaggtatgtaaataaacataatt

SEQ ID NO: 28868 - DNA, 1123 bp, Mus musculus
aagaaaaagaaattgttttcagtggaacgtaactgataatgagagtatctgaataactgaacatattaaggaatattacttacatttatctaggaaggaattgcattattctgagtttgaagtatactcagattgaaggtgtgactcattctgcttgaggaatcacacacacacacacacacacaaacaccttactttagtcttatcttaatggagcaggagacccaggcaggtcacagttttggagatagtagatgagtataaataattttcacaaattcccatttttcctgaagtaattttttccccacagtagacagttaagtgttttcggtacagctctccccttgcccactcttgtattaaaccaaggttaccagcacgggtgctaagtaagctcgggaccacagagcacttggcccaagggatttatttttaacttgcacaaaagagagagattatggtaaacattttaaatctcaggctcttggttctgttgggtccagattacccaagacctagagagactgcgtgtcactggctcgtgctgtacaggaaaccacttatggttgacagtgggttgtgcaccgtcactgtgtcatggggattccagaagccacgtcttcaccgctttcatcagtttttccttttgttgactgttggcatctgaccacctgggtgaatatcagctgtctctttatagattactattttaaaatatttatttcagatgttcatagaatgttcaattttttgatgcaagttatttacagaggcatatatatttaataattgagatatattattttattgcacaacctattttccaaagcaaatttactttgtaggtgtttgtctttttgtgaagaaaaaaatgtttttttcttttgcctcaaaatacaagttgtaaacctgtcttctggcgtaagtgactcttgtgataatatttgctttccgcttatttgtgaaccagtttggagttgccagttgaaccctcagagctcccctctgacctggattcagtgcagtgctggtcaaacttggcattgtttccctgcctcggtttcctctcctcattgcacttgagtttggcctccgttagttcgtttttcagcaatcagtt

SEQ ID NO: 28869 - DNA, 2234 bp, Mus musculus
atggcatgcattcacatagaaacatacatacatacacattaagtagacaataaatcattttttaaatgactacttttatactatcaaacaaatctacttgtgctattttattttgtggttttcttttgtttatattgctcaaattctctctgtcagcactgtggaccatctatcagtggctttataagtactgcaatagaattaataccacagaactttatctattttctgtcatgttcaagatactgtaccggcaccaatttcttaggatgtttgtaagaatcatcttttaaaatctgttgtgatttaagatgttttgtgaagagcaagtgcctaagagacaacgttatctaatcatctttttgaggccacgggtaataggctgggtttccagtatgtctgattgcagtttctgtagctacctgcagaggcagtgttctgatcggtgttttgtaaatgtaaggattgtatttcagagccttgggagggaaagcctaatttccttgggagaattgatggaagggtaactacagcaactcccgagtatatttgaccacttgctctgtctgcacataggagatgttccctatttacactgcagacagttgagtggccttctagttgtcctgaggacaggaagagacaagtgggcaggagctaagggagatcaattcagattcctggacactgcagctgttcgagcaatccaacagcccaaccagctccttgggaatggagtgaattcagcagttctggtgactgtcatcccgccctggtctgagtgtctgtctgggttaattgaattggaggtcagctcattctacaatgctttgatcggggtctaaaatctgaggtagggaaaggtaaaaagcaggtaccctctcttcaaatagaagcgcatgttccttgtcaatcattctactgtgatgggcactagtgtcatctgctattgtgtttgttatgggtctggctggctcatctgtcctgtgccatctattctgggtagatccttgttagtagagacccgcaccctggacagtaaaaataatggaaaaagtctttatgatcaagtggaaaactaatcctggaattattctgcttaattctctggacattttgtttttcctcttcctttcttttcctttcctttcctttcctttcctttcctttcctttcctttcctttcctttcctttcctttcctttccttttcttttcttttcccactggtttgccaactttgtattcctgaatcaccagttctggtgcattcagttggaattagttcatgaagtaactgaaattctaagcatttgtgatttatcaggtctagaatggatcttagaaaactacattgtccctttcagcctgtgagcatgttgggcctgctgttctctgtctactgcaatagcaacttgtcagctgtcgctgctctactcttgccgtggccaggggacctccctcttacaccatgttgtgtcatacatctctcagtggtttactttttccatcccgtgtactgggcagatgatagagctccgtggcttgtttgaacattggcctttacccacctctcacccctgtgaacttcttgtgtgccatctcaaagtctttatttttaagattactaggttattttagaaactatcttcgatgtcacagctgttggggttgtagaaatatttgtagatttcatgagtaagacaatttatgaaaaatctagtgacccctttgcaagactttggcattatggaaatgctaacattggttctcgtagctagcccattatactatttaaaggttgttaggcacaatttatttcccttagggagtaacataaaaggtgacttaactaaatttaaatatttcatgccttccagttgcctattgtgaatatcttgagtgtgtgtgcctaagcgatatacataatacaagttttaatctctttaagcatctcttgattagatgcaggggtagctctaatgtatcaatagaccggtatcagtaagtaatataaaataacccatattggataatccttcatgcccttttaggatgaaagcatttctccgagttactttcttcctcagagcccagttgtctacgtactttcctttatgtattagctggccagaaccctgcatctttagttagtatttttttttggcatattgtacatttgctgttagctcttgttattttagaatgctgaacttgaaatataatgtaaagggc

SEQ ID NO: 28870 - DNA, 2206 bp, Mus musculus
tctgactgtacaattttatccttgtcttcagaaataactataaggattactccctggagtccaggctacacttcagaattcaagcagctcttcatctctggaagaaaccttccacggactgatccggaacacacaggatggatcttcccccccggttaacattgactcttgctatggagatcactctctgtgtcaaggtggacccatgatccatcaaataagaaacagaaagcctgctgtcagccacttcctgtcatcggagtggcgtactgtttggtctacatactttcccctctggaatgacatttaatactatacagaaattcttatactctgccttcactgtagatttcaattgagggggtgaagtcttttaaaagactggcaggtacaataaagcctagttagattatttatttttttaatgtaaaaattaatattgttcaaatagcaaatggctttatcagctgagccatttttagattggcttgtcctttaaacttcagagatattttactgctgtttaaatctctgagagtaaataaatatcacatctataatagtatgacagtgggtttctgaagattctggaagagagaaatgaggggcctgaggtgggtgaagtattcctaggcagaagggacttgtatctcagcaagatgtcacagttgtaagtttcaggatttccagtcctctcattggttgaaggtggtggcatttttcagaaactatcctgtatttgaatgtactcatatcagatccaataatagcattcaatcacatagacacatttctcatgtatctaagggaataaaaagctgtattttagatctccctaagcttagtgctgaagcctgaactacagacttccattgtgtttcttacaggaaggagaagctcctgttgctgtgagtgatatgtgacatgtcagtgattgtttacagtcatgatgctgctgacccagggccatggctgcatcttggttctctgagtaggaacccggatcagagcctgagcagatgcccttctggggtccccacacctgtcaatcaccctttgtgaattagaaagaacacgctcatttcgagaaacagaaaaggcacagatggctttaatttctctttgaattgtgtaactgtgagtctctgtgttagacactttcaacaatgcttagcattaatccaaactcttcccattagaatatagtttcttcaacccctcgctctcctcccaatcaacggcctatcaatagtgggtgttacagctgagggccagactccacccagtgacaaaaaccagttagagtccatggacctgggcttttgtcttgtttctattatttccaagaccagtaacttctctagagggtagatggctccaccttccctcgtcagcgccccaggtttgtagttctgagtctttctctgttggttaatagttaacaacataaagcaaataacttaccttttccaggacttgggttttccagtgggagaggcaaggtagcactcactgcctgcagcctccagagctggtgcatttggtagctttctgtatactggggaagctgtacacggaggagtgagtttgataactatggccttgcacatggattacaatacctctagtatccgctgagtctgtggtctcttgtctacagtgagatgaacgtgagcattcatgacctttcagtttatttatttatgcatttagcactgacagtggcccagattatggagttgctcctgctgtccccgactgcagttccccatgctcagcaggcactggtggcctgttacgtaaggtgccatttcttattcaacattgataacacggaggcagaaatcattatatctcactaatatgaatcacacaattagctacagatagtagggaaataaattgtcatgagctatagaaatatgtttaataattatatatatatatatgaagaaaagtttataaattctttagaagagctttgataacgatattttaaaaacaatctattcatactattaatgtgatggggtgtggtggcacacattgttaattctagcatttgggaggcaggggcaggcaaatctctgagttcgaggccagcctggtctgtttattcaaaactcaaaccaaccaaacaaaaagaatacccatattttgtgagaaactatcaaagctcatggtctgtaaattcccattctgatat

SEQ ID NO: 28871 - DNA, 1186 bp, Mus musculus
gcgccatttctgcatattggagcgcattactgggccgacacatgtttttaatgatataaaagaacctgagcccagtaaaataaatattccaatgatcatttctaacgatatgcttggaaacactttatgtaaacaagtggcagacattttaaaatatttccctttacttaaaagtaacaacagaaatttacattaaacaaaattgttcatagtgtcagtttaaaatactgttttccttccgtgtctatattgtatccaaggattgtatgctagagataattagtatttgtttgttgaatgaatcaatgaatgattttttagtaagagtataagataattgcttacttaccttagagcataaaagacaaaaggatatagtaaaccaggggaaattatgccactaaattccaaacaaggaaaggttaggaccaaatcctgacggtcctgttgaggttttcagcaacacctcacgtagctgccgatggtttttcatccttactccttaggaaatgatgtacgtctggaatggcttttcaatagtgggaaaaaggaaggacctttctgaaaatctcttggtgactgtggagaaggctgaggaggcattgcagaatcaaggtaagtgtgcgggcccaggccctgtgtctgctctccttcctcgcctgtgtctccccggtgcacatgtgcctgccttgatctgtgtgcatctcacgagcccaccttgatctgtgtacatctcacgagcccaccttgatctgtgcgcatctcacgagcaaggcttcagcttgtgcttgtcatcaagataaagagacagcacctcgttacatcagtgagtcttgagaacctacctctaaacaaagggcatgtgccacaaaagaccatggtataggatgagactccatttttatagtctagccatgaccagtgtttaaaggaagggtcagtcagcatctttgtttttaaggagcagctcttcttagtctttttcggctactgtaacaggataccataggttgggtaatttataaagaaaaaaaaaaaggatttttttttttctcagatgtggagactagtgggtgctgaatcaaggtgctaggacggaccaggactttcttactgccctgtaacgtggcagagggcatggcgtggggagagactgaggcacacagcacacatcaccattctcttc

SEQ ID NO: 28872 - DNA, 2145 bp, Mus musculus
cgcctcgactcgccttgccttgcctcatccccctcccttagattttttctccctccatcctccttttttagataaggttcaagtagcccaggctggcctcagactcacagaagaggaccttgagttcctgagctcctctttctgcttctctggatgctaagatcagctgtgtgtcaccaagcctcacccttttcagattttaaggtggtgcactgcccccattcaactggggaaaaaaaaatagctttgcttataaactttttccgaggaaaaaaagtccagaggctgcccccttgtgttgaatcagggaaaggcatgttgtccccagcacttcattctactgtgtgggtttcaattgatacttgaggttttaaagcaggctttttggagcttgtatcatttcagtaactatggaggagaagttgagatatacacggtgaggattaggtattgttggtatcagaaaaaacctgggcttttgtgtctttcctttccattgtactgagatgtactcaccggctgtgttttttccagggccaaggagagcatgtaccacgccttgggctacagcaccattgtggtgttgcaggctgtcatgaccttcgagcagcaggacatccagaatggcatctctgccatgaaggacgctttacaaacctgccaaaagtatgactgagtaatttatatccgagctaagacaacccctgccttcccgccagagtgccaagtgaatgcaggtcgctgaagtaaggggttggtttgaggttagccagagctatggagcaggacttgagatttaaagtgtcttggacagttccgttctatgcagtggaattataatacagctcccacttagcacctgtgccctctgctgggtacatggggcctgagctatggtacaagtctgagggaggcttcagaagggctagcagagagcatctttctagttcttttgcggtaggttggttaagaactgggtgccatgtcaagtcaaacagggagtgcacctgttctatgtgggagaaattgcacactcagaagggaacttttatttgcccgaggatgcctttggacacttgatttgttggaatgagagtgtcagttctcagctgtactctgcatgtagaaggccatcgtgaaggctcttacttatattggtgaattttaatgtggctaagatgaatcgtcatgtgactttgttataatctcaaatggagaacattttcctgactgcactttcagtccactcttttctgaggtaagtggaggcacttacctcaggcattctgctttcatccacaaaggaggggaggttcgtatgcagtgggcctgtgggctcctctacaccacccttagtaggctgagtgctcatggttggtggttcaggactaggcactgtatgcagaggagggaggcctggccttgcagagggactaggaattgccatgtggcgacatcttgctgtgattgaaaggatcaccagtgacagtgagcttcgcctgatgctgatctttgcccttgtcttcaatgcagatacaggaagaaatgcacagttgtcgagtctttctcaagtctcctttctcgagggtccctggaacaactgagtgaaggtaagcatccactgaggcttggtctctctgtcttctagaggctaagagcccctgaaccatcactgaagtgtagagaatgaaggaagtggcctttccttttcccagctcaccctggtccctggttgactttgaagctgtgtacacatttgtgcaaacagaaatgcatataagggacgcgcgcagtttgtttttcacttgctcttttttttttttcaaacattgaaccacacacttgtgctacaatgtgatcttgccccacaccagtgtccgtaaatgcgttttctctgtttggagctgtgcagttgtgaaatgggatggtactcggtacagcaacgtgattgttctttcatcactgaaggacagctctatggttttaatttttggacagctctatggttttaatttttttcctgttaacaaatattgttgtcctaaaatccttgtgtgtgtgtgtgtgtgtgtatatatatatatatatatatatatatatatatatatttgtgtattctttcaagtacttcatgagacagttttc

SEQ ID NO: 28873 - DNA, 1200 bp, Mus musculus
aatttaagtatttgtaaccagacccaggtctggctgctcacctacacttaggaaataagaggccggtgggaaggaatttgttttattgaagaactggtattcagggcctggcatgggagcatacacctgcaatgctggcactcagaaggctgagggcaagcaaggtttgttttcagtgtcagtctggctatagacaaaacttttctcttacaaaaaaccaaacaaaccagcaaacaaacagtgggactggagaggtagtttactggttaagagcactggttaccctttcagagggacctgagttggattctcaacacccacacagcagctcataaccatctgaaactccagactcagaaaactcagatattcactctggctttctggatcaccaggctctcacacgtgatacccatgcagccagaacagccatgcacgttaaaactgcaacaaacccagcagcctaagagggtgggtagctgttgcctcagggctccatcttataaatgtaataattatttcaataacgttctaataaaatatgtatagctttacttggggaaaaaagttctgagccatgcttggtggctcatatctgtaatctcagcccttgggaagtcgaagccagaagattgttgtgagtagagacagaccctaacaaaaaacaaaacaaaacaaaacaaaacgctggaagactatacatatagtaatctgggctaagcagtgacgcactcacggtcccagcatttggtacatagagtcaggaggacgtggcaatttgagaccaccctgattcacataggagttccaggccagccaggactatgttgccagactctgcctgttcctgccctcttcctcaaggggggtggggggaggaaaaaattaaagaaaagggatacaaaagatgaaggctgtgggttagtagttttaacctataggtcatgtttcctttgagtggattgcatatcagatatcctgcatttcagatatttacattatgattcatatcagtagcaaaattacagatacgaagtagcaactaaataattttatggtttggggggccgtcaccacaatatgaggaactgtattacagagtcacagcatttggagggttgagaaatattgctgtgggtgattttaatatttatgtatgttaaaacataaggaaagttggtaagtctcccagtggtttta

SEQ ID NO: 28874 - DNA, 1132 bp, Mus musculus
aatgcagctgagtggaaggagacagccccagctgctatcagcccagctcaggttaacaagtcacctcccatcactgagatgctgggtgtagaatgtcttttggaatcctagctagtcgtggattgtagctttctcagcagaactttccttggtgtcccccacccctccacagacttgggcacctccctcccctcttttcactgcttacatgggcaggtggcatctctccaggtggtgtctgccttcttggttctctgccttgggtctattgctaattgtctatagcaagaatctgatactgtgactcccaagagactcttgtgtttccatctttcggtctatggacagttagttcccctgacctgcccctctggggcccagtagtgcatcttgactggagtcacattcactaccacacctcactaccacacctcaattgaggttcaggcccagaggaagacaggaggagaaaaccctttgttagcagctctgttaaaactccttctccatccctgggctcaatgagtctgggttccctcacacttcaccagatttctgtgccactgtggccagacagccatgttggtgaagtcatcatagctctcggaagggactcgaggtgtgggatccttgggagctcctaatgctatcgtaagccttaaactctttacttaaatacctaaagatcctgtagtatgtgtgtgtgtgtgtgtgtgtgtgtgtgtgtgtgtgtgtatatagccaatgctttctcgatgtgttcaccttggccttgatcatatactggcacttgtatagggcctacgtatttaaattatctctgtaaatgatgccctttgtatgttaattgggtcgtatggtaactaataagtggtgcagtcttgtcttgggtgggaagagctagggatgggaaactcctcctctctaggcggggctctggagggtgggactgggtgtggcaggatgccaggtggcactggggacagagaaagagggtatctcactgggagaagggtgaagtttttcatttacaggatgaataaaggttaacagggtttggtgtgaagggagttcagtatggacggtcagcagggtgtggttttgaaggtgtgtcctgtcccagaggaaaggg

SEQ ID NO: 28875 - DNA, 1405 bp, Mus musculus
aattattcaatgatgtatttaggacaagctctgacccgctgttgaaaaatgcatggctgatcataaatcgttgcttttcctttctccctttcccaacctccctttctctaagccttgataaactgagatgcctcggggaagatgaagacccggaagtcatcccagagaacactgacctagtgactttatggtatgagttttgttttgttatatgctatttgttttggtgctggagatgaaacacgacctaccactaaactacagttagtctttctgctgtttatctgaacactctgaatgttttactccaccacttaaaattcaaccattagtttggtgtcctggcttttggctgtaatcccagccctcgggaggctgagtcaaaactgatgtaagttagaggttagccttagctacctagtgagttcaatgataattgatgactggttgttgttgtggtggtggttgttgttgttttaaacatttggacatcctttctttggctctgtggctctgtggctctgtggctctgtggctctgtggctatgggatacagttgtgtgtgtttccccaggctcttccattcagtaaatcacagatactgtgctaatttacccatcagttacgtagctccaaaagaagtaccattctgtaatttgggattagggtgatatttttttttttttaagatttatttaatgtatatgcgtacactgtcactgtcttcagacacaccagaagagggcatcagatcccattacagatggctgtgagccgctatgtggttgctggaaattgaactcaggacctctggaagagcagtcagtgctcttaaccactgagccatctctacagccccagggtgatattcttacatctaaagaaaaacattaagaacacaaaatccctaatatccactacatatttgaatttgcattgattttttaatgtagactttatctacttagatttgtaatgcaagcttaaatactcagatagtgtgtcccaaaataccggtgataaggaaggaattggtgacctacacctttaatcccagggaggcaggaacaggccgatctctgaatttgaggccagcctggtctacatagatctctgagttccaggccaggcagggctatatgatgtctgaaaaaaagaaacaagcaccgttattttgcttcttaatttttaatcttcaatggagccattttatttgtaaaatactataaaaatcaattcctaatcctggggcggtggctaagcactcaggaaggctgagctaaacccatcgccatgaagtcaaggccagactaagttcccggccagcttgaattaaatgtgagatcctgtctcaaatataataaaataataataatcccttcttaaatgtaataataacaataaa

SEQ ID NO: 28876 - DNA, 2503 bp, Mus musculus
ataaagtgaatgttacttctaagtgctcacttcttttatcagaagtgaccctcagtccattgtgctacgttagcttgcctctttgtaataatgcgtagtctgtatgacagctagatagccaccaggttgttatagaaggtacaaatttgtttactttccaaagtaatttagttttaggactgggatttcagtggcattagaactaaagagaacagactggtatatctacatatagaaagtccacctacaatcctttatagctactagtcacaaaaagctaaaactagtttgttttgaatcttacactcactaagaaagtcactcattaaggtgtgtgttttctttttttaattagaatcaatccatgatgcttgtaagtgataaatgataaataaggaaactagcttaattgaaaacatggccatattggaatgggatttttagtttttctatcagacatattagaggatacatcagttgctctaaggtagtaaccagatagtccacacacacaaacatgaactatcactctgtcccgtctagggaggacatgtcacaggtgttctgagcgatcaggccagctgttggtttttatcaggcaggatagttcatccttaggctttggaattccattggaaagtgacttcataccagggtttttgtgcgatgtgattaaatatgttcttgatttctcagataattattttcatctatgtaaaaattacttcaataattggacttttacaacttgactgttttgagcaaacgctgtacattatatacacaccagtcttttgctttgtccttagtacatttttaacttggacaaaaattattctagttaagccataagtgtcaatgtgtaaattgttttaattaaagttttttctaccaaactctattagtaagttattattactaaaggaattctggatttcctgctaaggaagtagtagtgttctccttagctgtcactgagaccctgctaggagatgcaggagctatgcagtaggaagctcaggagagaactgccacttgccttgtgttgacttccctttcttcctagccacaggtgttaagttatagaacatccaacttcagaacattaatggcactcctaagttatgggatgctgccttgctctgaccatgtatgttcattttgaagcacagctgctttttttaatttggaatactctgtctataaggctaattcacagacaagctatcactctcaaaactctgataacaacaatggctgacctaagagatctagtgaatgatagccacctctcccactgtgaatagagtatgcatgtataatgtgcatgtatggatacctactttgatttctcagctgcttggatcaacttcagatatccccctaatgagaaaatctggttgtaagcttgtatgtataaacaattcggccagagctcatctgaccacatttgctattctagttaggaagttaccaaggctgtgatgtgatacactaaaaatgttcctactcatatcaacttacctgagtagagatgccaggtaaaggcaagtccgccatcctgtatgcagaacgacggcgtcaatgaatgagttttattccattgctcagagaatatgcaaatagctaaattgtagcttgagacccttaagaaatgagagttactaaaaaatgtgcttaaatttgtgccacgtaattctccaacagatactagaggtgactgccccgtgctgtaaaactgccaagtataatcattcttaaagaattgtgaagcataagcaagacacttgaggaaatagctattttccatgcaggtgtatccacagggatgttcactgacaaagttgttccattcatatttacctatgtccttaaagtgacacatgatgttatatttaagagattgatattggcataaaatcggggactttatagcttgtaaactttataaagttgaaatacttttgatgtgaactagtgagtaaatataagtgataattgcagtaacttggctagcctttcttcattttcaccatcaaagaaatggaaggtatgtgaacttttggtgaaaaagaagtagaatagcattctcaataaataaataaggattccatagagtaatgtttatctgtcatctttgtctagtaaaacggggtaattggcattatgtgtgttattaggggaaacttgctggaatgtactttctgagagtacaatcattagtacaagacccacatgaactgcaataataatctgggggttgtaaaaccattcatcatgaatgtgtgattatgcagcagaatcctcagggtacttagcactattcaaaacaaagtaagaaatttgggcacaatgtgagttagccttggcaaggagatagtaccctgtgttgcctacagcattaagtgagaatccttgtagacataccacaagcaggcacttgtcagctccacgtcagtcgccataactggatgtgtaacattatgtccatgacacgtgcttc

SEQ ID NO: 28877 - DNA, 1195 bp, Mus musculus
cggcgcggatgggaagcgggcggccgcgctcgcagcctccctcctctccccgccgcgcccctccctcgtgggctgcggcccgtgggaaaagccctgggagcgccggggtgggaggccggcggccgggtggcgggcagcatccctgcctcaggtggccgcgaccgcaggccccggcgctgctcggggccgaggccgcgctctgtccgaggaggcgcgcaggcggctccccctccccctccgccgcctcccctccccctgccctcctccccgcggcccctccctggggtttgcgctttaaccgccctccctgctgtccctcgcaggcgcgtcgggacaccccgaggcatcctcccccgcccgcgggcccgccagtcccagctcgcgtctgtgctctcgcatctcctgatcgcggctgcgctgctcccccttctggtcttgggactcccggcgtcgcccctcaaacatgactcgcgatttcaaacctggagacctcatcttcgccaagatgaaaggttatcctcattggccagctcgagtaagtgatttgtagccccggtgtagcggtgcggcctgcctcccatcgtttcttctcggcttcctttcagtccttcctctccttttctctttaccgttacttggaacctttcattttagctttctttctttttttttttttctgtatactcacgtacaattgtaaaattctaggttttccttcatatccgcggcggtttccctttttgagtctctgacaggtgttctatatagcagtttttggggatgacattcaattaacgtttcattgaggcgaaatcatcaagtaggatttttgtgagttgaaatcatgacatttccttaaaatttggaattttgaacaaaatacaaagcgtcaacgaaaaatgcagactccaagcccttgcatgtcagctgtggtttaggttgcttcgtaccgatttgcagttggcggctcatttggatctttagattcacagtctttggctttatgaccttgaagatgttgttttccattttttgttctccatagccaaagggagaagtagaccggacactggattaacctaactggagaagtcctaagggctcaagatgttacattaaacagccgagctccattttcaggaaaaaaaaaataggttttttttgttagtttataatggtgtcaaggttcagaata

SEQ ID NO: 28878 - DNA, 1113 bp, Mus musculus
tctcccttttcatgcccatgaaccatgggatgactgacacagatgttccacttagggctaagcagttacagtcacatgttctttttcttttgaaggacttacttatttattatgtgtgtgaatatttgcctgcttgtattgtatgtgcactgtgtgtgtgtcgagtgactgtggaggccagatctggatcagatattggaccccctggaactgacagttgtaagccactgtgtggatgcaggaactgaacctgggttctctggaaaggctgccggtgcttttaatctgggccatttctctagctcctacagtcagttattcttaacactttgactagttatcatctgcagtaactgttaaccactacaaaaagatgcttttctgcgtaaagctgttagcagcagtaatctgtgggcataaacgtaaatatttaggtaaatatttaggtttttgttttgttttgttttgaggtcatgttttgctatgtagctctggctatcttggaactcactgtgtatactaggcctgcctctgccttctaagtgctgggattaaaggtgtgcactaccactacactcagctatacacataaatgtttagaaggtaaaaatttttgattattaaaacttcattgtaaagaacttgcaaatatgaaaaaaatccctcattgagcttagtcagacctaaagcttatatacctcaataaactcacatagagttagaatagctattctaaagctgtgctacttcatattagattttacactttcactgtaagttatgtttttacatgcttttgcacacatgcacacaaagcaacacacatagtgccttggaaaatctatgacagagttaaactagaaaataattagctgtctatcctctttcatgacttcaggtgtcctttatagaaggtgatttgacaggcacatcatgtgcttttagccatatcacagctgtatcctctacactagtgcctgtgtcctttctagctatgatcttttaacaaatttcaaataccagatgtgaattcctgtagaacaggcctcaaatctaatccgagggcttggtcaccctcattgaaggtcatgccacgattgcaccaatgtgcat

SEQ ID NO: 28879 - DNA, 1116 bp, Mus musculus
gatggcttagaagttaggagcactgtctactcttccagagcacccaggttcaatccccagcagccacatggtggctcacaaccatttataactctatttctggggatctgctctttccatgggcaccaggcagacacacacacacacacacacacacacaaaataacaaaacaaatattgttcatttatattttcttttgagaattctgttcagttccctagcccattgttgtattctttgttagtgtttgaggcttttattaattctaaatattattccctgccagatgtatggatggccaagattcgctctcattctttaggtgacctcttcacacatccaactgtttttggtgtgcaaaagcgttttactttcttgagatctatttgccaacgtggtctttatttcactcgtggctagagtcctgttagagagttcgtacacgcccatttacagactgtgtcctcccagtttcagagtttcaggttgtgttaaggtctttgagcctgttagaattgatattgtgcagattgagagacaaggatctggttttatttttctgtgtgtagatactcagttttctcagtaacttttttgttaatgaagagaagaggtcttctccggtgaatatttgaggcaactttgtcaaaaccaggcgtctgtggctgtgaagatctccattctgtcccttgaagttcgtgcctgtttttgtgtttaccatgctttttttgttgctgtcactttgtcacacagcttcaagttaattttggtgatgcttccagccttatttttttactccttacaattgctttggctaactaaggtcttttgtattttcatatcaattgtaaaattgttttttctatttctgtgatgagtggtgttgggattctgatatggattgagttgaatctgtaggtttcttttgatagtcagcagcacaatatgtattctttgagtatatgaggaccagaggtatttctattttcttgtgtctttttaaattcatattttattttatttttaaaaagaatttaaattttacttacatgggtgttctgcttccatgtatgtctgtgtcatatctcctggaactggagttacagacagttgtg

SEQ ID NO: 28880 - DNA, 1190 bp, Mus musculus
taaaattccaaatgcctaataacaggacttaaaaagtcgggcatttttacaagtacaccaaactgaatgctgttgttcattcatatatatatatatgtgtgtgtgtgtgtgtgtgtatgtatatatatattatatcatatataaaacatacatttgaagcagcacactacagttataagactattcttctccaaagtgttcttataaattcatttgacctttattgcagggcaaaaaaaaaaaaaaaaaatcatagtgttcaagacaggctcagtttgtaacaaatagcggaccattacaaagaggaaaagcaaaatccagggctgagcagcaagaagctttggttcaatttcacctcatatctttctaataacgtacttgtcactttattaccttccagtaatgtgaacgctgctgacaagactgtcacactaacagcagacaacaccctctctgctccggccccagttctcccggctacttattgccctggccctgaagggacacaaactaatagtgtgctttccagttcagcacttggccatcaaatataaaaggatgcgtaattgcctgtttatccctggtgaaggggaaattgagtagagggccaggctttcccaccagttgcctgctgtacacaatcattcacaatcagcctgcctcctccatctctcctgcctctttctgtcatcctctctctcccccacctccctgtttctttcctccaagcacatatgcacaacgactgtgttttcaggaatcctaaggctgcttccatgtgctctccccagctattaagtggacagatgacttcttacataaagggtcagtagagagttgctgactgttctcggttactttgaagtagtaattcaatcccatgtccatccatttggggagtgttgggtgtggtcattgcaattggggaaaattttcctgcacaaataggaggaggttgcccatattctgtgaggaaaggattagaatgcttttcttcctggtcaaaaagtgtgtgtgtgtgtgtgtgtgtgtgtgtgtgtgtgtgtgtgtgtgtgtgtgtgtgctgtaaacaaactgctcatgaatggtggctgaaaaacactgtttggggaaccttaaatgtttggcattaaaccatttgctaagtgtacacaagtatctttcaataatggactctaaatccatattta

SEQ ID NO: 28881 - DNA, 1102 bp, Mus musculus
actcttctgctggtaattgtattgacataaacgagtcccatgtagctcatccgcagtctgagttcagctgccctggtccttctgatccttcttatggtttaaacatacaagcattcccttctcaacatgactagcttctctctagacgttagtaccagtgacctagtggtgtgacttctttggtcatgttttccataagaggagggagagagacctctagccagttataaccagttagttagtgtacacattgtttcgaaagggagggtctgagtctgtgaagaatgggctggcatggccccattggactcaggagaagtcatataatttctcctctccatctgtgtactctataggtacatgccaggcacatagatgagaacgagggaggacccttggcggttcaaacacagacaagccaataatcagactgagatggacacagcacacctgagcagcccttgatcacatctagtctgccagcattgtgttaagttgaatgacagtaaatagaatccacctgccctaagacgtgtagcatctgctattgtaaaggaataagacgcccaggagagagaaggacttccatctgtgaccacaccctgtccttcagagcgttttaaaattatgacaaatttactttttctccaaaatagaaatatttaaattagtggatttttctctttctctcccagtctttgtttttagcaggagggatctgagtaaagagggcaagaaaaggcaaaacaaacaaacaaaacactggcaagtctgcagttcttgtagaagagacagatctgactctggtcctggcttgagtgtagctggaaatgagaacggctaatgcattacaagtgtttgttcaggagaaaaatcaaagtcagctctgcctcgtagtgggtgccagcccagcacatccatcctccaatatcctgcagagttccctgtgaccaggcgagccgctgcatacaccgtgggaggacttaacactatcttacgttccttatgggtcaggataggcaaaataggcaggtgtgagtttgttatgattattatttttgagtgagaagtaatggccagggttcccttgggaccacaaaga

SEQ ID NO: 28882 - DNA, 2727 bp, Mus musculus
tgtcgttatttaatgaagattagggtacaattttttttgttgcatttttcctaggctacgcagcaagagttcacatcttatactaatatatgctaaatagttgcatggtatatagatcattgttgttaaaatggcagtactgaaggcattttagatcacaaagccccagtggtctgcattctgtttgctctgacattattaaactcaatctgtttctataactgtgactgtaattgctacatttgcatggcaggaaagtttgcttcgtgcattaacttttctaacgctgcttacatgttgctttctgttcttgctctccgcgtttcataaactggcagagcaccttcagttgcattgagtaattatgcacaatcaataagtttctgtatttgtctttgttgtttctttgatgtggcctgtaggacgctgctggcaaggtactggaccgctgggccatcatgtctcgggaagaagaaatcatcacccttcagcagtttctgcggtttggggaaaccaaatccatcgtggagctgatggcaattcaggagaaagaagggcaagccgtggctgtaccatcttcaaagacagactcggatataaggactttcattgagagcaataatcgcaccaggagtcctagcctccttgctcacttagagaacagcaatccttccagcatccatcattttgaaaacataccaaacagccttgcatttctgcttccattccagtatataaaccccgtgtctgccccactgttagggttgccgcccaacgggctgcttttggagcagccggggctgaggctgagggaaccgagcatttcaactcagaatgagtacaatgagagcagtgaatctgaagtatcgcctacaccatataagagtgatcagacgcccaatagaaatgccctgactagcatcactaatgtggaacccaaaaccgagccagcatgtgtctcccccattcagaattctgccccagtcagtgacctaagcaaaactgaacacccaaaaagctcattccggattcaccgtatgagaaggatggggtcagcctccaggaaaggaagggtattctgtaatgcttgtgggaagacgttctatgacaaagggactctcaaaattcactataatgctgttcacctgaagattaaacaccgatgtaccattgaaggttgcaacatggtctttagttcccttcgaagccggaatcgccacagtgcaaaccccaacccccgccttcatatgcctatgctaaggaataaccgagacaaagatttaatccgggctacatcaggagctgccactccagtcatagcaagtacaaaatcaaatctcacactcacgagtcctggccggcccccgatgggttttaccacccctccactagaccccgtcttacagaaccctctcccaagccagctggtattttctgggctaaagactgtacagccagttcctcctttttatagaagtttacttactccaggggaaatggtgagtcctccaacctccctcccaaccagtcccatcattccgaccagtggcaccatagaacagcaccctcctccaccctctgagccaatagtgccggcagtgatgatgggcactcatgagcccagcgctgacctggcacctaagaaaaagcctaggaagtcaagcatgcctgtaaaaattgagaaggaaatcatcgacactgccgacgagtttgacgatgaagacgacgatcctaatgacggcgggaccgtggtcaatgacatgagccatgacaatcactgtcattcccaagatgagatgagcccaggcatgtccgtgaaggacttctctaagcataacaggacccggtgcatttcaagaactgaaataagaagggctgacagtatgacgtctgaggaccaggagcccgagcgggactatgagaacgagtccgaatcctcagagcctaagctcggtgaggaatccatggagggggatgaacaccttcacagtgaggtgagcgagaaggtcctgatgaacagcgagaggcccgacgagaaccacagcgagccgtcccaccaggacgtcatcaaggtaaaggaagaatttacagaccccacttacgacatgttctacatgagccagtacggactatacaacggtggcggggccagcatggctgccctgcatgaaagttttacatcgtctctgaattatggaagccctcaaaagttctcccctgaaggtgacctgtgttctagtccagaccccaaaatctgttatgtgtgcaagaagagcttcaaaagctcctacagtgtgaagcttcactacaggaacgttcacttaaaagagatgcacgtctgcacggtggctgggtgcaatgccgccttcccctctcgtcgaagcagagacaggtcagtaaatctccattggctcctcctgctgagggtgggggtacagttcagacaaggttagatgtttgtgatgcactgtaaggaccgccatattgaccatgtgatcactagactgccatgctcattggaggatttgtgttttcagtgcttgttatgattaagcatgcagaatcgtgccatctggtaatgcatgccatctttctctgtgtatgtgtatatgtatgtttccatgcatctaggtgtgaatacgttaacagtacacagttccttagaagccacagcttctgtcattcatatatgctttgccttgtggcttttaaattaaaccaatatat

SEQ ID NO: 28883 - DNA, 1211 bp, Mus musculus
caaatgactttgaaaataattatatgtaacatttttttgtacaggtagactataaactgttcatctgagagccggggaagcctataatgcaccattagtgtacaagtcattttatctggctaaaactcaattgtcttgtagccctcaaggcatcaattttagcattattgctctcaacaacagtatattgaatattatgtcagttaaaggagagtaattatcaaggcaagttagggtggctgttagtcttaccacatattgacttggttagcagttggctatagattgtgttaccgggcaaataaagatgtacggtaagttgaactggtcaagccaggatattaatctaagtccctctgggctcaaacctacattctttatgtatatccagatacttctacctttagcaagagttttgaaagtggaagagaatatgtcacctgtttttcaaaacgggagtgtatggttgcaggggaagaagaggtcatccggaattcaagaaagctatcatttgtatatgatgttcagagaaaagtggacatgacagaaagccacacagtcattgaaaagcttcggggatctgttaaagagcctttcactagggtggcatatgtaagccagccagttgagtgtaaaatgaatagcataaattggaccataaccacgtaagaaggtgggccatctcctaggcgtgaaaatcccagtggtctctggcgtagttgctaaagtcttcattcagaaaggaaagccggattgctttccagaaaagtaagatggaaatagtcacttaaatgctaaaatataaattcaaaggagcctatattttctgcaatcaaagaataataattattattacttcaggacatcctctagagacacatttattcacaatcaataaaaacagtggcctgcactcttatgcctgcactcttgtcccagtctcatttcctttctgtctctgacttatcatcattgaatgtagtcatttaaaaataaaattttcacatagcctctctttagctggaacatgtagctaacatgcctgggtgcatgttccatcctgcctttggaaaactccccacttggaagcgagtccttccagaattctaagaaccagttcagtctttctgagtaattagcagaatgtcagcagccagggtgtcagaggctcagtgatgcacactgcaagtaacctgggccacatggttcta

SEQ ID NO: 28884 - DNA, 1242 bp, Mus musculus
ctggtgttggatataacatgttacagcagacagcattgttggggaaaattcccagggaagggccctggcttcccctggccttgtgggcagtgatcgtggcgtttcgtggagtacgcacgagtgtgtatctatctgtgtgtctggagaggggttagtgcagggtgtcatttggtgcctgacagtggaacagtgcagtgactcctagctctgctatccaatgacatgcagtggctgagggtttgaagctgatggttgggtctccagtgcagcctgcacacctgacaggcagctgttaaaccgagcaaaggcaagctaggggagtcacaatctatgcataaatgatagggatatctgtgcagaaggtgcgaaggaagctctgacccccctcccccagatctcccccttcccaaatgaaacgcacagttcagccagcttcttaactacagtatactcctgctactggctgccaagaagctcaaaaaatccaccttcacttttcagtcagaagaggcagaagtggatgtgagagaaagagacacacagagagacagagagccaaagagggcaagagacttgactttaagagactcctgtactgacaactccatgcagttcggaaccagaacaactgcggctgaaccagggttcatggggacatggcaaaacgctgacactaacctcttattcagaatgtcccaacaggtaagttactttcattttttttttaaagaaacctcgagttgttatgtgcccttttcttcctgctacttttctttctaaatgtttctgaaatttaaaaatatatacattgtcatttctgtgctactggattgtgcagtgttacttcctggcttccccaagggtccttaaggaaaaggggggaaaggacatcgaagttagagaaagcaaaggcatttgctgcaaagtttcaccgtgtgtagcctgggtcctgcgaagccttaatttatttctttgtttcccgctaaaaagagaaaaagccactactcaacaaatgtatctttctgagtatgtgaaagacttggtcaaagtgtctgctgtctcgaagtaggtctttgcaagcgaacagtcctaaagcgcgggcccctcacagcagcgggtctgacttctggtgtctggagcagctggactcagacctgagcgaggctgtgcaggcttccctgccggccgggtcaacccggagggcggcaggctgcgctcccgcttgctctcggcctccgttcc

SEQ ID NO: 28885 - DNA, 1195 bp, Mus musculus
ttacattcatgatataaggtttttttgggggggttatttatttattatttatttatggttggctggcttggttttggaggcagagtctctctgtgtagcgctgtctgtcctggaaagagctctgtaggccaggctggccttgaactctcagtgattgacctgcctttgcctcccaagcagatccttgcttcttactgttttcagtctttattactgattaaaattaatttatatacttatttttaccacaatttaatttctgaatgcataattgaaaaagcgatgcttgatgttgatggactaaaccaattaaatgcttgtttgtttttaaatttttttttttaattttatcgttcatcacttttcacctgcactgtacaaggtcctgattcattctgctgcaggcacttccccatcatggtttgtgattccatgcatggacttatagtgaggttttctgaaaggataggagagggagttcaaaatttagatttttaaaaaaatttgacaggaaaccaaaatttaaaagtttaaaaacctatgtaaagagtcttactggatgtgattggtgtagtgcagtcgtaaaacaaccattcagtattatttatgggatgtgtgttctttgtcactcatgtgttttatgttagaatccatcagcagatcacctctctgatatcaggcactcttctaatcgtgtgtctgttgctctttcgaccttccccccagccccaaagcagatgctggtatcggttgtctcatttaactgatgggactggcacactgaagagataagcaggggctcctgggcatgcagatgatgagggggcagaaccaggaactgaaatctagcagaggcctactgctagtctgaaggataatcattgaatcagaagtctgcaggtgggaaagaagtagccaaggtggcttacagggcagaagtggcgctagagaagattggagtggtgagaaagacttctcagcaaagactctgccacacttgctgacttgatggacaaggaggaagcccaaggatgaaggttggggctatctcaagtaagtgtgacacagtggtttgaaattcagagatttgggttcttggggttttctgatcacaaaatgattcttatttatggtaagattgtacaacttttaaatatgtcaactgagtttcaagtgatcacaggaagcgtgataa

SEQ ID NO: 28886 - DNA, 1178 bp, Mus musculus
gttgcactttcccttcctaaatatgtgagtcacagaattgttggcaaaaacatcccctcaccagcaagatgtctgctggtttaagcaacttggtctcttgatgccattagcaaaagtattaattgtccaaagcacctttgttcactaatatctatctatctatctatctatctatctatctatctatctatctatctatctatctatcatctatctacctacctatctacctatcatctatctatctatcatctattatctatctatctatctatctatctatctatctatctatctatccatctatctatccatcatctatctacctacctatctactatccatctatctatctatccatcatctatctacctacctatctactatccatccatttatctatctatctatctatctatctatctatctatctccctcatacttctgagacatggccagttttcttccctccctgctgttaagcacttggcagatgagggggggggtcccatttatttctgagtgagatggtgagcaatctgtatgttggctgaaaagaaaaaaaaatctccagtctgaattgggaagaaatctggtctctaagctcagattccttgctgtacagaagctgtgtatatacgtagcccgtttctgaagggtacaggaagggggcacggctgtcttcccttctctgtttacttacccaggaatcagtccattccctgagtccctttaccacaaagacgtaggagagaaacactagtaagcatttcccactccatagaacaagacagtgagcatcgctccttcccacgtttacttgtttgtgttccttgaacatcatttgtgcatattctgccctcaatgaggaccaaataaagatgatttttgtgcttagcagtttaaggtatgtggctgcatatgcaaaccccttttccactccagtcattactttgaacgcctcccttcctcattttgtgtgtacagtgctgtgtacgctgatcagtgttgggttttcgttttgttctcctttcagttatggaagtcccgataggcacccagagttctatttatctagctgtacaggctccttcagaggtttagcgtgctgcttccgatatgccacttgcggtagtggatcgtgtggagtgaaaggcaaatcttcctgcttaatgtat

SEQ ID NO: 28887 - DNA, 1237 bp, Mus musculus
tctatctatagatttccttaactgcttctatcattacttggttaagaaattttggggaaaactactatgcataggaaaaataaacacaaggccttagactgggaagttccttgtttccctgagtgtgcccccacccccacccctggctgtcagaatgattatctttgagaggtaaggggactgagactgagatttacagaaactgaagtagcatcctcaggccatgaggaaaacaaaagccccatcctttttttttctcattttaagggatcttcccttttctgatgcagaacatttagcattgccaagtctcctcttggtgtttgtcttagtcactgttagattgctgtgaagagacaccatgatcaagacaactcttataaaagaaagcatttaagtttcttaaatttgggggttccttaagtttcaatattgttacagtttcaaatattgtccaaaagccttggacaaatctttgagtgccattaactccaggactttctaagttgatggtagggaaagccaaaaaaaaaaaaatgttttccctttgaaggtgctgcttcagttctgttaactgctttgtaaggagtaagatttctgaactataaaatccccaatgtttcatcatgacatcaggatttcaaatatgtgcatctgaggctaactcagttggaccaagcatgatggtatgatcgaggccccagatagaatccaagcaccaaagcaaaacaaaacaaaaactcaaacaaacgaacagatagtcaggccttgatcatctctaagaactggcattcccagcttcagagaacaaagcaagttttgtccatgactataaccacagcacaatgcctggcacaggaaacagtcaataaatacttagttaatggagactgaacaaagagaaattctgattatctttaagggcatcataaacttctaagtagagggatgcggggtgttttatagtctttgcacacagacaaatgtaatcaaggtatggtgaaaacatttaccatttcagtctatagctgacctcaagttctgaatgccaggcctaagtgcttcatatgaaaagtgaaatcgcagtctccctagggttctttatcatggaagccagtttctgttttgtgcagagatgtttctctgtgttaaatttggttccaggtttgtttttcctaatagaacctatgcatattttctttcttatttgcaaaccttttattttataggaaatata

SEQ ID NO: 28888 - DNA, 1144 bp, Mus musculus
ctgagttggttgagattattaaagtcccacaaggctggagcatagattgtgatgaaagaggaggcatagtcttgttacagatgacaaaaccaaatctctggaccctgacacaaagtgctgacctaagcattccacttaggaaacttacaaatgtaagtaagtgtccaagtaccacaggcaaacttaacactgctcatgagaactaactccagagagcctattgatttgctgggccaaccacaactgaatacaccaactaggtgatgacctctggtaacaattcattccccagccagaagtctgaggtaaagaagtgaaggatgtgctcccaggagctgtagggagggcagctgcttacctcatggccgtattcttttctgttcaagtatatcttcatacccaacttaatccttaattctttaagaccattcattttaaattaaagtctgtcctattgacctcagttacaattgtccttgacaaaaacagatcatactctagtggatcatgctgggggttgggttttccaatacacattgggatggcacacaattcaacccatgggaggactatagtacttaggtttatagcgtttccatgtgaaataccacctctaaatcactgcgtgtctagagatgtctgtcctgactcaatggaacgaaatcacttccttacctttaaaccctgcattccaaatcttgaaagctttgtgttctacttggaatgatcagtagggaagaaacgaacaaactggatcataagatggcctggcacttagctcagagcagcaaagtaaatgaacacagggagggaagggcttgaatctgacctgtaggtaggaacaggaagactctttcaggcagggaatgttggaaataaatgttcaaaggtgaaaaagccaaggtgtgtattgggacgtgactgagcccagcaggagctcacttgcttgaaggagagtttttctagaaaaagaaggggcttcgctatgtttgtgtgaaacaacaaataacaccatgttgattattccacaaatctattcagtgtctttgaccacaggaaagcaactctggaaagctggaataagaaatttctacctagaattctagacaagccaaccaaaatatcaaactcccaagaatcacag

SEQ ID NO: 28889 - DNA, 1175 bp, Mus musculus
aaattttaaactggcaaaactaatttatggtattaaattgctatggtatggtataatggggcaagaaatgtagctcagttaatttgtctggcatttgggaggacctggcttcaatacccagcatggaaaaaacccacaatggccgtgttctacttctgtagatgtggtatagttttggccaagcactgtgtgtacagtaaaaatgctctgatctatgtaaccatactgcattcactttctgtgtgttatattcaaatttcttgtagttggatgaaaacaaggaaattgtagattcctaattagcttaaatttgaacagatcccccattgtaagaatcaaacagaaggcaagtcaaacaaggatcataaagaatattctaaaaggtcaagatactgtgcatttctgccacccgtggagcctcggccatgatcacccagctttgccactgtcacatagaagcagttagagcagatgcataaaagaatggatatggccacgttccaacataatgtacccttgccggtagtggtggcgcacgccggtaggatttgctgaaggaggcagaggcaggaggatcacgagttcaaggccagcctgggccaacataatgtacccgccaacggtgaacttcaaatattgtaattttcaacatgtcttgaaataactttttcagttattgaaaattataaagccattcttagcttcccatctatacaaaagtaggctgttagctagatttagcctgcaggtagtgacctttgccctaaggtgatgtgcatatacccatgtcttggtgggtctgtagccctggcctgacctcttgttaatccttctctcacctttgtaggtaggcagatattgcattatcttgtcaccatttggaaatttactgtcccgaggtttgatgaggccaactggacaggtagggaggtagttaaaatcgtgtttatacgttgtgagtaaatccatagtctcttgactcggaacatatgtgtcaggctggtggaatgtcaccggtaacattttgtgaagcccaaaatctctcctaggaaaagaataaacacaagtcattgggatccttgctcagaaaaaagacagtgttgtccccttggctcgtattaacaaatatttcattctaccctatctccttaccttctatttttctctcttctact

SEQ ID NO: 28890 - DNA, 1212 bp, Mus musculus
catatttagtccctaggtaccgttaagaagtggcacactattgtaagtatattgctctaggagcccttcattatgagagtcaaaagatgaagtatctggctattttgggtttataagtcactaaaatttacctatagtcggctgagcatttctgaaatgatcatttcctgtttcagtaccatgaacaaatctcaactctcacttctccaaaactgattataacttagtgtttcagtgccttcctgcacagtagtgccttctcctgcagttagttccctttgacgtttaggaactactttgatcatgtcaggcccttgcttaaaagcccattgatggttcattgtaattatagaacagcgttttggtataaagaccccttcttctctcctcccacctcctgctgggatcttttaccttgtcctcctagttcacctcagttctttgttagtttgcagactctaataacctttaattataccagttaggattaaaaaaaattatttattttcacatgtaggatatttttcttctaatttttaatttattttcatgtgtgtggatgtttgccaacatgtctgtgtacctctttggtgcctggtgctccctgaggagggagtcagatcctctgagactggtgttagcatccacataggtgctaggacttgatcctgggtcacaggatgagcagccactggggtatctcttcagccagctatagttcctttaaaattcacagcagcactttaaccctttaaacacctttgatctcagccttggggaggcaggcagatctgagtctagtctacagtcagttccaggacagccagtgcaacatagtgaggccctgtctgcaaagacaagactgaaggttcagacaaatgacattttctaccttgatgtcttagtttgccctccctagatccatggtcttccatcttttctgaagtatatagtatagctgttttgtgtgtggggagggtgtggtggtggggagacaggaattttgctgtttttgttcaggttagcttcagcttacagctgtcttctgcctcagtcttccaagtgctggaactacagatgtttgcctagcttttccttaatgtctttgttagacatctcccccgactttatgtgatttctgatccagctgtatacacaccttggtgctgagcatgaaaagtggtactaagtaagataaagaacatttggggg

SEQ ID NO: 28891 - DNA, 1153 bp, Mus musculus
ccagcaaccataaattataacctaattatgtacaaatgaatgacacaatgagatgtgtctctgataatagaaggcaagaacccagacttaaccatcaaagtcctaaaagatctatcaacccaagcaaactactgttcaatactaagtgaatgccaggtttggcggctcacatctttaatcccagccctcagataggctgaagcattcattttttacaagtgatagattctatcctttcttcataacattttatgatcaaaaacagtaattttatggtatatatatttcacaataaaaataactagaaagcaggtaaaggcacttgccaccttgcctgattatctgtgtttgatcctagggtaccacttggtaaaaaaaggtgagaaccaggttgtcctgtgacctctacacgtggaccatacatagtgtagacactcacatacacataaatttgcatacacatgaatgtaaaaaaataactgaaaaatctaaataacctataaattgagaaataaggccatgggcagtagtgcaggcctgtacacgcagcactcaggaggcagaggcaggagaacagcttggagttccaggccagcctggtctacacagcatgtttcagctcagtcaatgcttcacaatgagatactgtctttaaaaggaaatggagagagcttaccaacctggaagtgaagcaggatacttaaaaagtatactctttgcatatacttcctctgacacaggatcaaacgtaagaggagacatgggaggcaaaagatccacagccttaaaacacagaatttacaatatgaaataaatacatgcacaaacaaccataatgacaaagctaaataagttcatctacaagtgaattttctccctaacaataaattaccaaacatttattctgtaactatttgtatgtattatattttccctgcatatgtacctgtatactatatgtgtgtctagtgcccacagaagccagaagatagcatcagataccttaggattgcgttttagctggttatgagctaccatgtgggctagaaattaaatcctagtcttcttggaagaacagccaatgggcttacctgaaaaaccacctcttcagcccctgcaaacattttttttaataaaatacaatatttgcatg

SEQ ID NO: 28892 - DNA, 1197 bp, Mus musculus
cacaaaaagaaatactttgtttatatttgtatactttagacacgagcttccggtttcaggccccctttcctccttataatttaatggaaagaatgattctattattactatatcaccatcatcaccattattactatttttttttttcgagacagggtttctctgtatagccctggctgtcctggaactcactttgtagaccaggctggccttgaactcagaaatccgtctgcctctgcctcccaagtgctgggattaaaggcgtgcgccaccaccgcccggctactattatttttattttgagacaaaacccccctctctgtagtaatgggaggtgtgctgggattttaattccatcgccttgctcctccagattgctgttttgcttgcttgtatgtcttgtgtgaggttgtcagatcttctgggactggagttacagtttagatctgccatgtggattctgggaattgaacccgtgtctttttggaggcgcagacactgttagtaacctgagacatctctccagtctcaatgaattttgtcttttgtttgatttttgtttttgtttgtttgtttatttttcaagacaaggcttctggacctctttttgtggacaggctagccttgaactcagataccagcctgcccttgcctcttatgtgctggggattaaaacgtcccaccaaccatccctagttaaattaactttgttttgttttttgatgctttagacatttttatgcaacctcagttaagtaggtatatgatagtatgcaatcattcacttgtagtaggttatacatgttattttaaagcaattccatggcatacatgtaattttactattagggacgaaagtaaatttgcatactaaaggatgctcccccatttttttcctttgagatggatgattatataccatggcctccagctctgtttgcctctcttgcttaagtgttgatatcatgttaacttttggttgatgcattttcagaaacttttgctgctgttacatttcagccctcacataactatgctaccagaatagggtgatgaagtttccagaaacagggctggctgggcatgacggtgcatgcctttaatcccagcactcgggaggcagaggcaggtggatttctgagttcaaggctagcctggtctacagagtgagttccaggacagccagggctacagaga

SEQ ID NO: 28893 - DNA, 1729 bp, Mus musculus
gactcttaacatataagaagcatagttacatgcttgttgacaaagataagcggtgcaggcatatccagtatggactgcatgctgtgtcatacacatgatatgcccagaggaggagggtagatgtttcctgtaagaggcgggcttggatagatttgggctgtcctttttctgcatgcactttatgtagcttctagatgaaaaccaggcattttaactgctaaacgccttgggagatgctgtttctataccctccagattctctgtagttttgctctcagcataatcagaatagttactttgctactttggaaaatcatgatgtttcaccttaatatattgctgtcccctttaggtagtacttcaactgtgctattttctactcaagctccagtcgaggatgcagtcttcagtgaggttactaatttcaagaagaatggtgatagaggagagaaaaaacagaagcatttccctgagaggagctgtagctttagttctgaaagtcgagcggggatgctgcttaagaagagcagtttggacctgaattcaagcgaaatggccatcatgatgggagcagatgccaagatcctcacagcagcactgacatgtcctaagacttccccgcctcatgtcacaagaactcacagctttgagaatgttaactgtcatctagctgacagtaggactcgcatgtcagaaggcacccgggattctgagcacagatcatctcctgtgctagagatgctggaggaaagccaggagctcctggagcctgtggttggtgataatgtggcagagactgcggcagagatgacgtgtaacagtctacaaagtaacagtcacagtgaccagtccagagacacacaagctggagcccaagatccagtgaacaagaggagcagttcatatgctactaggaaagccattgagagggaggatgtggagacgggactagatccgttgtctcttttagccactgaatgtgtagaaaaaacgtctgattctgaagataagttattttctccagtaatttcacgtaatctggctgatgaaattgaaagttacatgaacctaaaaagcccactaggcagtaaatcttgtagtatggaattgcatggagaggggaaccaggagcctggctctcctgctgtgtttgctcaccctttagaaaggagctcgagtctgccttcagaccgtggcccgccagcacgagacagcaccgagactgagaagagctcccctgctgtgtccagctctaaaactctgactgggcgtttcaagccacagagtccttaccgcgcttacaaagaccggtccacttccttatcagcattagtacgttcttcaccaaacagctctctgggttctgtagtcaattctctatcggggctaaagttggacaatatactctcagggcccaagatagatgtcctaaaatctagtatgaaacaagcagcaacggtggccagtaagatgtgggtggctgtagcatctgcctatagctactcagatgacgaggtaagaaaattacactatgtagtctgtctggtgtaggaatgctttgtagtgctttaatgtatatgtatatgtttgtgtttgtataatctagaggtttctgctaagggtacttttatattttaaaaactttatacatgttctgttatataaagtgacttaaaataaatgatgtaaaaatacattgtcagaattgccaggcatgatggcactcacc

SEQ ID NO: 28894 - DNA, 1200 bp, Mus musculus
atcgaggtggatgacgagcgcaagctccgcaccttctatgagaagcgcatggccacggaagtagccgctgatgctcttggtgaagagtggaaggtaaggttgttaccggcatccatgtcccagcttggcgagcgcaagggctgttttgggttaagtttcattaatagaaccaagtttggggaaatgggccgaaaggacatgcttctttcttgcttgccgtacggaattcagggtcttaaaaaaagcctttcatgttcatgctagtaaaaccggggtagtcagggtaagtcaaaaggagagagatggctagtttaccttagttggaaacggagacaaaacgtgagtggttgaaattggtctcagttattctccctagtcgggtgttgaacctaagaggttaagaacctgcacttagtaggttggaactgaactagtaaaatgttgttattttatgttcaacgcagggttatgtggtccggatcagcggtgggaatgacaagcaaggttttcccatgaagcaaggtgttctgacccatggcagagtgcgcctgctgttgagtaaggggcattcctgttacaggccaaggagaactggagagaggaagcgcaagtctgttcgtggatgcattgtggacgctaatctcagtgttctcaacttggtcattgtaaagaaaggtgaggcttttgttgaagcttgcttgcttgtttattgagagagatctgcctcctaggtagtgggcattggcccaagaagttgtttcccaagtgataaacatttaatgtctctattttgattgtttctttaaggagagaaggatattcctggactgacagacactactgtgcctcgtcggttgggacctaaaagggctagtagaatccgcaagctttttaatctctccaaagaagatgatgtccgccagtatgttgtcaggaagcccttaaacaaagaaggtaatggatttggggggggggtgtattgtgctactgctgcagctttgcttgccagcccggagtctggcttaccagactttatgttcatggctttggggttaggaatggccaggattctgagattacgaaggcattctcattttaatacatttgaaaatcctttaaagcacttgatgtatatgtaggggctagaggacaacttgcaggagaggattttggagagaccgggttctaagctggtgtttt

SEQ ID NO: 28895 - DNA, 1183 bp, Mus musculus
ccaatggcacataggagttctaatgtttttatcagcatttcctcctactcttcattttgtcttttgctttttttcaaaacaaggtcttgcagcaacacctcaggctattatctagttcgtagtaggcatgctgactctgacccccaatgcagtttatagatgtaagctaccacacccactccagtttctccccatcactttgtaagatccctctgttcataccaatgcatgtgagtgtgaagttatacctcagggtaattttatctgcattttttgatggatgatgatagcgttattaagatagcgttttgaggccatctatatatcttctttgaggaaatgttcattaagagtttcttgcttgtttttaaattgggctatttacttgagtgatttggttagtagaatatataccctaatcaggtatatgacttacaaatatttcccacaatatttgaggtttttaatgtgcttctcaggtgaggctactcctagcctgggaacccatgaagacttaacttttccatattgttctcaaggcataattgtgtggaaagaaatttggggtccttgagtcaaccctgaagctgcatcctgctgggagctttgaaaaaaaaaagttggccttttagaaaagattgattcccttgaagttgaagcctttatggatccaggccttgtttgggggtctctgacttcctgactatagagaggctgggagtgtatctgcatgaacattagacccagcaggcatgtctaatgtcagggtgatgtatcactttccacaccgctttgtttccaaaatgttctctgtcttacctaaaacggtttgctcacatccagttaccttccttacgtcctgctcagaagcccttcccataacacaccaaggccataattctcttcagtatctaatgtgggcatttttttaatgtgtgtgaatgttttacctgcatacatgctcatgcatcatctgcatgcttgctgcccacagagaccaaaataaggcaatgaatctcctagaactagatttacagatggaagtaagccactatgatgtaggtgctgagaactgaatctaggacctctggaaaagcagcaagtgcacttaactgctaggccatggctcccagtctccacactataggattttgtctcatctactgtctggcattagccctta

SEQ ID NO: 28896 - DNA, 1178 bp, Mus musculus
ccagtccctggaatgtttacacacacgcacacgcacatacgtatacacattcaatttgtgtactctctttttaggaagaatttatttctactcagggatcttcttacatctaaatctaatgatagtcttgtaaatcaggggctaattgccaaaaaaggtcttgagctgttatcttttactacctatcctagtaaaatgatctgttggtgatgtgaattggttattgaccatgaacagtcaaaccaggtggtcctttgaggacttgttcagaaggtttaatatatctttgacttacatattgactaacaggtagtttggaaatagtatagccttgttgtgattaataaaaatgattatctcttggttccatgtctgagcccctccattaccttctctttgccatttgacatctgttgcttacagcccaaactttttctttacttctttagatcgtgaaccttatagaggaaactggacactttcatattacgaatacaacatttgattttgatctttgctcgctggacaaaactacagtccgtaaattacagagttacctggaaacatctggaacatcctgaggatacaacagctggacgcatcaaaaactatttttttttttggttgtgatttttttttgttgttgttgtttatatgaaaacactcggaatgatacaaccaaaagggaaaaaaataaaaatgaaacaaccttcagctttatttttctttaaagccagtcatcatctcttgataaaggagaggttacctaaaccagcctcagcggacactcctctgcaaggaaatccccaggaagaattagcctggatagccttgaaaacaagcagacacaacacaagaaaacttaaaagaatgtgtatggtaccgtggatctttctgtggtggttcattccacaggacgaatgcatattcaacacactgccttattacataactgatctatttattaccacatacagataaagttgtgagggaatgacaccaccagacgtcctaaatactcggtcccgcggatgctctttcaatgcagcgcccttgccgtcccaagcccagtgaccttattcgtatactgtgccactttccaccaactcttcccaggtcctttaacttgttgcagtctatggtttccatctttgttttcccagttccaggacatagtt

SEQ ID NO: 28897 - DNA, 1137 bp, Mus musculus
gcacaagtgtggatggagctgagtatgtaggtacatgtaggtgcacgtaggtcacagaggttggtagtagaatagtgggaaccctttgaaaatatcattgccatagaagcttcaggcacagacagtatttggagttcagcttggtgaactgatagaccaacggatactgttggggtccagtcaaaatttgcagctcagcaggtgatagagccaagtcctcactgtgttctgatgcttgaatttggcttgtacttctgcctacagccagccttattgtgcaagcaggcaccagggagagagacactacatccaaacaaatctatcccctttcctggaagccagattttagttccctgtaggaacaaagtgacaacagcatcctccttggtacagaagctagcccactgtgagtgaatttcgtgttgatgaatggttgtgcttgcgtgcgtgtttctcctcaccctaagtgtcttttaatcactggtttgctttcagacggctgccttgaacttgctgtgggagaagtgctgcagtgaccatgtggttgtgcggacagcctgcagcgagggactggtggcacttgtcgcccagggtcatgcagagttcagctatgttctcaatgggatactcaacctgactccttctgccaggtacacgtgctgccatgtttggttaaagcttttagaagcacatctaactgatgtctgctaaggatcacacattagtgctgcagtaatgaactgaccaattttaagaaggatacctggcataagcagttctactcacacagtggcacggttcttaccttgttttggctgtctgcagtcagcccttggcaccactgttagaaattagcatgagctgggcgtggtggagcacgcctttaatcccagcactcgggaggcagaggcaggtggatttctgagttcgaggccagactggtctacaaagtgagcgccaggacagccagggctatacagagaaaccctgtctcgaaaaaaccaaaaaaaaaaaaaaaaaaaaaaaccaaaaaagaaaaaaccaaaaagaaattagcacgaatttttcctaaatttttgataacataggaatccgtcttctgagtatttccagggagcaagttctttgaacttgctt

SEQ ID NO: 28898 - DNA, 1151 bp, Mus musculus
gctaattccagatgcagtcaagtcgacaaccaagactagctattacaacctacctttgactatttggcacataatcatatctctttatgttgcgcttaatttctaaatgaaaacagtagccaggtcatcattatgcctaatatgatataactattccatgaataaccataaacacgtaatatattttagaaaaggtagcagtgttccttgagggacattcttttactgtctcatgacttgaatatgataaccattgatattatttcaaatgtaaaaaaattgtggaaagttaacacaacaatttgcacaaacgttattaacaaagtctgacaaacatgcacaataattatagcccttttctttctgcaactggccacatgaccttagctggtatttagctccaactcctgtcctcggctacctattctgtattatctccatccccaataagctccttggctgggcttggctctttttctgaggagtgatccatcttcattcctggaagtctgggtcctttgtcatcatgcctgtattggcttattgtagactcctgttgactttagtcaaacaggacatggtagcacaaagagacatcttgaagaatcttttgcatttcagacataatctttcttacctccagagtggagaagctatccaatttccccatagtaatctggaccaataacttctcataacagtgttatacctttctgagtctgttttcttaagggcatcagaaccttaatgtagcctggggaattcttgcgcatgccctggctcgccagcaaagcagacgccacaacaggatccttctgcacacgtttattgggagagcttgattgcagaggcgaagagaccccaagcccagaactcgtgctgcttatataggcttaggagaggcgtgtctcacaactgaattggttatgcatgggttatgcttaccacctcatttgcatgcctacatctgattggttaacttgtctctcatctgattggttaacttgtctctcatctgattggttaacttgtctctcatctgattggttaacttatctctcatctgattggttaattctcaaaaccttatcttggcaaaaaaaactttactgtctatgtatgcgtggtggccagcggtagccagtgccacc

SEQ ID NO: 28899 - DNA, 1199 bp, Mus musculus
acagaaggggatatttaggctatctggataggtgtctttcacttggcaagaagggaacatggcagaaataaggccatagggagagtcatgatggttccttatttgaggtcagaggctgtatagttttttggcagtgttgtttgtttttgtttgtttgtgcagtgaaagctattgggtggtattaagaacataaagggcaacttcagcttctggctagaggacactataggggtgatcacgaggaagaagtgactaaagatacagcttttatattagtatatttgaagaagacaaagataataactaggcaaggctttatgagaatggttgtaaaaggaggactctgaagatggagccacaagaacttgccagtagatgatctgtaagaaatgaagaagaatgaaagctaggatacctgagcactgtagtactttgttcccatttgggagcattgaaggcagagatggtgctcagtggtttcctgtttgcttggtgaagttcaacctgagacagagctggatgcctgtgcaccggttaggaaggaacatgcctcttctggacatctcacatttatttgggttttgaactcttgttattttattccagcattggaagaattctttacatctcttgtgagacaagagatggtgaatatgccccgtgggatatatcactctgcattgaaaggaggcgtgcgctcagaccaagggaagacagtagcaggaatcccgaacttcatattgaagacatacgaaacaaacaagcaaccaggattgaaacctggcctggcaggtaagaatactgcacttggtgaagtgcaggtttacagtgtcatgtctcaacttgtgcttccatgtgaaattgtaataagttacatggtaggacattgcttggctgctgctcacatttacacacagctggaacagttacaacaaacaaccgaattgaaaaggaattcaaaaaatgcagaagcaaagataaatagatagcttcaaattccagaatggggagactattttagacctttttaccccttggaacatattctattctaactgtggatttgattggcagctggctcaggccagaggttaggtcttgttggagaagtggccaacaaatgtatggaaacaattttaatattcttagttatcagggaaatgcaaatcatgaatctattgagactccagcttggtcca

SEQ ID NO: 28900 - DNA, 1149 bp, Mus musculus
ctggcctgtagatgttaactttgcctaatagtactattcttttcttgggacctgtgtcttgacagtatggtcaacatacaataatccctggttcctacttgcccatttcttttagatcagataaatcagaactatttgttctttctaccagtagttgttttaattagtaattacaatattaccagatgttgtagtttttcagacttgtctttttgttgttgttgttgttgttgttgcttttttcccccataaaataaaggttaggggctgtagagcagactcagaggttatgagtgcttgctgcttttccaaacaacctgactttggcacctagtaccttgttgagtggctcagtgtaactgactgtagctccaggggctctaatacactcttctagcatctaagggcatcatgtgcacacactcctacacaggcaacaagcacagacagaaaatttaaagtaaaatgaatcttaaaaatataatcaaacataggggctggagctatagctcagtggttaagagcactggctgccctttcagaaggctggagtttgagtcccagcaccctcatatcagctcacagcatctggaaatccagccccagaggatcctggtcccttttctgccttccttgacacttccttgacactaggcacacacatggtgcgcaagcaaacgtacaggtaaaatactgacaagtaatataaataatataagataaagctaaataccaagagagctattggcttgagatgggtgtgtgaagtactccttaagagaacagatgtcagcactgcattgttctcagagtattccccctcctagaagagactcatcacagttaatctgacttatattttcctgaatttgaattcctagctagggttattcaggaaggttcattacacaaagctcctaacctgtagaggatatacatatgatctcaatatgagaatatttaattatgccttattcctaagaatcattctaaaggaatttatttatttaatgcccctctcataccccgtgtgtatgtgtgtgtgtgtgtgtgtgtgtgtgtgtgtgtgtgtgtgtttgtatctcatctgcctgtctgtctgtctgtccatcagggcttctctcatgccacagtagaatccatgtttat

SEQ ID NO: 28901 - DNA, 1136 bp, Mus musculus
tctctctctctctctctccccctccccctccccctccccctccccctccccctcccccccctccccctccccctccccctccccctccccctccctctccctctccctctccctctccctctccctctccctctccctctccctctccctctccctctccctctccccttttctctccctctactgaaaattgaaagttaagcctcagtcaagtgcattactaatgaccaacagtcccaaccctgcatataggttttgatacaaacttttccttttgagaaaagaagtcaggagtcagagagcaccttgagccagacagaagtggaaccctctgtctcacttcagcttcagagcaccacagctcctgtgcaagtgtggaacagtcacgctgtatatgtccctgacactgtctcttttggcatccaagcaccggctgtattctgggagttggacttgccctgtccctcatgagccacagcagccacacggagtcccgggtccatgtggcagcatctctgcggaagctgtctacctacctagatgagagcgggagccagagcaggacatttcaggaggtaggcagtgggccccggtcctgctctgctgactttcgctgctatgtcactgctgtttttcatctcatggtttagtggccctccaggtgaaggtcccacttagtgtcgcagtacggggaggggctgaatgacaagccatacaataccatgttctccagctcatactcagacgggacaaggaccactagagaatgcacacatcttctggaggttaaaccaaggcttgtcctcaagtgaaatgtaactttaaaaacaagtcagattcaaacttaaggactcacacataagtgcacagtaatatgaaaattatggaggaaattccctttaccacatttggcgaaaaggtttttttctctggtgtggcagaaaaatatgcgtctagagtttggtgtgacaccgctgacatgtgtgacctacgctgagctgagatgctttagctatgggtcatgtcctctctgttgtggccaggtaaagctgagctgcccatgcccgcggttgggaggggcagggatgaccttgtggccgggccagattctccctctcattagagcagattcccag

SEQ ID NO: 28902 - DNA, 1169 bp, Mus musculus
tgtgacccataacacaatgggaaacacatacattacagatacatgtccaggtaaagtttactgtgagtacacttgcttcattgatcataaaagctcagccttcttataggtgtaagggcttctctttaattaaacacttaatggagataaaccagttcatgtctaaaagaacacaagtttaaagtaaattgttacagaggcagcatctcatgtaaatagtaatgacattaagaaaaataattatcactagcatgccaaacatcaatggttctgcaaaatttctcatttactgctttgacacctttttgatcaaaatgatattttcagacaaagcatagctgtgtcaagtgcatcagtctgcctgtgttcttttcctcctagccaccctgctatccctgagagttctcccagagtttaagaagaaagctgtatggaccagagcgtatgggtggtgacagtcacaggacccagcaacattctccatgggaggagacagaccagagaaacagaagctttttaggactgctatctgagatctatgaaaagtgatcctcaccattggaggtcatgagaagatggctacatactgacatctcactgtgtgcgtggccaggagaagggtgcattccttgggtacctgggcatttaaaactgaaatagaacatgacttctatatggacagagttcattgtaaaagttatcttttctttgtgaaaactagagtatattttctctccctcaagttctagtaaaataatcttatgagttttgtgcaatgtgacttttatttttaagtgtgtgggaagattttgccaatgaaagcaaaccatacaggtgacaaggttgtgataatctattttccatgaagctgtgtcattgagttttattcttgttgataaaacccccacttaagagaactgctaggcacattccaatcactaggcatgatactgactggtacccaagttaaactcatcagtgataggtagaattcccatgctgggttgtcatgaatacacgtgaaagttatccaattcacaacattagtggccacaaaggaggctattagttcacaaaccaagaaactcatggttggtctgataaatcctgatgctgtggtctctttctctggagagcatgcctcctacttagcaaaacgtccgccagct

SEQ ID NO: 28903 - DNA, 1143 bp, Mus musculus
aaagtatggctcaagtgtaactttttaaaagatctatttcatgtgttcataagtgttttacctacctgtgtctatgtgtactatgggcatgcctgctgccagaatagagggtatggatcccctggaactgaaattatggatggttgcgagctgccatgtgggtgtccaggttctctttaagaacagtaagtgctcctaagtaatgagccatcacttcacatcctacaactgtaagtttttgttctaaagtttttcttgagcctttatcaccaacttcctatttgcctgctcagggtgctagcatgtaaagccaaacagaaaacaaaatcggtataaatggggaaaaatagataatccttctatttcccattttatataatagttgtgtccttgtggtccaaatgtctatattccatgcatcttgcaagtatattttctgctagttgcattgtttttgttggaagtgaaattgtgtaatacttggtttcgtggtgccccacaaaaagcactggggccttaactagacaatctagtttgactgtgctgggcttcctctttagttcctctccatttgctagtctgtgtaggacaatgacagtataaaccaacacacacatgaaggatgccaaaccaaatatctacttacctatgaagagcatcatgaggtacagcttcagcacataagggaaacaggtagataggtcgaacggaagcacggtggagtttgtaccaaatgactcaaaataaggcagtgactgatagatggtgaatgctgtttaaagaaaaagcatcatgaagattccctttctgggttacagaagggtacgtgcatgtgtttctaagaaaggagatttcgaattgacaataacagttttgtggtgattgccgagtcctttagttaaaggttcagcttgacacagaaatctgtggcatgattatgtgtcttaaattgttctagcattattgttaattattgcccattgtgcactgtgccgttggttgaatccacacatttcatgcttacatggaaagactatatggcgcttcttaaaatgatgagttaaaaatacatctgtctcctcgctcacaaatagggagaaagtcaggatggaaagtgctgcatactattttcttcttggagtt

SEQ ID NO: 28904 - DNA, 1165 bp, Mus musculus
cttctctgaattaagtaaagggattccactatccagtctgctcaaataactgtcgatggatgttctgagccttcagtctccatctccccacactagtggctgtaaagtctcattgtttcctagcattgcttaaagtgggacttcatttttcaggaaataatctacgagtgaggcacagcaaaacacatttgcatgtgagcacaaaacagcgttacctttgtccaagaaggtacctgttctggcgtgcactttattaaacctcagagaaatgtacctcaaagaatgagtcccttaacaaaaaaaatccatttgtcttagagggaaggatcaaaccagagctgaccacacttgccccaatcaaatatacatcctgcctcagtagctaagcttgtgtcatccctctgtccccaattggctttgttgtatgttttttgctctgctctttggagattgacattaatatgtccagccattcatagcagcactagactttttgtatgataaatttctacatggtcagttaagagtctaaaacacagggtacttaagaaaggcctggagttacagttttcatattgcccctgagtgttctaggagtgtgctgtggaggatgaagaaatgtgttggggacctagggatatgggaacagctattttgatgttttcccagaaattgaaattcttaaatccgttagtttccaacttggattaaatgaatggatggatactttgctgttcatgagctacttttagaagctgatatttaatacatacatgaaatttgacatatttatcagtaaaatattacaattctgagcccttagggagtaattttttcctttgatgtttatccctccagccagctctggctgcttttgtgctgttaatattgatctctcagattgttaagtacattgtgaaattcactgggtctctgaacagttactgtaactttagggaatactaccaaacacaaggaaaggagggaaataacagaaaagtcctttttttttttcatttttttaattctttggtttttcgagacagggtttctcggtatagccctggctgtcctggaactcactttgtagaccaggctgtcctcgaactcagaaatcctcctgcctctgcctcccgagtgctgagattaaaggcatgtgccacca

SEQ ID NO: 28905 - DNA, 1642 bp, Mus musculus
aatcatgtgtaaagaagaatattacctgccatagtaaaataatcaaaactatctgaatatcaaaaaaaattagctgtgccgtgtttccgttatacttaggttatggagcaatcaagtggaaatcatgtttcctcacgaagaaatgattaatctttttctctacttttaaatataatcaaataataaagctgtaaaaattaaaatggacttagagaactttgaaactcctttggtggtgaagtgaagacaacaacaataatataactgcgctgtgtatgtgaatcaagatatataagccaaataaccccctttcccaaataaagaaataaaggaaaatgctgtgtgaggagcttactaaacctttgctaagaaagatcctgggtcaccacacagctaagatgatgtaactgagaaagccaaggccggtgtttaatgcaagccagtgtgactcatcacagtgtatcgagagttgacacataatcagttggcaatttttttcttttgtttaaaagaagaaagtagaagcctaactttttatttttcaaattactgttgttacaggtgccctacagcgcccgtaaagggtctgtaaagtgagtgtgcctgtgtctgaaattgacttcaagataataagctgttgattgtaagcaataaatgaattatttgctccagtgttaatgtcgagcgaggccctggataagtgcaattgttacttccgcccatgttgcagtgctcccatctctggctgtaagcagtccgtggagactccgtgaggcctgatcagggctttaggttgtttttactcactgcagtgtcaacacttctttccccttagccactgcggggtgggcatccgttttgttgcctttagaaaatgctgctctcttcaacatggagaatgactttcttcagtggcctttctagcatcatgtgcaggcttcttccccttttccttaatccttcatcatgatgaaacatgcatataatcactgggtctggctcaacatgatgctgtccgttctgtccatcttcctacgggtatcgtaattccattctttttctgacaagatgaaatctccttgtgtatcctttccgcatccttatccatgcatgtgttgatggacgtgtgggctgctcccataatgtacctgttctgagtagtgtttcaataaacatcagtttgcagacttctcagatgatcagattatacttgagcgtttgtgttgggtcttagctattgctgtttgtatagaaactaaactccactttgagaaccactatccaaaccatttctctggttgttctttagattccagacctcagacctagtcaagggcatcacttggtccatcgtacatttttttttcacaactctttattggttctaattggttgaatttcacatgcacaccaaaccactcatctcccctcccctcatgcccactctccacccttgccccctcccctgccaacagaagcggtagtgagggtctcacggtgtgtcctacagtatactcttggcttgccagtgttggtggcattgagttgctggtctggtacaaggccctttgccttctgctacactagcaatactggaacctcactgggactcttcatatatcctgttgttgccctgtagtag

SEQ ID NO: 28906 - DNA, 1100 bp, Mus musculus
gcgcagagaagagccgctgcgtgtacccgggaccagggcctgcacgccgcggcggaccggtaagtgtgtcccggccaggcccccgcgcggtcgggcagacacgaggccgcagcccgaggacgttgtttattttcggttttaagcgcgagcatccccggctcttcctctttccccgccccgcgtcgcctccttctccggtcccctcccccctcccggctgcccccttctccgctgcctcctcgcctccttctccgcctccaccccggcccccgcgaaacaggaaaagtgggggaaggagaaaaaggagcggttgacccgagggccgagttgatcggagcgccggccggggacagaaggagcgcgcttggtcagtcctagctccgcgcgggtccggagctcggagattgagaaagcgggaagtcaagcccaggatccccgtagcaggcctgccctggggtccagtgctcacgggacagagggccatccgtctggactagttctgagttcaccggcgggagcctagctgatctgggtggcccagatgtgcaagatgacgtgggacccaggctagcttttggaacctggattagcggccctgagacttggtggcctttcattacgagcgcgggcctagtggtctggctgcagtaaagtagcaatccacagcagggtgacagctggcagggtcttatagagcggattccaaatgccagtactagacataggaagatggcaaggcctggaaataaccaaactaacccagcaaaggccttgctgcaactgagagccgcagggcaggtccagctgctgcttttccatctttccctctagtatgtgactttgcagtggaacctttcaaatctaggatcgaagaatggatccgttaaataaaatgagttttgagggctccctgagtatcagtgtagggttaaaacaaaccagtgcataccttgggttagctccacagagaatttgaatttcccaaataccgtgggtggccctggggcttcgggctaccctacctggaattttctccctcttcaaaaagctgctgctcctccaggtatctgggcagaaggcattttcccacttcctagggc

SEQ ID NO: 28907 - DNA, 1219 bp, Mus musculus
accatttatttgacactgaacaaccagctggagtcctcttccctgggaaggatgaccttgcctgctcccaggtttcctcagtgtggacagtcttttcaagctccaagtggcttttgagaacagagtggttgtttgaaatatttttaagttgtttgcttctatccttcctctataagaaaaaaggaaacatggcaaataaatttgtttcaagaagacctatatcttgatctggaaagatctgcacaaatattttgatcccatgtaaactacatcaaacaaacttttcagttgtttattttctaagttaggctgctttcagggataaggattgtaaaacctggcattgttgacatgtattttgctttaatattttttttgcagaaaccagaaccttccagttttattgcatggcagaactatttactgacttgtctttgcagcagattattgcatttaaggtgccatgaccgtctaagaaggcattattatttttaatcattgttattacttattatcttttatttcagctaaaaattgaggatgaaagtctaggtgactttctggtggctgtgcagatgagaagtcggacagtggcactgcagtttgctctgattgactctggagcctgtgtttgaagctacagcaatacaacagtctgctccagcgctgagcttgtaggaaggcgaccactccaggccgactcaatggctttagcctccagagttatcgtcggtgagactacaccagagggttcagtttttgaacagcatccttttgttgcagacccttcgaatccaatccttttaaagttcctaggcccagataatattactaccaccgttaagttgcatatgggaagccaggaccttggggcttgggaagccagcacagttgttttgtgaatggattcgctgccttttcgttttctattgctgtgatgagacactatgtccacaagcaacaaggaaagagtttgattcagtttacaactggtaatatacaacccaggcagtcggagtaaggattgatgcagaggccatagtagcgtgctgcttactggcttgcttacgctactctcttagagtaccagaatatcggtccattccctcccatccccaccacatacaccctttgcccagggattgtaccacccacagtgagctcctacaccaatctcaaacaggaaaatgcacacaggtcagtgtggttggagtacttt

SEQ ID NO: 28908 - DNA, 1631 bp, Mus musculus
gtcctgaggacttgaatttacagtgcatcagattcgttggctaattctgtctgtagatagtctagcttcagctgtttatggtgatgctacattttcgtttataaatatgtttgtggtaaaaaaaaaagaaaaaaatgagtataaccataggttttgaacaaatttccttacatttttcatacaaaaatcataaatatctgtatgctattgaaatttaactttgtatgatgcttaaaccactatttggggaaataataaaataagtctttaccatgtatgaaagaaattttaaaaaatacaaaatattttctgattagcatctagcttataataaattttcaaaaaagctgaaggcaactgtggccttcatcaggatgcactgagaactatatagttacgtcctgcgttttgtataaactgagatgctcatgtgcttccccttagaacaggcaatgtgctatgcataacatagttgtacattatctttgcagttgctttgagttttattttttattatttaaaactgtagttataaaaattttcagtatagtacagtacatatactgtgaggcgcgtgctaaagtgaacaagcgagttttcatgctgacccactcaatgctattcagaactcaattggcttagcactttctcatatccttaggtgcatttagattgtcagagttaacctgcgttaaaaaaaaataaaataaaatacatgtatatatttaaaaaaaaaaataaggtttcccttgtgggcaaacagcagctacacgcttctttcctgtgctactgtagcaaaccacagcattgatgagaaggcatgcggactgtgcttcacttcacagtgtttacccgagcacttaataaaatgtaaggctggtatttatttgaagttgtacagtatgacttaattcacatctgttggaatagaaaatatattctgttgagtatttaagaggctgtacatgttttcttttgtgtttggattctttgtgctttttcatgttcggtacatcaataaacaaagttgaagggaaagaactgtgtatctttaaatacatctggattgtggggtacctatgcgcagtctagttcaaaaataaataaataaataaaaagccttactctctttaatgaaaagaggtgttctcagaggtcgagttgaaagctgtgctatctaaaaggaatccagaaggcaagttaactgaagggggtggggtgggggggagacttaaaggaaaggaaaagaacaaaaacaacaacaaaatatcaaaccctaaaagagaaacaaaaactgtgacagaatactcttgacttcattaactaggtgacttttacagggacgtgttgtttcatcagctaggaatgcaccgttaaccctcgagcattttcaggagtggttactgcacaccctatgacttgggcatggcaactttattctgcctctgtccctaagactgtgcccaccagaggaggtgttgggtgacacttgtgttgagcaactgctatctcattaagagacaactttctgttaggttaacaaaattgtgaactgtgccagctccttccatgcttcatttacacatttaatcacaacacatctccggaaggtaaaaggatagaaaaacagt

SEQ ID NO: 28909 - DNA, 1197 bp, Mus musculus
tgattttctcagtatgggatggttcaaactagtttatcttcagaattaatcttagttcatggcttagctctctaaaatggcttaatcccctgagtgacattaaaagtatcaggcgtgtagtattaatcacagcttcctgacaatttgctgacccttctgagaccccctgttaagtattatgctaaattgagcaaaaatgcccactatgtactgtaggtttggattcttacatagtatctgtaaggtatgtttcttaaaatgccatctggctctcactgttagctgtttagtaagaaaatgttttgatttggctagctgcatgaatatttttatgctaaagattttttccttcaaataattgatggtatgtactacagtaatttaaatattttgtacttagaacatggcgtttgatggatgatgaatagtctgctttctagtaagtaaaaatattcttttgagtacgtgaagaaaatatatcctagtctgtaggcacagttaaggtacttgtgtgtgtgcacatgtgtgtgtgtgatgtgcacaccataacaatacctttttttgtgtagtacctggctctttttttctcttttcctttttttttctttaaatctccctccccttttccctccttcctttctacttcctcctcttttggtcttgccagctctgacagttttataagttgttctttttatccattctttaacttcttattaaaaagggattttttaaaaattttatttatttatttatttattttagcttggtatggtggtgacacctttagtaccagcactggagaggcagaagcagatagatctaaatgagtttgaggacagcctggtctacaaagcaaattctaggacagccaggactcagagaaactctgtcttgaaaagccaaattaaaaaaaaatatatatatatatacacacacacacatatatagacatatagacatatatacatatatattatacttatatataatataagtatatattatgtaatgcaatatattacatctaattatataatcaatataatattcatacttttttaaagaatgaaaaaacacattatagctaggagaacttgccaaggttaaaattccttcagaggtcaccaaaacactttgagctagatttgaactggttgcagttgtccgtggacctcgtgtgggctttcacttaat

SEQ ID NO: 28910 - DNA, 1349 bp, Mus musculus
gaagctgttcctgaagtatctgaaaaatatgaaattagctctgtccccagcttcctgttcttcaagaattctcagaaagtcgaccggttagatggtgcacatgccccagagttgaccaaaaaagtccagcgacacgtgtctagcggagcctttcgcctagtactaatgaacatcttaaagaagacctcagccttcgcctgaaaaagctgactcacgctgccccctgcatgctgttcatgaagggaacacctcaagaaccgcgctgtggtttcagcaagcagatggtggaaatccttcacaaacacaatattcagttcagcagctttgatatcttctcagatgaagaagttcgacaggggctcaaaacgtactctaattggcccacctatcctcagctctatgtttctggagagctaataggaggacttgacataattaaggagctggaagcatcagaagagctggacacgatctgtcccaaagcacccaagttagaggaaaggctcaaagtgctgaccaataaagcttcggtgatgctctttatgaaaggaaacaaacaggaagcaaaatgtggattcagcaaacaaattctggaaatactgaatagtactggggttgaatatgaaacttttgatatactggaagatgaagaagtgcgtcagggattaaaaacgttctcaaattggccaacctaccctcagctgtatgtgagaggggatcttgttggaggattggatattgtcaaggaactgaaagacaacggtgaattgctgcctatactgaaaggagaaaattagtgaacataagcatggtgtccaaggactgcaagaagtaactaattaccttggaacagtagatgatttggtcctgagaagtggactaacagtagagatacaacacactcagccatgctcgatgcacttcaaaaggtgtgctgaagaaacatgctacgttctccacgaagcagagaaggcaataaactcttcagactcagctagaaaaaaaaaaagaaaaaaaaaaaaaagggaagtagacacaataaagaaaactcaaagcaaggcaatgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaaaatccaggtaatccaggacacaatgagaagaccaaacctacagataataggaattgatgagaatgaagattttcaacttaaagggccagctaatatcttcaacaaaataatagaagaaaa

SEQ ID NO: 28911 - DNA, 1196 bp, Mus musculus
gaacccaaaccattttctatcatttcctggttacagaagagaaactatatggtcttaaattttattactgcattttgaacattttcttttaaaattctaatctatattacaagaattatgtaagtaattaggatacataggggtcccttggtcttgcaaactttatatgccctagtacaggggagtgccagggccaagaagtgggagtgggtgggtaggggagcagggcagagggagggtacagggaacattcagaatagcatttgaaatgtaaataaagaaaatatctaatttttaaaaaaatagttaaattactgaaaaaaaagttattaaagccaaccctccagtttccctttccatcagatcttgacactggtcttggtggtcgtaaaagaggaagagtggcctgacactggcctcacagcgatgcagttgctgtagagcagcaggccaaactcagacatgcctgggctttgtgaagtgggaaaacttgagaactgtgcagtagtattgctaagtactggcttactttcatgttgtttgtttgtttgtttttaggggcatgtaaccaatgaagcagccattatatatgatttggtctacacttgttggaaaaattccacaagaggatctcctggaagctagcagaattttttggctagtacctagccaggcagtcattggaatcagagctacagtcagattaaggccagcctggcctacattgagaaacctcattttgttaaaagtgaaatacttttcagttagcatgcaattggttcaataaagacttttgggaagtgtcaaaaaaaaaaaaaaaaaaaaaaaagctgaagccagataaagagagagatttggtattttcctgacatgatggatgtagtatttggggatggggatatatgaagagaagggatgcacactcaatttgataaaatacaaacaaattgttcaaagatgacctagtcggccatcactgcaaagagaggcccattggacttgcaaactttatatgccccagtagaggagaaccccagggccaaaaagggggagtgggtgggtaggggcttggggggatgggtatggcggacttttgggatagcattgaaaatgtaaacgaggaaaatacataataaaaaaatattaaaaagaaaaaaaaattgttctcattgcctaagatcttcacatttcttcag

SEQ ID NO: 28912 - DNA, 1660 bp, Mus musculus
tggtccaggtcttacattgctatctaattctcaaatcagctttctttgaaaagtggttattgtgcttctgttttcaaaaggaaaggtaatagaataaattataataggaaggttaaacatgaacataaaggcatgagtactccatgtagtctagtctacacagagcacttgccatgatgcagcttcctggaaagccacaggtttgtttctaaacagcccagcaactaaaacaaaggagacatcctttaattgaacaattcattatgtctatgacagtgctgtttcttctttctttttttggtttctccagacaaggtttcattagcagctgttctggcactcactttataaaccaggttggccttgaaccccgaaacctgtctgcctctgcctcctgagtactaggattaaagccaccactcccagctcagtcccttttcttaagaagtgtacttatattggtatgtgtatgtgtgtgccttttggttttatttgtttttcggtactagggaccaaacctggttgcatgttggggaaggtctactcactggattacattcccagttccaggctttcgtcttgattatggaagaaatggttttataaggactttgttaaaaatggtgagcagtgatctcaacattgccattatggagagccatgggtttcctgacttaatgccatatcacagtctaagaagaacaaatttttttccactaaggggaagaagattccgagtgttgagattaatacaggaaagaacttctagaatatcaaaagggagtgaggaaatgtaaatagaggatgtgtgctttactgagtattaaattccaagttcctgtgtgtacctgaactttaaacttcatgttgctgtttcatttatgtattcatactttacctgtattgaattgagagttaaatttttatatcagaattaaatggtaaaaaaatcatcctggtgccattataacacttggcttgttaatacatccattctagcatgcaattttaagtacaatttatgttatattttgaaaagcagggtgggtatctttgaaaaaagaatggatgtggtcttacttaaaacatgagttcactcttcagaatgtaagaggtggcaaattgtaaatacttttgtttcttatcactggcttttttataacttttatttgtacagcctaacaaaaacataatctcacttgaacctgtcaaatggtggtttacatattttgtttttctttaaacttttttatagacctcttaatgttttcttgaatataaaagaaataaacattcatttagtaaagcatacacacatcttattgactgtaatcctactaagtagaaaaccattcttagttttatactaccatgacatgtatgtaaatatgcattttaatttttcaaaaagggatgtattggtcagaaactttaatatcccattatattaatatacccattttctagtatctgaaactttcctgcttttgattatcaagcaatgctattaaagattgcacaacaatcttaccattcccttaggaatatattttatgcataaaattgatggatcaagttaataggcaattttggattgatgtctgtctaaatcaactccactaggacaattacaggttagtgaatctcctactgtattttc

SEQ ID NO: 28913 - DNA, 1621 bp, Mus musculus
tctttattcaacaaatagttttaaagtaaggagctgaattcaaagcatcacttggtatacatgaggatctcctcattggggacaaccacatcttgagggccagtatttagcattaaaatacatagcaacagaccaaatctcaacactgtgcaaatataaaaataactttttatatattctaaaaacaattgttttgtagtgggaaaataaagtacatttgaataataggtataaggaattttctagatttttttttatacacgttaatgaatatttctttttaacagacattgtctttcctgcacttgacattcttcgcctatcgattaagcatcccaatgtgaatgagaatttctgcaatgaaaaaggagaccagttcagcagccatcttatcaaccttctgaaccccaaaggaaagccagcaaaccagctgcttgctcttaggactttttgcaattgctttgttagtcaggcaggacaaaagctcatgatgtcccagagggagtcactgatgtcacatgcaatagaactgaaatccgggagtaataagaacattcatattgctctggctacattgaccttgaactattctgtttgtttccataaagaccataacattgaagggaaagctcaatgcctctcagtaattagcacaatcttggaagttgtgcaagacctagaagccacgtttagactccttgtggctcttgggacacttatcagtgatgattcaaatgctatacaattagccaaatctttaggtgttgattctcaaataaaaaagtatgtctccgtatcagagccagctaaagtgagtgaatgctgtagacttgtcttacatttgctgtagcagtggggaaaagacgctgaggggttttctttttttgttttgttttgttttgtttttttccacattttacatgactgattgcagatgtttaaaaagaaagaaaggaaaattggattaagttcagatcttgtaaagttgtgttgaggagaaacaaattataaataaagtttttgcactgatggttgtgaggttttcctgtgtaatggagtagattttcaagggtgtagaaatgttaaaaactataaccaataacagcacaattataacagcattttcttccttaccttcaccactcaggagaacacagaggttctataacctgtttctgatctatgacatcttgttcagttgactgttctcttttgtacattagcttctccactttcactgttgtattctttcaatagcactgatgcatttcaaggtcttcttttaggatttacttgaaaaatcatttcaattaagtttgttataaattgtaaattgataaataacaataatttcttgagccatttgtaaatagaaagtatcatctttcatggttcaattttacatgaagaaagcacattggtaagctgttatattacatatcatttcagacaactgaggccttaaatgagtatggcttaggagtttctttcactatatgaggtaacttcattttttctagttttgatatcttacaagttaaatcatttcttttatccttcaccatttgaagtagtagtgtcatctttcatttcagttttgtacatgttgatcatattcatt

SEQ ID NO: 28914 - DNA, 1127 bp, Mus musculus
aaggcacttattaatgtattgtgctcccccaaatagtacatcggtttctcgtttttattgtatactaaaatagttgtccagatgtatctattatactatgctaagggtaggaaggtagtagttcattgagcaaatttactttactaacagtagagttcattatcttaatttttgtttcagttccccaaagatttcttagagcagcaatacctgataagtagaaaagtggtggggaatgagaaaagggcacttgcagtattcatcccctgccctttgctttcttgtttttcctgctaatcagtgtactcgtactgagacatcacatcagatttttcccaatctgatatataatcccttactcatgcaacatagctatttaatgtttgattaaaaacagtatgttctttgaatggtgtattactactcaacctgcgtactgagtagtaatggatttcttttatgtttgatgtcttagggtaagccaggggccaagtgtgtttgtattaatgatcctctctttccagtcctaacaggggctttacagaaatgcactgtatgagcggccactctaattttgtgtcttgtgtgtgtatcataccctcaagtgacatatatcctcatggactgattgccactggaggaaatgaccacaatatttgcattttctcgctggacagtccaatgccactttatattttaaagggtcacaaagatactggtaagtataacatgatggtatttttgtatttgaagaagtttcactactttgaattacaatccatgtatttttcttccttatatttttagctatgtttattagtggaaacctttttggaccgtcaattatgtatgaatgtctgtgtgggtatatacacctgtgctcaggtgccatggagatcagagacaacactgagctatatgttgtcatcagccactagataccagtctgggagctgaactcaggatccctagaaaagcagtttgcacttttaataatagaggtgtctcacagcctcctatactttgtaaagtatgtgtagaagtttggaacatgatttataaacacttaacattaattcctgtacagagtaaagatgtttgtgtatatgtaatattttatatacaga

SEQ ID NO: 28915 - DNA, 1151 bp, Mus musculus
tgggatattgaggttgcaactgtgacagtacaactcagccagtcagttgtcacttgctgcattttgatgatcattttagacacataactgtatacttattgaatattattgctgtatttattcttttttggttttaatttcttggtacaaggttttgccatgtaacctagggtgacccagcctgcaacttgctggaatcacaggcatatatcaacatacctggcatgaaattttattaatatgtaataatatatttgacttgatacctgtttttaactaaagatgtttggtttaatatttatatagctcccccttgctcttttttgtttactgtttacatggaatatgttttttccggtgtatttgtgtttggggagctaaactgaaactctcgtgcgtagacagcacatactcagatcatgtttttaggcattctgccaatttgtcttctgattagagcatttattccattgacatttaaagtgaatacattttattattttctatattagcttagttgattttggggagtatctgaaattgtgtttgtgtgtgtgtgtgtgtgtgtgtgtgtgtgtgtacagctagtaggagctaattctctcctaacagctcttgggtgaagtccttgacctcaggccagtcaggcttgtgagtaagcatctttacctgaaggctggcctcaaggtggaggctctgccttgggttcccaagtgctaagattatagatagctctgtgcctttagcacagatgaggactgtcctttctttgcctgactctgaatttatttcatatggaaaacacacacttcttggagggcaagtttgatagtatgaaattcacttgcttttgttatctggaaatgtcttcatttacctcctttttgaacagcagttgaacaaaaacatagcattatttgttgatgggtaggttttgtttggtgtgtgtgtctctgtgtttatgcgtgtgtgcaagtgtttgcactttgaatacattggtctagtgtcacatgcctcaaaaattatttgtataggtgcacagaggaaattgcacagagactctcacacatgtaaaatacttactctcctactgagccatgccttcataggttttgttgcttttgttttgtctttaatgggaaatttgcctg

SEQ ID NO: 28916 - DNA, 1137 bp, Mus musculus
gctgaaggcaggcaggcatgacactggagctcagagctcacatttgatttccgagttgtagtcacagagcaagattggcacaagctgggatggtgagatggctcagctggtaagagcactgactgctgaggtcctgagttcaaatcccagttgttttttgagccatctcttctgccccagagacattttagaaagtgttttatcttaaatttacatggtggctcacaaccacccgtaatgagatctgatgccctcttctggtgcatttaaagacagctacagcgtacttacgcataataataaataaatctttgggcctgagtaagtggagttgacctgagtgagtagggcgaccagagaaactggagcgagcagaggtcctaaaaattcaattcccaacaaccatatgaaggctcacaaccatctgttcatgtactcacatacataaaaataaatgaataaataaatagataaatctttttaaaaagattgacataagcttggcttttgaaacctggaaggccaccctcaatgacctaggtctttcaataagaccatacctactcttaacaaggccgcacctcttaatctttcccaactagttctactaactgggagccatatatacaaataatataagcaattctcattcaaaccaccacagcacgtttgtctccatgcttttgcacacacccaaggacagctttgagtattgtgtccaggctaggctagcagtcaggctccagagattctcttgtgcccacctccctctgggcagcagtgattttacaggtgctcacagatgggactggttacttatatcagtccaagggatccaagctcaggtgcctgtgtggaatgtgagcttaccaactaagccgttgatatccctgcccaatttctaataaactacaacagaattgacagtatagtttggtggtgtttactacagtcataacattgtaccacttttagcagcatcatcttcataatctgttcttggaaaactgaaactatatatccattaaagtagtagttagctcctggcaactaccattcttctgtatgtcttcaagattttgactaagtaacttgtacttcatataagtgaactctacagtattcactttataactg

SEQ ID NO: 28917 - DNA, 4505 bp, Mus musculus
acaagggaaataattagctccaactctgtccaattgcagtagcatgtgacaaaatgtcattgaactagacttggtaatgtagccctcaacctagcttttttccctactgtcaggagaaagagaaaaatgagtcacatattacaatagaaaaaaaaatgccatctggtattttacatagcttaacccagtttcatgcacttgctgaatattaaaagtaaacttttttcatgttgtaaattcaaattgttcatgtaagtattagtgaatatttctgcttgctggagaactggtgtttgaccctgtccaggccttcttattggcaacagttttgttatattgaaactgaatgtgagtttagagttttcttttttctttttttttttttttttttttgctgtagttgtagccaaagggggaggcagcactggatggagtgactgcagtcataggtgacctgaatctgatttgggcactgtgatttaaagaaaaggcgtttgctttctctaggccaagtttgtcttatgtagctgaggctaatccagccctgagtgttgctcctactctgatttatctgctggcttgttaggctgcacttttggaactttataagatcgtgtaattgcaaaattaatgtgtagctttaaaagagaactagcagtttttccatttccctctgtacatttaatacgaacaatgaaacatactttgtaaaatcctcttgaaatctggaagtgcaaggactccagagcaaaaatcaggaatcctgagctctcaacctaatctgcttaagctttggtaaggggcctcgctccacgctcagctctctaaactcatcagttgagattcaaagagctgaattctatcacttgttgtctcttcaagcacacaaggctacaaaagtcagtagcaattaattcattcctttctgttttccttcctcttcacctgtctcttcataggctgttggcacagacctgaaatggatgataatttactttcttgcaattttcctagaatgctgttgaattttaaaaagttctttctcaaatctggactttacacatgccagtggttaagagtattcactaccctgatctatacattgtaaggacccaacgggtgccaatagtcagagtgtagggccttgagaacagaagtttttaagcaactattgagaaaatacaactattttctgactgtagaatatatttgtaatttatcttatgaaatatttttaaatacagtgaaatatatacaaagtgcaagtatctcaaacctactgttgaggaaatattttacataggaatcagattcttaaccagtttttaacagcataaattcaggatattcagttattgtttgtctgcttttgttttctgtctgttctctgtgctgccttctcttctcttgtcctagtgtctacttgctctggcagctgtaggtggccaacctaggcctcctgagactggttagagccaagaccttaaagaagcacagatgagtctggaacttgaggggacatgtaacacagaagttcatggagagagagagagagagagagacagagacagagacagagagagacagacagagaccgcccttcccaacagtgtttgcagaagtggaggaccagcaatgcctgagtctctttatcctgggttctatttttattggtgcataaaaatagaaattgagcttaaattttgtctcttattctgacatggttaaggacacttaataatagtacttctcttatattagacttactgttcttcaaaactaatactcaagaaagcaaaatcagtggaacaagaccagtaaggtaaaactcgctggccattgtttaaccttggcccttcttctccactccttttaaatggctaggagctcccagtcttggagttggtatggccacctgctcaatgctcatgaggttttaggcaccaagcactttagctcactttgacctcttccatatagaatttaaaattacattttataattgtgtttgtataacatgacagtattcacattttggattaaaatattcctttaatctaaaacttggattatttttcctaataaaattaagtaaaatgtttgttatacacccttcaaaattctgagaatttgagactgtacctgatgaatggtttatgttctgagagggttgttggaaaaatgcagaccgtgttctccatcccttaccaccactcaggtgtttgtttcactccagccaggagcactgcaggtcctcctgtcacaagcctggacatctgaacttcgtccttcccatcctagccagaactcagtatggcttagatcatccatgggaggcggaggtgcagtagttagaaatcagtagataggaattttatttaggttcctacttttacagcttgtgcgccacctcacagggtgaggtgccttttttccctttactgtcaaaccctcatattcatctattcatccattctcacagctcataggtacaagagctttatatcattcattgaaagtaattaaacagacccattcagaaaatgcctgcagtcatttattgtttagcattggtccaggcttctccacagaatgttcctctcgggctaggtgaggttggtagcatgcagactggaagcaccgttagcctcttcgtttctaaggacagagaaagtggcagccccggcattccagcctaagctgtcctactgctctttagtttaccttttcccatgtacattgctgagtcctgacggaaggaaggcgctagagaagccaacaaagcctgtgcacgcctccactctgtctctgctctgtgccaactgaagacacccaattggccacctgcttgtggacacacttgaagttcaccggcagacatcctatgttggtttctcagcaggagaggtggccacccaaatttcccttttctacttaccagcaaggcacttaatctggtgtcacgtgacactcatagagaaaagcacctgcacagaagcacaagaagagcacacacattctgttgtgttagcattaacaaacttaacgaacaaactttatctctagagcttcatctctagttttgtatttagctcttagaacaatatatcttataatgtatccagaaaaatcagaataatgtaatatccttcgattattatttcctgacctttctgaaaaagtttcatgcatgctttcatttcctgtaactttgttttctgatatctcttctaccttactcccttattgccccgaccaaatcaggaggaaataaaagcatccaagaggaacttaaaaggttctaaatgaaactaaactttaaagccgaaattaattcgcagcatctgtgtagcttttatttttgtcctttgctgtttctgtcatatattcatgtgagttccagggaaaataacctgctttgttgtgtctgagggttcctagtagcttatcaggaattcaataaattcatatttccggtgttatatgttatcaaaaaattgaggcctgtgtggtggtgcacacctttaatcccagaactcagaagcagagtcagggagctctccagtgctcaaggttagcctggaacaggaggactacatagtaagaccctgtcatttaaaaataaaacaaaacaaacaaacaaacaaaaaaaacaagacaaaacaaagctgggcatggtggcgcacgcctttaatcccagcactcgggaggccgaggcagaggcagaggcaggcgaatttctgagttcgaggccagcctggtctacaaagtgagttccaggacatccagggctacacagagaaaccctgtcttgaaaagaaaaaaaaaaaaaaaagatcatctgcttcagcatatgagtactaaagttgtaattagattttagcatgatttatgtagaggagtcttttataaacgcctttaaatgtgtagattggagttgatttatacagttgtgttgtatataagatattgcatgacagtttatgaacttgttgctgttttctcacaatattaacagttttgtaaattttttcactatgcatttacagtgttctataacaatatatgacttaaaactattttatacatttaaatgttatgttgtatatatctacattaaagaatattgtaaatatcaatgtttgtaaaattataagttttccaaaaatataaactcatttttccatatctacttgtggcatattaaaaataccagtttttaagctttgacgtattatcttgtagtgaaagaggaggatcatgctgtcaattcaatgtaagcaaatgttaaaaataaaacaggtagtttttgatgtctttgtaaattattagcaatgttattgaattacagaagaaaggcacttagttaccgtgctattgctgtaacaaaacatcatgaccaaggcaacttacaaaagagagcatttaatttggggttcacacttggatccagagagcccatatcagggagtctggcagcaggcagttaagcatggcattggagc

SEQ ID NO: 28918 - DNA, 1198 bp, Mus musculus
aaagattttaaccaggctaattttgttacgtttgcctttatttttgttctgaatgtagcgaacgaggagacgcagggtccgagatccatggggaaactggtgtgatgcaaaagacttagaaggacaaacatttgaggtaatttggccatatttgtggttcatccatgaaaccttgtttcattattttaattcctatatattatgctgatttcattgttactgtgtgtatgatcttccctatgttaattagtttattgaaaaattaccattaaccaagccataggcaaatggtagagttaattagaagtctgacttgtgctgagaattttgattctcaatctccacattgttgtctcttaagtcaagatgtgtagcatgtagttacataagcatgcacgagcggacacacacatacacacacacacacacacacacacacacacacacacacagacactaaaccggctaagcaccagcaataggcaatggtggtctcactcgccaccatggttcctgtgactagcctgcagaaagccagcaacagctcgctcttcccttagccccataaaatgcttgctcgctctctttctctctctctctcaaatgatattcttttgaatgatgtttgataaccaattgaaatactgttctaaatattatacatactgaattatatatattcaagtgttatttctactaatagaagttgggtccctgataggaaacataggcaacaaatattgtacatatatacacatgcacacatgtgtacacatataaaatttgttgtcaataattagtgtagtagagtggaaagaaagtattagttttgttatctcaagtagctacttaactgtactaaatcttaaattttaacttatgaagtaaggatgatagccctctgaaagaattttaaaagaactgagaggaagtgtattaagatcttagtattggacatccagtaaagctgctcagacgaggtactcagaaatgttaccttcctcatgccccctacctgcccccagccttacacctgaactcttgctggcataataacaagtaatatatggttccttcccataaggttggtctaaggatatgaggtactcccagagtgtgatgaggaaagagttcataaaaagtgagatgtttgaacccaaggatcaggagaagaatcacctcaaaatgtagatggaag

SEQ ID NO: 28919 - DNA, 1170 bp, Mus musculus
agactctgatttcttggaaaaccgttaagttctttgcttcacagattcccagcaatgatttgtatgtatatggcaaacactcagggcagagtttaaaagatcaatctaccaagctctctgtttgaacaatcacgtcagttttctgagtctatttacttatccataaaataaaatccgtgaaacctgcatccattccactgggtcattctaataattcacggtggcgggcggggcgggtaggcgcgcgcgcgcgtgtgtgtgtgtgcgaaaatgaaccagagacaatggatgccacaaagcagggtctctcgcctgaatggaaaaagatctgctgtgagttagcccacgtaagacgtgagagaagtgagataacccatgcggtccttggggaagcagctttcacgcagtctcctggtcttactcgccggagttccccggaagtgcgccacgccaaggccccgcctccggccctgggcccgcccccggtcccgccccgccgcatctcgcgggatctcgcgagtacgcctgcgtcaggtgcagtcatggaggcggaggaggcggatgtggatgtggaaggagatgttgcggcggctgcacagccggggtgaggcgcggagcggggtcctgcgggccgggctgtgctaggcaagggtcggaggatgcggttggccgagggtccgtgtggacggcgtcgggacccggggtgctcccagccggaagtcggccgggtccgggagtggacccggtgccccaggttgcactgtttatctccactttctgggctgcgatggacagtgtttaattcggattcctacctgcattcgcgctgtctcaggcgcctcacagcatcttgaacactggcgtctaatttagtcctgcgcccgctagcgacctggtccagtcgtttgattcctccttctcagagcaagttgttgaaaacttgggggaaaggcagcttaccctaaaggatccagattttagagttggacaagtcatgtttgccttttgcttttgctcttcctgtttactgtcactctgaccgtgatcaaggcatttgaggcatttccaagcaaggctccgcttgcttggaaaccaagaatcacttgtcgatcttactgttgtaagcatcgaatgaaataattctgagagatgttttagcatatggagaat

SEQ ID NO: 28920 - DNA, 1187 bp, Mus musculus
atggggagaaactgcatatatatttaaattattcataattcaaagaagggtcaggaattcatttcccagaaagaagagtgtgcgtgcaagtaattcatgtttgcatataatttccatgttacagctataactttgtggcgggcatcatatcagggattaaaataaaggctttgcatttactatagtatactcatcccactttgtgccaattcaaccattttccacttatagacagatcttcaatggagatcttcaacccaagcccatagttttagtgaacttgggtgtcagtagggtttggagaaagggagctgaccatgaggaggcatggatactcatctgggaagcaggaggatgatacgccatccttctctccttcccctctattaaaggtggctccccgttaggaaatacggcagtcacagagaggaatctgtgatatacagaatggttggggtgttagttacttttctgttgctgtgataaactatcatgagcaaagctagttagagaaggaagaatttattttggtttaaggttccagggggaaaatccataatggtgggggaaggcgtggcgggatgagactagaacagaaatctgagagtccacctcatcaactctaaacacaaatccaagagctatatgccagaaatgtacttccttcagggagactatacttcccaagggttccacactgtgcccaagcagcaccacccagtgggcaccagggctgaaatatctaagcctatggggcattcttatttagaccaccactgttgattatcatgcctctggaactctttagatgaattccttagttctttttagttaaaaaattatttatttgattattttatatattaacaatcttccaatctcacaactcattaatccttcttattaccataatataaatcaggttggagggacggctcagaggttaagagtacttgactgctcttccagaggaccctggctcagttttcagctctcacgtagttgctcccaaccatttctaagtccagtcccaagggataagatgccctcttctggcctccatggatatcatgcaggcacatggtacacatgaggaacaatccagtaatcatttgtccttctatggtcgttgttttagttgctgctccaggttactgccgtgaactcctgccttgattttccttaaa

SEQ ID NO: 28921 - DNA, 3353 bp, Mus musculus
ctagtcttattttggtttcactttgagacagggtctcataatcctgaactggcatagaaatgacagtgtgttcaaggatgaccttgaacagcggatcagtccttcctgcagtctctgcacgctggtgggattaacggaagtagttgtagaccacatggcaggtttgtatagttctaggggtcaaactcagaagctctgctcatcgagctgcattctcaacctcacaatcaactatatttaagtcagattatatcaaattaatattttcagcttacttagaaagcagagcacagtatcagctctgtctctgggcaggacattggagtagttggaagtgtgatgaagcgaatacttgtcttgaaatggcatcctgtgagggaaagcaaatgcatattccaactttatgtttttagttgtaacagcaagtcaagttaatttgcataaagtaatgggtagtttgtcatttaatatctagatttgctttatggaaaagtttcctgttacacatgtggagaaaaactgtgcaaggtgaattccttagtctggtgtgtatagtttcctctctttgcaaattctgccctctagaggatgcttcagcatgctgtagaagctataatgcttggaaaactgctgttgcagtgactttgtctgtaaaagtgactcattagaaatttgcagcttctctgagttgtatgccagtttgaacatgtactgctgtgaatgaggactgaactattaggataggaagtaaactgacatttgtgtttctgatgaaaagcaagctacactttgcaatagccacatgctttggagcatggtgttcttgtgggcattgctttctaagaaggagtatatcatgtataattttgcctctttattgaaaagaaatagtgatggaatagcttataaccattttggtttctgcttgcctctaaggagtgtctggagctgtatttgtggcattcggttcatttctgcccaacattgttttttccagaggtgttactttccaatttggggtcactttttaaagtcacagctttggaatattagttgttaaatcccattgcttaatgtagccacaggtggtttgctcttgagtcagtcacacatccaacactttgtagccacgtttccatcattgttgagagtttgttgagagttcatgtgcagcgagtcacaatcttggtttttggtaacttgaagaaattctttgatccttagactacagatttaagaagtgttacgtccatttcacttgtacagaggaatcagatggggaaaggagtgcagcagacacaagggagacaacagtgtgctttcccagaacattgccagtcattgggtgaaggtgtaaacttgcaggctgcatgacccttgttgggtcagcttctcacctctgccctcatcatagcatgaaagaagggatatgtaatatataaacaaaaagggggtggtggtggctgagtaagccagattgagctggcaggctgtggagctgtggtctacattttattcttagtccttcataaatatgagtattgttctatttgcagtgttaactcatttagataattgcctgtaaatccttgcccagtaattcttaaccacttaaaataacaagaatttcacaatgatttggggtctttgagattagtggcatctgccaggatattttgttttatcagggttccttctgttcactacctcttagattttgatgattcttgtctacattttacactgttggtttgtatttttgtatgtttatggtgtctgcttgcctgtgtcttttagtaaaataagactttaaaattacttagcatgctatttaacattttctaaaaattatgacatttgggtatatttttgtcaataaagacattgatggtagtgtttgtatttgcttataattgagattttacaagttcccttttcatggaactgactgtaaaacgtcaacttcaataaatttatgtttccaatataattgctcataaatttgtaagtaatgtagcataaataagaatatatggatagtttcttttttcttaattaaacaagcaaattttctgatttttctagttttaagtagaattttgaatgtttgatacatgtttatacaaaactagtgtaaagttctatatcatctagattaattatagaaattcagctgtaaccagggtgagattctttccttgtataatttatgcagtgagactgctgcccagccaggtagaaatcagatctagaaccatgacttctccaagtgtattgaagggaagattgagtgcataaaatggatttgacaaaaaaatgtgtgttgcagtgactataaagttaaaaacaaccttgaatttcaagtggctgttcctcgactgatactcctttctcttttttggatataattatgacactgatgtttatcttgggataaacttaatgtattgagaaatatttgaagtttattctatttttttaatgatctgactaatgatttagtataagtgaaaaaaaaaatgtcttgcctagcaacctctagctgagtatcccttagtaatatctggtctttgatgactggatgttatacacttcacaaccacacgtacttctgtatagtggtatatctggcatgtggggagtgactgtggtttatgccagagtactgacaatttgtgtaaaaatgaatgtaaatgacttgttatacatacagtcttactgtgatcctgtttgttgcacacatttataaagcacaagtcatcagaggaaatagtgtgtagttactaaacttgaagtttcagtgaagtgtttagtttattaaaaaggtcctttctattttctatggcaaatgctgtcacacttgaaaactagaagaagcaatacttgatttatttttgtaagtatttagaatattattttgaataaataattgtcaataaaattgtgcaatgttttacgcaaataaagttctgcttctgattcagtttgctgtggttttagtggctacaaatgcatatttattttccattttagcgaaggactaaacccacttcgattggtaagcaaaatcacgtgaattcaaacttacattttgtgtgtaaacagcttacataaaagtgatttttgcgcctggcagtggtggtgcatgcctttaatcccagcacttgggaggcagaggcaggcggatttctgagttcaaggccagcctggtctgcagagaagttccaggacagccagggctacacagagtccctgtctcgaacaaaacaaaaaacaaacaaacaaaaaaagtgatttttgtgtatttttttgtctctagcttcaccattagaatgtagatatcttttgataat

SEQ ID NO: 28922 - DNA, 1224 bp, Mus musculus
tttttttctttttaatctttcatttgttagatttttaaactgtgctgcaataaaatgtgtgtggtactatttaaccctataatggtgatggaattttcccaaaaagccatcttcctactgtttcccttgaaatcccatcctgcttttcctgtacactacccctcacaaaccacaagccgcagcaacatggatgccagtttggagcagcaacagccaggatgacctggagccaggggggccttcggaacagatgtatacccttcctggatgatgttttcagccttgtgagaaacctcatcatcaaaggagatggctagcaatgttaccaacaagacagattctcgatccatgaattcccgtgtattcattgggaatctcaacactcgggtggtcaagaagtgtgatgtggaggccatcttttcaaagtatggcaaaattgtgggctgctctgtgcataaaggctttgcctttgtccagtatgttaatgaaagaaatgctcgagctgctgtagctggcgaggatggcagaatgattgctggccaggttttagatattaacctggctgcagagccaaaagtgaaccgaggaaaagcaggtgtgaaacgatctgcagcggagatgtacggttcctcatttgacttggactatgactttcaacgggattattatgacaggatgtacagttacccagcacgggttcctcctcctcctcctattgctcgagctgtggtgccttccaaacgtcagcgtgtttcagggaacacctcacgaaggggcaaaagtggattcaattcgaagagtggacaacggggatcttcttccaagtctggaaaattgaaaggcgatgaccttcagaccactaaaaaggagctgactcagataaaacaaaaagtggattctcttctggaaagcctggaaaaaaaattgaaaaagaacaaagcaagcaagcagacttgtccttctcatccccagtagagatgacgaatgaaaagtctgaagaagagcagagcagcgcctctgtgaagaaagatgagactaatgtgaagatggagtctgaggcaggtgcagatgactctgctgaggagggtgacatgctggatgatgacgataatgaagatcggggggatgaccagctggagttgaaggatgatgaaaaagagcccgaggaaggagacaacgacagagagagcgccaatggagaggatgactcttaagcacgtagtg

SEQ ID NO: 28923 - DNA, 1150 bp, Mus musculus
ttctttattttttgagtcccctccctcaggattgtggattctctccctcttcccgccttagtggtttaggctctatgtagcgcagacgggtggcgctctgcatagcttgtgcccaggatctaacctgcagtacagaaggatttaaaaaaaaacaatctctcatcttgtatctgatttggtttgataatgtgcttttgggagaatctcagagtccaagctgtcctcctagtcatgtgacggaggctgacacctcagctccacctcctaagtggtggaattaaagaggaaaaaataagatagtttactatggagccattttgattgtctgagtttcaggcacacagatgtaggttaccacaaattccatattccatcatggaagcagtttgttccataaagttttataatcttacagaacaaatttaaagtacattgggtgtggcgggtagacaggtccggagagtctgggcaagcatttctgcagtaccaagatgctatctgtcatttcttatgagttcgtggatggatgctctgtgtagtggtgtgctagattaataggttctaaaaggttcttatctgttggtcacaagacacagggactgtcctggaacggtgtcctccgagctagaactagcccaagataagataatgaacctctggacctgcagcattccagtgtattgggtattgcaggctgatctgacaattagcctctgcaggcaccagtcttccaggaactcatgtgtacccggtgcagaaaaatggcctcgattttgtttgtttgcttgtgcttctttttcaacttcagtactattgcctattcttttgtagcttccccacatatatagactctataggtgctggaaatgtgatattttttgtttaacaatgcaaaagttacagacttgtttttgctatgctggagatctgaacctagggccttgagaatgctaggtatgtgttctttttgtttgttttcagacagggtttctctgttgtagacctggctgtcccggaacttattctgttgaccaggctggctttgaactccgagatccacctgtctctacttccccagtgctaggaataaagtacagtgccatcttttttttttttaatttatgtatttacattataaatgctgtcccct

SEQ ID NO: 28924 - DNA, 1106 bp, Mus musculus
tcagatccaatctctaacagaagtctgacttgagtgtcaagatcccggggacactccagcgacaagccagcgacaagccagatcaaggtggcatctcaacagatgtgcacagcacaacgttgttcttggtatctgttcatagatggtccagtgggcatcatggtgttctaggcctgtgagctagtaatgtcactgagttctggttatcaggtgcagcctgactaagctccttttacatatctaaaaggcttccccccagacagggtttctctgtgtagccctggctatcctggagctcactctgtagaccaggctgacctcgaactcagaaattggcttgcctccacctcccaagtgctgggattaaaggggtgcaccaccattgcccggcttaaacgccatttttttaaaaactatcagtgggagtattatacacacacccatccgtattaaatgctgttgttgaaatggactagcctttcccttccagctctaacttgaatccacagtctaaggatctattttggtttttgagatgaggtttctctgtttagctgtggctgacctgctctgtagaccaggctggcctcaaactcccagagatcgtcccacctctgtctcctaagtgctgggatcaaaggcgggcgggcaccactgcctggctagtcagtctaagggcctgtcagtacagattgggcctttgggaggagaaaggggaatgggatttattttgactccttcaggaagtatctaacatttttcactctggaaaaaagtaatgttcttaggtcaacctcaaaacttttgtttgtggtacacacaactttttacctttccattcattttttttaaatttatttttgttatatctcattatatgttttgttattttatttatttatactttatatgttttgttttattttatatgaggacaatttgtttttgttttgttttgattttggctaatacatttatagaaagttgcaatcataaaggatatgggaagacactacctttttttagtttttattttttttattagatattttctttatttacatttcaaatgttttcccctttcctagtttccctctaaaaatccc

SEQ ID NO: 28925 - DNA, 1958 bp, Mus musculus
atgggcttaaagaacttgcctttagttacctggtctgggactctaagaaaaaaaagctggtgagatgccaggagggaggagcagctgctgcttctactcaaaggatcgggatgccgtgtctaaccttatatttgacttctccatcagaatctttaggggcaggtagcgatggtcctaaaagccattcatgtacaaagttgagtgctctgtcacaagtcactccacttttaacgaacatagaaaaggggaggtacaaggtgccgcaaacagaagagccaacagccaaagaagcagacttgatccttgaaaccgaagaaaacttcaagagaggcgtgatcagtgttatcagacagatgcaaagggaggtcgacaaaatcaaaaacatttacgtttccgacgtcctgaatatgaaaagttcactggatgatctgaattccttagcttgcacgattgaggccagggtgagcgaacaggaagatgccgtggagggactgaccaaggatacaatgcagttagccagggagatcgttgataaagaaaggctgagagagagggaagataggtttcgaagctccaacatccgagtgatagggattccagagaaagaaaaccgggagaacggagcggtggacataattaaggaagtaattgaagaaaactttgccgagctagaagaccagagcctcgagattgtcagcgctcatcgtgtccctaattcagtggatgagcacagactcacgcctagacacatcttagtgaagtttgggagtgctagtgataagcagagagtcctaaaagcttccagagcaaaacaagaaataacctacagagggtccaagatcagactgacagctgacttatcacctggtactatagatgcacgcagccagtggtgtggtatcataaaaattctgcaagacgaaggctttcagccaagaatcctttatcctgccaaactggcatttgattttaaaggtaaaaccaagatattttttgatattgaggaattcaagaagtttatctctgatataccctatttgaaagatctgttgaacaatatacattagcaacctggagtgctctctgtccaccaaaatacaaaaccaagtagagttggacagtggaccatcacgtctctgtcttgaagggtggacggctgactttttttcccccagggaaaggggctggggaagcggtgtaactccctgagtgttggttgagttagacagcgtatgtagcttttcagtagctatctaccttggtaaggaggaatcttgtcagtgtgaccacacacggaaaaatactagaggccacagtgggatgggaaaggacatgataagttagaagagactgcaggctgactgactcaacaagattacattgctttattatttactattacatattaaagcttgaagtttgcatttgtcattggtttacttaatgtccctgcttattttccagagaacctgtagattgtctaatcgcttctaccttgtattgcttcaacccatccattagtggagtctttaccttagcacgtgactgtgtgtgcatagatagtgcttcctttgaaatcagtctttagtgaggagacactgaagaaatctgagagaagaaaatagcatgttttgttttgttttacactggtctccagtatcccaaattgtcctgaacctctccatgtagctaggactagcctcctgcttcagcctgccaagtgctgaagttatgtttttgggaaaacaccatgcagtgaaaattgtgtctaatcctggggcaagttaggacaactgagcaagccctgacacccctgtgaggttgggggactctacagaagacagtgccaggcacccctggttttattatttttcccatgttgggagtggaaccaaagcctgctagctctcttgctgtgtcctcactcagacctgacataaatgtcagatgtaaaacgg

SEQ ID NO: 28926 - DNA, 1417 bp, Mus musculus
ccagttgtggcctaccagataggctcctatggtttgattttggaggcagaagaaatgtctccacagcctactccctggggagttctgagaggaagaagagaggtagcttgctcctggcagcactgggtttgccagctacccttcctgtcttaagtgcccacaggaccccacacagtagaagttgcttggctattctccccatcactaggaatcttgctgattgggactgtaatcttaattaacttttaactttgtagaagataagggttttcctaagccaaatcctggtcaaatgtcaatcttcagagtttacagagcctccctgctaacatcaggtatcctggacacgccatctccactttgatgcctatgtgttgaggtagagagtgtgagcctcctcaaggctgccaaagttgagggttagctggggatgtcagtgtcccaggaggaccccttgggccatgccaggctctaaacagaggatgatggtaaagctcctgtgtgctggcaggaggctggcacaacaggagggagaggctcgctgtgcacttccgctctctcttcctcttgtctctacatcagagacaccaagtctcgacctcctcttcctttcatgttgagtctggcaaccaggacagtgcctgtttcctggttagttagggtccatctgaagtgtttcttcagcgcctggtgccgctcccaggtgtacctgtggaggggaggggctttggttttgactacacttcatgcagctcagagtgttcttcaacttttaggttttttaagacatggtttcactccgtagccttggctggcctcaaactcattgagatccacctgcccctgccttctgaatgctgggatcaaaggtatgcaccaccacgataggcctaagacattaaaaggaaggggagtgtttcttagtgcatgccatgcgcgatgtgcacgcatggaggtcagaacaggtcttgtatggacccagctatcttgtctcccttttgcatggattcagaggactgaactcacattgttaggttttcacaggaagcagcaccttttcctggagccttatcaccagtgggtttcaggaaaggctttgatgaatggcatttgctgcatctgtcatcctaaagtgaagagactatattttttaagcactgtggccatgggttcagtcatcgtaggtgtcatgtctactaagaaaaatccctgtgagcggaatgtattaagatatttctaaaacttctcaatgcaaaagccgatcctccaaaaacactccatcactgcccctgcacatgctcatccacgtgtgtaacacacaagaaaggtgagtgtgagctgaggcagggctgaatatacatcccaacaatagtaatatatgtgatctgagagtctttgggagtgatgttgctctcaa

SEQ ID NO: 28927 - DNA, 1490 bp, Mus musculus
tcaccattggagacagaaactatgtcaaatatgcacagtacattcccatcatataattctgctcattaggatgctcggtagtgttttgccttaggccaagcccccccacactacatggggtgcagagtgcaggctgcagtggagtcatccagaaattcaaaacgtcttcggctttgaattcctcgtgacgttgtctttgcagtcctgtgtagcaagcaggtaggtcagggcacccttgcacaatagaaaaagcaatactttttacatggagttttaaagcgcactgtttttttctttgttttgtttttaatcaagtgtgtatacaaatatgttccagtgactatgcatgtctagagagaatggcagaggagtctaaattcgggcaaagtgggactaagcccagtgatgtcagtgccagggtgtgacacttctaagtacccgaggggctccattccttctatggaagtaagcagaaaacaaatggttaatactagtgatgcatgcttgacagagtccagttatttcacccattcccagcctacgagagaagcaaatgaactggccagcttcttgctgagagtgggtcactgtagaagtcaacattactcacccgtccctagaagcacagggcccctagaagcaggtaccagctctgagaacttcctggctccttggtgcacagacatccagctgggctgcagtagcagccagccagggtaagatagagctttctctggactgacatctctcccagggatagttctttcctgagcatccgtatcccctgggtcctgtacatggaaggctcataatcatagctctgaaaatctcacgccaacattatatatatatatatatatatttcctttatataaaaggaagagcatcaaaattggtgatctgtacactgaaaacactgaagcaagaattctcatttgggctggggtgcctatttgtttggtacccctctgctaagtcacaaagcttttgtgggtaacaatgtcatcgtccccaaggtggaagcaagtatacaacctacctctgggagtctccataagaaacagcttataaaagttttggaatctggataacccagaaaggctgacttcagacattctgtagcaaagtccttttcacagcatgatttgtgagagatgcccagaatccctcgtgtggatgctgcttagagataggaaggatggcaaaacagacgagctttaaagaatgctgtaagaggatttattccaatgtcaaaacgcaaatgtaaaagcaaacacacacttttaataaacgttagctccatgctttacaaaggttaatgtgtatccagccccagggatcttgttatgcagcaggtctgaaaggaggcctgagtttctgtgtgtctaactgggcccagaggacgtcaatgcggtcagaccacagccacgcttcgagcagcacagctccggcctgtcctttttgtttataaattaaaatgttgcctctca

SEQ ID NO: 28928 - DNA, 1599 bp, Mus musculus
tatgagctgtacaacaaagcatctaatcctgataaggtggttgggacaccattcaccgacaatagaaattctgaaactaatgatactactaatgggacccacgaatctgacaggaacaaggaatccagtgaccaaacaggcgttaacatgaacggacttgagaacaaaatttcctatgtagtgcaaagcttaaaggagtacgaggggaagtggttgctctttgacgattctgaggtaaaagtgacagaagagaaagactttctgaattctctctccccttctacatcccctacgtctactccctacttgctattctataaaaaattatagtgagtatatttcccctgtaaatattaaacagacctggacagatgttggtaaagttgattacatctaagagtctttagtttatcttttgaagctattggatattattggtctctctaggcttttatataaatagtgagattttaaatactgaaaaccatgttaatttttagaatcattttccttagtagagactagtgatggatgagctgggaacaaacttgtgtagattctaaatgatccaaaatggaagcttgacacagttaacacttggatttacatgatcttttgtgtttgctttttaaaataaagtgcttgtatttgtattctccatattctggagtaattatctacttgatgtttataggtctggctttttcacccaagaaacaatctcattcagtatatttagttttataatagtcatgaagccaaatctctgcgctgtatcagaggcacaaagtctagaatatgtatattcacaatggtgtatattttgtgccttgaataactttggaaagtgtctcagaaaacctggcaatcccctctatcttcataagaattttatatgtatttatgaagatggctctgtactctagtcaatctttttggcatgactaatttgtatctcttcatactctttctgcacgatctgtacatagaacatcaacttagatgtgtgacctttaacttttttaaaaactgggaggtcaataaaatttaagctgtttaacaaccaaatgtgtgatttttttttttaaaatgtatattctaatcaaagtggagttcttagattaatgtgtatgtacaagagagtcatcaagcataaataacatttaatactcagcaatggagcagaggccaacaactttcagaggaaagttaacaaccttaacacatctttgcttaattttaagtcatttgtctaaggacttggccaagggacactcacctgaataaatatacaaatgctattggagtaacattccatttcaatggaaaaattgcttattaacatttcacagatggtgtgatggcaactagatcatgcgtccttgtactttcccttaagtttagaatcactagtagaacttttaaaagtaaccatcctgtgctatttattaaaggttgtgttttaggaaacattgtcaggaagtataacaaaatggagtaagaaatctccattgcagctcatgagaaaaaaacccggtattttggaactaaaccatacatacataactcttaagagttcttcacactatctgagctgtc

SEQ ID NO: 28929 - DNA, 1194 bp, Mus musculus
agtcccgaaaccgcagacgctcaccgtgcgtggcgggtagtagctgaagtccagtagttacagttacgagggacagctgtaaatctaacttgggcctgcccctcacaaatgaactgctctaggctctgagcttgcagcccgggagcttagggtctccgacagggcttcctgcaggaccgcggcctgcggaggcttcggtgtgctgtgctacggtggccgcgcggggccgcgggccgcacgtcctgcggtgcgtacgcgctgttcggagcggctgctggagccgacgcgcgtctggtgtggggactcctgcgcggctgtacagttatccagtcccgtgtcgccgaggggtcggctcgaggctggcggagtggagaaggttggagcttggtgtttgtagtctacgaatggccggttctgggggcggccctgcccttggtgcagacccgtggccaaccgtctgggttcctggagggttttggagcctctctcgattctgcttcctcctgagggttatcttctgacgactcctcctcgccctttgaactgtaagccttccagtggccggctgttctacccttcttgaccaggaaaggttttctccctagccgccgtatcccattgactcttccttgtttctcttcatttaaaacaaaaagagtgtatgtgtgggaaatgttagatctcaatctgtccgtctgtagccccgttgcccctttcgttgtttgaaaccgcaatctgtagcattatataccctggctgtgctaataacgctgacttcatagaccggcttttgctcattctcacatgcccacccacatctgagggttattgaagttggaaactcagactacaatcttccgtgcgatgacccgacatcactgggtcagctcagcataactctgcttgagtttattttcttagggtttttgtcgtatatttttgttatctttattgattacttttccacacgaggttcattgcgacctcggggctaagactgtattattttatagctttttaatctttgaattacttaggtgaagatttccttctgtttgtttaccttttctgaccttacattcccttgggagtttggaattgattttgtgtcagttgatagcagatagacacaaaggagtgatctttcctgcctgctgcttgtggcttttaattagattatgagtctttggaagt

SEQ ID NO: 28930 - DNA, 1186 bp, Mus musculus
tacccttttaaagtatcagctcctgtgatggtatacatctttacatagtgacaagtcatgacgtgactgtatacatccttacacattgacaagtcatggcatcttatttgcgtgtcatctttcaaagaactcacatgtgtgtgtcctgagccaaccaaggtaaaagagaaggtgttttaaattaccgtcttgtccaaggagtgattttacagaggtgcagagggacactgttaatagcagtgttactgtagatcctatattggtcccccagtgtacagaccacctcagtgttcattctcatttgattgggcagtggaaggcttacattcattcctctgaaatgagatgacacaataatgatagacacacataattaccattctgcacacttgctcacctatctctatactatataacttacaccttaaacattttgtagatgaaagcaagatgttgcctgcaagatcaggatgtgccattgaagatcatgtaattgcagggaatgtggaagagttccgtaaggatttcatttctagaatatggctgacctacagggaagaatttcctcaaatcgaagcttcagccttgacgacagactgtggctggggctgcacgctgcggaccggccagatgctgctggctcagggactcatactccattttctcggtagaggtaaatcaagtctctgtgtttctgctgctgctttcactctgagcatcggtttgtgtagcacacccaccttgctgaggttaaggtgttccactgatgttccatctgtactgagctgagccgcgtgtcttacacgtgcgtgctctgcagatgcaacatggctgtctggtcaccacagtgaatttacctcacattttattgttttggttgaattttctagagtgccgaattaagtaagtcctgggcagaagaaattttactctttttttttttttttagtacatgtcagtagtatcttgaaattttatcataaataattacatttatcatacttatcacttatatttatatattatatcacttaatagtatatattaattatatattatacattatgacattatatacattctatcatatataatataattataggttaataattttgtatataatatatacaaatatattacatagaaattatatattatataatataattatatttaattaaca

SEQ ID NO: 28931 - DNA, 1383 bp, Mus musculus
gctacagctcaacaccctgggcgccgccgcggcagccgcgggcacggcgggcgcggcgggcaccacgtcgctcatcaagtccgagcccagtgcgcggccgtcgttcagcatcgagaacatcataggcgcgggatccgcggcgcccgggggctcggctgggggtggtgggagcggcggcggagccgggggtggcgggggcagtgggggcggcggcggcgcgcagtccttcctgcggccgcccgggactgtgcagtcggctgcgctcatggccacgcaccagcccctgtcgctgagccggacgactgccaccatcgcgcccattctgagcgtgccgctgtctggacagttcctgcagcccgcagcctcagccgcagcggctgcggccgccgccgtgcaagccaagtggcccgctcaatagtgatgagctagtggccgggccggacggcggcctctggcagcagcctgctcttccaggcggtacgccctctctgatcctggtccatctgtcctggtcctggtcctggtccctctacccaatcctggactctgctacccgcccccgactccccaacactgaccaacagcggcctccatcccctcactcacctaagctggcggagcaaactcaacccgcgtccgctgggaataactttccgtacaggtaaaactgataaccgaatttccaaaaatgcaccccgacggcgcctgtgttctcagtactgtgggggtgggagggacattctttgtacatatttgtataaaaatcattgactttccttttggggtttttatttttttaagaaaataaaaagcaattcagtagatttagagctttgaactttcatatttttttgaaggttcactctgcgcagttttatctgagaaaaagaatgtataaagacgttgggagattttaaatccaaaaaaaatttttcaaaaaggcgaagtgtcattgtattataaaagtctgtttatatatgaatgaatatatatggtattctaaatgttattccatcgtgttgtacacaattttgtaaataaatttttaaaatgctcagcctagtgttttaattaggtgtctagcaaatggcaagattttacaatggaatttgcattgtcttccccagaaaatctagcagtcttaagtaatgaccttttcaaacgttgcaaattcacaatttgggtgtagaaacatttgaatttgaaaatggaaagagcgtacttaatttaaattatattaatatgtgacttttcacataaccaggataaggatgacaatcccattcatatcaagccactgtgaatgactcgcagctcctgcaaagtgtgctgtcattaaaaatctaggcaaaagcagccttgttcattttaaagaacattggt

SEQ ID NO: 28932 - DNA, 1162 bp, Mus musculus
tgaggagcatggaacatgaagaagtttgaaaatggttgcctcgggagtcactttgtgcttgcagagtagaaggaaatgctttctctggtcttttcctcaagggactgtacatgtggcacacgaagtgtttgctagtgacctagtcaagtggctgttggctagacgtgtggagaagttgacacttcctgaatagtcacatgcagaccttttttcttttaaactaatcttgaaaatcagacatgcagagtatatttattttttccaggctcggagtaaaattatattctgtaacattaaaatgctttttcttgtcattttagaccagtttgcttagttttaactgaaattcctttcatgtcaacctggtttttactagtttcaacatttaggtgagtcaaaccaatttccatgtaatatttccagtacgattattacagtcgttgaaaaatttacaccgtagctattgatgcttttgcggctttattttcctttacagcatgctgcctcttctattaaaggatgaactcctgctgccctcggttgtgacagtgatggcatttgtaatagcttgtggcactttctttccaatgttggagaacacttccgaagaacaactgcagttgaagtcctttgctgtctctgtaaggaggcaccttccgggcttcacatttttgcccagaattatgcagtgtttggtaagttaggcagcagcttgctttccagtatttaatttctgcatgtatactgcttgcctagcaatacatgtggaggttagagggtaacttttgggagttggctgtttccttctaccatgtgtgttctagggcttgaactcagattgtcaggcctggtggcaagtgtctttaagtgccgttccatcttactggctctgttcagttttaaaggagtatattttttagcatattactagtttttttgtaagttactgaatttttgttgttgttggataggatcatactcattatgtagcccaggctagtccagaacttactatgtagcacatgcagcatttgaactttgcccttcctgccttggccttttatatgttaggatcatagacttgaaaggccatttataccctgttgagatgtgttctataatgcatccatataacttacacattttactggggttaagtatg

SEQ ID NO: 28933 - DNA, 1744 bp, Mus musculus
tgtttgtttgtttgtttgtttgtttgttttgctaagcatactataattttggtaatattcacagatatttaatggtaaaacaagaaaaaaaattgtcccagctggtcgtagtagctcatctttgcaatgtcagtaccaggaggtagaggcaggctacctagagatcaaggccatccttggttataaatagcaagtttgaggctagcctaggctatgtgagaccctgtctcaacaaaagggttcccaatgccaatatttaataatggaatgcatcctataaattgtaacttttaaaaactatgtattttatatatagttttaaaatgtaagaccagtcagaatgcacacagagccaggcctgctggtacacattgggcatctcagcacttggtagggacaggcaggaggagcatgaatttgaggctagcctgagctacataaaatcctgttttaaaaaacaaaacaaagtcagacaaagtgtgcttcaataaatttaaactgagtttattggaagaattaagcacctgacttgtttagcgacaagtgatgagcatctcattcagaagttgtatctctgggctgaagagatggtttagcagttaagagccgtggctgctcttcagaggacctgaattcaattccagcaaccacatggtggctcacaaccatctgtaatgggatctgatacccttttctggtgtgcatgaagatatcatacttgtatgcataaaatatatgtatatatgtatttgtatacataaatctttagaagtatctcagggaattaacatttttcttaattactgagaaggtacattatgctatttgaaatttgaatatccattattgcatatgcaaaattggatacttatagattaagtagtattcttgtttccaagaatgtagaatctcttgatgctattttttttaaaaagaacttttattgaatataaatctaagaagtttgaagtctttttagttactcatggtatttagttctaaatttctagagtcattctaaattgactaccatatcaacgactccatctccctttctgttaccttgttaacaccgaaataactgcatattcaaatcatggctaacaccggctctgtcccattggtagggttatcccttcacccatatcaattcctaaaaatcatgtagtgtgttttactttcacaggaaagctgtttctttagtctctgatgaaaattaaagccactttacgactagccttgtttgcgtgtatttctttcataatatagtcaccagagcattaagtcattaaatggcatattctaaagtggtataaagaattggagtctagacttggctatccataggctgatgctagaaaatatgtatttctcagtctgacaaagcaaatgtacatgaggacttcagggtcaaggtcagcagagaggcaaccttggtggctgcagaatcagcaggcagtatcactgcgtcactgccccactatccatggccactatctgtaattgttgggcccagcaggcagcatcctggctacttttacttgaacctgttttacttttaataatgtatcaaagtttaacacagaattgctgatttccattaacttcccagaaattgagtagtacaacttcaaaataaaagtattaagaagtataatggaatgccagattcagtgtttgtcctgcacgtaaattctgtcaataaaaatacattttttcggggcctagcaaacacagaagtgga

SEQ ID NO: 28934 - DNA, 1963 bp, Mus musculus
gggactcataaattgcaagaccttctttttccagttttcaagatctaaactgagctctgtatgtagactttcctggatgggtcagacattgacaaacagagaaagaagttgggatttgtatctgtatgcccaggagtgttcagaccaccacagctttccatgtgggagagaggccggtcagctctgtggggaggatcccttcagctccacccttgctcacaggggcctcattcagcagtcccctggcctatgcccaggacagagaatgggtggggaaaaggaaggctcccaggcaggagtgagccttgtcggtaggagcttttagcatagtgtgagttttagggttcaaatggatttctgccactttgggagtactgtggagtgagaaggaaagcgtgaagacaacaacagaaagttactaaacatcatcacgcattagccactggcctgttgctcttccctctttggccaaactctaatagttccaggattcctacactgccactcgccaccttatcgtcgtctaagccctgctgcttccgcctctctgctgaaacgccccctcagggagggtgactctgcttgctcattccctgtagcactgttgtgggcctttacctatgccctgcatttggctgactttgcgcttaacagtctcattccttgtcttgatcacgccactgatcgttcccaccatcccatggctcgccatacttataccctaggtctttgtccccagcttgctgctcagattctcttaagcatcgctcctccccaggggtgattcccttaagatcaaatctccataaagcaactgctcctttctcatagataccactagagtagattaacacaattccagtgaatttatgtttgtaagtcatatgtgcccattggagactaagcttaagacaggattgcattttacatgaaggtctttccttggtacattcaagggtatcagtccaggacctctgcagttagcaaattctgtaaaagattacgtctgtaagaaataaattgtcatggtctgttttcagcgtgaggtgcagttagagctcatcagagagtggcggataagcaggagacctgggcctttctctgctagctgctagctgctagctggcatctgcttgtctgaacactctgaaagctgagaagttgcgggcaggctgcactttgactgtgccataattagaaaagggggtatctcaggtcccagagtactcaccaccaggtagggctttgcattgtgagccaggagaacaggggctttgggaaggcaggcatgctagaagaactgaagactgggcctctctggagcattggtctatgggagaagagagaacaggacatgatcaagaacttcagaaaaccctgacctgtgccaaatcagccatttttgccttttctcaatgctggtgcctctgtctgcaaaatggtttattaaaaactgcttcactactgctagtctctcgaatttgttattgtatagtgagggtcctgtaagatggggtgcttaattgcttataatccacacagttaccttaaatcatctttatattagaaaactaaatatggcatagacgctgtgctgtgtgagaatacaatgtaggtgtcacatttgtctcatattactttttttttttttttctaaacagggtttctctgtgtagcccaggctgtcctggaactcactttgtagaccaggctggccttgaactcagaatttcccctgcctctgccttccaaagtgctgggattaaaggcgtgcgccaccatgcccggcttcatattactttttaatgtttatttgtgtatgtgcatgtatgtgggtgcatgtgtcacagcaagcttgtgggggtggggacaagtgtgggatgtggttctttcccaccatgtgggtcttgtggactcaggcttagcagcaaatgctctgactggctaagctatctcactggcc

SEQ ID NO: 28935 - DNA, 1197 bp, Mus musculus
atagagtgtctgagggctgagtggtatgcccacatcttcattaaactaacaagtggcaaagtcagactttaaatcccgttttgattctgacaccacatttctgagtactggtacagtcattcctgcacagcttccagtctgaggcagaagcgggacaaacgctgctagttggtgtgcagggtgaagtggatagcagagggtgtggtgtgtgaggagtgtttcctcctggcacttgttacttagtagaactgaagatactaagcaccctgtaatgtgctagtgagtgagtcagtcatacccagggaaggattatgccttaatggcattgtttggtaagaaacagtatgggatccctctctatgagacatgtgttcttctaggaatctgattctgttctgcacactcgttctctgggggaacatcctagaatggtggggttgtttttatccccagtctattcctaacctccaccactagaagaagctcccccacccccattttccttgccctgatgtgctgagatgttcacgtgagaggctctcagaaaccttctttcaggaggaacaataacttcaacctgatccctgtgatctggacaccattgtggtgggaaggggagaagaagagctttgtgggggccccgatacttctgtgggtgcagaagcaactggcatataattgcaaaaagggttgaaaggagtaagggaggagaggaggagatttgtcgggacggggcgggggggggggagtactgcagcgtggtaattggagatagtagatggcaacccccagtgaagctgggaagaaaagactgtgtgcttcacaaacacaggacggaaggggtttcatgtttaatgtaaatacacctgccgtttgttctccaaagcactggttccaggttttgagataaaatagcattttgaacattgtgccagtggaatttgtctttctgtgcccaggcactgctgttcactttgttctcagcagaaactagagaagggagagagccctgactggctccaaggtcttaccccagccagcattgctacatccaccgagtctcagtctggatctccccccttcccccccccccccccagacagggtttctctgtatatatagccctgactgtcctggaactcactctgtagaccaggctggcctcaaactcagaaattcacctgcctctgcctccca

SEQ ID NO: 28936 - DNA, 1109 bp, Mus musculus
agttcttacttaatgaattagttaattgtagtagcctatttatagaagtactaggtggcttccaggatctgtttctctttgacttgaaacattacattgctttccagctttgaaaaaacaatgcatttcccagcatcttcacagagatgtgctgtgactgtgccactgtcccctgcttcccttatcctctgtagaatgcaaatgctggcatttctgcggtgggggacagggagcagattgtgaagctgccttccagtcccagattcttcgcagcaagaaacatgcttctattgaagctacttatttaaaggttaacattttggagaaatgtagctaagcctaaccccaaagatgggcctagaatagtgctctgtgtgcacagtctcccttgatagtaacaacatgcctgtgcatttagttcatccatattggacagggaaagcaacctaaacacggaaacatcacttactctaaataccactcaagtctcctaacagttcagccctcatctctgccaggttacagcaaatgcctgctacactgaatcatctgaaccaggctgttttcacacacttgctttgggttgagtttaatggtaccagtttaacgtggcttcacacacgcacacatacacatacacaaacacacgcacgtacagtcctccatatccattgaccaccgttatatcaaaagtgtagtagtcctatgattgttcttcctgtaattaaagtacataaattattcttgtgacaccattccctaaagcatgcaagtgaatatttatttacatagcatttgcattgtcctaggaggtatagataacatatagataatttaaagcataggatattcatagcccattttcaactatgtcacagtttctgtaaggggtctgcacatctctggcttacagtgtccacaaaggtgccctaggatgccacagaccagttgtatgtgcagaaagtgacagttgggcattgtgataatcatagcattttaaggataaagcaggagaattataaatttaacactagtctgggctacgtgggattcaaggttgactcatacagcatagtgagactttgcttagaccaaataaacagcctgac

SEQ ID NO: 28937 - DNA, 1107 bp, Mus musculus
cctcccaggcatggaccatgctcagctggtggctatcaaaaccttgaaagactataacaacccccagcagtggacagaatttcaacaggaagcctctctcatggctgaactacaccaccccaatattgtatgcctcctcggagccgtcacccaggaacaacctgtgtgtatgctctttgagtatatgaaccagggagacctccacgagttcctcatcatgcgatccccgcattccgatgtcggctgtagcagtgatgaagatgggacggtcaaatccagcctggaccatggtgatttcttacacatagcaattcagatcgcagctggcatggagtacctgtctagtcacttcttcgtgcacaaggaccttgcagctcgcaacattttaattggagagcaactgcatgtaaaaatttcagatcttgggctttccagagaaatttactctgctgattactatagggtacagagtaagtcttcactgcccatccgctggatgccccctgaggccatcatgtacggcaaattctcctccgattccgatatctggtctttcggggttgtgttgtgggagattttcagctttggactccagccatattatgggtttagtaatcaggaagtgattgaaatggtgcggaagcggcagctcttaccatgttctgaagactgcccgccgcgcatgtacagcctcatgaccgagtgctggaatgagataccttccaggagaccacgctttaaagacatccacgtccggcttcgatcctgggagggcctctcaagtcacaccagctctaccaccccctcgggtggaaatgccaccacgcagaccacttccctcagtgccagccctgtgagtaacctcagcaacccccgatttcccaattacatgttcccgagccaagggattacaccccagggtcagatcgctggtttcattggcccagcgatacctcagaaccagcgcttcatccccatcaatggatacccaatacctcctggctatgcagcctttccagctgcccactaccagcctgcagggcctcccagggtgattcagcactgcccacctccgaagagtcggtccccaagcagcgccagcggatc

SEQ ID NO: 28938 - DNA, 1197 bp, Mus musculus
ctctccatcacagccaccacctgcaggcggcagtgaccgtgcacactgtggatgctgagtgctaacaaccctctcgcctcccggagcagagtggccctgcgtgacacagaattctctgcgaagaaatgagccggcatacagccctgtcacgtgacgcactctgtccagtgtggttccactggtttgctgcctactggcttgtggggatctgatgctggttctgtaacggagggggagcctgatgaactgacctgacatgatggaatgggaccgtaggcacaccgccaacacagacaaacatagagggaactgagccggaggagtgctcccagcaccagaagcactcagtcccttaactggaagaaagctggagccgaggcccatgaacgtggcacgccagatgctaccagccgctggacggactcccgtgtttcctagcggtacctggacaccaccattactgtacagagctcaccttaggctctaaacgatgcatctcaaaatttctaagtaaaggattatttttctactatttattgaactttcaaactttgtgggaggggaaaggaactgagagattctcagccttcaccctggctgttatgtgcgatgtggttctctgattaaggagttgtgtttcttaatttaactggtgatctgcccactgtcctcatccacaaaacacacaaacaaacaaacaaacaaacaaggaaaggaaaggaaaggaaaggaaaggaaaggaaaggaaaggaaaggaaaggaatggaattggggaaatgaagaaatctttctctggcttatttatgtcacttcctagaaaaaaaaaatgtcatctgtgatagtgtcccctctttcaaggggcagtgatctaagatgctttcaaagaaacttcattcctttagaattcatttccacctcccatgtgatggttttccttaggtttctacgaaatctactattataaccgtagccttccagtttagggaggcatgggtttattctctttgttttaaagactataaattttaagatgtctccttttttactctgagaatataaaacaggtaaagggagacattttaaaattgtaaaattgtggttcttaaaagatttcttttgaaatcacagctccaagctgctgccacggatccaccaaactgcttttggcttccacggggcttcatcaaatggctactc

SEQ ID NO: 28939 - DNA, 1192 bp, Mus musculus
gcagagcagtgcacacagcccttcctgagggaggccgtggacagcgtggggcagttctgagctaacaggctctacctcactctggttatttactcactctttggtagttgttaagctgaaaggaaatggccgcttaatccaattcacttctgaaagaacacttgtctttatttgtctgacttttgacttcaccctttgccgaagatcttggtattaagtgagcaacctttttccatctagaaatttctatgtgttcattgttaagagactacaactgatgaagtgtaggatctcaatgatcctagatcagatcattaaaaaaccttatttggaggacttatcatttttgactgataatgctctccagcattaattataaaatctaaaactggtacatatgttacatgttttataatgaattttacctggcctaatttattgcatataccagctttcattgaaaaaatgacagctaaaaaatgaaaggaagaccgtcctagacacgcttcctataggtgatgaccagcacgaggtcccagcagatgactaatggtgtgctctgaccctgcacctcctgcctctggctgcagctctaagtcacagaatagtggaggctagagactgctatctgggagctgcagtgtgaggaggaagcagtggagggaacttagagacacttcacattccatgtgggtcctccactatgccagcctgtgcccgttattacaagacagaaatgcaaatcaagtgatgttagtacaaggtcattacaaccaaccccccaaagtctacgctgttagttttctgtgtcagctaatggtttgaaatgcttttcaagatgcaagcttaatattaaaaggcatatgcatgtgaagtctttagtatgtttattgtataaagagtaaacaaagtgcatatagagcgagacacaggtttgacgtaaacaggggctatggtgatatacagcaactaaaccaatttaaatggcaactgtactgttgctactaaactgatattgaattctttgggaaaagggctcaaaaggtgaaaaaatatcaaacaagtattaaacagcattaatgagtttgccagactcttggtcatgagtaactctgcggttcacattgaatctaaagtgaaagctgttgattacccagctacctccaagtcaaccaacaacaactacctagtg

SEQ ID NO: 28940 - DNA, 1262 bp, Mus musculus
gcttatgagaaaatgctgggaattccaaccatctaaccggacaacttttcagaaccttattgaaggatttgaagcacttttaaaataagaagcatgaacaacatttaaattcccatttatcaaatccttctctcccaagccatttaaaaacgttttttaagtgaaaagtttgtattctgcctctaaagttcctcaacaaatactcgagttacacatatgcatatgtcacactgtcactcagtgtgtggatatgcctatgtcacactgtcactcagtgtgtggaactttctctttaaaggtgtaacatcttaaatttggtgatgaatagtgacaaccaaaagactagattgtgcctaagcactccttctggaacaaccgaatgatcagctgcatagcaaaggactgtgccgctggcatattgatctcagataaaaacttgtggacttggctgacactctcccttgccctgaaatctcaatgtctattcagtgatagtacaagcacgtagataccacttagtatactattgtttctattaaaaaaaaaaaaaaaaaggtctgttcctgctaccttttaggactgaagttttaagcactggtacccactgtggggcaaacctgtgctgcaggagggagcctggcatacacactctgcatgttacttcttgagaactagacctgtgtgcctgtgttttcctgaacagctgctttctgtcaggcagactcctctgacctggatgcggtcacatccacctttaagattgtcagtgcatactccttcctgacgatcccctggggcaagctgccgacagtggcgtaaacaggagacatcaccctatactgcgaaactacagaaaggaagacagcttggcccagcgggctgaagttcagaattcactaggtagttgttgttggttgacttggaggtagctgggtaatcaacagctttcactttagattcaatgtgaaccgcagagttactcatgaccaagagtctggcaaactcattaatgctgtttaatacttgtttgatattttttcaccttttgagcccttttcccaaagaattcaatatcagtttagtagcaacagtacagttgccatttaaattggtttagttgctgtatatcaccatagcccctgtttacgtcaaacctgtgtctcgctctatatgcactttgtttactctttatacaataaacatactaaagacttcacatgcatatgccttttaatattaagcttgcatcttgaaaagcattt

SEQ ID NO: 28941 - DNA, 1195 bp, Mus musculus
tgaactctggtcttctggaagtgctcttaactggtgagccatctctccaacccaacaagtgatggctgttgcttatccacagagtgggatagagacaatatcaacttctatgacgatttgaggattgagagactactaaacattttgaaatggtgtcaggcacatttcaaaggtaatttctgaggtaaaaccgttctgattgttttatttttttaacttttcaaaatgattggagtatatgctttcggtcaatttttaaaaagctcaagttatatccataatgtttaaaagatggtgtggcatgtccccagaagataccaaacaaagaatacctgttatattgtatttttgaaagatttctgttaagagaacataataataattttaaaaagttttggtgcttaaccaaggcagtttccattgagatgctagatgaattgttttattttttaatggaaaattagaaaattgtttttatgtaacctctgtaggagctgtccaagatataattgggaggagcatactgggcatcccagaagaccgatataaaggtgctgtttagcttttgttaagtccatgcttatagccagtggtgggctgctggccaagagacgcaggcagacctgtttataaaatgatgtctttagagttgtgtcagaattaaacattttataagggagataatgctccagggagctttgctgcctaaagaatgataggaatttaaaggaactttagtttgttgttttcctttctacagtttctgctgtgttatctatcatactttcctgaagcaagatttacccaaagcagaaaattatacagtcttttctcctaatcatgtgtatgtgcacatatagatatatgtatatgtcattcttagtgatgttcttgtacaagcttattgaatttaagtattcatagagaatgataggctgggcatagtagtgtacacctgtaatcatagcacttggcaaatgggggcaggaaggaggaggtcagggtcattgtcagctacagaaagtttgagcaggcccaggctgcctgagactgtctcaaaacagcaagcaagcaagcaagcaagcaaaaacaaccccctctctctttggggagagaaagaaaaggataaaagaacgagtggttggaacagcagtcttgataacatttttaaagaagatttatttattactatcta

SEQ ID NO: 28942 - DNA, 2875 bp, Mus musculus
aaaagatgaatattgaacatgctgctaaatattaacgctgtcagtgtttttcttctgtgagtgactaaccagacggcgagaggtcagaaaagggagcaagcctctgaggcttggagcatcttgcactagctatacacagcacctgcactgagtaagacagctttactgttgtggggatgcagagtccttttgtttgttttcttcctattccaaagatgcagtctataggtggtcataaagtccagaaatgaagatactaaggtcttatcagtcattgtgtgtcaagaaagcatttgtgaagactttccttcctggatctcagacttgctggccaccttgttacaatttttattcttttctgggaagaacagggaaatttcttcccactgccttaaaaaggtgtcctgcacctgcctgtccccaggaggtggtcttttattactggtggtgacttagtgtgacatctcatagtctgtgtggggtcagggtatggggtgggcttagcactttagtggattgagacattattccattctgaaggtgtcgtgtgttctgtgctcctgagtctgtctgccttcctgtactacctggactcccatggttcctctcagtcgtttttttcatgtgcatgttctgcggctgccttagtggagatgcaggccagcattcccactcgtgttctcagtacagagaagtaagcttccagagtgcagctgcacggggcaggtgaccatctgggcagtgtcgtgatgcagagcaccttggaagcttacatctggatgtcacttggtaggggttgggtgataaaagcccaggcttcctggaggggcaggtcgggagtgggaaaccctgagattattcccaggaaccaagggaagtagggagttaaagggattcagggtaattcaagagaggtaggaaaacttcaaacttttcttcccctcttgtggagtctggggagaacaatagggtgtgagcagctccttgcctgcacactgctgtttctctatgcagttcaagctcagtagactacggtagccccagtgggacaccaggctcagaagagcagcaaggggcaaagacatcttttccaaagtcttgggtgatttcatgtctatgggtgtaaaggtgttttctgcagcaggcttggctgattttgtggaaatggtcataaatactgaccgtgtcttgacaaaggtgcaatggaagcagcatctttgccttctcaggcgacacatggccaagagtctgggtgctctctgaggttctgactttacattcatggactccccgttcagcttgcatcccacaggcctcatgggaaaggctgcatgtttattcctccagtatttatgacaaaaaaggtgctatgaaggaggccctctgagtaaagtgcgcactctccggacctttataagcattgtggtgaatcttcccaggcacaaccaatatttcctataaacaagagtccaggatatgaagtcttgcccaggctcttcatatgagtaaacactaaagctatgattcagtcccaggttttcctgcttctgaaacccttggccttttacaggatgttatttgtctgtcttgacctaagcaacctggggccatgagcctgcttaggtctgcttgtggcctcagggagagtggctgcgtgaggctatttctttttatgctctttgcctaagcaaaaggagttcccagacacaagacgttaaggcaggctgggtttagaccaggtcaatctgcctcaattctaggcgtcaggaagccatatgaaagctgacatctactgaaacattaaaattaaccataacggttacccttatttttggtgtggcaaactgcacaattcttgccagaacaaatgccatcaactgcctcagggcactccttggtttgactgttctttatgtggttgggtgtgagggagacaggaagccattgcccaggactccatcctgactccctctagtgacagacaggaagcacagtgtcttttaataaaaggctcctgtttaaaacctttgcagggagtaccgcaccttctctctgggatttgggaaaagggaagaaaaattgaaaaccccaggctctgtgtggactgcaagaaatggtagagctcaaggcttctctagtcttatgagaacttgtactactgaatttgcgaattttgtttttttgagctggaccgatctctgggggacgacgttgagctaggatggcatttcactgtgatcccccaagttcaagccagtctttaactcagtgttggcttaagtttccctggagctggcacgtcagcttttcttcagtgacagttggtgttcctcttgatttgggtatatgtgcttagttcagagtctgttctgtatctgctatcctaactattcattgtattcattgatttttgttttgttttgttaccttgcttgaagattgatttgtattgaatttgatagaaataaatgttttttccgcttaatatgtgatggaatttcataaatgcattattctctgttttgctgtttataccctgtaaagcttcacaggctctctctgatttgtaccacttgggagttcttctgttatccacagttgtcgataatctgcaaaaagaggcaaacagtgtaacaacctacacaaagtaatgatggtgaagcaaacatgcctcgggttctgtttgttttcccactgtatcgttgctatgtccttgtgccctcctgttccctgcttgccccgtcctttacctgttaaacccggagccctttgcgaggttgtctgctgaactggggctgtaagaagttcctaagtgccctttcagaagaaacctgagagaatgaaggcatagcccttttcccaaccctggtatggc

SEQ ID NO: 28943 - DNA, 1149 bp, Mus musculus
agagtcttgctatgtagctctcaaatcaaatttgctatcctaccgcttcagcccctcagagctggcatttcaggcataagcctccatacccagtgtcctttattaatttttatttaatcattttaggaaaacatttcctatgttcagataaaaaaattgaccagcctattagacagtgccaccgtagcgatgagctctgtgtccattcagatgtaaaccaattttggcttcttctatttttaagcagaatgctgtgtttagtgcacagggaagcttttaaagctcccgttgccttaaagcctggaaaccaacaccctgatcagccagtctcatgtccctcctctggatctacggtctctagagtcggtcttccttggatgacagaagtggtggtgagagacttatgctgggctgacaggtgaccagaagagatggaaggtgaactggtgagctttatctgtctttggggcaaagctccttgcttttatatccctagtatccccaagggggtatgaggaaggcagctgcggttataggccatagactggtggaacatgtggatgctgccttctccagttcctaagagacagaaaggggttcttgtcagagtcagactccacaggtgatacaaactctttgaggtcagtttgcctcatccagattacatccctgttgtttcttatggaacctagcatgcatgagctgttccatgagtatctcttaaataaccagtgagcagtttattgtactgttgacttaaaaaaggaaaggaaaacaaaacctgcccagctcgcatcatgatgcgtacctgtatcacctgagcaggagactggtgagttcaagcctgcttggttccacagctaaaagacaaacataaacagatgaaaaccaccaccaccaccaccaacaagaaatcaacaaattatatagttgccagatatttcagaaaagcacagtgaagtcttgtacatacttcctgagtataaaactttatttatggggctggaaacatggctcagaggttaagagcactgactgctcttccagaggttctgagttcaattcccagcaaccacctggtggctcacaaccatctgtaatggaatcccatgctctcttctggtgtgtctgaagacagctacagtactc

SEQ ID NO: 28944 - DNA, 1782 bp, Mus musculus
tggcccatgctgtgtaactgtatccatttgttagggtatttaattaaactcatagatcatttctaatgcaacagtcatctgcccatttatccggttgattgtgtatgacatggtctactggatagtaggttggttcacggggctttgttctgacaggaatgtttttgaattggaacaataggtggctgttcttgtagaaaatggaaaacttagtctcagtagtaccttacatacgtgtgccaatttatacagaactcttggacatttaccttatttccaagaatgccgtcacacagataagatagtagcacctgtctgtgtgccctgagacttggggagtggagcctcagaactgttgttttcagctggaaaccccgggtttaacctctgctgttcctctgttgcaaaagaggaaacaggtagacattcttaacatgcagctttagctgaagcgcaaagcaatatggccggagttgcacattttctttaccctgcggtttgtgtgctccctaattatggcatgagatgatgatgatgatggagacttgcctaatgaaaaggagctacccagggactctagtcttcttcttctttttttttttttttttgaaaattattgcttttattcaaatttttatttgtgtatctgtgtgtctttatgtgcttgtgtgtgtgtgctcgagcatcatatgtggacataagaagacagctttcaggagtcaattcttcccttctaccatgtagatcccaggattcaagctcaggccttcaggcttggtagcaagcaattttacctcctgactcaccttactagttttgtttggtatggagatagggtctcaaagcatagccctggctggcctagaatttactgtgtagaaagatcaggctgggcttagacatggcctcagcttccgaaggctgagattacagatgtgccgtcatgccatcggtcttctgggctgttttcttccattgaactaaaatgactttctgtgtaggcacagtgccaactgattgttgaaatccaataatgttttctattttgattttccatctgttttcaacggaaagagagacagctgttctgaagattgtaataattttctaactcaacagcttcttaagtgttagagtccagagcagtctcccagtgatccagccaggtccctggcgctggggctgtcctactacactgcttgagaaacttcatatttctcttgtgtataatctgccttctagggaaggttgaactcataaaacccacagaagtcaaattatttagattgagccgattaagtccaaaccaagttcatacctataggctataaaagacagtcctcttaaaatctggaatatattagtgaacttgaaaaaaataaagataatgaagttttatgatttgaatctgaaatgtttctcatggactcgtgtgttagatagtcggtgctgttgggggatgggggaggatttagaaggtactgcttgtctggaggaagtgggccacatgggtacctttcatggctctgcctttggtggtctcacctgggccagccctttccttctctccacttcctggttgctatggtggaaggggatctgctcccagcatatcctccctgccatggtggaccgaaaccactgagaatgtgagcctagataaagcctttgcctttttaggtagattatagcaggcatgttgtaacggtgacgaaaaaggactaacacagggagaatgctaaaatacttattaaaattgagtgggaaaatttgtttggaaat

SEQ ID NO: 28945 - DNA, 2406 bp, Mus musculus
gctgaccttgcagagtcttgacattccagcctgtcctttgggaagccgactcagcattttgcctggggaaataggacctcggccacccaaggtgaaggcatgacatccatctcactgtctgagattaagatttatgagtggacattatgataatgggattgcgtaatggttttaaggaattgatttagggattgtgtatgtgtgggttttttgttttgttttgtttttaaagatgtaatttgaggaatggctttacacaaactccaagaatatcaccaaccaagtattttttaatggaaacttactgaagcctttagcttcttcagtgtgtgtcctttggtcaagagcattaacaattattgaagtgacttaacggtggaaaggggttatgtagaaattgaggaattacccctttcttttcctggatgagctataacccaagcacatgataaagaaatcaggagccctaagatgccaaatcttgactccaggtcaggacattggggtaccagctcctttttcctttaagtttgctgttgattgaagaaaaactcttgaacgataccaccaccataattccaaacctatttgaaatccccttctaattgttgccatgaggctcagtgctctttcttttgcttagccaagaaaacattcttcatgggtgacagtttgcaaagcagcttggcccattcacactttgtatagacctggcattctggtgactgcaagccaggggaaaaacagagaagataacactgagtgctatttagaagggtttggttggggatagagctgtggtgtgccttcagatccaattggatagcttgccagttgaggagtcagagtcccacccacccagtggatctggcccctcccaccccgggattatctccgctgggtttgctgttggatgcatgtgaaaactatgcaagaatgaaactttcccagactgacatcagctggtggcagttcactccagtgctcagagcttcccactttgcaggggaagcagctcctactgctgggacttcgctaggtctctgggtgagcacatgtgcggcatctatttatctatccatacctgcatatgaatatgtctaacgtgcacacacacattcacaaagcaggtggtcaaaaagattatcatgctgatcttaaaaggttcacattcaatattgtgaaaagctttcagaagttgtgtttccaagacaatcattttgtttgtttgtttctgttttaatattcttgtgacaactaagttgaaaaagcagcatgtcagaaataattttgattctatatagacctcttctctttttttaaattataaaagtttattatttattttacctttaactgataatgtgaaattctcaaaaatatgttctctttaaaatatacagttgtaaactcttcaaagtaaacataacaatctaggtgttatttattaacgtattatacaatgatgtctgacccagtatgtgcttgtcctatttaagattggaatgtgagacatgttgctgtgacctgttttgttttgtttttttgtttgttttgtttttgcctcattccatatttgtagatattgtgtgaactacagtatataatgacaataattaagaggatattatgtggctgtcacatacattttgagatgatagaactatattagctttgtgtcatgtttgcataggtcattaacgttcacggtttaaataccattaaatgttatgcgattagcaatgaggaagaacccttccttaaatctgggagtttcccaccgctctttccctgatgcattatgatcctggacgcctgtctatctcaaaactcttaacacgtgcagaccaataggttctgtgttccttttaaataccaggttgtgacagtttgttgttggccagatccaccatctcattcatatttattgtaatatatttttgttttgtaaatacatgaaacaaaacaaaatgtcattgttctaaaatatttgtaatgtatattaaaaaggatacaaaatacttttagaaatatacattatttttgtacctgcgggagtacgaggggccagagagatgacgcagtggttagacgtgcacactactcttgcagaggacctcagtacccacactgcctgtgtcttcagctgcagagggctctgatgccctcttttggtttccacaggcacttgcattgacgtgcacacacccctcctctatacacatgattaaaataaaatagatcttaaacaagcaaagaagcatcccaaaccaaacaaatgagaaatggagtacaatggcaaacttgacagacaccctctaacccgacttgcttttaaagatcggtaagggggaagaatctgaaaagtgtggagtacatttgcaccaaaaggtaacctgacaagat

SEQ ID NO: 28946 - DNA, 1192 bp, Mus musculus
gtgaaaattggccttagttacttgcaggcctgcgtttatttaaggacctaaagaaatccggacccacagagtttgtaatgaatgagggggatagacggacgcggtagtttacacaaaatgttaatgtagtttgctacaaagcaagcaaatctatacaaaagtcaaagatcttacatagggatatctctaatcctgatttctggtgctgtcactcactcccgatctctactatatcagccacacactctcaaaacaaaccacacaggcacacaggaagagtcgtcctggaaggtaacctctccccatccttatcccgtgccccactttttccaccagtcctttcaggcaagtttcctaacagccagccagggtgatggtgagcatctagaatctcctgaggcagagcctgggccccaagtcacgacagtgaggaagggatggaccccagattgagaaacagggctgagatgtctcagaatccaggatcccccgaagagttaaaataaaggagttattctgaagtaatcaaagtgggagggggctgagactaggagcggagttcccggccagcggggcggtgctgaacaaactgggagactactggaatgaagttctgagtggcaggaagtaggaccagtagagtccgagctatgagtggcggaggcgggatcagtccaatggggtggagttctgcatggcggattgggatccgtgctggcagggactgagctcagccaactgggggcggagtccgcgaagtggaggaaggcgttgggggagggtctccatgagctggaggcaggattatgtgccagagtggcggaactgtgggccgagcggaaccgggcccggcagaggaggagctcagagtggcagggatcagaaccagtataggaaatactgagtgcctgtagggcagaatctggcataattgggtgtgaggttgtaattggcagaattctaaaccagtaggaatcaggttctgcatggatggtgggattgggcttctgggggcgggaagccacgggatggggcggagtctaaaatcaggggcggggcctaatgaaggggcggggctccgttggttgggtaggaagtcaataccgtcagggggcgggccgggctttggattcgcgcgccggccctggctagtctgggtgtgggcggcttttggagaaagccggaagcagcg

SEQ ID NO: 28947 - DNA, 2291 bp, Mus musculus
tgtttacagtgtatcttgcctagaaaagaagcaaacagattcgtaactttccaatttctgttctttgtgaaagaggtatttgcacctcatgttggatcactgataatcttgctccatgtgtttttcttgaggcagttactgcaaactgaaaacaaccatgagtctcctcaggacgatattaaggatgctactagacttaattaacaagcgttgtggaatccattaaacatgacccggaagttctctgtcctccacccatgacattcctagccccttagcagccttgtgtcatgcttcagtgcggtgtctgatgtagaagaatacaacctgaaaaggacttatcccttcttttgtgtttcagatcaagtggggagcctgtggtcttgtgctggccggcaacgctgtcattttcctcacaattcaaggcttcttcctcgtctttggaagaggagatgatttcagttgggaacagtggtagcccctcctccccatggaaagcattgagtcttagaatttgtactgtacgtatatgtgtgcacatgtgtttcagatttgaatatgctgagtttttttatacctttatatcatgatcatcttagggaagatgttgtaaacaaaagatgagttttactcctggcacacaggtcactccattgactcaaagtgaattatttttatcttctagcttccagaaagcctgttactatggccttgtagacagctgctcacttatccagggggtctaaaccttttgccttgggttaggcttgggagacactggggcagatctcctacagcccaaacataggtggcgctctccctgtacacttagactcatctcatccacacagagcatcagcatctgctaggagcccattggggatgcagggtcagactgggtaactttgatgcgattgcacacttggcgcacgcacattgacgggtgaggaggtttgttgtagaggaataagcatcatagctcccctgccctctctgggtgttgcatgctcatttgcaggaaaaaaaaaaaaatcacctgccccctgctgtgaatgagttcagacttcaggtgtttctaacatgttcaatacttgtgttgttcctcaaatttgggggacctgttcttaggcaggaacagataagtcatccaaaaggcagtggctgattgctcagaataagatacaaaataaccaaaaaacccctctggggtgcaaggagggaaacttggctggaatggtccctactttaagtggagggcaggatagacaattcttggaaatgtccctctacggtgcctcccatcccccatgcagcatttggtttgctcttggtggtgggtctcctgaagggtatgaggcaagagtgagcagaggggagggagtcactgaagttacacgctggtgcacttttcatccttgatattgaacttgatgtcacctccacaggacacacagggatccacatcattttggttcttataaacagtttttctagctcatcttttttatctggagcctactgggagaaggaagtgagaactacaagcacccagtcaggatgccatcagcggtgtttaagcattgatgctgctcgctaatgagtgtccagagcactctcccttgaggcttgcggtccaaggagtcagcatccaggccagggctggtgtgacgctgggaccagcaggtgaatggacagaggacagtgtgcaatgttatattttggccttgtgcatgacattatgttttgaatattttgtgtacaaatagaattgttagcgttgtcatttctagtatttacattagaaaaattatttagatacttgatcatttaactggcatttttaatcatgacacttgctattgtaataaatttgacttttaacactgaaggagagttgcatttcataaatctttaatctccatttaccttgtgttaaagatgagtgacaatctcttaacactttggaatggacagttctgagtagtgatcctgtcttggaatggacctctgtgataccattttgaccgtccagttggctgtaataacttttctttccccatgaatttatctgactatttttggaagtgtcttggttgtttgattacctcaaataaccaagatggctttcatgtaggagcttaaagtatcgctttttccctcttccttttctctttttaagatagggtcttactcagtagcccaggctacctttaagctcacttgatacttctctttcaccctcaagcacatagaccgtatctggcttaagagttatctcttgatttgatttc

SEQ ID NO: 28948 - DNA, 1099 bp, Mus musculus
tgtagacctccttctggagcactgggattaaaggtatgtgccaccactgtcctactcataattctcagacaagtggagccccttctgacctttttataacctgcctaagagtttggatgttgagattccaggccggggatccaattgactactcaggcttggctttgatttcttttggtctttcagtgtttcctgctagcttcttttaggtgtctcttttgttttctatgtatgattgttttgtctgcatgggtgtgtgtgcaccacatgagtacatcgtgacctcggattcagaaaatgccatcagagcccctgaaattggagtcttgaataggtgggagccaccgtgtgacttctggtaatcacgcccttgtcccgggcaagagcatcagtacccttaaccaccaagtcatctctccagatgccaaggtagtcagggttttttgtttgtttgttttgttttgttgttgttgttcagttaccacacatccacacaaacgcttcagcagaagaacatgagtctcatcttcatctccatactatatgcatacttattattctaaactatgcagatgtggaagtgggtgtgtgaatgagtgtgcaacagtcaaggcagccagaggccttatacttccccagagctgaagctccaggaagttctcagatgtccaacttgggtgctaggaactaagctcaggtcctctctaagggcagtacacaccacagtgtgtacctaaggaaccatttctccagccatggcattctatttatttattgtgtgtgtgtgtgtacaaagaacagcattactgccttggactgcttgaggtcaaagaactttaggagtcagtactgtgcttccactctgttcattccagggaagatggttaaaccatcaagcttgttactggacccctttcccttcatagcaaattctgctacccatattgagaaagaataacagtgaggggtgaaataactatgtttcaaaattcttctttgctatctattcatccatgggacatgggtacaaggactaggcttagggactcagaacaatgaggacagttgatagttgaacatttgtaatgcaggttttaag

SEQ ID NO: 28949 - DNA, 1175 bp, Mus musculus
cttctctctccaatgtcacggcaaacaatgaccagcaaagagtggcaaggtcagtcaacactacccagcacgatggtgcaatggagagcctgggtgccgtgaatcaccagtttactatgcatccagtgaagccattcaggtaccatccggtgaagccactctctccgtgcaatgattccgtacgacttggatgttgccttgaaggcttcaggagtcagatagatccctggccaggcacacacaaagagaaaaggttctaagtaaatcattatgcttttcacttttctttaataagactcagtgggcttcctcccactgacgactaactcggagagaactgtagaggggtggaatttttcaaatctcccactgaagagctcctgtgctgggaaccaatcatcttccctgtcattgtctgactcacccaacctcctgtggcagcccaaataagccaagtccaaagggggaaaggaaacagtcttttccctaaacataaaaacaaatacaaccgggctggtgagatggctcagtgggtaagagcacccgactgctcttccgaaggtcaggagttcaaatcccagcaaccacatggtggctcacaaccatccgatcacgagatctgactccctcttctagagtgtctgaagacagctacagtgtacttacatataataaataaataaatctttaaaaaaaaaaaaagcattctcttataaaaaaaaaaaaaaaacaaatacaaccaaagaccctcctttctcgaacagcatcctaaaggacatgtctctttatgagtctgtctgtctgtctgtctgtctctctctctccctctctctctctctcagtggtgagaccttccttccttttcctgtcttttttattctttaaatggagaaaaaaaaagaagtgcaatccccaagaacatcatgctggacacccctgcctctcccactccccattagtcctgctgagactgtgaaaccttagaaaggaaaggttgaagggagggcattaggatcattgaactccaccctcgtgaatggattcatggcccacttcaggggtttactgattttcactttcacaacagtggacttttctaactagctaatctgcctcctctcgggcctcttcttcatgtctagcagtatgccccatacatgcagagttgtaagcag

SEQ ID NO: 28950 - DNA, 1220 bp, Mus musculus
ggatggggagcggcagacctacacacctgccttggagcagtctgctgatggacataaggacacgggggcatcatcaaaggagggaaaagagaagaaagagaagcataagacaaagacagcccaacagattgccaaggacatggagcggtgggcacgcagtctcaataagcaaaaagaaaacttcaaaaacagcttccagcctattagtgctctacgagatgatgaaaggcgggaatcggccactgcagatgcaggctatgccatccttgagaagaagggagcgctagctgaaagacagcacaccagcatggatctcccaaagctggccagtgatgaccgcccaagcccacctcgagggctggtggcagcctatagtggggagagtgacagtgaggaggaacaggagcgaggaggtcctgaacgggaagaaaagctcacagactgacagaagctagcctgtctgctctgccgccaccagtttcccagcaaggaggcactcatccggcaccagcagctctctgggctccacaagcaaaaccttgagattcaccggcgagcccacttgtcagaaaacgaattggaagcactagagaaaaatgacatggagcaaatgaagtatcgagaccgtgcagctgaacgcagggagaagtatggtatccctgagccaccagagcccaaacggaggaagtatggtggcatatctacagcctctgtggactttgaacaacccactcgggatggattaggcagtgacaacattggcagtcgaatgttccaggccatgggctggaaagaaggcagtggtctgggctgcaagaaacagggcattgtgacacccattgaggcccaaacacgagttcgaggttctggcctgggtgccaggggcagttcctatggggtcacctcaacagaatcctataaggagacactgcacaagacaatggtgacccgcttcaatgagacccagtgaacaactttgaaagcagtttctacagacgtgggacagagaagatgaagtgtggaatggtctaagaaaggctcttctatctaccagcctgctccccaaccagagaagccaaattagacttggagttggtgacttctgctgggaaattgggctcagatcatgttccttttgtaataaaatctaaaaagcctgaaaaaaaaaaggtataagtactactaagaatgagtaaaataaaagagaagaaaacaaaaaa

SEQ ID NO: 28951 - DNA, 1243 bp, Mus musculus
ctgagttcaaatcccagcaaccacatggtggctcataaccatccataatgagacctgatgccctcttctgggtgtctgaagacagctacaatgtacttagatataataataaggaaatcttagaaaaataaaaaactaaataaaaagaaagaaagccaagcactaaccttggtttggaagtgagtctgctaagttcctgccaaacttttacaaaccttttatggttttacccctttatcttaaagctcagacgtaagtgttaggtctgtgttaagcagtgggctctagcactagtttccactcattattgagtagagacctaaagacttcaatttctaaaaatttcctagtgttgccaatactgctggtgcagagttgtcctaagtgtagatgttcaaaaacacaccccaagttgacttttctgattttcagggtatttttattattttaattaagcaaaattcacttactaatttttctctatatcttgtgtgttttatttatattacatttcaccattatttcccatccaggcatctaagcctctagctattatgaactcgttcatcctcacaatgtaccatgaggtagtaattggttttatgacagagaccagagtcagtttacccaagaatatactgaggctagacatgaacactgcatgtctatcaccagatcttttttatgtttaaaataggaaatcatggtgggctccatgtttcaagctgagattccagttggtgtttgtagatacaaagaaaatgaaaaaggtgagttaaattaaattaagtccctgaacttttgaagtgatggacttttcctgagggcatggtgtgagtttgtgtgtagatacacatacctgtttgtgcttatgtggaggccagaggtcaaggttgggttccttcctgtgttggctcttggccttgagacacagggtttatttagctaggcaggctggccagtgagcatctgtctttctaccctcagcgcctagattacagatgcttgctgccactctggctttcacacatggtgttgggcatccagacctgtgttttcaggcttgcacagcaggcactatacccagcctggtctgttaattaacatacagaatgtgataagaacatgatagcctattaaataactcttaatggcttctataaaggaagctgttatatcagtcataatgatcactgtttccagttttctctgtataaatctgacagaaaacaagggaattctg

SEQ ID NO: 28952 - DNA, 2974 bp, Mus musculus
cttttacaagttcttttacttcaaatttttgaagccctctttaaggatataaaaacattggtaaatttgaatgacccaaagacttaactgcaccttctcctttgaaaaccaaatcatatatttgattaaaaggtaatctttccttattctttatgaggaagaaaagagtttgtgtttctgctcaacatcaaattttttattatctggaaatgtctttacaacagacatttttctctccatacaaattgaacatcgttactaaggaaaccctcatgaatcctgaaggttatgctagcatgatttttatatgtagaagtttaaaaataaaccaagtcaggtttgtatttgtaaaattgttgacatcaatgatgtctttccatattcttatctgggcttaagaaatacattctgtatttttccagattctttgtagcctttgaaagatttttacagtacatatgtcttgactgagctgtcttttcttaatacaaaaagcttgtataattttcttaacttgtacagttggtaaacttttatgagaggaactgatattctgagtctgtcagctttcattttattttgctaagatttttctaatgactttttaagtgtgtgtgtagttaaccaagtcatgtttcttatccaggtggtaaaagcattcataaagaattatgaacatgcgttattttcaaacttctacttactgacaaataatttgggatgtctaaatttcagcatgatactcagattacaagcttgtttgcatttgctataattttataaattaattttgaaacaaaacaaaaacttaccgtcagcttaagtgcgtagatgtatcatgctgaatagaatcctgttcagttgctctcatgtgccctataagatttctcatcgtttccattaagtcaacagaaggggaagaccaggtgatgttgcaatattgccacatccaaggagtaactgttgacaggtagcaatattcatttttatgagaaaataatggttttaagaattttcagatttttccagttgtaatccagtttgtcagatttgatagtttttccaaaatgaaacacatacaaaataatcattgttctgtgtgatttttaaaaagggttatctgcactagccttgtatggatgggtgccattttatttttagtgcaaaattcttcttaaaaaatgtagttttttacagctgatagaccaatctatctccagactgttttttagcgaatgattattagctatgttttctcacacaggcacatccccaaatgctgctttcagtttgatctcagccatcagttcaagagccaatgctctcaaaggcagatctgtgctcctttcacaggctcagttgtctgatgcaggttgggtaaaggttcgcactgagaatgatcgcccaggcctctccctcagagtattcttagatttgtccagactgcttcctttccctcgaccagtattggaaggcactttgacagtacatcacataatatgcatttattgtttttgcagaaatatcccagtaagtcagtttcagatggaagtgctaagaagcatgagaggattttgtttgtttgtttgttttattgaaaaccattaatttatccagaatggcagtaggtcaagtagctttagcagatggatcatagcctctgtttccctgcccacccccacccatttctattatctctcttttttctgtgttttttttttttttttttaaaaacaacaaaaacaaaacagagtctcactgtgtagcccaggctggcctggaacttaacaatccttctacctcagccctctaatgctgagattgaaggtgtttcccaccacacccagcaacaatctattctctaaagcaggttttattaaatgagttcaaaccattctaactctttgtcacagatggtctctaggaatgtttttttaaaaaacagtgatgctttttaatcattacactattggaggtgtcagcccaccttttaaaggctacaactgctgggcaagttcctagagttcttgaaactgttgttacaggaactttttaaggaatttctcaggcatgttgggaaatgtgccaggtgtatatgtgttcatatatcttacttttctttttaaagtatgcataatgaaacatttctctaatacacgatgctcagcttttccaaactacattgttctgtgtttgtacaggtatttcaccctttgttcaaaactgcagccactgaaacttaagtcattgcacttttaaacaacttggcaatatcatgagtaatttgttaaaggtttagtatatttcataactcttgagcacttaagtaattgagatgagaaaataagccttcaggagtagggatgtagctcagtagtttgactgttttgcccaacgtgcatatgaagcctgggttccatgcccagtaccacataaactgggtgtggtggcacatgcctgtcatcctaagcacttgggaggtggaggcaggaggatcagaagttcaaggccgtcctcacctacatagtgagttggaggcaagcctgagatacctgagatgctgcctcaaacagaaatgtctctgttggtagttagcattgtcattttcctttgaaacacaatgtttatgatgtattctcagtaaggttcagaatctgtaactcagctcaacgcggatctgttgagctttaaaatgtatttgaagtaatttaagtaggcattcaaaattataaattagatgtttttaaatttctgcataataatttgcactgtaaaatatgtccttcctcccatttccttctgccattctgatatgctcattaaaatatttttgtaaacatacttgtgtggtgtctagttatttcactgttttaatttcagtgtttaaactctgtgctgctcggaacacacagtgaaggttgtactatccctgtgcctccatgcccacgaacagtgcaatcaacggtttttctgt

SEQ ID NO: 28953 - DNA, 1833 bp, Mus musculus
gaagcatcagtgttttgaaatcctttactctatagcttgctatctgggtggccctggcagtgtatacaatgtgttccagctagagctgccttccagtgggctgtctctggaaactagctggaaatgcagctgaggatctgaaatttcttttttcttttcttttcttttctttcttttcttttcttttctttcttttcttttcttttcttttctttctttctttctttctttctttctttctttcttcttcttcctcctcctcctccttcttcttctcctcctcctcttcctccttctcttcctcctccttctcttcctcctccttctcttcctcctctttctcctcctccttctccttctttctccttctgcttctttctcttcctcttcctcctcttctattttgttcttccttccatttccttcccccacctttttaattgcactgtcttcatagtatcacatttgccaaaggtggcagctttggcactaaaagccctgagaagtgttttgctttcctagactgtggggtgagcagagtgtgcctgggaatgtctgcttcctctttgttcagctggagacaagcaagggtggaagaagccagccattcactcactcgttcagctggagtgcagtgaaagtccctcgcaggcactgtgctgagtgctggaatacagagatccattggtaatggtcctgctctagactgaatggaaaatggaaaacgtggttctctgtccaactggaaaaatccgagactgtgcaccagttacttcagctctttggacctgcaggtctatgagattagaagcccctgctctgcctaccccacgccatgagtccagagcccacaagagactgaacagctatattttgtacaccagcatagcagtggctcagcctaacccttttcttaaagggacaatcaaggcagctgccaccccgtccccatgccttcatcatgtggatgtagttgctgctctttgtatccctgtttgcaggtcctcatttccacacaaaggcctacatttctgaactgattggtgtgagggaagagctaggtgggcatctttccattattggaacttggtcttttcttggaaggatctaagtccctctccctgaagtgatgtgaggtcagctctcacctacagatacgtctacctgatgagcatctcagaatggatatatctcctttcctcattctgagagagcctgtgtgagtggacattgactgaactgccttagggaggagtgattgccagagctgggtggcatggctctgaagcatcgctggctttggaggggcttgcttgggccagcatgattgctagggaaggagcttgcttctgcttccttggtgcttagctgactgcaggtctggagcttgtatttttttgtgtctcagtggggaataggagagttttgattttttcccccccctctatttgaaaattttcatctttaggctctatcttgcatataaattttgtaagaaggacatttgttaagttttctgtgatcttgtatcagaaatatgtgggaggttttggtcagtaatgccaagacaggctctccatggagtgttagtgggtcacagggccactgagggctttaggtctggcctttgctttccatattgagggctcttagtgaccagcacattgttaaccacatggacagatagagggggcagagcctggaactctcaagtgtagtcctcagccagagtcggaccttagttgaaaggacacaaatgaaagaagaaaaaaaaggaaaagaaaagagtcagcgatttgtaagtaagacctacctgcactgattttaggccca

SEQ ID NO: 28954 - DNA, 1197 bp, Mus musculus
tttttttttttttaaactgtggtaaaaatatcagtttattgttttaatccttggatgtgcaactctcaccaggcaccctccccaaaacattcaccgtgtcagatggaaactcttgtgggaacgaagcaatcatttcctgttctctactcccctcctcaaaaccaagtaacctgtgttgtgctgtcaatctctgtgaatctgactattctgtatatcacacagatgagcaatcgcacagtatttacccatccgtgactggcttaggccagttacacaatgtgttcaaggtacatgcaccctgtaccgtgtctcagaactggaattcctggcagccagcatggcatccttgactgttggtaacctcctttgcccgcacctccagatgcctggcttttcccctttcctgagttgtagctaaatcaacaacaaggctcacatctctctttcttcacttccatttcacaatgcccctccctcatctcttcttgaattattacttttccttctatattgggcaaaacggtgcctgttttctggggagcctgtctccagagatccccttcatgccttataaaaagtgacctctccctctgtgcccttcccatcccgtgcactgcttttagagaatgtcttactctgtccgtgctaccattacatattgcccgtgactggaccatttatagagaacaaacattctggatggttttggagaataagaaatgcaaaatcaaaaagcaccgccccatcgggtgtctctgttaaggcctaagccctctgattctaagatggtgccttgatcactggtcctggagaggtgaaaaccactgtccatggacagcatgggccttatggacagccgaagagacagaaggacaaaggagggcaagtgctaactgaaggctggtgtctgcagcatgagctctgtgctaaaggcctgtcttcctgattcagtcacattgacggttgttcccatgtatccaagttacccaaaatggaaataaatgtaaaattatggggctaggaaacaatgtttttctctgcctaaaaccatatttacaaaaattaacagatacttagtaaggcccgtcacaggccaaggtctacctaccatgggttctctcactcctgataatgactgggctacaatgggcctctgtaaaaggctgtggaatccggtgatcaaagattgtcacttgg

SEQ ID NO: 28955 - DNA, 1342 bp, Mus musculus
ctctcctctcctctcctctcccctcccctcccctcccctcccctcccctcccctcccctcccctcccctcccctcccctcccctcccctctcctcttctcttctcttctcttctcttctctttaaaaaagatttatttatttattatgtgcaagtacactgtagctgtttacagacacaccagaggagggcatcagatctcattacagatgggtgtgagccatcatgtggttgctgggatttgaactcaggacctttggaagagcagtcatgctcttaaccgctgagccaccttgccagcccctcagcatgtgtttcttaagcattacattcccagtttgtaaatacatgttttccacaggtgtttatatcttatttgtgtgtgtgtgtgttctagataaccaagcaaaagaaagatgagcctcctttatggactgcagtctaccaggataaatcggtttctctctggagtgaataacctggccaacaggagacagtggacccccccagcaagctgtccactggcaccaaagctccgagcagtaaatgcatactggggactgaacacagtcagtcattgtcattcagtgaccttactgcctagaaactttcttttctgtaggactctcaatcacaaaaaatcaagatgcctctcaagtgcccaaagcaaggaattgggggtgcttacctacagatgtactgtgcggggtgattctgttctaagacaaggagcaaggaaagtggctggcgttcctgctctcgcggcctcctgttctccaagctgtcctgccgtaatagaggcccggagtttccgtacatctgcaagggttcaggctgccccagtccctctcttgctgctcattctgaagccagtgcaaaagctccttgctatcatcgtgggcaggtaaatatactttggggggaaaacagtgtttgtgttaaagttcatgaagttttatgttcacatgtgtatcaacatataatactttttaataattaaactttagtatttataaaactacttttaaggaaacctttccctaggccatatttagctcaaaatttaaaggtaaattctatcagtcttgtgtgtatgattttaataatcttgaaatataatttgttgcaaattaattgtgcacaaatgtgatccttaagttttgttggttgagatatttctaaaagatttcacatttctaattataaggataacgggcaatattgacaatgatttgtgtaacaacagcacttaagaacattgccctttgattttgtggaattttaggcagttggcatgaaatgaaggacttcatttatatagttaggtgctcagccttagccac

SEQ ID NO: 28956 - DNA, 1453 bp, Mus musculus
agactggccttaaatttactgtgcagcaggcatggccttatacttgtaatcatcctggttcctggtcttcagtgtttggaccacagggatgtgtaagcacactgggtgtatgtagtgctgagaaccgaactgtgttcttgtatatgctatgagagtgagcactctatcaactgagcttcagttttcttttttttatatgagattttttaatgtgagatctagtcagctttattttctgaagttcttaggaaagtagaaatagttcattttacttggcatgtagactaatagaaaagaataaaacttggattgaagcatgtttatataaaaaaattataatttattcctatgtgagaaaccatactgctctcccatgaataattcaaatttcagaaatttgagtgtttaatatatgtaaatttttgcacagttcaagattaaatgcccaatactcatcagatacccttccatgaggcagcagaagcattttgtagtgaaaaatctcttaatagtactttttaaaaaaatcttctagtggatggaagaatttaagaacgatctgctgcctgagagagacccccgctacctgactgtgaaagaaatggtttatcatctgacacagtgcaatcgagacgtcccggggatctcggagaccaactgggtggttcatgtggttgactccccagccgtcaatgcctttgtgctcccagtaaggaaattctttatgcacgtttgctgttgttgctgctagcttgagcgtctttgagttttactgtgagctaattgcttatcctattctctctgtgcagaatggacaagtgtttattttcaccgggcttctgaatagtgtgacggacgtgcaccagctgtccttcctcctgggccatgagatcgcacacgcagtcctggggcacgccgtgagtaccgggatgtgcagctgctgaatgtttgctttgatattagcaagtggaatcctttaaggaacacagtcttttcttctttcaatttcttcttcttcttttaatagatgggacgtaattgccttattctgtacctgaaaaaatgtgattagctgatttcgagaatttttgcagtctttcgtatatgatcctgaataattagtgtttcccttaaatactgtttttatcacctgtctcttttgctaaaaagtaattagtctcagactctaattatttcactttaagttttaaatttccataattattaacatacttgtaaactagtcagaaaattaattgttgtaaagttatactactatttaagtggtaaatcagttttattcttactattttcacatgatggcttggaatgttgttggaaatgcctaaatgatatgcaatatggagttaatgtggaacagtaatgacatgggccgattagtttacagaacttcatctagtatgttccttctcattcagagctttaacttata

SEQ ID NO: 28957 - DNA, 2597 bp, Mus musculus
ggattcctaagtacaaagagagaaaggtaatctgacgagtaaatagatgtagtaatggtgtcatgcctagtgataagaggagtgacagagcccagaggaggaggagctgatccggactggccagttccaggaggctgctatgtgaaccattgcattagctcttctggctgcctcacagtcagggaaggttttgattctgattctatcagaacatttattggcctcctacccggtcctttgattctttctactctttcccttttcttttactatttccagcacatgctcagtggcaggctgaatgtggatctgtagagttcccacccacaagctacagcagacgggacatggtggctgagctgtgcaagggcacatgctcttctgtaggccaagcccactattgctgtgtggaaagcctcaggccaccataaagaatttagtggtttgtttataccctacctcattccaaagtatcatttgaaatgtcttcaagagggtctcacactccgccgccggcttacactgcgcttcttgccgctcctccgtcgccgccgcgtccttcgccgatcgcaatggaagaagaaatcgccgcactcgtcattgacaatggctccggcatgtgcaaagccggctttgctggcgacgacgcccccagggccgtgttcccttccatcgtagggcgcccccgacaccagggcgtcatggtgggcatgggccagaaagactcatacgtgggtgacgaggcccagagcaagaggggtatcctgaccctgaagtaccctatcgaacacggcattgtcactaactgggacgacatggagaagatctggcaccacaccttctacaatgagctgcgtgtggctcctgaggagcacccggtgcttctgaccgaggcccccctgaaccccaaagctaacagagagaagatgacgcagataatgtttgaaaccttcaataccccagccatgtacgtggccattcaggcggtgctgtccttgtatgcatctgggcgcaccactggcattgtcatggactctggtgacggggtcacacacacagtgcccatctatgagggctacgcccttccccacgccatcttgcgtctggacctggctggccgggacctgacagactacctcatgaagatcctgactgaacggggctacagctttaccaccactgctgagagggaaattgttcgtgacataaaggagaagctgtgctatgttgccctggattttgagcaagaaatggctactgctgcatcatcttcctccttggagaagagttacgagctgcccgacgggcaggtgatcaccattggcaatgagcggttccggtgtccggaggcactcttccagccttccttcctgggcatggagtcctgtggtatccatgagaccactttcaactccatcatgaagtgtgacgttgacatccgcaaagacctgtatgccaatacagtgctgtctggtggtaccaccatgtacccaggcattgctgacaggatgcagaaggagatcacagccctagcacctagcacgatgaagattaagatcattgctccccctgaacgcaagtactcagtctggatcggtggctccattctggcctcactgtccaccttccagcagatgtggatcagcaagcaggagtatgatgagtcaggcccctccatcgtccaccgcaaatgcttctagatggactgagcaggtgccaggcatctgctgcatgagctgatattgaagtatcaatttgccctggcaaatgtacacacctcatgctagcctcatgaaactggaataagcctttgaaaagaaatttgtccttgaagcttgtatctgatatcagcactggatcgtagaacttgttgctgatttttgaccttgtattcaagttaactgctcccttggtatatgtttaataccctgtgcatatcttgatttagtccttagttcatgtggctcggtcacttgggggctggggagagcacgctgtagatgagaaagccccagcctggtggatctctgtgagcaccactgagtgatctgtgcagggtattaaccaacagcagacttccaggatttcctgaggctggcaagggttcctgaaccagttaccactccttcttgccagtataacagggtgggaaagtccgagccttaggacccagtttcagttctggtttcttccctcctgaccaccatcggttgttagttgccttgagttgggaacgtttgcatcgacacctgtaaatgtattcattctttaatttatgtaaggttttttgtactcaattctttaagaaatgacaaattttggttttctactgttcaatgagaacattaggccccagcaacacgtcattgtgtaaagaaataaaagtgctgcagtaactgaaaaaaaaaaaaaaaaaaaaaaaaagaaatgtcttcaagagatatgaataatgcaagtccataggtaagggagcaaagaacaacagaaacaaatatctgtatttatttattcattgcatgcatgtgttatgaagaccaggcgagaatcagtaaatacgcctctttcttttctcttttctcttttctcttttctctctt

SEQ ID NO: 28958 - DNA, 1151 bp, Mus musculus
atatgtgcttcagcaagacctttgagataatgctgagctccaacatattgcctcttcctgcatagtgaaaggtggacactgaagcattgattatctgcctagcctagggtgtctttacacacaatgctggtactttaatacactctacacataggattttcttgccacttctatgcttgttttgttagctgtttgtctttacccatatgctatagagtgtcaataactgtaatggcagccagaagttgcttcagaatttcagttgtttaggagcttggctacagccctagtcagctccaatccaagaactactttattcttgggatccaggctctgagaacagctccatctagattggctagttctctattactgagaaggaatgtaaaagcctgcactgtatgatcacgtgtgtttacattttcttccagactgaggtagcgtgcgtcacatccatccatgttccattagtcaaggcagctcatggggccaatggtcagacctgacagttaaggggaggctttccatgaactttgaggtgctggcagtcacatgacacaggcagggctgcgtaattctcttattaggaaagacacagatattggaatccacagtatagtattctaccatctgcgtgttcctagactcccagtttcattcatttggaaagtgaaggctggagatgtcacatacatataattatgtgatttggactgttatctgactccctgtccatgttctttcccatctggtacccagttttatctctttctgcttgaagcatgcactcgtttcttgggacatggcgagttttataggatttatcaaagcaatatgtgtactcacatatctgtgacttcatatattctgttacatctgtaattgaattttttttctcattcagtgcagttaagtgttcatttctatctccagtggaaacttaggctgagatgcaaacccaaagccttcctttttattccatggaatcctttctcttctccttgggcttatcttaacagtgtgtgtgtgtgtgtgtgtgtgtgtgtgtgtgtgtgtgtgtgtacgtgtgtgtgtgtacgtgtactctgctcatctcagactttctatggcagaaataggagtcagtttttacttatgggtccctatgtgac

SEQ ID NO: 28959 - DNA, 1160 bp, Mus musculus
tgattttataatcacattctcttcaaggctgaaatagcaagagcatctaataccagggatctgcataaggaaattgcagtgccactgtgaagctcgtgattggaaaatatgaccattgtcagatggggaaggggacagaagcaggtcagaagcagcgcccatcccctccccccaccctccgtgcgcagggagcagcagagttttccctcactatgtatttcattggctagctgtattccatcacggagtggggttctacacaggcagggaggtttcctcttttgtttattaaagtgtccatgtagctagaatcccttcagttaagtcacattgataaaacaaaaaacaataaatatcttgtgtgttgagttggttctattttaggtggtataatgagaattacagatagcagaaactacagaaaagaaaaatggaagctttttttttttttttccagtgttctgttggcttggggaggtaaggtaaaaaattaccaaatacagtatataccatatgcaaaagacacgcacacacacacatacacactagagccggggagcattggaggtgtcctcccaggctaagaactctttcagaggtttgagttctcttgggagtctgcttcctgatactacagttggctggtgtgctgcagtctagctacataaagaagcaccagcaggcagaagcacaggggcatgctcccattttcagcagcgcaaagaattcccttagtcttttagagacctggattccagccaaattggggtgcctgaagcaggtgtagggggttctattgagctttttaagaaaggaactctcacagagaataaaagcacacctgagaaaatggttgcagccttattggggggtggggggtacgaaaacccaaagtgcgatatacccaactgtataggctcctaaagggcgcgtcacaataaagtgtgccttggcaccagccaagcataccatttcggtggctctcaagttctattaccaaagggtgctaagaaacccttttctttcctgaagcttctgtcctttccttttactctttgctttggtaagtgtggctggagtacagtttcagagatgccttggaagggattttaatctgataaggtaaaaaaaccaggagtccctagatttgaacaaaggcc

SEQ ID NO: 28960 - DNA, 1106 bp, Mus musculus
tttcttagtgcttttgcggacacttggaaaaatgattccatgcagagatagttgtgtcggcggctttatttcccttctgctgtcatggagttggaaagcaaagtccctactcttcttatcgcccttgcagccactatctctagctgtttttattagaaatagccacccagttttgagtaagcaaggatgacatctgttgataagttaaagccgtatagctccagaataaaagaaaacagacagactcaatccgcacaggtggaagcttaggggccaataccaaatgtttctgttttagcaataaagaaaaatatcttcaattatttcactttcttcctcttacctttccatctgggagaatcatatgtcttttaaagactgagtcaacgggggggggggggggaagaagaaggaaggaaggaaggaaggaaggaaggaaggaaggaaggaaggaagaaagaaaaaaaggaaggaaagaaggaagaaagaaaagaagaaaggaaggaaggacacaaaaataatattataatggctggtgtgtggatggcaggtaatttgtacttcactgatgtgttgctggagcaatcttaagggcgaaatgttagcctttgaagggatgaaagaaaaatgaaaacatttatttggttaaatggctaagtaaataaactgcctatcagacttccccagctgtcaggtccaagtagcatctgtaacaataggaatcgtttggtctgtctccctttgtaacaatagatactgccataaataataaatcgctgtcacttttttaatactgatctctgtagtgggaacccaaagcgtataaagtattgcctgatagtttcctagcgttcagggagaaagaaagatggacttctaatgctttgggagggtgagtgttcagttttgagctgttggtttgtttttaatgactgaaagaaagaaaacagagggccagagtctaaatgagtctgaaaatcaagtggcaagcatgtctgccctcccaagaagagggccagtgatacagtagtgctctgttcaggtgttccagtggtcaagtgatgaggatgaaagtgatgaggatgaaagtccactggtcaagtgat

SEQ ID NO: 28961 - DNA, 1121 bp, Mus musculus
gaatgaaaaaaattttttttggacagactttttaaaaaacaaggtttatacagatttttttttttaattcaaggtttgctactttgtgtttatttaaatttgcaaagagaaaccgaagcctcctaggaaagagttgcattgttatttttctcctgctagtctgaatgtgcattttcacagctaaaagtcacttgtaaataaggtttgttaccacattcgaagcccatgttttctaaatggagaacattttcccagaatcaaagagacatagacccactgtctacacaaagaaagaaagcgtacctggtgccttctcaaataattgtagagtcaaagtgaacgtgttccaagtctgccccaccccaccccctctcctgttcctcgggttctctgtgacctacctgtccctcccacagacggtcacaggatttgcttctgccctttcagttctacttgaccaaacctcacagcatcaccagtgacgttcttcactgaatacattttctctttcacttatttcactttttaaagccacctgggaaaatatttggctgccttcttatgcttttaaaatgaatgcaattattagcagtgtttatatttgaaagtttataaaggaaagaaattcagagctaaggactgactcttaattggatctaattccctgtgtgttacgatagcagcacaagttatgtaaccttgtgtagttttctcttgtacaaaatgtggatgataacctacctcacagatgtgtgtgagaagccgtttcaaagcccctaagtaggggtttatagtcccatcctcagtgtcaatcctcccttttttactagacacctttgagaatggtaggatgagtatcttgtttttagatgtcatatgtaataagggcatagtgctgagaatgtttaagacacagtttcacaaatcatagtgttcttactgtaagacacttaaaaatttcttgaaaacctcaaatgtttaaatatcgaatctgtcttttgtttcaataaatattgttattcaaagtgttgtctgaagctgccttaatgtaccaaaatacaactgtcaaaactgttcacaactatattcatggttgtactgttttgagtgttcattttgaa

SEQ ID NO: 28962 - DNA, 3131 bp, Mus musculus
aaaagcactatattgcaagatagattaagttaattgattatatgttgttttggtaaaagtattttaaattatgtgtaatttatctaataattatttattcatctattgtatttatgttgtaattttaaaaatcattgatctgattcaccctagaaaatattaagctcttgaaaaaaaaaaaaagcaacattgccttgacaggtttctcttcaccaaaaattgtatattttctatttaccaagaagcaaatgagactgttagaccaggtttctcatgagattccagaagacaagtttgtctgtctttaaatagctttttgaatcaggaatttgcatcatatcacatcagataactttgtagttcttttaaaaagatggtcaatatttatcactccaacttctcaatggtaaaataaaagaatctttgcccactgattgagaaggagagtgtataatttaaggtaccttaagtttaatctttgaaagattgccatcttgtggcaatagatggtaattttagtagttattttaataccaatacttagtcctgcctgggttatctaatgtgttttatgaatgtggcatagttctgacttctccaaatgtgtctgtatccttgtttgtggggtgggggagagatcaccttatgatgtttgcctaatcatggcatggaaggccttgaagtaaggaactgaatagattctttacctctaataacagcatccacaacagtgatgaaggcaggaaggaggcagaatgcttttagtctagtgaatttaaaccaaaattactttatatgaatgattatgatgctattcaagagctaaaagttatttactattgtcttaattcattccagtattatgaatacccaggttgacagttacctgctgaatttcaggagaactgaaggtcattttgtttcttttaacattttaagacataattatttaatgaatctagatgatagagtaagttggttttcagagagaattcagtgactcatctcgaaaagcagaggcaggaattcagtcacagcatagggatttgttgctcttggaaacagagaaggaaagaattctttgcaaatttacagttcctacatttcagtcaatcctatgggtatggtaggtactgagtttagagcagcctatcctcttggatcgtgcggagaataactattaagttatagatgtggtatgtcttggaaacggagtccatctgtttccaaaatagtatttcctaaaacaaagaaatcccacaaaataattttgaaatacattgtgttctgctctgcaccttgcagaggacagtgactattaactcgaaagacttgcagactttgagaaaaaaacaaaacaaaaagaccccacataactgcaaaaaccctactttgcccaaactagtttactcttttaaaacgtttgctgagtctggttgcttacctgtaatacgactggggagtatgaggcaggaagatacgttggggcctaagaactagatagatagcaagaccttgtttcaaattgaaacaataaaggaactgtagcatcccataagaacataggagaaacgattgtctctgagcgccacggtgtggtcgttagtgacagtgagtaacacctcttccccagagcctgatgctaattcagatctgctccattgaccatgcacatagggtcatcctgagtctgggcttgtaccacatgctggttttcctaatcatatgatgctttttaggtagaacatctattctttttttcccttagagggtgactgaaaagtcctagacaaggttacttatggaaaaccagaagagtaagagagcagtggctttctgttgtggcttcatggatagcaagccagttttattcatttttcaatggccactgaacgttttctaagtccttttatttaggaaaccaaaattgaagctatctcaaagtaaatctacagggagagagaaaaccaaaccattcacaagttagggttctgttttgatcaagaactcttgtaaaaggcccttgcaacatctggttatctgcagagagaagctaggagcctaagctaagcagaaacattaagaccctctgtgttagggaattgggtatatgtagcacagtaattctctactttatgcaagtaagtattcaagaatatttacttaattctcaatctactcttttcttagctagtttgtactcagggaacacaaatttaatacaaatgaaatgaaacacaatttggaaaataatcgtaaacaaccgaatcagatttttatactgcttcatctgtagtctctgctaacatgcaagcatgcttagttaatgtgggccccacactgatgttcataagacttaacagcctggaacatacctaacacagataccacagctctgcctggtcactcccagggtgaagtctcatacctaaatgtgagactgcccgtagacttgtctgctttgtgtttggttcagtctggcaacttgtccttcagttctctgtggcttgttaagtagggcttatggcttagtagttcttggcaactctgttgaaaactctggatagtaagtgtgatctaggacttggcctcaatttaaaaccctaaaatgaaagggatggacacagagctatcgtccctctgagctctgaagtcatgccttgtttactacttcagagcgtcagtgtgagtgttcacattttatgtatttgtttgctagtatgagtgttttttccttagtccgaggcatttcaaaggtacactaaccaaaagtacttggactactggaatgcaaaactgaaaacatggtgtggatttagcattcattagaagatgactgctaggtagcagtggtggggcccatgcatttccaggtctgctagtgctccctcgcagtacccagtccagtaagcaggctcactgcagttgatcatcttctgggctgaacagaaagagtttgtgaaacatctgagagtcaagtaataaaaataaacactggtgtgttgtttgtaagtcctggaatgacatatagtagttataagtgaatgtagttagtctaattataaaagctagttgattgcactaactagatgtaattttgtgaaatatttatgattatattgattttatta

SEQ ID NO: 28963 - DNA, 1184 bp, Mus musculus
ataaaatggccaacattcttcaggcttgcttacctacttggtaattctgcaacaacacacacaggttgtaagcatttgaccacttcaaacttcttttccttaaaaaccaaactcattcccagtctcctgctcggctgatgccatccttgtttttgtttgagaaagagccccaagcgttctgtgcactgcccagccatagtttcctcctgttggcagatgacctcctgtgttctcactgcccaatagcctttcctgacactgatgacagctaagcttgccttgagggctaaggaaatctggcctcaacctttctcagcatagctgtagtttttaggatttgtgggccacctctaatttttctttccaagatagccactgtttctttttctgtgctgttgtcttttgattttcatatgaaagcagcttaccttgtttgtatttgtggtaattatacacacacacacacacacacacacacacacacatatatgatatgtacaataagtacgtagctggttgtggtggcgcacactggtaggatttgctgaaggaggcagagtcaggaggatcacaagtccgaggccagcctgggctacacatttttagccaggtttggtggcgcacgcctttagtcctagcacttgggagacagaggcaggcaaatttccgagttcgaggccagcctggtctacagagtgagttccagaacagccagggctacacagagaaaccctgtctcaaaaaaccagaagtatgtatattatatcctacttaattaattaatctggcttttggtgaagacagcaagaggcccagagaagaaattcacattgcaggatagcaagtacctttaactctgtcctgaagctttgcttgatcatccttttgtttagcaaatacccacttccaatgacccaaagttttagccaatgaggtgtcatcaaacagaacacaagtagaggccaaaaatgtattttcagaacaggcttcttgtaattctgctattgtcaaaataaaaatgtgaatcacctggctcattcatcctgaaggttgagacagagcctggtgtcagagacatggaaccaacacttggctagccacattcagcagacccccagattcatcgacatggaatcattgctcattcttttaagtttcgtgataattttttttgcagcattgtc

SEQ ID NO: 28964 - DNA, 1188 bp, Mus musculus
agttaatcttaggaaattattactgctttgcattagtagagttgttattcactgcatctggttcccctctgatgtctcctctattaggcaacatagaccaagcacaatactgtgatcgaataaagggaattattgaactcttgggcagtaaattgtcactagatgaactcactaaaatttggaagatacaagtaagttgagcagaattatttttgcctttttctgatatgtatggactataggagagggggtagggtggtgaggagtcagtcaaaccagagggacctcctctggtctgtactaggtgagctatacctagtctgtgaaagccggtgctcttcttacctgtggccacttagttctgtagcagtcaaaatctggctggaaataaactgtgctagacatgtcagacacatgtcagacacatgtcagacacatgtcagacacatgggcttgacgctggggaattgcttacaaagcacgcagtcatgtggtgcacaggcatatttgccgataaaatatccacacacataaagaatttttttaaaagtttagaacaaaataaaaaaaaaagtgttgctaagatggaagatggctgggaggaatctactttgggaggtgcagacagtgaaagtggagagtgccactcccactagcaatgccagagcccctgctggcccaccagccctgtattcattctctgagcctgagcccaaaccactccttcctctcccagtcctgctactcactgctcatcacaggaagctagctgacaggacactgtgggagcacagttagctgattcccctcccagcagtacagagagggctacagttgggcaggattacagaaaagcactcctaggtccctagactttgcttcccgtatgtggccgctggccttggtgaacaccctcatgtataatgttttctcagtatacattctgaacccacaagaggtgaagattagtagatgggacaggggagggggacagagacagaatgagaatgcctgctacatttaatgaacagctacatatccatagtggttttggagaaagttaactgaacctacatgactgaggttataaaatgagcatcagtcattcacagtagggtctatgctactggccattgggtcaaaagtactagttgaagtcataaagattttataagcaacatttaaaat

SEQ ID NO: 28965 - DNA, 1205 bp, Mus musculus
taaatctttaaatgtttatctgatctctgggtcctagggggtgtggaaaaggaaagtggtataaatttaatgacaccgttattgaagaatttgacctaaatgatgagaccctggagtatgaatgctttggaggagaatatagaccaaaagtttatgatcaaagtaagtatttataagtagatatagtctattcattttattttttattatttagggttttttcagattagaagctataattctttatataaaaatacaatagattttgttcttattttcctaatgcagagatatgattacttacagaagacagttctagcagctgtgctttcaaaacctcattatgtagtgtgttcccttcatcctctcaccccaaggggatgcaccttaacgtgtattctcagcaacactaaaaaggccttacacttcttacactttgcactttgcaaatttagtaaataaattgttgagtctggaggccctttattataaataatcactctgaaaaacatcttatttaccaaaccttctctcttaacatcttataaaatagcaaacccatacactgacgtccgtcgaagatactggaatgcctacatgctcttctatcaaagggtgtccgatcagaactcacccgtgctgccaaagaaaagccgagtgagcgtcgtaaggcaggaggctgaggatctctctctgtaagtctctgccatgtgattcagtgggtgatggcatcttcaagatacaatgctttttttttaaggtttatttatttattttatgtatatgagcacactttcaatgtcttcagacacaccagaagagggcatcagatcccattatagatggttgcgagctaccgtgtagttgctgaaaattgaactcaggacctctggaagagcagtcagtactcttaactgctgagccatttctccagccccataatataatgcttaatgtttaaaaatatttaagcatacaagaaatcctaaaatgaaaataagttgtttgtttattgctccccagactttattgccctgacaagaaattactttgtatttagaaacatgtatataaattagtcatggcagaggcagaattgagatttttaatttcaatccgaattgaggtgtgtgtatatatatatatatattgaatgtactttttgtccaaagcataatgctataaccagaaagattttttttatg

SEQ ID NO: 28966 - DNA, 2569 bp, Mus musculus
tcggaatctcccatgatgattggtgaattaagaagtgaccttgatgatgttgatccttagagcagtgtgcccagacaggatgctcagcaccttttgggaaaccagaatctcatcattgaaggccttaaataagccttgagtgggagccaggagtgggaggagaaccgcgtgctccagaggagagacttctctggccactagaaggctgggagctgttgggagaattctgcaatgtggaccagctgtcccagcgtctacatgtgcattgacacatgattttagaaaataaatctggtggcaaacttgtgattcatggacataggagagtgaggacgaggaataaagctgtggctctctctgtgacacagggagaagaaatgggagggaaaattattaatctgcagtaacattgaataggaatatccaatttacagtgatgtgaagatatgtggtaaaattctttctgttgtaaaatagtaatgaacccagttgacacaggcctttgtatttaatatgtctcctctgtacagacccctggtgtctggtgaaagccctcagcatggtctcagaccttgatgacatgcttccagcatcagagactgtggcattgttaagctctttgaggggttttctgattcaagattgacaagagcaataataaatttacaacaaaacaaaagctatgttctccagaagagtaaggtgtgttctctgacgtcagtcagtaaggactgatgggttgttcccaaaatagaatttaaaacaaaccattaaaagcactttataagtttattgagtttgacttcataaaactatcctttttaatgcttggagacatattgaataaactagtcttaagtcatgtgatctgcaatcatttgctttgcttaaacataatttctgtggccctcatgttgattgtgtattgagttaaataccaaggctgggagctgctactctgtgagattcagcagaattttactttagagaaagaattcaagacttagtttctccttaatgtgactaatactgaagagacaagatttaaaatatactttctctgaagtaactagaaaataattaaatgccatccatgtagttgtatttgccaacatgacatctctcattcgtttgaggctgggcttacatagccattccctgtgttctttacattttgtatcttcagttgctcagtgtcagccttgtttcacctttagttctgccttattttccacttgccatgcacagaactgggggagcctctggaagtgccaggctgccactgtcagctagatttgccaagtcaaagaggcacagccagcccctaagtgcctttttggttgcttttgcattgtgaggacattcggcaggcaggtcacagtccctgctgtgtgtttcagggactcttcatctcactgtagatgttccgtgcaaccagcttcagttgtgggttctgtagcctaacacagaccaaagccagctttggcctgactcacaaagatggtcaggacagcatgtaagagcagagctgtgtcctcagggaaacagacaggcaagtggcagagctggtcggatgctggtgttcttacagtttttgaatgtgagggactaaagttgattttgaacacctggacacccatcccattttctcccttcccagtccaccacctcttcacacccatgcttataggaagattgtgtgggacccgcattgaaacgctggccttgatacatggaggaatatcattgccagcaactgcactcaggagcccgaattcaggagtgaaattgccacttctagtcagccccttatttcctatggaaacgacgccttccgccctgcgcctgctgtcctcacataaagctgaatcagggtcgccgacactgttcacgttggtccatcttcttcctttgctgctgcagtgagcatccttccacgccatcaggaaccacttgatttccaacagcttcagtccactaaccttctgaggacttttttaaatgtagtaccacaaagtgacaattatggcaggcctgccttgaaagaattgtcatttttactgccaatttttggatgaagatgtttttataatcttttacagtggtctgcaatcaagcaggaattgcacaattgactcaatgctatgtgttctcaaggagctccttcagtctaggctgccctccggactgccctcctgcccctaaggcaccgggacacacagatgagcctcccacaggcagctcctggagctccccaggtggcctctcatggtcacctacagctatgagctgtaaggcccggagcctgagccaccagactcacctggctcgccccaccctccctgctagcaccaaggcgtgtacagcatcttaagcttggaacaagcagactggaattttcctctgctacctcttgtgtacagaatcttgtttataaatttcaaaaggaagtagctaaactagggaagactctggattctaaatttggttcatgtgtggtggagttcttagcttctaagagtataaaataaatttttcaaaaatgtagaattggagtctcacagacttt

SEQ ID NO: 28967 - DNA, 1163 bp, Mus musculus
ctagtagggacccagctcatgttccctgcactctgcccctctctgcccccttagtcctcccactggggttttcaggcagttctagttatgaccttgctgggtgcttcagggcctaggcctcagcagcaggaagtggatgctgtttacctgagcatctctgaaacagggagcagtaggaggttaaagtcacgtgaagcagaaattgcagagggaaattgaatacaggtgaaagcaacaggcgggaatccagtccaggccctgcgccccctcgctgccctatcaggtcaagctctcagcctatgccaattctctctcccagtctgaaaactcagacctgttctatgccgtgccctggtcctgtgggaccctgggcttcctggtggctgccgagatccggatcatcccggccaagaagtatgtcaagctgcggtttgagcctgttcggggcctggaggccatctgtgaaaaattcacccgcgagtcccagcggctggagaaccacttcgtggaagggttgctgtactccctggatgaggctgtcatcatgacaggggtcatgacggacgacgtagagcccagcaaggtaggccaggggaagaaaggtgggcaggcactgggcctatttagactgcttcatgtggcatggtccaccaggatgcaggtaacaggcttcctcagaaatgtgaggggccataagaggcctatctcctccactgctgccacccgccagtcacgtgcttcccttatagacagaacctgttgtctaatgacagcccatgtcatagatgaagaaaccgatgctccaagggctaatttagatttctacaaggtggcagagccaagatggagtaattgccttgatacttcctccagatcaaatgggcacacctcagctttcaccatacaacgtttagtgttttattaacatttgacacataacaagtgagtaatgtgtaacttattgttacacataacaagcaagtaatgttttagtctttattttcagacaaggttacctacctactagctcaggctgacctggagcgcactgggtagtccaggctaacctccaacttagggctatgatctgagtaagttctggaaatataggtgtgaatcactatgtaatattttggagtttgtttgtttgtttgtttgttttt

SEQ ID NO: 28968 - DNA, 3332 bp, Mus musculus
ctgggaccctctagtgggttacaaagtcaaagttcccgtttgcaaggatgtgggtgagctagtcccgggtctgctacctgctgggaaaagacagaccaagctgtttctctgacctctcactcaggtctaccccatctggctgtgcccattcatcctgcccagccagccaggactagtgcatcccaagggagatgaagcagagctctacgtggacatcggggcatacggggagccacgtgtgaagcacttcgaggccaggtcctgcatgaggcagctggagaagtttgtgcggagtgtgcacgggtaagtgacccggggtctgggggacacaggggcctcacacccaccttgtccatcctcaccgccgccgcactccttccctcccatgcaggttccaaatgttatacgccgattgctatatgaaccgcgaggaattctgggagatgttcgatggctccttgtaccacaagctgcgcaagcagctgggctgccaggacgccttccctgaggtgtacgacaagatctgcaaggcggcaaggcactgagcagggcacctggggagccagctgcatggacctgctctccctcgctcgctccggcttctctgctttcccaggtctcagaaaagaaacccctccacatccccgaggcagcccgatggcttccagggtggctcgggcaagtggaagcacgtggagtcagacagacctaagtcccaggcccagattagccactcgttagctgtgtgactgactctgggctagtcacctggcccctgtgtgccccgtgttcatctgtgaaaggaggtaaaaaaaaaaaaatatctacctgctggatgtcaccccacactaagggcttccaccactgcttccatgcaacctcacgcctggctcctgctttggatctaacagctgagtccagacaggctccccacaggtcacccttgcacgggtttggccaacaccatgaaggagttgccttggagtttcacctgcatagcttgcatcagccccgagagggcaaaggagggtcagccttccacttggcctcgggggtggggcagggggcatctgattggcaggcaggcccaggatgtgctgtgccaaagccaggtctactccaaagtcctctctgccatcttcggaccatcctggccctacttctgtgtgctcgagctgccccagccatcactgagcccactcaggactgctcctggaagacatctcaaggtgggaagcctggctttcctgggctttgctttcttaactcccaccatccaggcctcctctagagtccactgagtcacaatgggggcacatgctcatgactgtgtcacttaggggcggtccccacactgagtgagaaaggggcatctgccctgttgctactgtgaggaccctccctggggttagaaagaaagcatccagggtcactcatctccccctcccccattttgttccctccccccccctccccccccccccccccccggctctagttaatttcagtgccttacaaatcctaagctcagagaaagttagctccatttccgttcccaagggaggggcctctgaggtccttctgccttgttgatgaagagtggttggttgtagagcccccaccttcagaactgcctggcccagctggaaacccagagtctgagggggaatcaggttctggaaggcaagccagaactccagagctgagctggtcacagtcactcctcccccaccacccctgcccctccagaggctgcagttttctcgcctgtcacttggaacattagagctcctgaagcctgtctgtcttaagacgttgggaaagcctcgtgttgaaagccgggggagcttaaatgatccaggtggtagctagggaccgtccatcagtggtccttccctccaccgccacgccagctcctgggtcgttttcatttatctggcagagcccaggacccttagaatcatattttagctgaaggatgctcactgatgcggccgagggcttgggatactgcacagtgctactgtgtcctgtgaaggctggtgcactcagggctgtgggaaggcagaatcacctcatccatttggcctgtgaaggaagtaacctcactttgctgtctgagcagcatgtattcctggcatgggctctcctagtggtccatgtgcatccttgcgcatgtgcactcgctcgcagactgatgaccctgcttgctgcagatgaatggtcaacgcgagctaggttagttagtgtgatgtataaggcgccatcattcctcaagtcaagcctccatcccaaagcacctggagctgtggcaatgatgccagcaacctgtgtcacccaaaatagtcaaaatccagccctccacagacactccccaggacctggggagggaagggattttgagtcacattagcctcaggttagtgtttggctccagtaatatcttgcccgaaaagtggtcgtcttccaagcatggtgttctgggtcccagccttgtcttatcgcctgtcctgtcagtgtccaaccacacggtggcttggtggggtcactcagctgctatgggacagcacatgtgggaagtcaacgcaagcctctcccctccgtggctctggtttcttggctgcatggttctctgtaaattcagttgtagccactgtctttggctagaaagctgaattggctgttgctgaaaggaaggaggggatgggtgtggcgatgtgtgctgtgtgatttgttgtttttttttttttaatttggtcatggggaccaaggagaaggcatgaatccctgtatttggctcttgcagcctcaggcactgtgcctactctccaggtcatgtccctgtggttctggggccaccacttgtgtaaaataaagtacagcctggacgctagtcttttgtcatttattcagaggaccagtgtagagtcggacaaggacgcagccaccgccactggtgccattcagctccaatgtcctgtctgaacacaagcacccacagatgagggctaaaaacatgggggaagcgggtagcaaatggatttctgtcattccagtgaagaaatgctggcacctcaggagggatgggctctgtcctcaggcaccaggtacacttgtcaggtctggctggtgttctggcttcatcaatcggttgtgacaaaccagttttgacaagctcattgttcctgtgtcgatgtcctcatccaaaagccgaaggcacaacgacccttccagcagaacacagtgccttcctctgcacactaccagccttcctgtcagccagatgtgtccacagggattaagtggttagctttgcagtcactagagaccca

SEQ ID NO: 28969 - DNA, 1193 bp, Mus musculus
cagtctgcaaagttttggtcagttcttgttttgtgccaatctcaggaacatagatgcttaagtgttcaggagctaagtgtgttttgagagctcagagtcgggggctctgaggaggggcacggacagagacagagactgggctcctgccagctcccttcttgctggtttcctgtttacagctgcccatcccgccagcacagcacacagatgctccagagaactttggtgaattttcagacctgcagttcaattacagaaagagaagcaggcaacttggaatccgccttcagcagccctgaaaacctctgaggaagcccctctaatccctccatgtcacgcgcactcctcgacttctgccttcctctctctcccccccatctgaggacatatggccccttgaagtttttgtttgcttgcaggggaaaaacccaccctgccagtgtggagtgtttctctttctcttattattattattattaagcatcaggagacagcaatctgcgtgcagataccgtgcgtgcataattaataaaaaatctcattatttatttataaaaaagacgcatggggaactggggaactagggctatccccattatctgtggagagaaggggagagacagtttttgaacattggatccttccagagaagcaaatctctatgcatgcaatgaataaaaacccatgtgctcctgtggggagtgaggatctgtgcccagggggcatccgaaagcaaaagcgtggtcaggagcttaaaaaagaaaagggactgatgagagtctaaggctcactcacagagcagagtaagtataccatgtttgaggagaccggcaggatagaaatactgagagacacgggtttagtagctagtccaaggaagataacctggggcagactccagactctgggagaagcagctggagggagagatgctggcacaatcccatcactagttaccacattaaaaaaaaaaaaatctagatgccaggtgaggggagcccctgggttggctatgactaggtaggtagatgattttaacttgatggtgatggcggggttctacatggccgttttgcccttggcctcctgcttctctgatgcccgggcaagaccttcagaattaacaatccaacttattacgtaacaaaccctgagatcagggaatcagggaccagcctttccaggtttgcaga

SEQ ID NO: 28970 - DNA, 1184 bp, Mus musculus
tctgtcttaaaaaacaacaacaacaacaacaacaacaacaacaaaaaaccaaaacaaaacaaggggggcagatagctcttcaggtaaaactgtttgctgtctatgcttgacctcctgagtttgaatcctgaatgtaggacagaactaacccttgaaagttgtcctctgacctccacaagggtatatctccaaaccccaaataaaaattaaaactaaacaaaagagggttggagagatgactcagaagctaagagtaccggctgctcttccacaggacccaggttcgattctcagaacctgcatggcagctcacagctgtctggaactccagtttcagaggatctggcgttctcacacagacatacctgcaggcaaaacaaaaatgcacaggaaataaaaataaatctaaagcagaggagggtgtgctggagagatgatggctcagtggttaagagcaccaactgctcttccagaggtcctgagttcaattcccaaaaaccacatggtggctttttttttttttttttttttttttccaagacagggtttctctgtatagccctggctgtcctggaactcactttgcagaccaggctggcctcgaactcagaaatctgcctgcctctgcctcctgagattaaaggtatgcaccacaacgcccggctttttttttttttttttttttttcagtcttgaattcacagaggtcaccagcctctgcctcctggatgctgggattaaagatgtttgccaccatgacaacagggcagaggctccgtttttctatggcttggtctgtgaactttggaacctcactgccccatcccactcatagcctgtgccacacctgggaagatctgttggtctgccttctggtctagggcatgtaacccagagtcactcagcactgaagtgacagaccccaagcagccaagatttctgacagtggcagggactggcagaaaagaagcgacattgagtggacagctggggacctggcagccaagagtgagctctgtcatgaagccagctctgcttccctaatactgctgcgaactataggtctttgcttgaatggtcccctggttttctcttaggagatccctatggcttgcagggtaatgtcccaacttctgtcagcacactgtgaggtgcccgctgtgctacgggctgatccttacctg

SEQ ID NO: 28971 - DNA, 1240 bp, Mus musculus
gcaagttccaggttaactggagaaacaaaacaaaacttcaaagcaatattcaggacttcaactgtttaggcttgattaagcgtattttcttttctggcaaagttattagcagtttattaggcctcatatagtaaggttgagtgagggcagaggcagagctgttgcctggcatgcatatcccttggttccatgcccagtgtcacaaacaataaaatcgggaaaaaaaggctacaggggctgggaatgtaagctcagcaggtaaagtccttggcatgagtggggcccagctgtaaccccagcactgggagagtcaaaggtcaaggtcatttccaactctacagtgagtttgaggtcatcctgggctacatgagaacctgtcttaaaacaacaaaaaccttacagaactagagtgaagctccagtagttgggaatgacgttttcagcgtgagcacagaatgctccagaagtttaagccttcctcttggctccagggtgtctcaccatatcaatccagcgcttacaatggctagcggttaagagcactgactgctcttccagaggtcctgagttcaattcctagcaaccacatggtggttcacaaccatctctaatgggatctgatggcatcttctggcgcgtttgaagacagctacagtatacttatataataaataaataaatctttaaaaaagaagaagaagaagaggccaggtcctgagatcttctgcctctttccttgccacatcagtgaggagggtctaaggtgtcttgaccatgttccttggaacatgttgggtaaggagcagtattcaaccctgaaactaaacctctcaagcacattggatacaactatccccatacaacttatctctgagacaaaaagggttggggctgatttagtactgggccagtacagtcagtgggtgggattcaggatcatctaggacatcacagagaagttttggaccctgtctttattactgtactattaccgtaaagaaacattgtatccaaagcaacttaaaaagaaaggtattgggctggtgagatggttcagtgggtaagagcacccgactgctcttccaaaggtccggagttcaaatcccagcaaccacaaggtggctcacaaccatctgtaacgagatctgactccctcttctggagtgtctaaagacagctacagtgtacttacatataatcaaataaatctttaaaaaaaaaaaaaaagaaaggtatttag

SEQ ID NO: 28972 - DNA, 1333 bp, Mus musculus
aaactggacagtttgcaattgctggtttatttcaaaagctgtttggggaaaaggaacagaaaccaaccctttccacatgggccttggggtttgcaaagctgggcgaggagatgcaggtgtcagctttgctctggcttgactggccatcacaacacactgggccagaggacccagagcctgctgtcacccaacagagaccatcgctgtgatccagcgtacacactgttccaggatggctgcctcttctccagacctctcgtgccaagccactggggcctccagtctttcgatccccaccgtttcctggcaagagtcctgctggctgggtagtggcccaggccaaggaggagaggccccgccaacgggatgactacaatctgggccatagccctgacctccatattctggtcccgagctcctcacatagtgcgcactggcagggcaggctgaggttgtggttttcttttttttcctcctgtttgtcctttttcagagatgggtgttggttggaattgctctgtatttgcttgggactggatggacagacttcggcattgctgtgggggtgggggagcaccagcaaccaaacagacactgtttctggtcctgtttttattttcaaaaaccgatgaacctgatgatggagcctgtcccctccgaggaggggtgacttggctgccctggcctctccccgtggcaacctttgtgtcttgccccggaagacactgagttcattgtacatgtacaccctctgcgccctgcccacccttgtagctggtctttgttttcttacctcccctttctgacccatgtatatcatattatgtgagataccatctgcctgaaaaaagaccttgtgcggattcttgggaacattgtagctgtttctgtgttttttcttaccttgtagtctggttctgaattatgagaggaaaaaaaaagtaattatgatacattgtagtttgtgtacgatatatgttgataacgttttattaaagggacatcttttttccgcagcccttcctgacatacttgtggggacccgggtaggagctgatggtaccgatgaggaaggagacgctgtacccggtgccgagtacagttgccttgggaggggtttgggacagatggaggctatccttactcaggctgaggcagctgtagtcttctggcttgcagtcacatcttaccttccaaagctttgcttgtacaagtcaagaacggtccccaaagactgttttctctacaggtggtgggcagacagcaaggtggccttcccacattcctaccttcttccagaggccaaatttgttaacttcccatgcccaaatgc

SEQ ID NO: 28973 - DNA, 1160 bp, Mus musculus
atctaacttgtaggtaagttcatggcacaggaggtgacattcagtaaatggcagctctaaatactttatattttgttaggtgctagagagccataaaacatggcttgagattgctagcagaaaaacatcacagagctgggattttatttgaagggctggtatccactgaactagtctcacagctttgatttctctgtggggagtcagcagggaactcagctgtcttgagcatggtttgaactcctcctgtttttaagcactcattccccgtattctgctcttaccacctggaagtttcggttttcagatatctcaaaaacaaaaccagagtcccttgaggcagccttttctctggtgctccctgacaggcataaacatctcttcctgagccctcccctcccctctcctctctctctctctctcttcttttggttgtcccacagggatgaagcaggctctctggcttactaagaccaagttaatagaaggcctccccaagaaagtgcttagtcttgttgatgatccagctaatcacatagagaaccaagaacagcgtgttttggatatcatctcccatgcccggctttggcactccactgaggacatccccaagagagagacttactggtaagtttcctccagataagataactgaggagtgttgggagttatatgttgctttaagtctccaaatatctcttctttcctccaagcccactcattgtggacagcctcatacagctgtgtaaatcccagattctcaagcacccttctctagccaggcggacctctgcccaaaactgcaccttagccaccacctggaaccgcggtaggtcaccctatataccagaaggccttgctgggctttttgttgttgttgcttttttatttgtgtgtcttaatctctcttactgtcagccccaccaccaggtcccatccctctcatcctgctacatgctctttgggttcagaagcacccttccttcagaaatacccttcactgcatagcacaggctggcctcagacttgtgatcctccagtctgcaccaccaggcccaactttctcgtttctgtttttacctgcttctaagactttattccaccagtgatggctgactgtgtctgttgagtccccagagcatgcgggagtgtgtaaatgc

SEQ ID NO: 28974 - DNA, 1196 bp, Mus musculus
gtgggggggagggggagagggggcaggttgctggctcgagaagggagggccactgttgctcatgcagggagcagaagctcaaccacatggggtcggggagggcgggcgcagggagtggggaccttgtcagggaccactgagtgggaagtgaccacagtgggcccgggaagcttccagcaggaagtgttacagcagctcttgtatgacagcagctctcagaagacccttggagtaattcttacaccgctgtgttatgccttctgggtagggtcttatgtaatatacattttggggtggattaagggtctgacagcagatgctttctattggcttggtctgagatgttagggatgcctcatctgcacgtggaaggacttgggatgctgcacctacatgaccaatcctctccatggggtgtcgtggtcacatgacaggggaacaggtgaagcacttactgtcctctggtatgaggtgccgggcttccgaatccacacaaccttatcaaatttcctggcacggtcggtccattgccccgcagataaccataagtacagtttctcttccttacaaatattctgtagcactttaacctggtctaggtctgagaacatagctcacaggagagcgcttgcctcgcttacacgaggccctgagtttgttagatccccagtgccgcagaacaaagagcctttgccttatttccctgtcttcgctgaccactcttcgcagttatttcgcatgactgttgtgaggtggtcttgccacgcagcccacacaggcctgaaacttgagctgcccctgcctcagccccttaaatgctgggaggcttttaagttaaatcttatttgctgctttgtgtctctactctttctccccacttggagagcttccagttcctggaagtagtgtttgagttttcctcccttctgagtctccagtaccaggaacagagcccggtgccagttaggtgtccatagctgttgactgtataattgagcaacccgcagtgagaaaagaggagcgggtctaattaaatcagggatgcttcctggaggaagggatacctgcatggttgaggtgcttactcagcagagaaggcaaactgtggaaagccgcagaagtagagggacaagtgacaggtctagctgtccgggagacagcatgtcgggcaagtgtgaagtgtgactttcatgttc

SEQ ID NO: 28975 - DNA, 1196 bp, Mus musculus
agccaaagctgtctggagggctcagtagtctgcatcccaagcttgtgctccaggtcagagccacttagtaagaaactagaactgggcttgagcagagttgtccagttggtattaagatcttgtcagcagcatctatcacttaataccacagaatgtccgtcagcagccacgtctcatattttctgcatacatttttgcctttgatgttcataaagacatgatttccactcccaggaatgttaaggataagaatatgatttctcctttcccattcaaaatctgtcttttggtggtccatatttaatgagctcttaagagtgtccatgttcaggggcttggctctattagactacaatctgttgctgatgcaaattaactatggtaaagccaacatccagggtactcaaattcaccaaacactttcatacacaacccacaacttctatcagtataacaagctttgagccaaagatgattgtgactgttcatgaagttatctgtaacctcttccaggaagatttgttctcttgcatacacacaccataaataatatattccttactacttaaaagtgtttgtttgtttgtttgtttagctcatgtccctgatgccaagaatgcatctcctcttccctctgactctggtgaggtcgttctggagtgacatgatggactctgcacagagcttcataacctcttcatggactttttatcttcaagccgatgacggaaaaatagttatattccaggtgacaactgtgttttacacattgacctaaattcagcaatagtcaatgtcatgtcttacatgagggtcttggcatagaaccatgtaatcagtcacctaagtgcttttgtccagtaatgctgcttaactggccttcagtgaaacccgagcagcaggacacagtgtaatttaccacctttgcttcttcccttgaaagcattacctcaagcttagtggttatgtggtcttcttgattttatagtgactaaattgattaagtgagaaatttagacgggaaagtaagaattgtataactcaccataaatagtggcatacaacacagacactaggacattaatgacataataggaagtctatagtagttctccttttaactgcctgtaagaacatggtacagatacatttgccctctaggaggtaatttttcttttgtctaataattgacagtg

SEQ ID NO: 28976 - DNA, 1221 bp, Mus musculus
ttgctttgtctaatttagtaattagaatgtattctccgggtttggtggtctaaatttgcaatcctagtgagggaggaaggcaggagcttcaggccagtcttacaacataccaagtttgaggcctgatctccatgaagtctgcctcaaaagtaaataattaaaatgctcttgacagtaatttgatgggagttgtttttggttttgtgggttttttgttcttgttgctttagaatagggtcttcctgtataggctgactgtcatagagctcatttagaccaggctgtcctggaactcagagatccatctgcctctgcctctgcctctggagtgctgtgatcaaaggtgtatagtaccaatcccaacaacttgaggaaatgttatatacatagtaggaagtctatgtgtctgatttcatcattatttgtaataggtatttagccatactacagacattttagagatagaggaaagaacatcaaatcatcctaataaactagatgtaataaaattttgttattaattttaaagacagcgcacagagttttgtattgtgtgtgtaaggcaatgtgactgactgttgtgttgttttgcagtaactctggatggattttaaccacaacccttgtcctctcggtgatggtgttgctctggatctgttgtgcagctgttgctacagctgtagaacagtatgttccccctgaggtaagtctggttttaacccctgggctacttgaagccagagtcacatgattaatcaatttaagtgctgtttaactagaaaaataaggcccttctgctagaatgagagatttggtggttttactcaggtgagattggcccgtatgaaaaccacgtttgtaagcccagctgcagtggctcgcactctgcactgacacgtatgtgccagtgggcctgagcacagcgccctcacctcttctctgagactgaagcaaactgctggtactgctctctaagctggaatgtgagagagggactgtggagccacttaaaattatgaattaccataaatactgttttagaaactaagaaaatctttgattctgagttcttctgttctggtagctaacctcaaagagattatgaccttgttccttagtaattaaaatttaactggctcaagatacagttgttaaggtaaaggatatttgtttgggggaaaagctgtaatttgctgattcaacttagtttccaagaaaaga

SEQ ID NO: 28977 - DNA, 1099 bp, Mus musculus
aatgaacaaaagctgagcagatacccagctccttctcttgtgattgttaggtctcagactgaagaacatgaggaggcagggcccctgcccaccaaggtgaaccttgctcactcagaaatctaagctttttaaaagagtcgtggacacataaacttccattcctcatagagctttttaagatggtttcattggacataggccttaagaaatcactataaaatgcaaataaagttaccaaactctgtgaagactttatttgctgtgactttacctgtatttttctagtcatttaagatggacattgggttgtatttttattttactaatatctgtagctacttagttagttgcattggttttggtttttttcctctcttcgccaaattctatgagctgatcattgtggccccgcccctgccatgccccccgtcagtcatctcacttaataaccgaaaccttagggtgtgatgcttctgcccggaaatggcctccaaactgtcctctggattatagcagaaatgttatttaatgacactacattttcagttgtattgaattgaaatcattaaaatctatttgaataattatgttctgaagcttgagtgttgggctttcttgttcttccctctcctttcccagtgcagagtcgtgggttgctgtgtgtctgctgttctatggcagctcgatcgagcgatgctgccgtgaaaacaaaaatggccttctcagaagtggtgtaaagtgtgtgtgtgtgtatgtgtgtgtgttggatgttggatgtcggggacatctgcatgccacagcatgtgtgtgaagatcagaggacagtgttcaggagtcggttctttcccttgccaggttgagatgggtcctctgctcgtattttgctgctgcactgtgtactccaggcgggctggcctgagagcttctggcttattccagggactcaaatgacaaattcaggttgtcaggcttttgaagctaatgctttgtccgctcagccatctctcttgaagttccacttgatgtggttttttttgcacagcttagagttgaaagaatttttccaaaggagctgtttgacctctttaaaatcgcatca

SEQ ID NO: 28978 - DNA, 1184 bp, Mus musculus
ggaaattaagaaaattggttattgttagactcactgaacccagtaagtgcccacctctccctctgccgtgatagtgtatctgccactcctgctgccgggcattcagtccagaccaccccagggccttgtcttagtcctggatggtatcagactttggcaggccctggcccacgaacacagaaaactcacccatttcttatttctacagaccagaatcgagctcgcacagaagttacaaggaaatgtcccctcgcagagacccacatgaactcttctggaaaactccagttctatagggaggaggctccggactgccatgagccactgttgagccaagaatcaaagaagagcaagaagagagctttcaaggagtcagagcaggagcagagctcgccccagtcggccaagcagaagtgtgtgtgtctggctgtggaagattgggatttgctcaattcctactgactgacacatacagtcgacctcccccacctcagtacgaggaggggagactgctggtgattttcttttggtttggatttacctatggcattagcatagcaagcagatatttctacttttgtggtgcgggagggaaggctatggacgtatgtaataatttctaatgtatattttcaatacatagtaattttttcaaataaactcttttgctctcgttgaattctgcttttgaattgcagattggagccacaggagatagcaccatgtgaactaatgaatttggtatgacctgttcttgctacagtttggaacagctgatagaatgtagatgtgaatgaagctgctgctgactgtatgcttccctgggccatgccctggcctcgtagcatatacatgaaacaagccaaaattcagagccaagaacctttaacatcaagttaagtggcatgttcaatgtcatagagcttacagtaggaagtgagagtttacacttctttctacttggctgcaaagcccatcctgtgttgttgccttctcaacaatcattagcatttattgaaatcccagccattggaggtattcattaaaacccaagtgactcacagcagtcttggaagtaagagggcagaagctttttccaacttaagacttcctggaaaagtcccaatgataataaatactgtaggtttcttcaggtcacaagaattttcttacagatactcagc

SEQ ID NO: 28979 - DNA, 1164 bp, Mus musculus
ctgtgctgctgtgagtctactttgaaaagaattgttgctggcatttttttgtaaattctgggtgaattctccaaatgaaatttgagctcaaagttctgaaagatgagtagattactaaataggtgagaaaaatgcaaaagaggcacttcaggtaaaaacagtagaacagcctcatagtgacaaagttctcagcaactggtgagtcttgctttcctggtagtggtaggatcataaagctgtgggcacagcaaggtgaagctgcagatgacattctaattggatttgcctccacacaccttgcttttacagttgcaaccaaggcaatggcttactacctcaactcagaagcccacctggatccagggcccatctatgttcgagaaaatgggcagctacacatggtcaacctggctctggatggtgttaaaaacagcctgcagaagccacgaccattcagactctttcccaaaggcttttccgtggagctgtgcatgaacagggaagacgacactgcacagaaagagaagaccgatcactttatcttcacgtacacccgagaggggaatctgcgatactctgctaagtccctcttcagtctggtgctgggcttcatctccgacaatgttgatcacattgattccctcatcggctttcctgagcagatcgctgagaagctgttctctgctgctgaagccagacagaaattcacagagccaggggcagggctcagggcgttacagaagttcactgaggcctacgggagtctggtgctgtgctcgctgtgcttgcgaaacaggtgggtggtagtattctctctcgttagctagtgagtacttgagtggatgtttagcctgtcaagccccgggccttagtgggctcataagctctaccatcagatagtactttcaattttgaacttacacatttaaagtacaggtcattttgaggggggctagggaagcaggagggggatcagtaactttttctctcttcatctcatagacaatatttagcattattttgaaaatgttctgtaaggattagcttggctaccgccgcttttccaatagataaaaatacttggcaaccaacttctctctttttccctttgagatatggtcttgcaatattgcccaggctggtagagaacaactaggctcacca

SEQ ID NO: 28980 - DNA, 1137 bp, Mus musculus
tttaccttaaactgtcttttttatttatttatttttatgtgcattggtgttttgcttgcatatatgtctatatgtctgtaagagggtgtcagaagccctggaactggagttgcagacaggtgtgagctgctttgtgggtgctgggaattgaaccacagtcctcaggaagaatagccagtgttgttaaccactgagccacctcgtcagccctaacaaacgttttggtagtggagttttgtaggttttgctttgctttttgcatctctcatggcagaaggtattaaataatactgtaattttttttttaaccttggaccatggcacagagcccacactctgtggggaagcaggccacttgtggcaagtcagtggctccctggaatccttgactgcctaggttccctttcttaccttaagaagtcaatacttgccgggcgtggtggcgcaagcctttaatcccagcaatcgggaggcagaggcaggcagatttctgagttcgaggtcagcctggtctacaaagtgaattccaggacagccagggctacacagagaaaccttgtctcagaagaaaaaaaaaagtcaatacttggctttgaaaagtgctcatccatctgtgttgttctccccaaaagtaatgggttttcttaattttatatttcaaggtatctgagattagccccaaagatactgccaaatgttaatgaaaaatgtcaatattccaatgtaaaaggtgtcacttttgctacacagtaaattaatttttgcacatatgtggtgttacacatgtatgtggtatgtgtatgttgtgtgtacacatgaacacatgcacatgtgtgcacgtgtgtgtgcctgtgtggaaatctgaggctgacaccgggtgtctttccttgaatgctcgctacctttgtttttttctttgttttgttttgtttttgtttttgtttttcaagactggatttcattgtgtagccctggctgtcctagaactcactctgtagagcaggctggcctggaactcagagatccacctgcctctgactcctgactgctgagattacatgcatggactatgtccagctggtggattactttatcattagaaagagaaaagaggacagctcccaacacgtagtcaca

SEQ ID NO: 28981 - DNA, 1134 bp, Mus musculus
ggagatggaaacaggctggatgcttattggaatctttggatgtgaaaataaaatgatgatgttaggagctggaaagacgctgagagggtaaagtgcttgctgcttgagttgaagacctgaatttagattctcagtacaatcaagagtcagctgtgtgatgcatatcctaaccccagtgttgtggctcattggccagccagccagctgctgagctctcggttccgtgagagaccctagctcaaaaaataaggagagccacagaggaagagagctagtgtcgctgtggcctttacatgtgtgtgcatgagcaagcacactcatacaagactcattatggtccatgagttcactgaagcacaaattaaaaaaattaaaaagtcataaaggtacagaataggttttgaagtcttgaaaatattccctaagactaaaaaacacaaattactttgggagattttttttctcaataatatattccttatttttcttataagaaagtgtaggccatcaaggagttagaatttgttgtcgttgttgtttggcctttgagaatatcgctactaagcgatacaatcatgctttagctgatgtgtgtcatatttgctgaatcatgcaggactgatgaacataacccataagccctggcagagatggcagatgattaattgttggagacctaggaaatctgggattaattttggtttctgaattctactttgaaaataattgctttcattattaagtgagtctattcagccagcatgtctcatgtctctttcttttgttcatatttttagatagtaacatactcatagtttaaacttggaagcatgttggttgttgagtgtctggttgggttttgttgtttagactaaccctttttaggactggtaagttacactgtttccacattacttttccttagctgaggcactaattgcctttactatataaagttcagaaatactgtttacattttgaaaacaaacttggcttgttactatggtagctttcctatgatgaaatgtttacatatggttgtattttctctgttagcaacatctgtgtgaattaaaagaaattctaataccattttccagtacccaaaacaaaatctgaataatttactttgga

SEQ ID NO: 28982 - DNA, 1474 bp, Mus musculus
tctaccaagaagctgctgctacaaatgggaggatgtattcatcatactcagtggaacccaagaaactgagctctgcaggtgactcctagtcctacacaaaggggaatgtatccgtttcctagggaagtgacagtagttagttcctggctaattgcatgtgtgaggtagctatgtttagcatttttctccttgcccatcttttccataagtatgatgtgttttgttagtagttaaaatagggacgcagagcagactgggtagactgacgaggtaaagtgcagatggtgagttcatttgacagtgcttagaggactgagccccgggagtgaacagaaaacataggtatctacaggctggtgacgcaagcctgacaggctggctttgatcctggagcccacagtgaaaggagagaacaactcctaaaagttgtcccatgatctctctgcatgtgcctgctcttaagcacatactcacaatactaatgcatggaacaaacacatctaaaactccttgagtggtttctggattacagaaataaaacatagacattgggacttaaatctaaatggaagccatctactgtgctttggtttaaagccttaagagggcggggaggagtgtagaagttgaacccctgagtgctgcctgcctgggccaagctttcttatcaccactgcatatgctctgttacagaagaaactgcttttcagactccaaaacctagtcagacgccttccgtgccgccgttagttaaaacttcactgttttctccaaaattatctacacccaatgtttcaagtccttttgggaccccgtttggctccagcgtagtgaaccgaatggctggaattcttgatgtaaaccccttctctgggtctccccaaagtcctcagctcataagaagaggaccgaggctgtggactcacacttctggtgagggctggctactttccaggtttaaagttgtatagttgtagcttagacagcttatgtcctcatctcatcctttctcttttctagatcaacaagtgtctgcaatttctaacccatctccttgcgcctctgttactgctgagggtaagacagtgagacagcccagtgtgatctactcgtggattcagaataaacgagaacaggtaggaagacgcatctatgggctttatatgtatatgtgagatctccactgggagagaggtcagagctctcacagcagtagctttctgtttgttttatgcttctggcatcagattggctcatgaaatcacccatagttgagtattttgacttatactgcatttcatatgacttaattctttaagagatagttgagttaggctctgggatagacagcaagtaaacaaagccatttcccatatgtttatatcttagtaggggaagtagatgaataagcaagtatattactctatatatctttataatttagaactgaattaatgtcagggctgttctggga

SEQ ID NO: 28983 - DNA, 2243 bp, Mus musculus
ccctgctgatacaactacagatgggacagtaaatgttgagcattcttggatcagaagagagcggactaattagacgcttcctttgtcgtggtgcttgctttgaaaactatactttaatgggagaaatcatggaaagaaattctcagcagaataaccgaaaactgccttttctgtacccagtgctttttgtgtgtgtggtataataaaatctttattcagttttacaggagcgtctatggcagccgaactgtctcttgctcatataacttgataatgattattcacaattgtttgtagaatttacttttgaaaagagtggagccagctcagaagttaaagcaggtggtctttcccagctgctctaagaggttagctctttgtaaactctcaaaatacataaacttaagattagtttgtttactaaaggataaaaatggtaacggtggagaaaaactcacagtaaaaatgttgtctacaggacatattttgttaatctgttaggttgtgtttttgtttccagggacaaattaaatttgcatgattgtccaaaaagagtctcgatttacagatgttaactctatataaaggaatgtagaaaaattgaaatcttaaggtacacgactaagcattcacattcgggtagagcaacgtctctgagttcactgtgtgatgctagtggaggatgagggcatcttgtttcctagccaggcttgcttgcttttttgaaataacattaaacagttggcagaggttttcaaatgaggggaaaaggagacctggaaacttccctttccctacggtttgtctttaccaggtcaaattatgttgtgagtctagtctgtcttcacatgggagcagcctctgctgtgctaactggctaataaaaacacagtaggccaagctttagagccaaaagcacatagtcatcagataggcaggtgaatgtcagaggctctccgcaggagcgggtacgccccggatgtactgtacaggcggtcattttatgacttatgagatcatttctttggagatgaaacatgggaggtcctgctggcagatattcattggaccagctttgggccaaatcctcctttataaatccttttctgttatctttttctttaaagtcagcacagtattgtatatgagtcttaaatgtgatgtgtatgcctagcctttgtcggcttcattaatgtattacatctttacagtagtgtattttagccccagatctactgcccattcaaccagcacatggcaaattataaacgaatcccgctagccttaaaaatgtctctatgggacaattcctcaccttaattgttaagttttgggtcttttaagtcccctctctaccttgtgtgtgaagttctcttgatgtgttgtgaaagttgggtttccagtgtgttggtttcttcagatactcagaggagcctggctagataacagaattaaagccataggccttttgtgtttgctggctgcctctgactgaagcatttcgggagacaaatctaaatgttgtgtttccataaagaactgtggcatgtgtgtagctcactaaagagagcattcattttaacttggacttactcctgtgaaatgtctggtccagtttaggttcttgcctttcccacttcctctgggtgaaagtatatttgatagaaatatgaatctttctggatgttctgtgtctgaggtattgaccacaccatgtctgcctgctggggagcaggacactgccatcccctcagacctgtacagtccctggaaggtgaggggtcattctttttctccattgtatattggtgggcactctttttttttaaaggcacctttcctcccgcatgcaacgaggacttgagggaggccagcaggagagaagcgttggctttggtgaagttgcagcctgctgacgtgatggcctgaagttagccttcacaagcctttgtccctgttagtaacaccatgctccgagcccctctgtgtgtgtctctagtgggacatacaaagccacaggctgcttgtgcagagtgacgggacactcacccttatcctggtgagtaggcatggagaagtcccactcgttcctgtgcttggtttcttcagcagtgttttgtatgtcttcctgttagtatttatggcagtctgcttatatccttctgtatatcatcagtactgaattggtagaaaaataaagtgacaattcctaactgagactgttcatcaaacactgaatctct

SEQ ID NO: 28984 - DNA, 1148 bp, Mus musculus
ggggtcaggtggctcagggaatggggtcggtgtggtgacgctaactttttttttttttttgagatcaggactaaatagaacgtgactgcccaaactgtgatctagggatggagtttcccgctttctaaagctcggtgctttcttccctccgcaggagcctggcgcgacccccagccgtgcgccccgccccggcgccatgcattgcgaggtggccgaggcactttcggacaagaggccaaaggaggcccctggtgctcctggccagggccgcgggcctgtcagcctgggagcgcacatggccttcaggattgctgtgagtggtggcggctgcggggacgggaacccgctagacctgctgcctcggctaccggtgccaccaccacgtgcccacgatctccttcggccccggagccctcgagactatggtgtgtccaagaccggcagcgggaagggtgagttccaccgcaccagtgtgctgaccgcgggcatgctgaggtcaggtctgtggtaccggtgtctctgccaccggctctgtagggattctagaacttcatggaacttccttaagagttccttaatgtctcagtatctctgtagttgattgggactcgcctgtcagtctgaactgatgcctggaagcatccaatttaaaccaaataggcatgtttgagaaggagatgtgtatgtagaaagcttacattacataattttgcttctatatgtttctgatgaaagtcgtgtgaaatgtcaaaattttattgtacattagtatctagtaattttttctaagcaacggaaggcatattttgaactatcacagtctctctaagaaaggaaggaaggaagaaagaaagaaaagacaaaaccaaatggaggattttagtaggacctcttccttaggaacctcagttttctcatcggtcaaattaggaacttattatgccaaatgatttttctgactcctgacttaagttcttttgagcctgtaatctgggttgggtcaagtgttgacttagaagtgacttttctgtgcttggtgaagccaaggcaggcccagaacccgctatgggcaaattcagggacaggtgctggtagactcctgaagatattcacccaatcatagttaattattaccgacatgttattta

SEQ ID NO: 28985 - DNA, 1214 bp, Mus musculus
gactcttagactccccgagtccccagacttatcccctttaccctgtctgcactcctggactcttggggggctacaaaggaagggaaataacacccaaggatctactcctgtaccctgtaccccccacccccattcttaagaaagatgcctccagagcacgccggccttctgcagtgggggcagctggggaccggtgagctaggtgtgctgtgatctgacaggcacagccaggtaggaagtcttctgttgaagggctccatgctggcactctgcagacaggccggcctccctgttaattttgaagccttagaatgttcccaaggatcccgcggattcctgctcatgaaactgcgcaggtcagaggccacacgtgttttgcttttcttacttgaggtattatgtgttcaaggtagatttatgctacaacctttgcttattgacttgttctttcccccgtgaacctgatggaacatgacagacgatatttacaaggcacgtgtttccgattaaatcatgtgagacattaaagcccgataaatgaaaacccctttgaaaggccaagttcagaggaggaggccatccctggcggggccttgaaggtggaatcgtcccttcagctggctgcagaaagtgctgtggagggctggcaggccctttgcctgcatggggccatttgtcactttttcccagccagtgactatggctgcttaaaactccgaggagccctgctccctctcacctgcctagggcggcaggagggacaagatgctccttgagtacctactgtgtgctgggctctgttgcccgagtgagggctttcctgcagtctagcaggacagcccagaaactctgaggctgctgctatctagtagatggaataagagtggaaccagccaaatgtgaccacagtccccaggatgctctgctttcactgcctgtgaccctggtcaagtttcttaacctcaccatcttggtcccttcccccgtgaaatggggacagtaatattgtctctttaggtatgctccatggtacccaggcccatgtagtgttcattattaagattatactttctgcagacactaaaggcaggcagttatagctgcaatctaggcctttggaccacaaagtttttctcagtattacctaggtggttctgccgggtgatacaggccagtcagtgactaccaagtgtggcttggctgcctgctgctcc

SEQ ID NO: 28986 - DNA, 1157 bp, Mus musculus
ctcaggcttggacggctacttgccagagggtaactaggagtctggctccacccaagggtcttttcctatccctgtccctcaagtggagccacaaagcttgcaagtgatgcttgtggtgtggggtgtcccagattgcttcttcctctaggctcgatctaaacctcagaccccaaaccagagcaaatggtgctaatttgctgaatcccaaactgaacccagggattaattttttgtacctgaaccaagtctatgatttcttactggaaataaagagagaaggttctatttaatttaaagtctaaccgccttttctcctctacgattgcccggagttgcttggacaaggtcctgttggctgttggctctgggtgattttacaggctggggtggggatggagtggggagatacagtccccattgagagcttttgagggcaggtttggaggaaagggtggtagacagtgtcagctcaacagaagcagccagggggctggatggagtctgggtctttctgttccctgcttgtgtagtaagctctctggagatgggagagctggcctgttgcctggagtgaggggagtggggcgcaatgctctggaggtctgtgcatgaggtcagccacacaagctgatctgggtgatgctacctgccggcatggcttcgtttttcaatatcctcttaggtttccccgaagaccaaaggcaaattagggtgtccctgccggctgtggggcatcatggtccccttatttgaggctgaaccaggtacaaacccaagcctctgatatggggggggggtaatgggtgggatacaggcatctatgtccactcatcctgtctctctgtgtgctgcacgcaggtcagtaaacttctctaagcctcattgtaggcgtgggaaagatggcctagtgactaagggtgcactcatagtgtttctccaaaggacccaggtttggttcctagcacccacatcgtgcaactcacaaacactttaactccatgtccagggacttccagtgccttctggcatcagcaggcaccacatgtgtgtagtggacataaactcacacatcacacacacacatacataaataaaataaaaataaatgaattttttagaaatccagagaaataagaccctgaggtactgaatgtctt

SEQ ID NO: 28987 - DNA, 1193 bp, Mus musculus
ttccacggcagctttgtggattgggaccacttccttcatgatcctggttcttcccgttgtctttgagacagaaaagttgcagatgaagcaacagcagcaactgcagcagcggcagatacttttagggcctaacacagggctgtcaggaggaatgccaggggctctatctccacttcctggaaagatgtagattcttccttcggtatttgtccttgtgggagaactttgaaattcatttgtgtttgaactgctgattgttggaactttttattcttttttttttaaccttggcacatcgatctatttgaacatagtgggaactttctccgtttctcatggagagaccccaggtacacctgtaccctacataatgaagtccctcacttacttcttcctgttctcactccaatgctggagtacagccatgtggaaggttagcccactctctaataaactgctcctaaggaagttcttacgtacccattgtgggaaagaagtaagtacgcccgaccataaggccttttttaaaatggaagtgtctaggacatgtaagcactgtggcactgacaaaatccattatacctgtagtacaggagtcaccaggaatccctgtgtgtgccagagagaagggaggctggctgtagctttagccagagggggactgggcagagcaggcactcatttcctctgcagagtttggctcttagacctgcgtatgtataaaaaaagaagtcagcgctcactttttgtatttaaatattaaaagaactcgaactgaaaaaaaaaaagacgctctaactaagacaatggggtagcgaggggttcctttcaccgacacacagccacccagcacactttaaacctcttgagcactcaggcaatgtaatagaatggaaatcgttgttctgtgggcacttgagggacaacggcagggggaatctgtacgtgtccagtggatgcacctctttctttttcttctgagtgtttttgagcctcagacattgcggaccagtgacacgtttcccctaggctctttcgttttcagcttctctataaatgaactatcataaccatcccacaaagcagatggcgtcaggaatgaacgaggtggaatcttgtgacctggcccacagcaggttttgtgggctcatggcttccttcttttggtctttcagttggaagccagggggttc

SEQ ID NO: 28988 - DNA, 1796 bp, Mus musculus
gtgtgtgtgtgagtgtgtgtgtgtgtgtgtgtgtgtgtgtgtgtgtgtgtgtgtgtgtgtatgtgactttttttaaatttatgttgcggaaaggtaaccacaaagttatgatgaactgcaaacatccaaaggatgtgaaagtttttatatgtataatgttttatacactttttaactggttgcactacccgtgaagaattcatgggacagccactgctgagtgactaacatgatgcacataaccaaacggggccaatggtacaaacttcactcatcatttgaatacagtatttacagaggatgtttgagttgagagcttttttaggtttgaggggcttgatttttttgtaaataaaattatgctttgtggctatccatcaacataagtataaaaagaaagaacgcttcaacccccttccccatttagattatttattaacatatttcgaaagtaaggttagctctataaataatttagagaggtgagagtatttatttttggtatggctggctcactgcacagactctgtgtttatgtgtgtgtgtctgtgtgagagaagaaaaatctgtagagaagaggcacgcttatgactattgttcaaatacataaaaacagttattttaaaacagtccacaagaggggtgtctagttttcagagacacttcagaaactttgctcagaaaacagatgctacagtttgtgcaggcatgcggtaggaaaggtagatcacctctggctactcctgaggccctgctgagccagcaaaatgctttccagttcctctttggctctcacgatgcccacctaggctttctggccagtgtactgaacagtgctacaagccctcaggagctcaagatagcagagtccttctttcaaagcccagcttagtgaggacttgggtcaacttcagtaagcttcctctgaagcaactgaaggccgagcctttagagcaaccattgtcaacctttgtgggtcgcctaagagcatcgcaaaccagatatttacattatgattcataacagtgacaatcacagttatgaggtagaaaggaaagggattttatggttgggggttagtccaacaagagggacagtgttaatgcttctgaagcatcaggaaggttgaaagccactgctctagagccaagtgagtgcatgtctagggttcccatgtttacagtaaggaccggctcaggcactgaccctctgagtcacgtgaatgaggacgaagaatttggaataggtttggttacatctatttctcatccccttattttccaccatttaaaaataataaacatgtttcttaccaccgtatgttcatatggataagactaagtccaaaaaggtgactacatccaaatttatatttcggggaaataccatgagataattatagcatactgggcatgtgtccacacacggattggtttcactgctttataaataaaaggaacaactctgggtatttgtatagaattttcttcatatgtaacatctttccatttcctgagccttgggggtggggtgggagaatgccacttgctgtctgtgaagtccactgttggaaacataattccatagtcccagaaggaattcagtccccaccaacttactctttcaaagtgtggtcttcccgcgactctgcagctctgcagttcactccagctgaacgaccagggacaagtacaacacaggagtttggcttaagtggcagcagactaatatctaaagttgacataactgaaatctgacatttgaggcatatgtctccgcgtccccacacaccggct

SEQ ID NO: 28989 - DNA, 1207 bp, Mus musculus
agcctacctggtcaatgcatatcccctggatatgtcccaatattttcggcttttcaattcaactcgtatacccaaacccagtcgtgatgaactctttactgataccaaggctagacacctcctggtcctaagaaaaggacatttctatgtctttgatgtcctcgatcaagatgggaacattgtgaatccctcagaaatccaggcacatctaaagtacattctctcagacagcagccctgtgcccgagtttcccctggcttatttgaccagtgagaaccgagatgtctgggcagagctcagacagaagttgattcatggtggcaatgaggaaaccctgaggaaagtggactctgctgtcttctgcctctgcttagatgacttcccgatgaaggatcttgttcacttgtcacacaccatgctgcacggtgacggcacgaaccgctggtttgataagtcctttaacctcattgtagccaaagatggcactgctgcagtccacttcgagcatgcgtggggggatggtgtagcagtccttaggtttttcaatgaagtgttcagagacagcactcagacccctgccattgctccccagagccagccggccgccaccgactcctccgtgtctgtgcagaagctcagttttaagctcagcagtgctctaaaggctggcgtcaccgctgctaaggagaagtttgatgccaccatgaaaaccctcaccattgacgccattcagtttcagagaggtggcaaggaattcttgaagaagaagaagctgagccctgatgcagtggcccagctggccttccagatggctttcctgcgacagtatggccagacagtggctacctatgaatcctgcagcactgcagccttcaaacacggccgcacagagactattcgcccagcttccatctttactaagagatgctccgaggcatttgtcagggagccctccaagcacagtgtgggcgagcttcagcatatgatggctgagtgctccaaataccatggccagctgaccaaagaagcagcgatgggtaaggcatgctgggtaaggcacgggtggggagaacaccttgggtctggccctccgtgagcctcggtaatgctccactcacatccgatcccttacccaccactaggtttaatctacttgccaactcccaaatggtctttttcctgtgctgtgtcgaaacagccaaagcag

SEQ ID NO: 28990 - DNA, 1197 bp, Mus musculus
gtgctgtttcccacactgggcgttctctgtacagattactagttattgtcattagagtcacaggaaaagaaacaggagaactgttcatagtctaggcctctgctttgagatagtcatctacagactttaacaatacaatggcttccagttactgtgtcctgttctcctctgtcccaagctttatcttttttaattcctcgagatgacattattatctctcttttatgcaaatagaaactgagacctggagagatgagcatcttgtctgaagccacccagtttgaatgtggcagagctaggattcttacttggccccttttgacccagagctttcctcggtgcctctgtttggcctccagtggacaagtggttctgtgaggagccactggccttccagttccctaagtgtagacattttaagctgatctgtgctcttctctttggatcttatttccaggttctgggatatacttttgaggacccggagtctgagttcctggccaggaagctgtaaatcatgcatcccccactgtggtttgacctgtgttttcttgaaaattacaggaagacagaagtgttgtgtaaggattttgagaacggcattgggaaggagctgcatgcgcacctgctcgctcaggataaacagaataagcacaccagctacatctcaggtaggtgcgcgggtgggcggggtcatcatgcccctcaggcatcccagctccttcccttcctgtgtgtgtggacccagcacttaagcaggtgtgcactggcagctacacaagaccagtagcttgcctttacagtacatgggcttgagacagaacttaatcgattctgtctgaaaacgatgcaggagtcctgtgtcgtgagtgtccttcagttctgccctgctgtcctctgcagccttgtctcacttgcctctctgatgccagccagtcatgtgtcagccaacctgctgcgtctggcttcccgaactgtccccatggcctcatgcacatcctgtccctggcaggttggtccttcctcagccatccaggtagagcagttggtctgaggaaacccagttctctttgccttcggtctagagtctgtggtgttctctcctgttcttacacttaaaaaaagtaggtgtttttttaatttaaaaagttctggtggtgcaggccggtaggatatgccgaaggaggcagaggcagg

SEQ ID NO: 28991 - DNA, 1123 bp, Mus musculus
cagtaacagtagcacatccgtctctaagatggacagttggttttcctttacttctgttgttgaatactgtttttgataaaaaatggtgtccttgctgaggtttactgtataattgtctctatatcattgttgtcacaagtacaacacagtgcttcagctcagtacagccagcatcaccttagtgacaatggctacatcgtattccatggtaaggacacactgctttcttacccattggatgctacaacgccattgagcatcaaggtcaccctgtcttaccagactgccacagaagtgtccctggccactgccctcatgctgcttcacttcaactgtgtctcatggaaggagtagtgtctgggtgtctgtgtctgatgttccctcttctctttctcctcgtctcctgcacatgtctgctttagataagaaggctgactgcacaatcaccatggccgactcagacttgctggctttgatgactggaaaaatgaaccctcagtcggtgagtacaggggctctgaccctgacgggacagacatctataggaccatgttgtcctgggtattagagaagcctgaaatgtccctccacgtagtgtggaagaaacagatcggtaagagttcagctcagggagagagcttaccctataaagtgcctgccatacaagcatgagaccctgagtttgggtggctcgcacccggcatggctgcacatggctgcagtctcagtgcagcggagacagagacacatgaatccctggagctcgctggccagctagcctggtgagctggtgagctctagcttcagtgagaggtcctgtctcacaaaataaagtcagtctctctccctctccctcctccctcctccctccttcctcctccctcctccctctccctcctccctcctccctctccctcctccctctccctccccctccccctccccctctccctctccctctccctctccctctccaaacacatccactatgccattcctggtctgtggtcagcccacacggaggaaagaacaggcctctggaaaggcttaacacacagagttagcaggcgtggtagaagggaacactttagggaggaagaagtgaggttggacacggtcttct

SEQ ID NO: 28992 - DNA, 1194 bp, Mus musculus
agctttgtattagaggcagtgagtttcttgcttcaccattttagtatgtgcctgcaagttctcacatgtaaaaggtgcaatgtataatttccaccataggtgaggtccacaatgattctatgacccgcttccctagtcctttggttctttttctctctgctgagacagggtctcactatgtaacactgtcctggaactctgtgtgaaccaggctggcctcaaactcatgaatccacctgcgtctgcctcccaagtcctgggattaaaagcattcgcccagccagctctttatttctttgtgtaggtttccagcagcccttactctgcccatcttgcaacccctgctctgtttgctgcctctgtagtttgccagtgagatcataaaaaggcaaattatagaggcactcttaattttagctcccattgatgatattctgctctaaggaagaaatttccctccttttcctgtctttaagtgtattcatatacactgcatgaagtcacaaggccttattttatccttgagatcacagtcctttagtatcaattattttgttgcagtgactgcccctggtttggccagtggggaccctctcaaggtgaccctgtgtccccgagtctgtgtaggccttcctttctctcttttctggctcgagaagttactccaatctcttcttccactttgtttttacagtttttagtatttatgtgcttttgggcttggctatgcagtaagtgaaggcaccagcccccccccccccccaagctgggattacataggtggttctaagctgcctgatgtgggaaccacatctgggtccatgtccgcagcccctcttgtcctttctatggcccatgcctagccccgtcatttctccaaggagtcttggtttcctttagtggaaagtgatgctgagacacccaccatacatggctgctggctagctcatccttgccactgccaggccttctcaggagacacatatgtgaattatattagtttagcttgtttttaagtagaaacttaggggtaatattaggtggcttatgtgttgttaatactcaccactggtttttagcagttagagcaggaatttagaaaactagttaagcaccatttgtagatggtgtcacttttgttttgtggggttttatttatttatttatttatttattggtggttgttttccaggc

SEQ ID NO: 28993 - DNA, 2626 bp, Mus musculus
ctagacgtgtgctatctttcaaatacaaattgtgatgtgaaggtgatctggtgtgacatctataatatcattaatgccatgtaagcagtgaactacttcatccccgcatctcagttcctttcaggtctggtgcagttgacagataagaattgacagataaactaatatcctgagacctgcccttgtgttatataactaaccaccagcccaaacacaggtacatgagctgaggaccgtatgaggacctgctgcccccccctccccccagccaattggctaggatgacaaatcctgaccagtagagtcttacctccattcctctgtcgatggcaactttgcccaggcgcacagcaatgggagcctaggagagagaacatcccgggtcttgaacttgaacttggaatgtgtagctcttacaaaggaaggtgcaggtctgggtctgggtccagctttcccactggtagggattatttctgttctgttcatccttctatgtcttaaagcttcctcccagaagttgtctttcagcctattctccaacatgcccttcacattagtctttggtgctggacattaaacctagaacttcacccaagctgggcaagtgctctcctacagccttagacccacagtgggcccctcacttccgagcaaacacttgctgagctgctgaggcctgtctttccctgtggtccttagcctcagattataggcatatgccacgtggtcagagtccttatggaaaatacattatattgatgcgaaatagaggctcatgggatggaagcactgggccacatattcagtgagtctcccaactcccagtcacctccccattgctgttcctccccacccagccctcatcccagcaagtgctagtgtttgagtttctatttggtttgtttgccatgagtgataataaacagtactgattttgtcattaaagtaaaaacttaatgttccccagaacagcacgtaggaggtagaggcaggaagatgaatttcaggctacatgagactccagctcaaaactgcaaaaattttaaaaatttaaaaaacattagcatgtttctggctatgtgactatattaaaattagaatacagtggataaaatttcagatgttacttgggaaccagtagtgtgtcttagtatgtctattcctgatatctaaatggaaaccagtcagctcctttagtcaatcttactgcatctacactccagaaccactccctcttcagtggtttgcccactaggtgctaactgctcatgccatccctatactaaaagttctagcagtggaaaaagtgaccagtgtaggtagacagccagtattatggtacacgaaggtgtatgtttgctttactttagaggccaggtatcattatgtagctctggctagcctggaacttgctatgtagaccaggtgggcctctgtcaggtttaaaggtgtgttaccattcctggctttttatttttggtggcgctaaggattggacctagctagtcttgtgtactagggaagcactgagttacacacacacacacacacacatacacaccctttcccttggctactttagaagccccaaatgcccataactctagggtaaggccactgtctcatactccactatttggaggcctgaatcaccttgaacttgttgagtgtactcaaaaggcaaaacccagcctctgtgtccagctggcttgctaacttggttccctctgtggaggtttcagtcactccgttggtcattctgagttctatatgagtcagggacactttccacctatagactgtcccttgccaaagaaaacacagaaaattggtgtgaaacaaattagttgtccctgactcctaaattaaagaacagtgtaagcgagggattatctcactttaagaactggagaagttccccttttctgtggggaaaaaaatcacttgcaggtctggagacttaagacgggatctaagtaggacaggttggtcttgaactcaaagaaatccacctacctcaaccttctgagtgctaggattacagttagctgccacaactggcgtcatatgtaaggacagggtttctctgtgtagccctggctgttctggagctcactctgtagcccaggctggcctcgatctcactgaggttctcctgcttctgtttcccaagttctgcgattaaaggtgtggctcaaatgtaaatttaatgttaaactgatgtatggctaatatttttgtaagtttatattttggcagttttgttacactttaaaatgttttggaattaatatatttgacctcaaagttattaaaattttggtacatattctacttcttatgagtgtctatgtgtttgtatgtatgcatacctgtgttggtgtgtggagaccaggtgacagcctcagcctcactctcacatttcctccttggggatgctggtccacatttttggagacatgatctctcattggttccccgattaagccctagctttttttttttttttcctttgtcagttctggggattgaactcagattctcatgctgggaagcaaacattttgcttgcttccgtccctagtcccatattctgaaatctcaaaaatcggccttgttgcgattgg

SEQ ID NO: 28994 - DNA, 2704 bp, Mus musculus
atttaagtaaaatataatcccatcatttatctcatcccttttctttcccctacacctcacctcttgtctccacccccacccccccaagtttacaggttccttattttaactatttttgtgacatatacatataaatgaatcaacatgacctgcactccggtgtgggatgtatctagagctctctctcttgaacccagatgaaccgccatgtgaaggaaaacacaatacaaacttagttcagaaatgacagtaacccaatctcttggctcagggcagcaactaaaatcctaatcttctaagccttattaaatctaaatcctttggtggtgaatctattattcagatctgctattgaagccaggagacactggtagctacatcttgctctcatactatccctgtccaaaaggtcggtctctttctctatctcacaacagcatctttctataccgggtaccccttcaagtttgtttttcctaatagtccactggggtcctctgcttactcagcagatcaggaaggttggctgtgaggatggtgttgattctaaggccctgactcttgaagctttggcagcacatcagcaatatagctggtgtgtgtcccaacccatgcttccatgactccagaccaagcttgtgctgaggatgctcagccagagctcaggtcttggtggagggtgatccctaggcaaccttgctaggagaggaggcaggcacttaggtatgcagaggtctgaggagctgactctgtatcccctttattttccaagctgacaccttccaactcacctttgctggtgccaattcaaatgccgcttgtcctgcaggcaccaggtccactgttgcccacctgattccctgtctcttctctttgtcagtgctcctggagactactaaagaaaggtcttcctgccccccaccccccaaggcatcccagccccaacaattccagcacaagctaacagttgcagcatgtttattaacacagggatatcagagagactgatagagaggttaaatagtttgtccagaattccccttgcgttacagagagctggagggctcctgacactaactcaaagaaactctgtgagagtaagtaagtcctcattgctctatccatggtgatcagagccaatgacaaagacccgaagtttttgaatgcagagagtccagtcactagccaaggtgagcagtatggaaggtggcagtgcactgcatggtcagtaccttggttctctggatgatctagactttatggtgtgtgcttaaagttagctgggtcacttgcccacaaatttgggagctcgtttctccctgaaggctgccattccttccagcctgtcctgggttgggatgttctgcaaagatacaatggatattagtttgggaggaataggaccagaggccaaaaaaaggccattgcataagtagatctaacctctgacaacatctgggtcattgtgagcctcagacactgctgtctcaggaaggccagcttctagcggtgtgcagtcactactggcctctgcagagctcagagtcctctctgagaatgatctgggttctgttcacaagtcccaggactccttgcttaggattttttctatttgttatggtggagaggaggctttctgaatgttctaggcaagcctaagcatagcaacttcagtttagcccagtgccgggcagcagaagccactttctctgattaaggagagtctccaggtgaagaaagacctgtgagtcccttggagctactcgggttagttaggaggcactggcatagttaaactgcataaggtttgccttgcccccaagtgtgcacaaacaaacagtagttatatacctgggcatagcacatctgttctatggccatccctgatgcaatgtccacctgcaaaaacataatccccaagtcaatatgactttgtccaaccacatctacacagaagagccggcccaccctactgcctgtaccagtctgaacagaaatgattgccacttagtaactggtgcctggatgtcccaatagtggtaaagggtgctgagagaagtggggtggggggttaatgtgtgatgtggctgttaggtataggtggcttcttccagatatagaaacacgggctacatgtttcagccagtgtctcttccccctgactgcctggccatgccttttgttactctagggatagtctttgacaggacttaggaatgaggttccagtctttatgacactggtgtagtcactagtaagcatggttcctaacttactttccaaagcacgtgtttgtatctgttaatgcatgggagaagggtgtggtgatctaaccagggtcccaggggctttacatcttgtcattcctaatccaatcaatcctcttctatgcctgtcttcctgtttgtactttaacttttctctggaaattcccctgccgccattcactaaagcacccatacacactcacatgccccaaatcaaggaatcagggcttcaggaatgtgagggagagtagtttcgggtaatcacgagttctcaactgaattctgggatgataggtgccatcatgacttcccactaatcttcagctcaagcaaacatcctttgttattttctgagatggggttcctctgcatagccctggctagccttgaaatccatgatcttcctgcctccagagtgctggtattaaaagcatgcc

SEQ ID NO: 28995 - DNA, 1107 bp, Mus musculus
gcgaccggagacctccacaaccccagggccctttgtgacctagcggcctttcaggggtgctgcttcttaaagacagggtttctttttgtctttgagcaatgggagtttgaaaccagtttttgggtttaccaattgttagcatttatcaattgactggttacttttctctgtgacaaaaagattgggtcctgggctgggccgtggaaggcagagacaggtggatctctgtgatttgagtccagccagggctacacagaaaaaccctgtcttgagaaaacaagaaatgattgggtcctttctattccttcagaagagggaaggaaactttagggagaccttggtcttgttccatttcctcagctgctccaggttatgtgtggccgagactggccttgagctcagcaatcctgctgtttcagtgctggggcttccagcatgagctgccacaccctggcgcctttaatgttcttttccctccaatttgaggaatcagatcattgagtgtgtgaatgtgtggggttgaagcgcaggcctggactgaagttagaatacattggaaattctcactttggaaaagctctgaccaaagctgagagaaaaagactgcagaacatttcagtgcatgcttttcctgatgtggacacaaagcgggtggttttatgagaaccatccctggcagtagtgaacaccatccagtctgtcctgcaaaactggaacagagtgtggacgccttcctttccctgttgagaagtagttttcactcagtcaagttttgaagaatggaagtaaatagcaaattcctctgtgcgtgtgtgtgtgtgtgtgtgagagagagagagagagagagagttttgcatgtttgagcctggtgtccactaaggtcaggactggaactggggccaccacatgggtgttgggaaccaaaccccagtcctctggaagagcagcagatgatcttaactgctgagccatctctgcaggccctggatgttagagttttgtgcttttagctagtgtggtccggacttagtatgtacacgcatgtttgtgtgtacatccatgcacgcgtgcaagtaagcacctgcagagggcaaaagagtattgaat

SEQ ID NO: 28996 - DNA, 1103 bp, Mus musculus
gagttaagttttttttgttcgttcattattgagtcagagtaagactcaagtgtatgagtcaaatgtgtgtcgctcttgctgtcttagcacttgctatgtagaccagccctgcctctgcctcccgaatgctgggattaaaggcacatgctaatacaccaggctcttttagccttattttaatcaactttagagcaagatattctttaattaatgaaaagttaagacactttcataaagggaagtcttttatagcatttttttcctcaaaaaaaaaaaaaatcaatgttacatgaagatttgaattctcagataatatgtagacacgtttttttagtcactgacttgtgggccagtgagatggctcagtaggtaaaggtgcttgctgccaagcccgagttcaattccctatggtggaaggagagaactgagtctcacaagttgtcctctatctccatgtgtgcatcatgtacactcatgctccatattaaatagataagtaaatataccaaacttaatcaacgtttaacatctccattcagaggcagagagcagaaggattgtgagttgggaggccggcttgagctactgaatgaggtccaggccatcttgggctacataaaagatcatgtctgaaaaatccaaaaaaaagtaactaaattagtgacgaaatctccgttgtttaggattcctctgtgaaagactggacttatgattatgagaagctgtcttttgcttgaattctcatgggatttaactctttccaagaaatgcaaaacccatcagaaagttgaatgtgtgtgcatttcagatacaattctggattgtctgggctgaaggtattccagttatggcctggtaaacaggagtattctgcacgtaaatcatgctgtatattcagatggaacatcacttaagtattaatgttgtatgtacagattgagatttttttttgcctaaataaatgttacaaattttatgtaaagtgtggtctactttcacgtcagatactttgaaatttagttttaagtcaagctccatattccttagtaaatccattgtactttcagaaatctacaaaagtctgtctactagagcatcattcc

SEQ ID NO: 28997 - DNA, 1709 bp, Mus musculus
tctgaagtttgttttccttctgggttgagagtgcaactcagctcagtactggagggaagcacaccgatttcaactcctactatcagaaaaggaaaagatgatatttaatgttttcttttttaagttatcaataaaaccataaatcaagaataggggctgggcggtggtggcacacacctttaattccagcacttgggaggcagaggcagctatatatctctgtgagttcaaggtctggtctacatagctctaggaagccagggctatatagagagaccttgtctccaaaacaaaacaacaccaatcataaaaatccatttaataaagttctcttactaatgagtccttttaggctggtctctggtcaatttttgacttttttcctttgtctcatggaatcagagctagcttaaaactctcaaccatcctgcctacgtccctcagcacaccccttgcttagctttttagtcccttcgttgtggtggtttgaaattacaggtgtgttaggataatactggtttgtctttgatgctctttgaccataggttccccccttggtacgtgctgatgaaaacatttaatgtgccaaattgggataaattaaggaacagtaaatttggctcagtttttggttgtttgactttgttctgtgagacaggctcttttgtagcccaagctggtctcaagctcactgtgtatctgaggatgacttgctactctgcctgcctccccaggccatgctgggatcacagtcatggccactatccccagatactttttgccttttttgagataggatcttgatatatattccatgctggccttagacctctgagtgctgagattatgggaatgcactaagccaggtttgctccatgtttcaaaatgcatcctcctcctcccccaagctcagaacaatatataaccatattcaaagttgaaaataggagaagaggggacagaaatgagccattttgtaatggtaacctgcaatctgtctcctctccaatggcacatttttatcagttggttactgtgggactttaattgggttttaaacagtgttaataagctaaaggcatagattaagtgccttctcttagctgatgtgggctcctccagttctacctacatacttatgttgagagagtgtttgggtcagatctgctctgagactgcttcccaagaggtttgcaaactgttttccttcataaaccctgtgtagtgacttcagatgacctcgtttatctcatggatattggatgtttagtccttgtcatttgctatgtgttgacacagttttaattttcagtgtttactcaaaagttttcattttagtaatgatgcaaaccccaccagtgataggaataagagtatggtagagaagtttgcattggtttttaggctcatcacggcgtgtgttccctaggatctcatggactttgcatgatgtggcacactatggcaaatgcagttgtttgtttccaagacttaacccaagacactgatgactaatagcctaagaaaaagaactttctcccgcctttccactgatctactttttaaaaaaattaattatgcaaaactgaatgcagtttcttactactgtgctgacagggtgcctctttaggacacagcctagctgacagatcagtgacaagtaaaaatatgccagcagtttagtagcttatgcttgtgaccctaatgtg

SEQ ID NO: 28998 - DNA, 2110 bp, Mus musculus
tggttttgatcggttagtttttaggcagttgcctttcctataagataattgatatatgaagaatcagttatcatcctatgaacccgggaggcagcaagttagcaacaaacttaaattccactataattttaagttgggaataattcagatttataatccagtaatagcaaggatgagacagaaggaactacagttggagaccacagagttgcaagccagcctgggctacatgggaaagaccctttctcacgaaacaaaacaaatattttaagggggtcttggtggcacttgcccttaattcaaaacactaaggaacaggtggctttcagggccagcatggactagacagcaagagcccatctcaaaacaaaccaggatgctcacatcttgttttgtaaataggtttaatctgaaatctcttctgaccacattcatacatgtctcaaatgttttccgtagttttaaagtaagtcaggaatgtttcagtttagaaaggagctagattaagctgtgcatctgagtgtgcacctgtaccctagtgcatagaagacaaaggtgagaggaatatgagttctgaaccagcctggactataaagagtgaccagcaagcttattgctagtatgcttttaccatgtctgactcatgtttcatactactgtcacactccttggacttgaatgtttcaggcttcctttataaggacaaatactgaatcaaactgaaagaaaacagacacatagaattatcaaaaagccatataaaactatggtttatttcttacttcattggttcaaggaattttaagagctatacgatacatttttacccaagatggttgctcagattcaccactggagacaagattgccattctgagactagcctgggctacctagtgatgcttgtctcagcagcctccatctcaaaagatgtctttttcatagttaaacacatttggaaaaaagaaaattctttcaaaggagtagtttttgctttttgttgacatttccccctcaattttaacgtctaagacaaagttctgataatatgatgtagtctacaataactagcaagcttgtggtgttgatttgccaagcttacaaagtacacttgtgaaatagttgagaactttggctccaagtgtcatgaccaaagtacatgtgctataggctattgctaaccttttacaaagtttcagaaaaataagtcaggtgtggtagagttcacctgtaatcccagtattagcagctgcgtagcaaattcagaaccaacgtttggttacctgatatcctatctggagaagcagaaccagacagaaatggtcaaaaggtctacagagtgattgagaataacctgatacatgaaggctcaaaaccaattcaatttatattctccaggccagtcagggctagattgccccaaaacaaacaaacaaacaaaacttaaaaacaaaagcccacaaactcaaagtgacagattgtatcccaagtaaatcaagctattagtgcccgtgttttatttttgtttttgagtctcaccatgtgtagacccaaggctgtagtctatattgatctcattcagttgacattcctgagtgagtggtaggattccacacatgtgctaccatgtctggctaagggatagctcttgctttgttttgtttgtttttgtttttccagacagggtttttctgtgtagtcctggctgtcctagaactccctctgtaaactaggctggcctcaaactcagagcttccagagtgctgggattaaagctaaaatgtagtaaatacatatgtgtatttataaattacgaatgtccagccagcttctacaggcctcccatttgtaattggttggtacttccaaagccactggcctagtggtgtgctttcaggcatagtttagactgacctgaatggccttgttgaactaactcatcagtatgctcagacaccagccatagggtcaggagtagcaagacttggatctgctggaagaaacacatgcacaaggacccaggttcagttcctgccagagaggaaacagaattatgagactttgtaagactggagtcgaataaagcaaaatatagatatcaaagcatctgg

SEQ ID NO: 28999 - DNA, 1134 bp, Mus musculus
gcagaagttttacacacaggcatagctcctctgcatgttgaccatgtagccagcctgtgtcttcatctagaaatggacttgtaggtttttttttgtttttttggggggtttttttttacttgtagttttttaatggctttttaaccctcctagagatgtggtgaaggtcagctctttctctcctagcaatcacctcccctgctcaagagaaacatgggcagttcctactgtgtgatacggtatattgttaacaaatatttgttgtaggaaaaccatgaacacagtggggtacttaggaaatcaacagagaaattggccatgggtgtggcaatggtgggggagaaaaggctgcaggaggaagctacctcagattgctgtttttcaggctccaaggagatgtcacctgaccaccatggtttgaacacagcaatcccgatggaggtaccaggggtaagctctccccggcagagttcatcctcgaacacacatctggaaagcaacaagaagcagaccgtgagccccacatgtctcccccagaaccagttcatggccacagtgactgctagcaacattccaggcagtcctgacgagatctctgtccccacccctggcccacacggaccagtcccataaacatccaataaaagtctttgcatcattacttctggaatctctttttttttggtgaaaatgtggggatacgaagagccaaagagactttggagcccagtaagatgcatgagggcttttcctaacaaaagcaccaaggtcttgttatagacccagctgtcttgttcagcctgaccaactgaggacgtgagtcacgtgggttactaacaacagcacacaatccagaaacctgaggtagtggagtctcagagaagccctccttctgaaaagtcctgacttgtttttctgtggcttctctgccccagagttgtgtgtgtaaaagtccctgggacggggagctatactcaaagggtagatttacttgtctaccctgccacctgtcctggagtgagcccctgttaggtacacagtgagagggagcacagcagaggctccaccacagtgagagggagcacggcaaaggccccaccacagtgagagggagcatgacacaagccaccatca

SEQ ID NO: 29000 - DNA, 1158 bp, Mus musculus
gccttcaaagaagtccttttttttattctatatggaacctagttgtcaaaataaggtccttaggcttggtggcaaatgtctgagccactgagccatcccactagtcctagcctatgattagactttctactaggccctatgtttaaaagtttccatcacctttgttattgatgagtaagcgtgggccttttgcaaaaaatgagatccaagttgtgtagcataggttattctggttttaatatatttgaggtgcctttataaaaccacaatgcatttgggcattttcatcatcagtgcacaaatgttatactgcaaaacatttttgttttgttttgttttttgaccatagttcttagttcaaaactttatcctgaaggcagacttgactagccagtaagtaagctcctgggatctgccttttcacctctggttgcccactgctaggagtacagatgtgcagcattgcgctgggcttttatatggtgattgggatttgaagtcaagtcttcatgtttttgcagcagatactttgtccatttagctatctcttcaggccactttatctgtatctcttaaattgtcctttatgaatgtttataaaaataatgtttgttacatttcactccagatttatttatatgtttgctagaaaataaatgctgtgtaattttcagggcccaatacaatagagtctcttgtttaaaaagtaggaacaaatccctattaagctgctagaatatacagtttattctttattaaggatatttttttgttttggaactcactaaatttaactgttttgtgagtatggatttgtagctaggcattggagcctggctggttcagtagtgggcacacaactggagaatattatatccatctcccattttccagtgtggcaataggtgaataaggtctttgcatttaatttagcatgtatgtgtgcacatgcacatgccatagcacatgcatatgtggaggtcagagagcaacttgtgggagacagttttctcttttctactatgtgggttttgagattgatcttagactatcaggcctgttgataaatacctttacccactgaaccatctcatttgccctagtgaggtttttataaaacagaacaaagaaagctaggaaccaaagttttttggaaac

SEQ ID NO: 29001 - DNA, 1337 bp, Mus musculus
aaatacctaataaaaaatggaaaaaaaaatatacgaaaatccatcaatgtaatccaaaaaaaaaaaaaaaaaaaaaaaaaagaattgagcccggccaataccctatttattttaacacttgagcatgtaagacaagtgtggcaagatgcttgcaagttcaaggctagactacacagtaaaatcctgtatcaaaacatgggggatgtgttcaggaaatcagtaacgtgggtattatattctgaatggtaagattccagattatttcttaggtttcatttttatttggactttttgtaaaacaaaacaaaaacagtgaagaacgagctactgtgtttcacatgagtgaagaaagctcaatgctagaacttttttctattttattttgcagctgtgctatattgactcccaaactgatggtggaatcccttcttactgctttgctttgatggtgatgttttttcttcaacaaagaaaaccccctcttcttccttgcttacttggaagttgggtaagcatgcgtttgcattgcagtgtgtgtgtgtgtgtgtgtgtgtgtgtgtgtgtgtgtgtgtgtgtagttcttatggagtgttgtgctcaaacattttaaggtggaattctagtttctctattttttctctttctctctcttttattttttaataattttttattactaatttggaatgcccatttatatagattgaaggctttgacccgaaaagaatggatgactttcagctgaagggcatagtagaagagaagtttgtgaagtgggaatataattcaagtagtgcaactgagaaaaacttaattgctgatgaaaacaaagctaaggcagacgaaccaaaagatgataccaagaagacagaaacagacaaccaaagtaatgctgcgaaggcaaaacatggcaaagtaagcttttgtttttgttttttgttttggcttttctacatgtagaatttatgacacctttagtgaacttcttgaatagcagtagattgagctcttggcctcatttcctcaactatacagtgaggggttgaactgttttagtttttggtactgagattatctaatacatttatttcatgtattgtttgaatcctgtcaaggcaattaattctgtttcctcattcctttcctatcctttttttttttttctttcttttctttctttcttgatttttttcaagacagggtttctctgtgtagccctggctgtcctggaactcactttgtagaccgggctggcctcaaactcagaaatccacctgcctctgtctcctaagtgctgggattaaaggcgtgtaccaccactgcttggcctgtttcct

SEQ ID NO: 29002 - DNA, 1156 bp, Mus musculus
tcattgctatgtagagatctgaggatgtgtctttggagaaggagtgaggcacacatattcttaagacatttgtatgatccccttgggaaggaaaaagtaatataaatgaagactggaacactgcaagaacattagaaaatcatttgctagtgtcaggcaatttgaaatagtagagaaagtcagtcaagatgaagtgtcaaggttgcagggaggtagattgatttgtagggaacttggaaatctggacaagatttaagtgggtgcgttggtaactgaacctgttgagatggaggaaaataagggaaagagctaaatatctaaagaaagcagtattaattagttttcaaaaggtaaatgcatgtgtagaatataggggagattatcaggtaaaatatacatatgtgctttaaggttttcttctttgtctctttgcccgttctctagtttcatttatgggtttaaagtcataaaagtaaataagcagtaaaaatattgagagtcaaaatttttaagttaaaaatctgaaaattttttatattttgttttcatgtttctttttctctttaatatagatgaattatcaccaccttgctctgaacaacacaacagggaacaaattttaattggcttggaaaagtttattcaaaaagaatatgatggtatgtcataggctaaaagttggttgttattgctactataatcacatagttttgagtttgattgacttaatgtttaactgttatatgttatatactattttagtctctgtggctgtgttactaataacagagataagaactgcttgcatgaggagtatatttaagacaggatagtagtcaacttgagagataaatataaatatttcagtaaatattaaatgatattaaaagtattgtgataaaagaagtgataggttgggtagtaaatcccttttgaggtagcatttgagttgagtctgaataatatgaaggaacaaattatatgaaatcctggagagtacattatgtaaaggaagggtagattccaagacttagattctatctgatgtgtttagagaccaactgggaggtccagtatgtttggagtggaatatgcaagataggttgtaaatagaaagacaaggtcatagagatattttaaggactagatcattaga

SEQ ID NO: 29003 - DNA, 1218 bp, Mus musculus
gagatcagtgtggtctagtgagttccagatcagccatggctcttagagaaagagtccttgtctttaaaaaatattttaaataaattaatatttatgaatattttgcttgcatgtatgtatgtgcagcatttgtctgcttggtatctttagaggttagaagacaagttgtgagtttattgcaactagaattaaggatgattgtgagccatcaggtgggtagtaggaattgaacctgcagccttctgaaagagcaatcgttgcttttttttaaaaagaattattcattttattgtatatgagtacactgtacagatggttgtgaaccaccacatgattggtgggaactgaactcaggacctctggaagagcagtcagtgctcttaacccctgagccatctctccatctccttgttacactgatttctacatttagttgtaatatataaaaatgcctgttttctcacaattttgtaatttgttacaaaatttctgggtatctttcagttcagtgagttttaaaaataaagtaacagagtagtcagtggtttgtggaatgagtttaatttttatttgtaatcattgtattttttagcgctgtgacattggagatgcatctcggggaagtttatcttcatatgcttacatccttatggtgctgtactttctgcagcaaagaaagccaccagttatcccagttctacaagaggtgagtgtttaagaatattataagcccaaagcatagtggctgatgcctgtagtcccaacactcgggactacaaagaaagaagtgtaatcattaggcgtttaatgccagcctgtgttatgtagtgtgtttcagaacacactaggcaactgagcaagaacttgtctcacaaagaactgttacaggtgcttttaaataaatcatggatttaaacaggagatcttgctgaggtcatgatggattttctgtcatcgatgtttttttgttaaaattaatgctataattaaaatagtgaaccttttgggaaattttactattggagtgtattgactaccatagtaattgttgagtatcttcggtaatattttaaaattttgaagtcttagaatactgaagataagctgggcagtggtggcacatgactttaatcttaccacccatgaggcagaggcacgcagatttgagtttgaagtcaacctggtttacagagtgagtctaggacaaccagggctata

SEQ ID NO: 29004 - DNA, 1102 bp, Mus musculus
acgccaacaagccataagtaataataaatgtgtatggagaatctcagcttgggttaggtatttcattaatcacttacttggcatcaagctataacattctaatgtttttccttgggaagtaattcattaatgttttttgtagataaatcctaaaatgatccggtcttgtaggttattaggttggataacttaaaatctaataataatactttttatgcagatctttgatgggaagcagattccgcagagaatggttgatggatggaatgcctttttctttgataaaacagaagagctggtaatttttgtataattattacattatagtatactggatggcattaggatatgcatactttaataattttacttgtttttattctttatatttttaataatatgtaacctttctcttctttttccttatcctcctcttcccatatttctcttttccttcccattttgttaactgaagaaaaagcgtttaccttcacttgggaagaacacggaatcactgggagagctttggttaggactgcttcgcttctatacagaagagtttgattttaaggagtatgtaatcagtattcggcagaagaagctgctgaccacttttgaaaagcagtggacttctaaatgcattgcaattgaaggtgactgtttacattactttcaattcaagaacacaaaaatttagcagggaaagctgatctaaaaagagtcaacctcttgttttcaatcacttaattttaagaggataattcactcacttggatagtttgcgagtatatagcactagactcctgtttggcacactctactttatggcataatatttataaatattaatttatgaatatttcttttctagatccttttgacttgaatcataaccttggtgctggtgtttctagaaaaagtaagttttaaaagtagagaatatgtgcattcaaatttctgataagtagtgtctaaatcttttgttatattctttcttcaacagtgactaattttattatgaaggcgtttatcaatggaaggaaactttttggtacccccttttatccactcattggcagagaagctgtaagtttatatttga

SEQ ID NO: 29005 - DNA, 1125 bp, Mus musculus
gccaatttcattaccatgtgcaaatgatttaaatctctgaggtgcagtttcttttttcataaattgtagttgaaaataacatttaatttattgaggttccacttctctgtagcctctttgcattgtactctataatgtggtggatacaaagtattagttctgttaccacctatgactttataataattctaattttttaaatcaattaattatttttgttttaagccaaggtttctctttgtatgtctggctttcctagaacttgctctgttgaccaggctggcctcaaacttaagagatctacctgcctctgtcttccaagtaataggtaaagatgtgtgccaccaccaccacctggcataattctaaattttatttattttgtccaaaatttcaattacagtgaaatatttgctaatgttgggactttttttcatatcgatctttgtattttggacattttacatttttttaataataaaattgtattatttctataggagtacttctttgattcaagagtactaacagatggagagttggctcctaatgatcgttgttgccgtgtgtgtggaaaaataggtcactacatgaaagactgtcccaaaaggaaaaggttggtaaatcattttctattaacattatagggaaagtatatgtgagactaacttgtatttataattttattcagaagtgtcttaagtacgaaagtttaatttttttaagttcaaggtttttaattggcttttaagtaaataaatgttcatctgagaggaatttttgttaatggtactcttatatcatttgcttattcactcagttttttttaaatagaaatgtttattgaaacatgctatgtgtttggaactgctatgagcaagaagaaaaggacttcctagttaatgcaagttcatacagtaaactgaatcctagagctacatgttgggctgtatctgtatatgatttgaattgagaaacacatgtcctttataccacctcaagatatatctgctggtctggacatggtggcacacacctttaatcccagcacttgggaggcagaggcagggaaatctgtgaattacagacctatgtaatagaaagatcctgtctcagaacagcagc

SEQ ID NO: 29006 - DNA, 1306 bp, Mus musculus
gtttatctcttgagcagagatctaaaactgaagaagtcctgtcagctataaaagaatttgcagtttttctacgtgtgaggttctttcccttgtttcttgccctttgtttcctgtcttcatacacctatatttgtttttcctccaaatgttgttatgtggatttttaaaaacactgtataactagctaacaaatttattttaaagggggagttgaggtaagtagatacaaatccttcaatctgctctctgtattgtctccagcagacagatgtgccacgcgtcgctgtagagagcgctgtccccacccaccacgaggaaacgtgtccgagtaatgccagcccacagcaaccagccaatcctgctgtctcaagggtatccgtacctcagtgtcagttacactcagcagaaaaagtgacattaaggaaaacaaaacaaatcaggttctgatttaaaattttaacacacgtttagatagcttatttaaattctaagactgtttttaaacactgtattatttgtatataaatatgaactatagtttttactggtatcactaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatatattgttcttaaggattaggaaaggatttcatgtgttttaaatttgtcacttctattctttacagaaccttgtagtgccaaaaactttttaaaaggtcaaaaaaaaaaataaaattacaacataaagattctgaaatgtttttcctttacatacttgtatattgaatatattcaaatttgaatggaaagttgcttttgtctgtatttgaagttctattttaagttaataaatctttttgacaagagtcaaatttggttaattcatctggtatagatgttagaaatacatttgtaataattgaaagaatttactctcagtgactgttccagatcagacttagttttagagattcaaagatctttcccccatttttctggattttcacaaccaccgtataaaggtgatagaagcaaatgctgtgtccatatgtgtccattgaaaatgaagactgaagagcagagcagtggagtgaattccaaaggtagcagtttgactcaaaatagatcattcgagggttgtagttgatttacagagagctttcccaatgtgcaagagactatgttcaatctgtagcagtgcctttcctcc

SEQ ID NO: 29007 - DNA, 1099 bp, Mus musculus
ctactgtggacagatcctctgttgagattccttttttccaggtgactgggttgtcaactggacaacggactcaataaataaaatgtagatatgacagtcacagcttccagcctgcatatgcactcaagtatatgtgcacattcaacatcatgtaacatacacaaatacaagtaaaattgcactgggtaaacctgtaatcccagcactgaggaggaaaaagtgggagatgtcactaaaaccaccacattatatctaatgttgatgtcacctgtactctgtgtcatcttatttgctacttaattgaatgattttcatctgttccatttcaggtctaagaaaagccacaagaagagccggaggggaaatgagtaatggatgcatcttgactttggtccaaatgacctcctgtggctatgagagcatctgtttaagtggaatgatcaagatctcctcttcaggcagctatgagtattttgggtttttcaaaatcaacttcttcttttgttgggttttgtttttattttaatattacagaggtgctaagttttgtatctctttggattataaccaacagctttgaagagtgtttttgaccaaatcaaggtcaagttttggcctaacccactatggttattcatacttagcagggtcaagaagacctgggaatttgagaggtaaaaagatgtgatcctttcatttgtaattaaacttgccacagttctcattttctctggctttttgtttcttctctataattaactgctttgagaatcttctggtttatgctgctgctatgtaaacatgatatgtaaacacccaggtagtgaaacatagtaattcctaacttctcattaggaattactacagcagtagtggcaataaacatacaaaatacctagttagtagttttgcaagaacagaatacattgaaacataaagctttttctgaattttttaattcaggttcattaaacaattcaacatgattacacttaacatccttcatacaagctaggtatcatggttcacacctgtaatctcaacacaggctgaagcagagcactgtttctggttttgacctaaattgctagataacata

SEQ ID NO: 29008 - DNA, 1789 bp, Mus musculus
ggggcctgtgaagaggtaggtcgccctgctaaaacttccttttcacccatttctggggagaaagcatttgatttaatcctctgaaggaaactaaatgcagaggtgttgggaagtgtttgtgggttgtttctaaagttcctcagtagacttggggcaggaagggagcttttcaaggttaactgttgtcagaagttttttataaatctggtttcctttgtgcttttgccttgtgaggtggacatccttggtaacagctcactgacccagctgtgccggctcaagagccgttgtacatcagagatgctgctacacacgcaccaaagacctgataactaacagtggcctgggctttcctcctgctgcctctcctggaccttcgtggaagcaggcctcccaccctccctgtgggcgaagacaaggataccccactgctctgtgccacagagtcccgtaaccgctgcatagtaattgcgtaccgcttaacccagcccccatttgcaccatttctggatgtgcctttcaaagatgtaactgtagggatgggagaactcgagggtgatcggaacatcccgtgtggggagggacaggattccgtgactccagctggccagcggcagactgtcccgctcagctgttttccctctgcctgtgcctttgttcctgacagctgctgcactagcctttctgcttcccagaggactcgggaacaggaacgttactttggtactattggtgggaagtaagggaaggttctctttggtttggtccatgtacctaaggtgaaagactgttaattggggagaaaaaaaggaaaaaagaaaaagaaaaactatcagttttatgtagccatttttattttaaaactagatctaattcactgtagggactttatactctgaacagtgtgaattacctagaaaagtcttcaaatgccctgctctctgtcactttatctatttatgtacttatttattttgagacagggtttctctatgtaacagccctggcagtcctgaaactctttgtagaccaggctggcctcaaattaagagatccatctatctgtcttctgagtgctgggactaaaggcgtgtgcaaccacacccagcttccctgtcactttaaaagcagaagcagtgatccacagagccactgcacctgtgcattcttcttctgagacggcatgtcatggagctgatcacctggctaatccctggctggccactctggccaatcttagcttttgtagtaaatgcagggaaatgagggggcagatcgttgcaacaattaatagtcacaaatgcattattttagatttttaaaaaatcagcatcccaactctttcccattttaaagcactaagttcagcaaagtatccctccagatttactctttactctgtatatttggttgtaggaggcagggtctcactctatatagcagtccacctgcctcagccttcctagtgttgggattacaggcctgagcatgtgccagccaccagcctggcttcctcaaggtgacttgtgaaggctctgcgtgaagtaaacactcagctgctggtcactacactgctgcagaagcagctcagggctgagcttctcccacttcacgtaggagatcccagggctggagcttgtccaactgttagtgcttaacaaggcagaaactgcacacaagtgatgccccagaacacactggccaatcttagccaccatgagctcgcaatctctcctatgtaagagatttaacaatgatattcacatgatcaagcagtaatttgcaatga

SEQ ID NO: 29009 - DNA, 1194 bp, Mus musculus
ttgatatccatctgcctttcagagacagtggcaaagctcattatcaccagtacaccatgtccagtttcccaactatgtatttacccttttagtaataactaatatatgcagaacttttcaatctatgcaaagatcttgctcctcaaaattccccttcggtttagcaccactgatgttttcttgcctgcactgctctttcactatgacagctgtaaaatgactttctagtttcagcatggccctttctttatgagctggatttaatagactcaaaacaaataagcccctccttcctttgtcctttattcatggagttttcttgttggtcctgtggacttctacggtcttagtcttgtactcgggtgatgtcttctttggttaatttgaacaccttcaagctggctcctgcatccttttcaaggtatacttaggtttaatccttcctgtgtcgcctaacaagaagccccaggctaatcttgcacttaccctgctcactttatctccaggcagccctttaactggagtacaggaaacaaagatctggttcaccgaagatatatgtgatactgactggctggcctggagctcagagatctgcctgcctctgcctcccaagcgctgggattaaagttgtgtgccattacactcaactttgtacactcttgattttctttgttaaatttattttgatcacaggccaaatgcatttctctagtttataatatcctgcttgagggcagctgatactggtgtcagtggaggccgggctcacacaggatttagtccctctgcagggaaagcagtttattcacaacgcccctgggttcagatgcaggcctgtgggacagtggtaggctgccaccacctctctcccaaggcccttggagaatgtgtgtccatcctgtgggtgaggggtacactgtgcacctactcttcaaaggtgctgatgaaagtcagagacccaggatctggacctttctctacaattggtacaaaacctcagaagtgcccttgaacactgcacagcactaacttgtaagaacagaggtctagagccatctgcagacctacagcaggaagcgcctgagaggcacagtagtgttaattttgagcgtagtctgaatagacctccgacggtgggcacctgtgcagcagctgcccagtcctcctgcccagccaactgtaccttgcctt

SEQ ID NO: 29010 - DNA, 1135 bp, Mus musculus
atggtcccccactaaacctggagctcactaatctatcactcacctacacgggcttggctcaccagtgatcccctgggatggcagccgctatcatggccagctttttctgtaagtgctagggatctgaactcagggcctcaagcttgtccaacaaggcctttactcatggagctgtcagctcccaggagaagtgatttttttttttttttaacagtgacatggaggtctgtatctttgttgtctatttaagttttaaatatattttctttatttttttttacttcttttaacttccttccaattattttcctaagtattgaggtacaaacaaacaaacaaaggcattgccatattttattttctacaatgattctttgtttatgtagtgaccatttaacatttaaagttgaattgtatgggcttacatgatctttccttttttgctgtattgtaacatttctttgtatccttttgtgatcacttattaagaagaatgtattttacttcccctttagatgtgaacaggaagtgctggtgttttacaaccaaagggatgcatgccgtgggtcaatctgagatagttattcttctgcagtgtctgccagatgagaaatgtttgcctaaggacatctttaatcactttgtacagctttaccgggacgccctggcaggtagaatgctttataactttgcaccattgtagatgatgaaaatatgaactcatatataaaacaatcaatcctgttaaatgtggaaacatgacattgagcttttatattttcttacagtgctaggaattgaacacagatccttatttgtgctaggcaaacactaccattgaactatatcccagcccttggactatattagaggcaagttagaacttcccatagttgggaaaattatgtattttattactttctgtgattctctttatttacaaaggatagactcaaaattataagagaatccattgaccttggggtaagaatgtaagttggagttcctaagggtcgtaacattggtatccagtagaaggaagcataatcatgagtcgtcgtcatacccccttgctggctgctgcagtcaggagctggccctgaccctggcctgagccaagcggggagaggtggtt

SEQ ID NO: 29011 - DNA, 1184 bp, Mus musculus
ctaaagattagatactgtcatattctggggacattttcttcaaagcacagctggaaatatttgtcaggtagccctaagtagcttttactgttaccaacaaacttactataattacttttttttttccttcagatgaaacagtttctcctactttattggatacaaagtggaataagattttagatccctcttctcacccattgtcttttaaccctgcattagccagtgtgaatgaacctacagtttctgagacaggaccacagctgaaagtcttctctctggctggctcagctccccttacaaaggaggacaaagatccctgtgctaacggacaggactgtagtctaaatccagagactgacaccatgtggattgatgaaaatgctgtgacagaagaccaactaattaagagaaactataatcaggatgatcaatttagtgccgttgaagtgggagaggagaaatgtggaagcctcacttgtctgccagacgagaagaatgttctggttgtagctgtcatgcataactgcgataaaaggacattgcaaagcgatttgcaggattgtaataattacaatagtcaatccctcatgaattcttttagttgttcactggataatgagactagacaaactgatcaatttagttttagtatgaatgggtccacggaaaaaggtataaactcggagaaacaaatggatgctttgaataaaccaaaaccagagagggattctgtgaatcatctctgtgcggcttcatctaacagtgcaaccagtatctcttccccttcacaattgaaggacggtgagaatgtgggtagagacccatctacatctacagttacaagcttagcagttaattcatcccagggaatggatggagggcctgccattaaacagcaaggaaattatatgccagatgaggatctttctggcatgaacagctcttccaggacagacctagggatctccaactccttttcccactcaagtggagagctcttaataaaaacagagccagctgaggagaggacagctgaagactccctcccatctgatttatctttgaatctcaagccggatactcctgctttatctggaagggacaattgcgaacagtcttcagactgccttgggtctagtgaaactagagctgatgaagatgaaggtaatgactctcagatg

SEQ ID NO: 29012 - DNA, 1190 bp, Mus musculus
ctctcctgcctagcttgagacagaagttctccatatagaattgagagagtgcctaattcctctttttgttcctcacctcgaggaacaatgccattgtcaatgttttattcctttcacatttatagttggtagagttcaaactggaatagctagcatgtgcttcctaattaactttatactcggcttatcctgtttcctaggtgttcttggtagcaggtgcaggggtgcctctttttcagcaaagttgaacctgggaatgtccttttgaatgaaaagaacatgtaggccatattatctcctagcataaataggcattctctgaaatggtactggctgcaggagaatttcttcaggcagtttcctattcttggccttgaccttacctctgagtagatctaattgattgtagctgctcttaaccccctcctgcatgcttaggatagtgcttcgggggaacagtggtaaacacagtatttaattgcttaccttcttccctagaacttggaggtaagttatattcattcactcaggttttcttgctgttctgataaaagcttgtgttttgacatatcaacatttattatagccaatattttaggataagatcgaaagaatctgttgttttctggcccatcaccaaactaactgcagcttaaccttgcagcatgccaacttttgtttcaagctagatatctttccttgatacttaagatgcaagaccaacagcatattgagagatttacagacatgaaggcaaatctcccgtgttctttttcatccaaacattttcaacttattttataaatttgttgattttttcccctgttatgttttatatatatggacgtaacaaaataaataacagtaataaaataacagtacaaaagaggagatatttcctctagtgcttctgttaattgttgtcttttctatttctctattctccatactaaattaattctcatgtgggcattgtttaaaataatctcatccattgttaggtcaatatttgtagctggtctacttacttcagaatttagtcgttcctttgcctgtccaagcaaaagacagaagcagagagcagcgggcaatgttgtagatgaaaaaagagagtatatctagaactgagaaaatgtgtgtcctggtccagattcaggctctctgttgccatgttcacccacatcacccag

SEQ ID NO: 29013 - DNA, 1482 bp, Mus musculus
aagtgagcacgtgcagccatgacgggggggtcagcaaaagtgctagaggttaaccaaagtaacaactaacaggtttgtaggtcttgatatttatgaaacagttgtgttgtcaattctctgattaatttttgtcgaagtccgatggaagtagcattctctcaagggaaaacaggtccatgacgccagggctgaaaactagaagatcttgatcttgttcttcctaaaacatttaaagtctgtgttgtcacccatcagatattaaaggcgctccacacttcccaaccccttacctttattccagttgttcaagggatgaaggaagctcaggagaggctgacgggcgacgccttcagagagaaacactttcaggatgagttgtgacatgaatgagtgttctggaagaaaagcagcagagagcgaatcctaaagaatcacccagaaccgctaagccaccagaaaccatgcttctacctacactggcaggagctctcactgtggagaggccactgacagaagctgctctgtggagccagcagcggggccgactgactctcatctgctccctttcctaagtatccattcctttgaatgtaaagaatgaaactctttgatactaactttgagccacttggggattaactccatgtcagtatttgagtctttacccattttctcctactgtactcaagctgaagtgaaacaaaccagaacgatcttttctatagtgtacaaattgcaggagttaccaattttgaaaggtggcattctccttttgtcttggtaaccctcctggacttctcccggaacccctgcgcccgcccaccctttgctcaggcatccccgtttgcacgaatgcgtgtcaagaatggctgtgcactgagacagccccaactggaagcatgctttccctgttgctgttagagaaactctcaagtctgcaaaccctacatgaagccattttgtcaattcaccaactgtatttttgtactggggttaaaacaaacacaagagataaaatatgtttcattaagctttattaaaacttgaaatggaaagatgctatggtggcctttggttactgggcagggaagaaggggtagccacagaggaggaagaggaagaaaactggtctagtctgtgcagagagtcctctcctaggactcctgtttctccagcatccacatccaggtgaataccagggcatttcctttgttgttattcaatagaatcttatgttgccctggtgtcttcaaactcaagttcaatgattcccccgtatcagcctcctgagctcttggaacacaggtgagagccacctctgcacatttaaagcttgcctttccactgccttgctggcacttttagcatagcacaggccttttctctttcctgggcgtatttgttgtgacagtcccattatttcctgttacttgcctactcgcctgtgatacccttctgtagcccatcttccttgccttcccc

SEQ ID NO: 29014 - DNA, 1224 bp, Mus musculus
ttccaggtggtggagctgccgagcggccaccacctgtgcaaagtcagagctctgaataaaggggatgccaactctgaagtcactgtgtactaccaggtgagcttgcctcacacactaaagtgagatgggcatttctatgtattcccctaactgagcccaggcagtaagaagatatttgttaaaggacaacttggagagaaatgaaagtaaacctagctaaggaatcagcatagaaccaccagaatgacttccaaatgagaaaaatgttcacctgcttttagtgggatggtaaatccaaggcagagttctttattctttgggactcagatctctacttctgtgttctttccacagtagaggaggaggtctgaacaagtgcttttcagcagccctcagtcagcccagagtctgctttagtctttggttgatcccgctcactgcttatttgtgaacatcctctccaaacctgtcctgtccagttggtggtctagcctttggataacatggctttgtttactctttttgactttttattgtgttgctgatcttgggtctgagtaccacccctctcccctttattttatttgtgtgtgtgtgtgtgtgtgtttgtctgtctgtggaagtcaaaagtcaaccttcagtatcattcttcagtgccatccatccccctactccatcctttttgtgtaacaacaacaacaaaattgagacaaggctggtggccagtgagcccaagggttacaagtacgagccactataccaaaattctttttttttttttcccgagacagggttcctcaaactcagaaatccgcctgcctctgcctcccaagtgctgggattaaaggcgtgcgccaccaccgcctggcccaaatttctttttttaaaaccctttatttttattagtgttttgtctgcatatatgtctgtataccacatgtatgcctggtacctgcagaggctagaaaagggtgctggatccttggaactggcgttacagatgtttgtgagctcccattgggtgctgggaattaaatccagcagcaccccagcattccttaaatgtggctccttgtgttttaaagcaggcacttgaccatctgagctgtctgcccagcccttctctcccagtcctgtctgaacaaagtcatcaccaaaggatgccacggtcacttcatataaactccttcctgtaggaaactgtgtctccacagaacacacgtg

SEQ ID NO: 29015 - DNA, 1134 bp, Mus musculus
ttctgctggcatctgtgggcacctttgcataatagcatacatgcacagatgcacacacagatgtaaatataaatacatctcaggaggcagagccaagtgcatctctgaatttgaggacagtctggtctactaaggaagttccagatcaaatcatttgtgtgtttgtatatgtgtgtatgtatatatatatgtatatgcacatatatatgtgcacgtatatatagtaagaccctgtctcaaaaacagcaaattggatatgagaacaatgtgcaaaagctagtaacattctttaataattcctgtaatcaactaggaaaagagttaaaagaactatatttgtaataataggtgggcatgtttaaaggacatgtatatatgagtgcacagttaagttctactgttgtttctgtagccagggacattgtgtgcttagtgtaaagtgggaatagtgtgcttagcagcaaccatgttccttttaggaggtgggtgagcaatttatgctctggagtggtcatcattcctttattgcctttggaatcagtttaccaacctacttctctctctttctctctctcgctcactcgctcgctcgctctgcaaacaaaacacacaaaacaacaccttgtatcttgttttgccttgttttttttctcccaaatcattaaaacaaaactgattctatcttaggcttttgcatcattattcatgtttaaagtctttctgtgtgtatagaaaaaagagaaaaagaaaaccaagaaatccatccacttggagaagactctgaagctgtagctactgtctgcagcctgaagaagtatgtactgatgagcatgcctcagagaagaccagcagtggcgcacaacttaatcttagcactcaggaggcagaggcaggcggatctctgagttcgaggccagccaatctataaagtgagttctaggacagacagggctacacagataaactgtcttggaaaaaacaaaagaaaacaaaacccaagacacaacaaaaaagaaaacctcagagaaaaagaggccatagaagataagtatgtattatgttggggtcatgagccttaaaagcatcacaataaaaggttgatattttggtgggttagaacaacagttttcttga

SEQ ID NO: 29016 - DNA, 1436 bp, Mus musculus
aagacagcaacagtatactcatatacattaaataaattaattaattagttaaaaaaaaagacacacacaaacatacagacacgcagttaaaaaattgtttttagtcatgcattgtgattcctttaagtcccagtactcagaggcaaaggcaggtaaacctctgagttttgaggctagcctagtttacatagtgtgttccaggccagccaagatttcacagtaagaccctgtctctctctcttaaaaaaaaagaaaagggctgttaaaataatcttttccaaaagtctttattatatttatgggtgggtttagcacgccacagtgttcttgcggaagtcagaagaaaacttgtaggagtttgttttcactccctttaatgagtcctggagacggaactcagttgtcaggctcagcaacaacacatgccatatcccctgcctgagacagagacttctctgtcctgctcacgtgtgtgtctttgtaggtaagaagtagtcctgaaatcgcaccttctgatgtgactgatgaaagtgaggctgtgactgtggctggtaatgagaaagttactccgagatttgacgatgacaagcactcaaaagaggtgaagataattgtacattcgattgttcttgttattcatgtcttaaatgatctttgtagctgaaaaatatttactaaaatttttcaaagtatgtatatgatcagaatgtaggtcacttgaagtacttctctaaacgtttggttactaaaatatcttttaattaaaaattatttctaggaagatccatttaatgtagaatcaagttcactgacagatgcagttgcagatacaaacttggattttttccagtctgatccttttgttggcagtaagtatctttcttttgtaagtatatctaaaacaatatttctgctgtgtaaattatataatcattaaggcttcagttttgagagcgcatttttttttacaatataagcaaagctgaaaataagggtctttagtcttacatttgctcctatttaattttaacattctaccataggattatctgattaagagaatgtttcttcagagtaaaggctaatggaaagatatgttataagccagtgatagagattgcacactcatgagtcagcatcatttagctaataattactgaaatactaacaccagaccaggcatggaatcacacttctgtaatcccaacattttgcaaatttgagtttagcctgagctacagaacaaagctgcctcaggaaactttttaaaaatgaagaaaagaaaaacaacaaaaaaaagctaacagtgtaattttgaatcagtagaaggtgtcaggcatggtgacataaatttttagttttagtactcaaagggcagaggtaggtagatggatctcttgagttcaaaaccagcatagtttacatagccagggcta

SEQ ID NO: 29017 - DNA, 2331 bp, Mus musculus
cattctttggatcttttaaatggcagtatccctctgaagaagatatgattgaatgggcaaaaagggaaagtgagcgggaagaagaacagaggcttgccagactaaatcagcaggagcaagaagacttggaactggccattgcacttagcaaatctgagatctcagaagcatgaagagttatctgtcctttgtcagcagtacagtgctctctggaacactgaagctatttaccatgtgcatcaaactacctatgagcatgggatacaaaaggtttgagattcctagaaatgtgacaaaagtctagtttgtttttttttttttttttgggggggggtgctatttcaaatgtgtcttttattttttcttccaaaagcagtaccctaattaaacggctttgcctagacccctgttctggtgtgcatttatagtgagctcttgcctgcttgcactagcccctgtaaagctagagcatcaagcctctgccttctggaacctagcagatgtagttttgcgctgtgctacccttgtcctgtagttactatgacaacgactggagttctgaaagtgtgcaagtattctccctgagctgagtgcttgaaggagggggagggaaagagtatcctgtttcttctgatcggtacaaattagtcagtttaaagtgcattatatgtacttctggagaaaatatagttaagttacttagagacaggggaaaatattctgcatagatctactccactattgaaaactggataagttaaaccattattgctccagccgcaagtaattcctaaataaaagtattaaagccttgtatatgaaacatgtttttagaacaattttctctggacttaaagaattttacgattaacagatacctcacgacatgtttcctagttaaaaacaaacaaaccaatttcttacaaataaaatttgtaaggatatgttcattttaagtgctagtgaggaaaatttgtaacttaaaatataacctatccgtttaagcaaacacttagcctgtacccattttgcctttgtggctgcactgaccgtagttcataagtgacctgaagtctaggaagctagaattggaaggtactttggtattcattatgtgttttgtttctttagtgaaggcccagctatttgcagtgatacaaatggaagaaataacatttgttatatcctcttactttctgtccatctttgtagtttaaatttctttatttgctttatttgtctcaccaataaaattgacaagctaccccacccccaaaaaaatcctagtttttaaattgagagaaaaataaaccaagttgccaaattatcagagccctacttttgttaaaagcccatcttctgctgaactggcctgacagacagctggattttaaatggatttgaagtaaactataatttgtaattttttagataagagttactaatttagtgtttgtaataccaagataaacaaaaatgcacctacaaactatttaaaattctttaggatagccaagttaaggtggtattgaactgttgttagagtaatttactgcctggcctataagtaaattctagtgtctaatcagaccattttgaaatggtgcttttttttcttttccacatactattggatagctgggatttaaaacaaacttcaaccactttcttgcactgctaacttttttctacttttgtaaataaatatttcagcataaaagttaaaacatgaagtaagggctgaatcgtaatcacaaggctttaattgtgataactaattccgtggcctaagtgcttgctgcaaagggtgatgagcaggtcaggttgggtggtgttcctgtttgccccttcctctcactcctcaggagaaaggtaagttgacttgaataaccttcgtttgcactgagaaaagtgaaaaatgtttgaaatgctttaattttttttaataaaaaacactctggaaatattaaatatctataacttataaacagcaacttttgatgtgtagtaagtgtgccctaatcttctgtgcgcttagctgggtcatagaggttcttatcctttgttaagatgtgtgtgctcagtgggccaatatcatactaaagtatgtaatatgacataaacatatctatatctccatgcttgagtgtatagaatgaatgtcttaagagccatttgtgatgttttatggtgttgaccctggctccaaagcctgcgcttgaaacaaagacagagttttaaccatcttccttttatgtacttgttcagctttatctgtgctctcttcatagatgttctctcatgtttcaaacttataaattactgttgtaa

SEQ ID NO: 29018 - DNA, 1186 bp, Mus musculus
gtttgcagttaggaaatgcagaattcacagtgatctcctagcttgtaagcaaactgagatgcactatcccttttctattaagaatgagttgatgtgtcaggaaacaaggctagcaaagtggatttgatatccctttccttgtgtgtcttatcttattgttttggtggttaatatggtgataattgaaagtcaagttgaaattcaaatattaatatttctgatttgttgagctttgaattatgccaccatgcttatataaaaacgaaggtggcaccatgatgaaacttaaagaaacagtttctcatctgtaacagttttgattctctttcctgtgacctctttccccactgtctggaaccatagcaaaaggatactgcatctcttgttactgtagtgctgaggttattgaagttacagaaacacatctggtgtgtttcctagaaaagtacctgttcagtcttgctaggtgactgacaggagaggcaaatgtgttatgttttgcacaccaatgcagcagggtttgtataaccacatgacttcatagttgtgatctcaaaggaacttctcctttattttttcttgcaattaatgtaagaatactctaaatctctgcacttctgaaggattagaggtagaaatggtctagtaaagtgtaatgttttattcatttagcatgtgtttattttccttatgttctccaggtgattcgttccttccactcagtgatattgtggttaaaaaatgatgagcagaagcgctctccaccttacaaatgagaaatgttcttttatattgtgttgagtacttgactaacacttttttacatacaaaagtttcttgaaggttcttcataattgcggtgtagaagaaattatgtcataaatagttaattgacattgagttgaagcagtcatacattgcttagattcccagtagatcccatgatggaaatatttaaagatgaacttggaaatactgaaattagactatcaggttctgttaaattgtctcgtatatcttgcttaatttctgttcattaatttatatccatccaattataaagtaaatttggaggaaacagctgaagttgtgccatatttttagtgataactctttttaaattcttatgttttctaattatacacttgtgtgtcatcaagtattatagtcagacttttttcccagg

SEQ ID NO: 29019 - DNA, 1108 bp, Mus musculus
ccctggcattcccctgtactggggcatatcatataatcttcacaagactaaagggcctttcttctcatcgatggccaactaggccatcctctgctacatatgcaactacagacacaagttctgggatatactggttagctcatattgttgttcctgttttgttctaatgatggtgtcctttgccttaaagaaaccttttagtttcatgaagtccactttattagttgttgatcttagagcctgagctattggtgtgctgctcaggaggttgtttcctgtgtcaatcaattcaaggctattccccactgaaattctctttctttgttgagtctttgtgtggtttaggtatcagggtgtctgtggcttcatagaatgagtttggcagttgtactggttggttttgtgtgtcaactttacacaagctggagttatcacagagaaaggagcttcagttgaggaaatgcctccatgagatccaactgtaaggcattttctcaattagtgatctaatggatcaaagggtccattgtgggtggtaccatccctggactggtagtcttgggttttataagagagcaagcagagcaagccaggagaagcaaaccagaaagtaaggtccctctatggcccctgcatcagctcctgcttcctgaccggcttgagttccagttctgacttcctttggtgatgatgtggaagtgtaaacagaataagccctttcctccccaaattgcttcttgatcatgatgtttgtacaggaatagaaatcctaagacagcaatgtttcttgttttctattttgtagaatagttgcgtattggcattagctctttgaaagtctggtagagttctgcactaaaaccatatggccctgggcttttttttggttgggacagtttttattgactgcttctatttccttaagtgttataggactattaaaatggtttacctgatcatgatttaacattggtaagtggatctatcaagaaaatcatccgtttcattcagattttccaattttgtggagtacaggcttttgaagattctttgaatttgctcagtgtctgttgttttcaatttcttgtgtatgtggaggcttactttg

SEQ ID NO: 29020 - DNA, 1169 bp, Mus musculus
tgttaaaaaacataacagaataaagaaataaacaaaaaagttgacatgttttatataaacacagccataccaacaaaatatgttgttccactattagatgttttatgataaacattatgttatcaccatttagaatgtcattaattcttacacttggttatcaattctaattaaaagtttaatcatcacagtgctcatattgcaattgtttaataaaaacattagatttgtgatatggttgtttaaagttttcttaatttgttgcgatttcaacattttagatatagtttgctttcagtaggtgaacattaaaaatatcaggcagaattggatttgatactaatgtatatactctcctttattatcaccaggttgtagctgaaagtatcataataatgaacgtaccttggtattgtgattacatctctttaataatgggcaagctatctgaatagaatgttagtgatgatctgttggcttgtttaattggtacacatatacacataagggaccagtagagctaaaccagatgtttagggagacaggtcacagaaatccatgaacaccaacaaaagatttttttttttgctgctattactgttgttaatcagtggtttgtttttgttagattttgaagtggagggaattattggcagaactatagataggaatgaatgctgtagtagcagtttacagaaaatattagacacagagagattggatacaaataaaatattagacacagagattggacacagctacatctatatacatgtgtatagatgtagctgtgtcaacaattatttaaatccatgacacaataatagtatcgcatagttcacattctttatgatcctaaagagcacatcctcttttttctttctttccatatatgcatatcttataatagccacaagttgctgatttctctaaaatattcttatgaaatcatcaaaatattaagtaggaaaaagacaactgtagcataggcaagcaatataaataaaaaaaattttacagaaaggaaacagaaatacccaataaaatatgaaaagatactttccatatttgatataagaaatatagataaaatcattctagtatattctctcataatggcaaaagtattttaatgtagatataaaaaagatgtaaacaaaatgtttgtt

SEQ ID NO: 29021 - DNA, 1142 bp, Mus musculus
actaatgctagacttcagtatgctaatatctctgagcttttttggccaaaagcttagaattgcttttattccatactaaatacaaaactagaagaccactacttctagaggaaacatagtgcttccatgtagatcttgattctaaggacttagggaaatgttgctaaatctattttagaatgatactagtcagcctcctttgtaccacactctgtcatttatcctagttaaggaattctctcctggaaattcttttgttttctcatagtttaaaaagtagaacgtcttgcaatatttgagacttaagaatcctgtgtcgtcagcccctgacagcatttagactatgcttccttcttttcttcacaataaccattaaagatttagttgaaaactcaaccaagtataattttccatactgatgtaagttaggctatctaatctttacataattagtaatggcatctcagatctaataaatttgtttgaaacttattttggattttgctttattttagatttctgacaatgtgcaatagacactttggcagcgttattgcacaaactattcggactcaaaagacagatcagtttccacttttcctgattatcatgggaaagcgatcatctaatgaagtgttaaatgtgatacaaggtaaagtatatttcacaacggaaataaaatgttattgataactttaccatttcttccattaaaatataaaatatcctaaagaacatcttttaaagcatatgtactatgaaaaatgaatatggtgttaaaagtctagcatccaataaaattgcatagttcttcagacataggacagtgaagttatgttcagaaattgctaattccctaaaactagcagttatgttataatcatttgtcagatgtgacatttatttctgttgatttttagctgtaatattgattagttgaaagaattgcttatctttaattatctagaaaatccagtgactatacattgcaaattgaatttttcacgtgtcagttgttcctccttatttgtgtgacttctgcctgagatacacccctgaggcaaaaagctgtgggattcctgtggatttagccataatttacattttcctggaaatttaaccatactttacattctttctta

SEQ ID NO: 29022 - DNA, 1221 bp, Mus musculus
tcttataaatgcaagtagcttttgtggttcataaatctgcagagcctctattctatgaaacagaaagtaagcttccactgaacattaacagaactgtgggtttcataaagtgggaatggggaagcaggataattaggagggagggtcaggaaactacttaactgggttacttttttgtcagggttaaagcagagtagaccccttatcctgactcactaggttgggacgcagggaaaccatctgcttggggatctttttatctccttagagattagtttgattgtgggtcgtgtagcatgagtgacttcacttccatttgttgtgctctacaggagcttagtccagagcagtggcctccagtaactttggcttagcagttttgtttaacagttaccatcttctgttcagctccctcctccgtaagagtatgacaaatggtttaggacattagcactactctcagttatggtccttggcatttctcttctcaacatgtactcacacatttctctgaatgaatttttgtcatctcattccaagatggaccatttgctgtgcggtggacggctacatgcaaacctttacaactgtagagaggatacagtatgccagggagatgacggttgtgactatatgggaaataataccaaaacctatgcaccttaccaaaaggccccatgaatcaaaccacatagaactgaatggactaaagattgagttggatgaaataaattctttcctccccaagttgcttttggtcgtggaatttaatcacagtaccaggaaatcaaactaggacaggaaccaaggttgccctctgcccctctccacaaaggtcatatatacatgcacaaaaacaaaagtctagaaaacaatgttttttaaaggtagtgtttcaagatttttttaagactgtaaaaacccttagctctgtatcagttcactaagttttatatagctattctgttctgcttggtctttagaactttcatacacctcagtttcttctttacaattctggaacgtcttatctaatccaatggtgtaatctcaaagttatcataagcctgcatttttgtttctattgcatgtaataaatgttgactggtgatatttcacatttcttggcatttctttcaacttttagaagacaataataacaaatctatgtaaagataactatctttgattaaatatcattgttaattgaaagtgttttct

SEQ ID NO: 29023 - DNA, 1142 bp, Mus musculus
acccctgctgctccctctgctccgctcgcctcctcaacacgcgctcaggtggatggcaggatggaccagcctcttgtgtgtcctccaatacccgttcccctttcgtttttaaaaaatccgctctaacaaatataaatttaggatgtatacatctcttggcactgactcgagtctttgggacacatatatatcagtatcaactgtaaaaaaaaaaaaaaaaaagagacgtcctaaggtgcactttcctcgttgcggtatttgtcgctctctttgttgcttatgccgataagcatgggtttccttggtgcagtgtgagtttttatatatgtataaatctatatataatctatacatatatatacaagccagtgtataatgttataaaatggaattctaagttattaattgtaatctgtaggtgacctcggtattaacgtggaaaacattcaaaaatcaaagcaaaaaaaggacaaaatggaaaaaaattagactattcgcacattgtacgtatcgggttttatagctgaaatctactgtattctggggaggtaccctgccgacccctggtcccccggcctgcggctgttctccaaagcggtccaggctgcgctgaagcacgaatagagcgtcgggtgagtgagccagaagctcccggactcgccagcgagcgacgctgcgcacagctgctcactttgtgctttcctttgcataggtatgagctagaaataaatgttattttctaaataaagtaacgctcgaatcccgttccgctcctcgggcggctgggaggaaaagctttaatttcccactggggccgcggtggcccgaagtcacggatcgcgcctgtgccccgaccctgaaggaacccagacaggaagctgcggggtggcgcctgggaccgcgcagtggggggcgcggctgggaacctgctgttgaggtgacgtgagggcgtggtgagcgtcgcctggcctggcgcaggttcctgcaccgcaggccgggccccgggctcttcccccgagcagatgacctagctgcggtcctggacgcacatctcactcttggcttcttgagaatttctggggtccagggcgctgggcagggcggctgggagacgaccagcgacacttcttttgccaggacct

SEQ ID NO: 29024 - DNA, 1149 bp, Mus musculus
atttattataagttgtaacacttggctagttttgtttgtatatgtcttaagatgttttcttatgatatttaagtgacagttaaagaggtatcaaggtaacttgtgtagaactattgtttgatatattgtcatgtttgttgtgaatattttttcttactgcacagtagaaaattaaaaaaaaaaactgggtctttattttaatgtaattcagattggggaaaactaaacagagctaagggaacaaaaggaccgtgggagcaaactcccacgtccagtgcactgatcattttagtacgtttgtgctttgtatggttatatatttaaaacaaaaatgaaacaaaaaaaaatacaagagttcatgctcttccctgggtaatagaaacagttactcgctatgcataatctagttgatagtaaaatttgctattgcttttcttgtcttgttacataaaatcttttcaatacaagtttagtcttaatggtaataaaacgttatggttatttataacttgtgcttattttgtgcattttttcccatgctgaacccactaagtgcatgtagacaggactgttgtttgcacattgaagaggcaaactttgtagtagtcgttgtagtggtagacagataacgaaaaccgaggctgcatcatagactactcctttaaattttttttctatttttttttcctcttttcggtttttggagaaaaataaataacaccagatttcagttcagagaacactcgttcaacattcagggaaacctttatatgtcacctgctatgaatgaatgcagtttgctggcaaagttctgatgcatttgctaagcattcatgggaaaggcatgccaaaatctcttctctatgatgtgttcaatctgagggaaaaaaaaggaaaaaaaatcttaggaccaggcagttgtatactttagttataaatgaatgacttcatgttaatcttgctagtttagatgatttctgagggaaagtattgtaaatgtttttttttcataatcttgttgtgtttgaattatttgtactttatctgtccagacaataaatgaaagtgtgtagaatgaatttgagcttcccaaatttttaaatgtgtttattcgaacttttttttccatagtctatgcagagttccctg

SEQ ID NO: 29025 - DNA, 1109 bp, Mus musculus
ttggcaaaggattggtgtaaatgccatgaaagtgcccctggctttgtaaggtttgggttctttacacattgttagttttccaaaaattcatctaagcagccaaaaatatcaccctggctggccatctaagcctgtagattcagtactcagctaaagcctctctacacccctcccccattcttacacagcccagccaggcttgccaagaactggcagaaactcttgctgcccttgggcaggggacctcttggggaggagatgcctggattgaaaccctgcccatgactccagctcagagccacttcttagtcagtgcccgaccttgaggaagggaaatcagagcttataagggctcttggaccctatctggccctttccaggcaatgtcagctcctcaccactgtctccaaaggcagactttgcctatagagaggcctttgcttgctgcttgggaagccacagaagctctttcagcttctgtttcttcatggaccatagggagagtttcctggggccaggaggataattctgtgtatcatattgacaccacaggccaccatgatgggagcatgtgacagataagaaaacataacttaaaggccccctccatcctaaaacctgccttggggaatgtgatttttaataggatccaagtctaagatgcctggagtgagaaaccaaggactcttagactggagtctctctggttgcaaggctgaggtgggtgtggctctcagctaaagaagggggaagttgaccttagcttttgcccagttctgtctcagatttgttggctaccccactgtgcctcactgtaccaaactggcctcagctctcaccatgtttgtggtgttctttatcacctcttccttcacccctgccccatgaattgtcatgaagagttctttaagagtataatagaagacaaagaaagatgctattaatgttattttgccaaaaatatttttgtagcataatatattaattaaagatgttatgaacttgaccctggtgttactgtttacttctctgttttccttctgcagggtacatttggggaattgtctggcttgtgagggcgagagcctaggacagtatggcacagagaa

SEQ ID NO: 29026 - DNA, 1458 bp, Mus musculus
gttttattttttaattttggcgttgagaatttaacccaggacctcatacatgctacactgtgttttaacaatatctgcttttaaaattgtctttttcctctacaggtttttggtgaagttgtgaagatttttgacaaagaaggctaactaaccctgaaggcatctttgaaatcatgcttgaatattgctttgatagctgctatcacagccccttttaaggcagttttaacctttcaagattacatctcaattaatgtctagaaatatatagtaagacaaattaaattatgtgttttttttttatttgtggtcacagtacacagtgaattcaggtttaaatcattttaggtattatggtgctcacaaaatgaagaagggtatcagctaattcttgtttgtggtaaagactaccccttttatcccttttatgtctgtgccttcggtgagttaattttttttagtatgcatgtatatccctttggtaattgcagtatattgggatttgagatttccacttcctcttgcttcacatttaaaattttcaacctgctaagtgaatttgtggaccaaatttaaaggaactttatgtgtagctggctcttgctcaaggtgtttagtaaacatactcataaaatggactcctagcaatgctctgtttatcagatgactgaccatttcctgttgaaagttaaaacttagagactgatttactacagcttgtgcaacgttgtatgatagtgcatagtctttgcttccaaggtttgagtcagggcacggggcttcagagcctgggcaggattgtcagctttcttctgacatagtctgtggggcaagggtcacaagtagtgacttgtattcctgtgctctgtgacacaggactgactagtcatcataaagtgatgtaacaagagttcctaccagtagacccttgacatgcattcactagtttatggtaatttgattcagttcttgttttagtaatagttaaaaagtttttttgttttgttttcttagactaaatatagagttagagtaaattagataaagcaatctaatggttaaaattcccatttgtattttattttctggaatatgtttttcatggttacttgttttaaaagattttaaaaatcattgcactttggtcagaaaaaataataaatatatcttataaatgtttgattcccttactgcttgctttttcaataaagtttgaagtccaagtgattttctttctttaaaaaattaaaaatgttttcttttttcttttttaaaaaagatttatttattattatacataagtacactgtagctgtcttcagacgtgccagaagagggcatcagatctcattatgggtggttgcgagccaccatgtggttgctgggatttgaacccaggactttcagaacagcagtcttaccagctgagccattttgccattttgccagctccctgtt

SEQ ID NO: 29027 - DNA, 1108 bp, Mus musculus
aaaggactgtgccacctcatctggtttgagctctttttataaagctacaaaagctggtgctgcttaagcttcagtattttaatattaatcagctaaataatatttctgaatcctagttgaagttgaaggtctccagccttctcattaaatttgtctttatagagaatccaggattcaacataataaaatttaaaatctgttgaaggcagtcgtacagaaagttcctttaatgttaatgtttttttttctttacagttagtgtgttaatgacattgagaaagatgattcagaaactcatatttattcagtgtcgattaggtgttttagtgtgcatagcatgtttggttctgtgttagggcttaaaaccccttctcaaagaatttaaactcaaagtcaggtgatattcacacagagagagagagagagagagagagagagagagagatcacgaaaaagaaaaggtatttgcaaatgcaaaatagtaatcaacaattagtatatgatttacctatgaaatgaacactgaaaaataaacatagtgcctgtggctgggcagtgagggcatgcacctttaatctcttcacttttgaggcagacacagacagatctctgtgagttcaagttcaccctggtctacagagcaagttctagaacagccaaggccacacagagaaactgtcttaacagaacaaaacaaaatttaattaaaaagaagtaattatagcatttttgtctgttttttgaggctggatttctcagggtagcccttgctgtcctggaccttattctgtagactaggttggccctaaactcagagatctgcttgcctctgcctcccaagtgctgggaataaaagcatgtgccaccaccacctggcagttgtgggcattttcttgtaaggtatctctacattttgggatacctctatgtatatattacagcactttaacctctccacaattcctagttttaggcacaaactttggtctcctctgattgtgttcctttccagtccatgctcacttatttagatacctgtgatgccccccatagacctcttttctctcccacatccaaatggaagagataaacaccatggacttggctc

SEQ ID NO: 29028 - DNA, 1119 bp, Mus musculus
tacaggttgaacaataactcattaggagttattttaatatgatgcctagttaacagtaataataggtagttctctaatagtcttttataatcataaattctttattcaaacaacaacaatagtgacagatatgggttttatattatggagctgaacttaaatttaaacataaataggttggttactcccattatacttgtgccactattgaaccagtgggtatctcaccagaccagtcattattgtagctcacaagactcacatctagttaagactgtctattacttttatccttcggatccatgtatagaactttctagcactgaaggctagccagaaagaacaatgctttaggacgaataccagcttgaaatatccatgttttgggactcaagtatgtgatatcttcaactttagggtcttaccatcaagttctagaaggtaatgtaatgtttcagggtgtctgggacctcactggccaacaaatgcaaaagaggtaagctatcttggctctgggatttttatatgctagactgtagtatgtggtgggagtattgttcttccactattgggtgatatggaaacttctagtttctttggaaaggtggttatatcaaatgatgttttgttggggcacagaggtgaaaggatgtcttgctaggacagacatgtgaaagaatgttttcctgaagcagacacaggcgaaatgatgttttgatacagaaaacacatgaaagaacccatgatgaaggagtataaatatgaccccacagacagggggagacaagcactgagcattggtttgctttgctccacatcactattcttcactaaagacagccatgtattggttcaatttgcataccgttgttgagctcaacttgtattaatgctgccattgaggaaaacctgcccaaaaaattgctcatgaggttcctgctgcagcttgctgcttcttaagccttgccttaggctgattagtgagcctggccatttcttcagaaatgagctacagctgcctgtctgcttgtagaaaggactaaactctagtcgatgcttcatgcctggtgtctgcctgtttagagaactgagctgcagctgctgaattgtatttggtgt

SEQ ID NO: 29029 - DNA, 1182 bp, Mus musculus
gggctggagagatggctcagcagttaaaagcatgaatgctcttccagaggtccaaagttcaattcccagcaaccacatggtggctcacaaccatctgtaatgagatctgatgccctcttctggtgtgtctgaagacagctacagtgtactcacatacataaaataaataaaattgttttttaaaaaaaaaaaactgaaaagcttattaagaggagctcagattcctggggtaatctgggtgctgctatccagcctctgcttcaggctgggcaccctcaaaagtccatgataccttcgacacctttcagatgggtcatactataaatttgggggaactactgtagattaatctgtagctatatcctgggaaggcaagtgtgttccagggccatccagatggttaagtaacctagtagttaattgttgcttgtatactaacttccatttgtgttgacatttcctaaaggagaacaatggaagcaaccagatcttgccatcaccttcacctccatcagagcttgacaataaatcccacagtgaaagtgcaaaacaggtactttttgcttgggactgtggtgggccctggaggcaggctgagactgtgggcttcacatctactgccccagcaggtgcctcacacctcacccctgcctgagagctgagcagaaagggatacatgctggtacttgggaattcgtctcttctccatactctgcttcctcccaaccggtggaataaattccttttcacatcttgaaagatataaaatgagcagattatcctataactatgacaagatataaaatgagcagattgtcctgtaactatgacaagtagcagccaggaccagggaaggatgggtgcaaaatctagaaagtctgctgttttgagccacagaaaactcttaagaatgttgagaaacatattcttgaaacttggcgttttctaaagtctgaagataaaaggcaggagaggaagacgggagggatactgggatcagaatgtcattaaagagtaaggaaatctctaagaatttctgtcctgagtttaatgccctttaaaggctatagtcatcattccttttcaagtagtaatcagtactagaagatgtcaataaaaataattgagtctagtactaaataatgcactacttgctgtgctcttgttttatgagccaattca

SEQ ID NO: 29030 - DNA, 3343 bp, Mus musculus
agattagctttaggtatctagtctcatcaggtatatttgaaacggatatgtagcctggactacctaaaaatctacttaactaaaaagacagaaaaaaacaaaaacaaaaaccttcttgactaactcttcagccctccagtcctttatactactataacaaacacattgtcaccttttaacttgtttgaaaacactatttaaaaaattatttttttaaaaaaatttacttaaagtatgatgtttagaaatctatgatttcatgaagccagtgagatgttgtaacttaaagttgccaggaaaaaaaaataaagccctcttctctctttcctgttttttgaggggaagagaatttaccttttaaagctggaaagtgtatgtatatagagataataagtcagtttatatttcatatgaatttgccttaaattagatgcactttatagagcctcagaatatgtcttttctttgaaagatgagtctcttctgtttgtaaatatataagatgaaagattgtgcataatgtgtagaaagacgattggctttgaatggaatgaatgaatgacttgttatgagtaactgacagtctgctctgggtggcaactgaacctcttcacacctccttaaggcagccctcaaatgcttgggcaccaccatagggtttgaagctggggcatcagttcaggtatggatgctgtgcagagggtgccagttccaaactcaggaaagtcagattctgggccactgctcctattcctaacctaagaaccagagaagtcttactgggattttcctcatttttaattatctttcaaggattatgagcgtaaaagttactcggtgggaaattatatgttttcccctcaagaagtgggtcttctctgcccacccactctagactaccttaaagttgtaactgcctaccttcagcaccatgtccagtcagaaatgggaaggttcatgtccttggctgctatcccaaactagttgcccagagcactagagaaaagctctgagtaccctttgattttacctttaggataaccaagaatttgctctatttcttggcaggatgcctaaagccaaaatgtggtctgatgaaacaggaaatcatattctttcttcctaattgttcactcaaaaggagctatgggttttctgtccagaggataccacatggagcaggcgtgcttggagcaggagccttctggtgatggggctgttttcccaggtctaaagagcatctgtgatgcttccgcttacatgctttgtgggcaggccaggacaggtctgataggagcagatcaccattcgctgacatgttgagacactcccagtgctcttaggcgtctctggcagctccagcagaagaccttacagaaccgcaggttgctgtagccgtcagggaaacactggagaagctgttgtgatggcagggcttctttactaaagatcattgctgtttaatttcgatcaagttgccctgtcagctatagatacagtctagtacctttaacctttaaagacatttggttttcgctttgctttgccttgctttttatattttgtttcttttatatatgatattcagcttagtgttggctttttttttctctagacattaaaactcagtgaaggcaagacaagttttcctgtgcatgagtcttcttagctcatgtttctctctctttaaattttttgccttaatgtttgccttgctcatctatgctgtcaccttcttggaaaggttaaaaatacagttcaaacattatcctggctctttaggtaactcttgttctcctggctgccttccatactaaacacacacacacacacacacacacacacacacacatccgtacagattttgtaacaaccaaataaagttctagcaataaattgaattattctgctatatttgtatatattgtaccataaatagtatgtctgtacctggaaggtttttctttttttctttctttctttctttctttttttttttttttttgagaactgatttatatgaaatatactgagggtaatgtagcttgtcctttttagtttcaagttctcatttgtaggcagatactttcaagacaccttaactctttgtggtatatgcttttcagtgaggaagcaggatttgtttcttggactttcttctggtttttccatgtcaagaagcttgtctgccagcatcacccctgagccatgtgatgtctcttatcaaactgaccagaggtagccataactgccctctgacattctatacgtttctcatcctgactatggcattaccagatctaggcagaggttgctatcctttgctagaaattggacagactcactggcttaggagccccaaaaacctatcaatcggtgaagattgggtcttcatttgtttattgtcttaccttgtgcatccagtgccttgtgttagtcaagcttcaccagccacagatcacctctaagagaactcaatggtagtggtggtgagtttggctttggatttcaatcctttggccttatcagtcagtagctaagagtacttcccaccttagtttcttaaagtgttacccttggtcctttgctttatgtaccatctaccataatatttactgaaagaccattcacaagccagtcatggtagtacatacctgtaatcccagcccttgggagactgagacaggaaagtaatgagttctagtccagtctgggctccatagtgagatcttgtctcagaaaagtacctggcttaaatatgactgtagtaacattcaaggaggagcagagcaatggatgcttggctcttaagaatgggtctaatgcagaagagctgaggcagacagtctcacttcacgaccagcttgtttcccttccattgcagtttgctctttaccattgctggacagccccatcagccccctccctggtcccagcgtcacagctgaaggttttgactgtgatgggctcacacttataatggcctattgagttgtttttagtgacagcttttgtttgctacacacctcattggcttgcttaccaaccatctagatgtggtcccttctctcatattcaagccagaacacatttgggtattcctgagactagagagtgtgtattgtttgttatataaacctaacctaccttgttgttttctcatattaagaacggtaaatctactttatattaatggaactattttggtaatacataagcaattttggttttgtttagagtggattcaaggtttccatgacttcatttgagctttacttacttcctatcaatatagccattttaatttatctaaataaaacattacgtttctctcactgtgtct

SEQ ID NO: 29031 - DNA, 1662 bp, Mus musculus
aaatgcctttcaagcttctggatgatacatgtcccaagactcttaggcgttgggtagggttgcttttgtgggtatccagttatgtttgtttttctctccagatagacccagttctcagccatagaacattttcatgatgcctctactagatggtgagaacacgataggggaagaaagaactagccatttatttcctagttcttcccagctttgccctcagtcccatcttaccaaagaaggaggatacatccacgggtaattatagcagacgtgactaaagtcccatctgaatgttgataatatttactttaccaaagagatctagcaaataataagtgaaaaccatagctagtctataaatttgttccctgactcttgaactcagaaatccgcctgcctctgcctcccaagtgctgggattaaaggtatgtgccaccaccaccacccggcccccgaatggtatttctaagatggtggtaggctttgacacccattgaattgggttcaaatatcaccattttcattagcttgttaatgactaattacttacactcttaagtcttccttttcttctgaaggtgaggatgatatctacctcataggattgttgtgagaccccagttagcatgtgtgcagagtactgtggagcctaggacgtgctgaatcccttcctctccttcacttctcttcttcattaaagaccaatgtggggctaggactataacttgggcgctgagttcagttcccagcatttcagatgtacagatcactcttcatttcagcttaaacaacaaaccctatctcactgattcttaacttgagatacagtggcgtcacttacgagctctttaaaatgcagttccaggaccctgacctgctgaatcagcatgtcccagtgctgaacaaagcaccaggaacctacatgttagtatgtattctagccaattctgatgtaggtgatcaaccattgccttatccattccttatgaaaatgtccactgcatgggtctttctcacctgcagacattcacacgggacttagattcctcttcctgatagttgctattgttccagtgtactccagttacattgtgttatatttatttctgtgtgtttaccccactagactgtgagctccttgagggtcaggatttaactttattctcagtgctagagacatgacctgaaccacagaagaaactcaattgttgaactaataaatgatacagatttagcaaaaaaaaaaaaaactcttattgacttacacatttctctgttaaatcctatagcattgtgatttgaatgtaaatttccccacagctcctgagtttaaacatgtggtccacagttggcagcactacttggggggtgaggggttatgaaacctttgggaggtgggacctcgctgacaaaggtaggtcagggagcatggccttaaaggtagtataccagcttctagttcaagattactgtttcctgattgttggcctcaatgtgaacaagctttagctatcactttccactgcatggactttgccaggccttctgagccatgatagactctacctgctgaaagcaggagcccaagaaaaatccttgcttaagctgtctgtcaggtgtatgttcacagtgacacaaaagtaactagtgatacacttggaa

SEQ ID NO: 29032 - DNA, 1123 bp, Mus musculus
ggatgattctgtcatagtagaaatgagggtgtaaaccaccaggatctctggcctggatgtggggcctgcacatgcactggctttcccatgcctctagtggcctttcctggccaggcaggattgatattatttatctctaagaggtactgctgtgcaaagagggtttgagtcctgcctccggttcgtactaagtaataattatgggtcctcaggcgggtggcttcacctttacacattacctacattttatcatatctggaatgactatcagagccatcagcacaattgtgaagagcagagggcagaggtacaaagggcccagctcacagctgggctcacagagggaaagtcccttatattattgaatatctgaaggaatgaatgctattctgaagcagttcttggagtgttggcaagcgggtgggggacgggagagtaatgagccagctgtgagaacagtaagcagcagaactgagcatgcgactggagagggccatcaggattggctcataaaagctttgcaccttgccatgctgtgataataagacttaaccccgaaggcccatgtttttaaaaactggcccacgtactgacaacctccccactggactgtacaggagaaagtggtgtgtatgtatatctgtatgggtgctcaggtttctgaggaaaggttatgccataattttcactgtggtctgaggcagactggccagtgacaagcttgcaaagccctaccttaaggagtgggaaatgtggaaggtgatctgggatagagcaggaagaaggcattttaagatctgctggggttagggctcatggtgtgaatggattcctagattcagtccccagcacttcttcccactcaaaaagaaaactataggagaaagcgaaactcttgttctgcctttctctacgggtcctgtgcggaggaggggtgaagactgcctgggtggggggaggcagagttttctccctaggattttgattcctcttccactcatctccatccctaggagttcccttccccaagaacttccagcaggtctgcaccaagatcctgacccgactcttccgagtctttgtccatgtctacatccaccactttgacagcatcctcagcatg

SEQ ID NO: 29033 - DNA, 1141 bp, Mus musculus
ctataagtccatgaccattttaggagtaatgacagcttagtgacccaactctgaccatgtgtacaagtgtacaaatgtgtgtgtatagatggaattgtacctctgaatcttctagactaccatcttctataaacatgagtccctggcatttgagtggaggttagacagtgcagctttgccctgagttccttaaacctctgacctatcaccatgtgggctgatttgcccagccaaggatgtctatggattgttagttcactcatctctgcctctagcagggcctgatatcattaagcctatgagcctggcagtggtggcacacacctttaatctcagcacttaggaggcagaggtaggttcgatctctgagttcgaggccagcctggtctacagagtgagttccaggacagccagggctacatagagaaaccctgtctcaaaaaacaaaaaacaaaaaaacaaaaacaaaaacaaaaaaaacaagcaaacatatggtcagcctcttgagggttgggattgatccctcagggtcccctggatcttgaacttggacacaagatacttcaatctcaaacccagaatctactgacatgactgaaggccagcacaaaatagccctccagaccagggagccactggaacttgaatgaattgaagaatccaattttcttctatctcaggacactgaggatcatgcaactgatggagaccttcccatcctaaaaacacctgcctcggcccagcctcctgatacattcaggcttcttggatttccaagccacagctatccagagaggctaggatgcttattcattagccattacttaatacctccatgctgagccctctgcacagactcacaggcagggaaaccggcagaaataggtttctgcccttccagagcctttatcctgagaggccaggagggcaagaagtcacataagaatattgtctctgtctctcaatatgcattggaggaaattgaaaccggtaaaaattcaaagctcttgacttctactctagggcctgctgattgcaacaccaagatgcatgtgcaaatagaggctgtcagacactctccaggacacaactgtttctgctttgagtaaggatttctagcctgatgccacaaagccctacc

SEQ ID NO: 29034 - DNA, 1298 bp, Mus musculus
tgcataatcgcctgcagcaggaccgtctctgccgggctccaaaggctgctgatgtgcagatcccggatccagcttgcggttggggctgcaggggctgcagccttcagggagtccagcttccaggagctgacagatctgcggacgtgcatgcctcttccctgcactgtcacctccttctggcgatcctcccaccttcctctgtcctacagacgtcctctctgcctgtcctctccctggctgagcaaagccatcccctcaattcaggaagggcagggaaccagatcagtcttccggtctgtaacacagagaagcacataatctttctttgccgtgaccgaaatgttcctcatttatcatcctcttccatgtttgggattgctgctaaagtcagtattatttctttttaaaaatatatttgcttatttaaaccatgttcttccagcaatcatagaacttcaaacttgcactgcaagcccgtagatattccccacgcggatatccacgcacttagtttttaatcctctccccgacagtctcaactgattttaagctgttactatgatgaaaacgttagagactggtgtctttgcatctctgtctgccgctgctgcctccacaaacccagggtagtcagactgctgtgtctgagaggaagccctgtgccctgctatgaggaatgctgcgccctctgccccagacatgaaggcacagccactggaaaataagctgtggagtcacgtaaaacagatttgcatatatgacatacaacattagtcaaccacaatcaccaaaattctctcataacttgtgcttgttttaataaataatttaaaattctgcctgtggcagccttggtggtccttttgtcgactgcaggcttgaagaggaggcagacctccaagatgggggctgagcctagtgaggttgcaggacggattcccaaatattgatccacaaggtgagatttgcttttctgtttgtagttgaggaaaggaaatttatcagacatcatgtctataataaacaactctgcttttgagaggctgtttaccaagaagttgaggtggggtcagtagccatcacatagcaggtttcaaaaggagctgtaatagaggaccctgtacccacccccacagaaggccatatttccctgtctaaagcattactatgcctttattgcagacctgatgtatgtccagaactgcagttgtcctaccaaaatagatgacaaaaagaaatggtgcttcccactggtacccagactagaaggagctgggtggaaaaggcctttgtaactt

SEQ ID NO: 29035 - DNA, 1143 bp, Mus musculus
ccaaggaccaccaacagtcaaaaaaagcaatgtgtttctgtatttttctgggtatttttctattaggaccttggaaccagagcctgctgagagggctgtgctgtccctccagagctggctgtaatcatgtcactctcctgctccaaagcctccctaggccatcacccacaaggtagacacagggacatgtccttggcacttggctcctgcccttccttccttgttcagattggccccagctttgatggacaccgcccgggtcttcctccctcattccacctctctctcttctgacttggcctttttacttctctagctgttgtagagaacaaggtttctctgtgtagccctggctgtccaggatctcactctgtagatcaggctggctttcagctcacaaggctgcctgcctgggtgctgggattaaaggcgtgtgttaccagagtctggctggctgggatatcttttagggtcatctctgtaacccattttctacttacatatccacaagtcagaacactggactgaggaaggactatgtcaccctggatacctgtcagggaacacttacagagataccagtgtcatcaatttgagcttcccagccaaataagtctcctccagtctgtgtttggttagcttgccagtattgacctggctcctgacggctcctccatgtaggttgtactggcgacctaggataccccttgtggtgagtgagtgagaccacttgtggtctgggctctgtaaggtttatcatcacatgcctagcacccagcatgttacctggcacttagtagatagccagtcaggcttgttggagggatggcagatttatttctagcgaatccattttggcacctcccgattacttcctatgccatccataatagggaattttcagtttgcctctgacctgctacctttatctaatctacttaattcactttgattcatgaccacagggacaaatatctctttgtctgtgatcaacgtagagcttcctcctggtcaagaaggctgcatgcatcaacttctaccaaccctcagctcctccatacttcttccacccagcccacaagcacattgaattcctcccactatgctcaggataagcaaacagaaacagcccctgcttgaatg

SEQ ID NO: 29036 - DNA, 1176 bp, Mus musculus
ggaactcacagagatccgtctgcttctgccttccaagtgctggaataaagacatatgccactctgctcagccaaacgatcatttctaaaaatagtgatcaccccctttcttcttggatcctaagcggcgtagtcaatttgatagtctcagaaagaacacaaaattaggtaccgagtcttgaaaagaaccgtctaaaaggaagatcttgaaactggcttctatggcttcctagcaattccgcttctgtctatagtctgctctaatttcgttctacctcggcagctttctccatgcaggttgagcccagaaggccttccctgcaacttcctaggagctcctttagatgctctagcacagccaccgcttcgtgtgcgccccgaggattctggtgggtggggtgtggaggtaggcggagccctgggggcgccgcaagcctagccccgccctgtctgccgctgatattctaagcagccctcaatccttcccggaacccgcgagagcgcagctgcagtttcagtcggaattattggcgttgttagttgacatggctgcgcccgtcttaagatgtgttcggaagctgctgaagctcgtggacttcacgccggtcccgcggagatatcgatataagaagaaatgggtaaggtctgacattagagggagacttatccagcccttgcgtttcccgtcactcacagttgcattcgggacatgaactccagggaccgtaaccttcttggagctcttgtctcacgcctgcctgtccttttattaaccacaagcctcttcctgttgcgtaagcagccccctgactccgcccctctctgttaagtcacggcctgagctttcattcggtgacgttacatcgcctcatgttactttttcttgcttacttttatcttgcccttcccacccttctttttccttttctttcctccctcttacccttcccctccagtcccatgaactcttcccctcctttcctccttaaaatttcagccccttcaacttcacctcaagcagactgccctaacaactactccttccctcctgagtctccgtcgtcctgcaggaaaggattcacccctgttctcactctcgaggtgcctgtggcgcccgggaaagacttcaacgaccacctttcctgtaatgctggcctttctccaaatgcaggcaaca

SEQ ID NO: 29037 - DNA, 1270 bp, Mus musculus
ttttattttcgccagcaggcgtgggatacatgttgtggtaggtgtgctgggctcagtgcaggtgtggatggggtcgggggaggtgatgacttggtggttggatgggaactgagaggattagattcacttctgggaagtttggatgaaagaatcatggcacgctatagctaagctgccaatgaggttgagaaactcttggaaatctagctgcccgtcacagttgaggtccagcttcttcatcatgcggtcaaggacaccaggatccttctggttctttgtgaaggcagccagctctgtgttcatgaaggaaaggaattcagttttggagagttgagtgttgtttccatccttcccgctgtacttttggaaaacagcaatcagggactcaatgcatctctcagtctctgtaggcatttttgcttcaagttgaggagcgaggtccagctgcgactgtggctgacggtggctgggacaggagtccatgacattattttctttttcttgtctaggtggcccacaagctctttaaaaacttgaagtaaatgtgcagattcgtcctcctcagccttgtcactgggaatcaggaacagttccttgtggttctggacgtcggtgtctgatggagtgagttctcgagaacctcactgactttggcggtagcttctcttctgtgtgactagcagtgacttcatcttaataaactgatctgcaaacttgctctttgtccttcctttgccatacccttactttattattttattatattttaaatattaaaaaaaaatttcccccataaaattgaacccacagtattgtacatgctaagcaagtaccttaccactggactgtatctcacctttctattttactttgtaagtcttgcaaaattgcacttgttagttctcagatttttaatcctgcctcagcctcctgattttcatattacagataggtgacacaaactcagttcctttgagattcctccctaccccctcccctcttttttatttatttatttatttttgttgttgttgttgtggttctaggacttgtatccgggttgaactttgtatgaggtgtggttatgcatgtctgtaatcttagcaacagggagtctgaagcaggatgagttcaaagccaactgaggctacatgaaaagacccacccctatcccatacatgtaaaggataaaatgtaactaattcctgttacctagcaagtaaataatccctagtaataggatgggtctgtctaccatacagaatatgct

SEQ ID NO: 29038 - DNA, 1146 bp, Mus musculus
gtttcttgggctagatttctcagatatgtttcagcgccaaggattttttgcacatattttaaaagtagcaatggaataaaataacttctgttaaggattcatgagaagccattgagaaaaccactataactatataataaccttcacaattactgttttggtatagtttttatagatggttaaataggtcttcctatagttagtacacactagacctagcttgaagcaatctggctctggagtatttgtttctgttaattgtgccatgctgctcatgtagttaccatgtttgaggtattacacttttattaacagatctgaaaaaatccaactgttttacctacatgttcactatcccttgcagcagaaacaactgcaatagcttgggtcacactctcattcatatttttcatggccatataacttgcctgtaaaattgaaggtttattaacgtttgaaacaggatctcattatgtatctctggctagcctgcaactcagagatttgctcgtatgcccaggattgaagccatctacttccatgctcaactttgtaaacgattcccaagactgtatgttaagctatctgcatgcctataatcccaagatgctgagggaagcttgagctacatagcaagatcttactctaaaagacaaaaacctgtatgtgggcaacaaatatgtagggaaagtgctagtgaggccctgaaggactcaagaacatcctttgctaccacttaaaactaagcagaaaccgggcgtggtggcgcacgcctttaatcccagcatttgggaggcagaggcaggcggatttctgagttcgaggccagcctgatctacagagtgagttccaggacagccagggctacacagagaaaccctgtctcgaaaaaaaaaacaaaccaaaccaaaacaaacaaacaaaaaactaagcagaatatggagaaaggttcagtgttaaaaatctgttgtccaagggcatttgttgaactcaagttcaattcctagtactcacatagtggccctttctgattcttcaaactaggcacgttgtacagttatacatacaagcaaaccaccaatacacataaaattttaaaatttgttgtttaacatgcacaaggctttgggttcaatgcccaacatt

SEQ ID NO: 29039 - DNA, 1556 bp, Mus musculus
ggaactggtagggatgccatgaattagatatccaggaagcaactaggcttttgtctacattgatatccttttcttcccccatcccttgtctcctaacccctagcatacctgatgtccagctgacagagagaagaggaagaatcctctgagaaaacatctgctagggctaataggccagcgttccctggcgagggagagaggaacactcattaactctactcacaaacaaggaaacaagggtatcctatcccagctccaacctgggagaaccctagtcctagcagttctgaatacccagtactcaaatacctatattacaacctggtcagtacctttaccccaaaagtttctagttcctagttccttctttccctcccttctcccttcctcctctccagggtatggtccctacccaggcggttccctggtagtcgaaggcccttcagtgtagagttgcccttcatagcagcaaccatctcaggaagaaattggactgggcgcttctcaaacagacggcagaaggagaaggtaatctctgtcaagagaaagtagaatattcagatgactgaagcaggggtggtgctgtcctcctgtcctaggttggcctagcaaggtactgtgaacatttatacagatctgaaaaggataatctatatagatccgagcaatattggaactcaattcaaataggacattgagcctgtttgaggaacatctctgaggataaattttttatccacttcccgctctctatatatagtcactgatgcttttgcagggggggagactagtcacagtgagtgtctgactagtcacacccacacacagtagcatgtttatttctccccactatctttttttttttttaaattgaaaccaccaaggtgctaccaccatttctgacagccccttaaaacaaaacaaaactgggtgatgtactaaaacttgggatattagaaggaaggtcatgtaggttccatatcctttatagtcaaggaagatagagacctgggaaaacagtggtttgcagactgagatcatgacaaagctacagtaaggacacaggaatgcgcaggctctgggttaggaacttaccttgaagggtcagattctttagcaaaaaaagcacttcactctgacagtctgcaagattcatatcatggaagctcagcctcttcagggataggttgtgttctggataggagacacacaccatgggtggtggggcttaattttcccagggaacaatgttaggtccctacctacccactttcaccattcctacctttgagtgtttgcaacacaagcccaaaatcttgaggcgaggcaaaggtggcactgtccagtgacagctgctgtagagaacctgaggccttgaggacagagcagagcagtggggctggctgggctcctcgtggaaatcccatttccaactgctcgaggcagttttctgtatgagaggaagaggacattccacttagttttctctacttcacttaaaaatacatatgttttaggtgtgggaacacacaccctttagttccagaactcaggag

SEQ ID NO: 29040 - DNA, 1279 bp, Mus musculus
gtggcaaccaccggggcctgtggagattatttcggaagaagaaccactttttggtggtgggggtcccagcctccccttactcgtgagtcaccccgttctgccctaggaaatggccttctgggtctgaagcatgtcctctcctctgtaccgttcatctgttatgtttcagagtgaagaagccaccatcagtcacccctattttcctggagccacccccaaaggaagaaggagccccaggggctgctgaacaaacgtgaagcctcctccaggactctgcagggctgggtactgtgtacccccagacaggctagcccgttgccctaccctgtaggatttagtagatgctggtaggggtagggctggtttgtttttaacatggaatttaattactaactccaaggggaaggatcccctgccccaacacccctattcctgagtttaaggtctatttatttacttccttgtcaaagaagagcaggagagttcccaggacctctttgggatccctgggtagctgatccactcttttcataccctgtcctcccaggcctggctcagaacctatttattgactgtcctgggggccttgggaataggcccaacccggggcctttattcctctctggaccaggatgctgccctgagggtgggactggctcatactcaggaaaactgttgtgcccaactgatggacaggcccatatggggtccatgtgctgacagactcacacagagacctttagacactggaccaggtctcctcttagccttctctttgtccagatttccaaaactggataaagatggtcattgattaaaaaagaagaaaacctctgggggtgtattttgtaatagttttgtggggagtatggcgtggtggtgagggagaaaccattactggataaatggtgaggtgtttggggtttttggttttttgttttatctgccatagtttatcttctgtgtgaagccatttggccaccaggggatgcccaagtctcaagcttcaagtcttttgtttcagaagggttccaccctggtaccagctgacttatatgccttgcctacttggcagccatctcacaccccttcctcgctattctaccaccctgctagttccatcctttgtgtctgagcccagcacctgtccccagaaacggagtaggtaagagaaaccaaaaaggacagatgggggtggttgaggcaatgctctggacgtaaccatagtggagacaggaagtgactggatcagaaacagtggcagccacagcagtgtggg

SEQ ID NO: 29041 - DNA, 1151 bp, Mus musculus
taccgggtagccccagatgctgtgcactcaggtacaggggtacccctgcaaatcagaaaccatcccttgggaaattggaatgaacttgagccatctgcttcccataggccaactctaaagctctttgagcataaccttgaagatctataagtgttgggaagattgatgggtgggggcagtgaaggtagattaagtggactgtagtcaccagtggtaaaaagtgaacagcagtcttggggcattctagagcaaagttctgccttactgctcagtcacttctaacagctaacactgatgtcttgttttctgtttgtctgtccacccatgcaaccatccaaagtaggagggaattcctcgcagagcagctctcccagctccagtgtgcccagttctcctgctggctctggacatacacggcccagctctcttcacggtctggcacccaagctccaacgccaataccgctcaccacggcgcaagtcagcaggcagcatcccactgtcaccgttggcccacaccccttccccaccagcaacggcagcttcacctcagcgttccccatcacccttgtctggccatgggtctcagtcctttcctaccaaacttcacttgtctcctccgctaggtaggcagctctcacggcccaagagtgcagagccaccccgctctcccctacttaagagggtgcagtctgctgagaagctggcggctgcactggcagctgctgagaagaagttagcaccttcccgcaaacatagtcttgacctgccccatggtgaactaaagaaggaactgacacccagggaagccagccctctggaggtagttggaaccagaagtgtgctatccgggaaagggccacttccaggaaagggggtactgcagcctgctccttcacgggcccttgggaccctacggcaggatcgagctgaacgccgtgagtcactgcaaaaacaagaagcaatccgggaagtagactcctcagaagatgacactgatgaggagcctgagaacagccaggccacacaggagccaagattgtccccccacccagaagcaagccacaatctactccctaaaggttcaggagagggtacagaagaggacactttcttgcacagggatctaaagaagcagggccctgtactctc

SEQ ID NO: 29042 - DNA, 1096 bp, Mus musculus
ccctcactctgtgtacagctccaaacatattttccctaaggcttaacgttgaacctaaacaaaaccatgcttttacttcattgggtatttactggagaaaaaggaagtggaacaaacaagtattttagcagatgcaatctttgaatacagtattcccatcctaaaaacttagtcttatcccagcaaggcatgatgaatgtataaaggcctggatcccttccttccgtctcctaaatgatagtcttgaaagccacttgcaaattgatttcctgctttctattacctgtctcctacccatgctaatagcagaagggctggggtcccaggctccagcatcaggctgttctgtgaggctatttccttacgttctacaaagcctaagaactgactggagcagggtcctggatcatgatagctttttctcatgatagcctgggctctttatagggggagactgtgccactctgctcaagaacatcggggccctacctgtggacatggtacgcctgtactttgcggaaactgtgctggctttggaatacttacacaactacggcatcgtgcaccgtgacctcaagcctgacaagtatgcccactgtctagttctgttgttcagggcatcctcttgataattgagacaaatgcatgttcggatcatcttagaatggctactaggaaacagaagaaaccaagcagaacaaaagactcagcacatctaatagtgacatagaaaattagctttgaaacacagacctctgtcagatgccactcatgctggttaactctgagtcagtcttttaactaaagttttgaacctcaaattcccctcttctgaaatgaaatcagtgcatttgctctgctgcatgttctagaaatatacccccttccttctttggtgctgtttatcaaaatcaaggtctgtgcatgctagggaaattctttaccactgaactacaccctcagttccagaatagtttagagacaatcacaggactcaggagatcacagcacttgtttcttgctcagatgacgagccaggtaggaaacctgactttgagatatatggcctgggcagctaggctagcccattaaggga

SEQ ID NO: 29043 - DNA, 1192 bp, Mus musculus
tgagcatggctttaatgactaagtctgctttccttggtttcctggaaagtgaagaattaggtaaaatgcaggttagaacccccgaggagctgcacctccctggaagaaccccttagataatgttggcactgggagtgacaaggagtcattggccaggtcgcaaagacatgattcaaactcacagattgatgaaaatgtaactgcagcttctcagtgaagagtggacaatgcagtgagggtggatcccaggcagtgttttgatttcataaaggagcccctaaaccgtggtggtctcaccgttctcatgggctcctttaaagtcagtgagattgggaggattgaaggaacattaagggaagtccctaagtgaatcaagaccgaagcgcacttctaagcctaacctagctgatagctgagatcttgggtttgagtactaaactgggtactcatctgtttgactgaagattacaaatgtttaagaagatatgatcacagtgttctacatgaaaatatagagtttactatgaaaagataataaaaagactgaaaaattactaccaatatccagttaaaacctagacttagaactcattttggcttttgtatcctctaggtgacagtcagggtagcattgactgtgacttgttttagaaatgaaaataggtatatacagtttttctttgtttcctcgattgatttgattcctaggacatgttggggtagatgtcctatctttcactaaccaaagctataagaacagcaagttattttctgggaaggtttccctagagaagccagcagtagattgattgtggcaagtagattcccctcttttcagccagggcagagagctaggagagagctacacttcttgcagcaaggtagcttattttaacattgcaccattttaaaactataaacaaatattctaggagctctaagaatatagaaagcctgaaactttgctttcatgaatgtaggaatatgtgagattctgaagagaattgagctcagggactccaagggtggccatatttctccttgattttccctggcactaaaataacatgattcttttcttcttcttcagtcctggacggtccccagtttcctttgacagtgaaataataatgatgaatcatgtgtacaaagaaagattccccaaggtaaggatttgttttaaaggagaaaa

SEQ ID NO: 29044 - DNA, 1180 bp, Mus musculus
tgtagcatcccctggaactagagttaacaagtgttgtaagctgcctgatgtgggtgctggtaactgaatgttcaggtccttagaaagagctgtaagtgctctcagcttttgagccatctctctaatgccccttaatgagttgttttttaaatatgtgggttagagttttaccggcagttgtgtctggaatccagcattactgatggttgtgaactgccatgtgagtgctgagagccagtgctcctaactactgagccatctcttcagtcccttagtgatggttctttattgaaatggtatgtaatgagtgtaagagtcttccaagcatttattacttagaagtttcttctttactttctaggtagtcaccaaaatgatctgtttagttttaagagggacttttgttagattatcaagctttgtttaatttacttgtatttgggtaagtgtatataatagcttagtataatgctactgcctggaaaaacccaaactgtagttacaacttttgattgttttagcccaggttaatggtgaactctcaacattctttctgcttcagcctttgagtacataagccaccacatatggccctgtagctttgagcatccttactctgaaatctgaaagtttttgagtaggaatatccaattaaaaaaaaaagttttggatattgcatcattttagatttctgattttcagaatagggatattcagctgataagtgctacataaatattctaaaatcaggtgtattctcaaatccaaacatttctagtcccaagcatttcagatctttatcagggatttaacctgtatatgtggacattttttatagacaaaaattttaaggtttttttttttttggtttttcgagacagggtttctctgtgtatccctggctgtcctggaactcactttgtagaccaggctggcctcgaactcagaaatctgcctgcctttgcctcccaagtgctgggattaaaggcacgtgccaccactgcctgtcaaattttaagttttaaccaccttggttctaaaactgcttctaaaatggttcttttccttgatagtcactttagcagttgtttttgctaagatctgaaggccgtcgtcattgcttttatctctgcagtctgtcagttagaaacaactcattgaggttttgcatactttacac

SEQ ID NO: 29045 - DNA, 1208 bp, Mus musculus
cagaaaaagggcccaagagacccgattaaatagaaatataaaaatactttcttggtattatttacagtgtctgtggaggccagaagactgttgaatcccctgaagctagctttttttttttgttttgttttgaagaaatatttgtttattttatatgagtacactgtagctgtcttcaaacacaccagaggtgggcatcagatgcccattgcagatggttgtgagccaccatgtggttgctgggaattgaactcaggacctctggaagagcagtcagtgctcttaaccactgagccatctctccagagacccctggagctagctttacagacagttctgagctactcaatatctaggctgggagctaaacttgggtctagagcagtacatagtcttgagcattgagcctgtatctcttatcctgtaaagctgcattttagcatcacaattatgttcctcctttggctccttcctccccacccccacccccccacaggtaggaatttattcttcatacatagtttttgtttttgttttctaaagagtatttcttttagccagatggcggtagtacacaccttttatcctagaagaaaggaggcagaggcaggtggatctctgagttcgaggccagcctggtctataaagagagtttcaggagagccaaggctacacagagaaaccctgtctcaaaaagttacagatatccacctgcctttgcctcctgagtgttgggattataaaaattatttcagggctggtgagatggctcagtgggtaagagcacccgactgctcttccgaaggtccagagttcaaatcccagcaaccacatggtggctcacaaccatctgtaacgagatctgattccctcttctggagtgtctgaagacagctacaatgtacttacatataataaataaataaatctttaaaaaaaaaaaattatttcaaagtaacttattttgaaaaatgtcctaatccttattatgtcatataaggttagtttacatttttgtgtgtctgtgaattgtatagtcatgtacctaaacatttcagtgttttgattatactgagaaaagtaaaagatgaaaaatcctgtattagaatctagcaatcatgaagtcatatttcatgaaaagaatcctacttgtggtttgaagagatttggctcccatagactcatgtgtttgaatctgtttggcccag

SEQ ID NO: 29046 - DNA, 1108 bp, Mus musculus
atgctttaagcagttgtgtgagatagtgagatttatgttaaaagcttctgttgtggatagtttgccactggaattgattgtgcagaagctctcttacagtgctttactattacatttgacctgtcaccttgatgacatttcttgcccacatctgagaccatttgtccttgtagccatgaccttgttatgaacagtgcttgcactcactgtgcagatgtccatgttttgcctatttgagcaacattacagtgccattactcaaggcagttgaatgaggtgaacatagacatagcttcccccctttccccccttttttaaatgtaacaaataaccttttatgttccccttcccccccttcccctccccctcccccctttggaaaagtgttgggaaggaggtattgaggatgagccgttgagaggattaagagggtgggccacacagagctgggcttttttgtgcttcatcacaaggcgtgctgctggccaggctattttagcacccttcttacaagaacacctcgtggaagatacaggcggcaactttggatacaggaccacagaggtgacactctgagggtaaatatcattcatgggtcttaacctttggagaaaacatccattatatgtcatgaaaaaatgcctgttgtgttgtgaaggatttaattctcagtaattcaggaacaccagtgaatctcaggtacaagttgatatgtgagacgatattcctaaggtaaatggaaaagctcttgagaggttctgtagcagtgacccacttaatgcttcgacccttattacatcagtaaccttcttcttcgtcttttaatatagttaaatattaataaatattccttgtgttgtggtgacttccaatcataaaattgtttttataagtataattttgctgctgttatgaattataatataaatatctgctaaaaacccttgtaaaagtgtctcttgaccacaaatggggtcttgtcccacaggtcaagaaccactgttctatatgtatttatggtaggtgtttttgttttgcctttttaggcaaaaactcaagaatgtttttgcttccttcctgtaacattctttatttccatcatatttgt

SEQ ID NO: 29047 - DNA, 1234 bp, Mus musculus
ctgtcaacacctgtgtctctcatgcacatagccaaggcaaaacactagtgcacataaaataagtttaaacaaaagagtttttaagggtataaaaatatactagacaatgtcttcaagagtttcgtgttttaagggtgaaaagtaacaagggtaaaatgacagagcttaacttcagtttagccctttgttaggtgtacagaagacagaatgctaatatgctcttgtccttttaaacaggggtgataccagtgctcagataaagtgttctctgtactagcatgctggtgaagtttgaatgaatcctatcacctatactttaaaacaaaacaaaacactaggtatatatctatctgtaagcccagagctgatggtatgatgaagataggccaattccacagtcttgtagataagccagtctagctgagatggcacacacacaaaaacacacacacacaggcacacagaggtaatgataccttaatcaggaagctgaattgagcaagacaggatgacatagggaagcaaattaaagagaatagtaaatggggtgtagtggtctgtaagttctaggccagcctaactacatagtgagacattgtctcggatggatggtatgtagatagatagatagatgggtgagtgtaatgacagcattctcccttgggagactgagttaactatgagtaccttgagggtgaagagtttataatgtggctggagttcagatctgtagaactaaagtaaatcaagataggcttagcagcctgcctatagttacactgcttacaaagtgaaggcccagacaggccggtggtggcgcatgcctttaatcccggcacttgggaggcagaggcaggcagatttctgagttcgaggccagcctggtctacagagtgagttccaggacagccaggtctatacagagaaaccctttctcgaaaaacgaaggaaaaaaaaaattaggaaggtgggtaagagcatgtactgcatcatggaaaggaattcttttcatagaaactcttttctctgttttgtttttgggaagtaagttgttttgcgcttatttctgttccactctgttgacctctattgtcttctttggtctctttatttttcaacacaggctttctctctgtttcagccctggaactttctctgtggaccatgctggcctttagccttgaacacacagagatttgtctgagtgctgggactaaagatatgaccaccacac

SEQ ID NO: 29048 - DNA, 1844 bp, Mus musculus
ggctacatagaaaaacactgtcttgaaaaaccggggcggggggaacaggaactgttttagaaataggaactctaaacccgacacccatcatactgaactctagactgactttataggaaaggggggaaatgtttgggtggcccagctttggttgcatacatctttaagcctagaacctgaggcataaataggcagatttctgaatttgaggccagcgtggtctatatagggtgttccaaaactacaatagtaagactgtctctaaacaaaagaaattaaatccttgtaagtttgaaaagtactgctttaagagatgttaggtctcttgggaattcccctccacatactcctctagaccggtgtagtcattgaaggttttttattttctttctcctatgctctgtagctacgaagaaatgggtttggaaagaatggcctcttacaaagccgtagttgcagcctgtcctccccgtggagaagcacttgcattgcagagtgtgaggactcagactcggaaacgagcagcagccagacgtcagacgacgatgcctggaagtagagataaaatgctcacagtgacctgccccgctgagctcagccttgtgtttagagaatataaagtgttcttttccttttcttatgttgttgaatacttcatgcacaagggaaataatcatatcccaaagagagagcaattgtcttgcttagcctttgttttcttccctgttacctgcttaataggcatttgtgtggtgggatttttttaagcacacacacagtacctgtggggctgtgcacaagtgggagctgtcagggcagagatgcagggaggagatgctgctctgctcaacagcttctactaccagcccttggggactcacccctgtgctcaagcaatcattgtcaatgacaaagtgactattgaagttataattgtattaaattaatgctaataatttggatattttattttatttttggctgctgggtaacttagcccttaaccaagcatatgtggttgtttttgttttttttttttttttgttttgttttgttttttattttctctttttttttttttttcttttgggtacagctgtaaaatatttggatataggaaatgttattcttgcagccttgatattcagggtggattgtaaaatatgaatttttgtgagatttcaaagattaagattattttgataacattatttacagatttaaaagatgtggttaccacaagtctgttgaggggaaaaactactgcataaaataactaacgtcgaataaatattttgcatcagtttggattgtcttgtgtaagaaatatattttctttaaaattagagagtggattctttttttaagggaaatatttttagaaaactaggggaaaactgaattcagccccacctgtttctcttttcagcaaaaattcttaatgtggaaaaaacctgtgcaataaattattcataataaactacattttttttactgaaggaattttttagtgcccaggatttatcaatatacctgggtttggaggcctccccccacctcagttggttgtgttttatgtgtaggtgttttgcctatgtgtgtgtctctgaatgccatgctgcactgattgccagaggaggccaaagggggacttctgctcctctggaagaacagctctgaactgctgctgagccaagtgtccagccaccaatatgaatattttaaagaaggcctgacaagtgcttcctacttaattaaatgggtgcatgggggtgattgaatgaagtaagacgacagtggagatggaggaatgagaatgactccgtgtagggttagcacttgcc

SEQ ID NO: 29049 - DNA, 1341 bp, Mus musculus
tgggtatctgggagatggatttgatttatggcttctttaataatgaatatatggaagagtacctggtcaacaatttatttgatcctttgtgtgatctcctgggtttgtcaaccttatcatctggtcatatatgatgggatgacttatgtcagggtaagttatagctaggatctttgtctttcaggctgagaatcaggctgagagccaaacagcagaggggaccgtggagtctgcagctacaattaaaagcactgcatgttaagaggcgagcagaaccttcctcctgagggaaagtggttttgtacataatgtattttttcacttttggggattctttttgtataactccaataaagattgtaggcaacagctgaggctttgatggctttttttcttaaatattggtggaatgctttggggcactctacatttcttgtgtgtacatgtttgtgttttgctattgcacaacccacttcctgtctaatgtggaggtgatcaagtgtggctagaagcccttcatcttctactggtgctatgttctatttcccaatacttggctgaaatcaattactgtgtaagctttcagtggtgctgtccttggatggggtctgctaaataagaactggtagaaatcagtttggtgctgaaaatggatgatggaatatgacccaggtcttggtttgtccctatctgctgttcatctggtttccatttaaggccataatcctatcctgggaaaactggtagaaacctgggaaattgttcctgaggaaaacagttgttagactcaggctcacactgtagtataagacactggggggagaaagtgtgttattttctgtatagaaaggttactatatgtcaataagtggaattgttatattgtctgcagttttgtctataaaaataaatatgctaattttaacaaagcccttgttctggaattatatatggaagactgaacaagtacaagaaggttcttgggctgctgggagtgcctcgtgcaatatggagttgagtggcaaactggtccatcacttcttggtgtctagttgtgggatggtggtcagggtttttttgttttggtttggttttggtttttttggtttggtttggtttctctgtatagctctggctgtcctggaactcactctgtagaccaggctggccttgaactcagaaatccacctgcctctgcctcccaagtgctgggattaaaggcatgcgccaccactgcccggtggtggtcaggattttaatgccattgggctagaacaggcagggtgcagagtctgagctgcctcatactgacttgttaaatgctacaaagcctgctgacag

SEQ ID NO: 29050 - DNA, 1196 bp, Mus musculus
gtgttttctgacagtcagtccaagcattccggaggggaagcagaaactccaggctagccagatctatatagtgagaccctgtttgcaaaggggagagatgagtccattcataactgaatttatgttaacttctgtccatggtgttatttcttcatttatcagagaattatatccaagctgtggaggagtttcaggcttgcctaagcctgcaagaacaatatttggaagctcacgatcgtctccttgcagagactcactaccaattaggtttggcctatggttacaactctcagtatgatgaagcagtagcacagtttggcaaatctatcgatgtcattgaaaagagaatgggtgagtgaacagaaattactgtatgtttaggtgataccgtcatttacattgtggggggaaactgggtttttttgttagtgatttaaagctgttctttgtagctgtactccatgagcagatgaaggaggccgaaggatcgtttactgaatatgagaaagaaattgaggagctgaaagaactgctacctgaaattcgagagaagatagaagacgcaaaggaatctcagcggagtgggaatgtagccgaactggcactgaaagctactctggtttgttgagttttatttttattttttatttttttgaaagatttatttatttattatatgtaagtactctgtagctgtcttcagacacaccagaagagggagtcagatcttgttatgtgagccaccatgtggttgctgggatttgaactctggacctttggaagagcagtcgggtgctcttacctgctgagccatctcaccagcccgagttttatttttaaataaaatacgtgtattacaataaatgtttatagtccatttaaaaggtacttttcctgacttgagttagttggtcagaatgtgagctcatttcacttgtataagttgtcccatggctagaaagtgtgttctgaatgcaggagacaggtgtacattctgtcactgctactttgttttttaccttgtatatttctttgcctttcagtataaatattgtgttactatttgtaaaatgtttttgagaataccattaaaaaaagcttacgtcatagatggagtgtcttagccataaattgcctggctctgttcttggcctgacatgctggggtatatataatctgtattgtaaataggacat

SEQ ID NO: 29051 - DNA, 2672 bp, Mus musculus
tttcttatttaagccagtcagtggtgtcacagcacttgcgagggagagacaggccaatctcttgagtttgaggctagcttggtaagcacagctagttccaggacagccagggctacacaaaggtactgtctttaaaaaaattaaacaaaaattctttttctttaattataaatgcaaagtacttcccagggccagaattctcagatctcatagagtcttgagtactgacatttgtaagctaatatggatggtagcaacggaaatcaggtcctcttgagaggaaagtgcttttaaccactgagccattgcttgggcactgcctctccctccccacactccttatttttaaagactaggtcttgctgtgtggacctggttggcctggaacttgtagaacttctgttttgaatatatatttttgtattctttttacatgatttctttttctgcttttttcgtcacaatcataaaatacattgctaggaactagttatacttttgtgctttttcttcttatagaatggagaatggagtgttgggaaatgccttagaaggagtgcatgtagaagaggaagaaggagaaaaaacagaagatgaatctttggtagaaaataatgataatgtagatggtatgtagagttgcatgttacagtcaagagttgcgacgactgatcttcctttaaataagtcacggaaatagggttctccttatggtggttggtctctccaaagatacttgggctgatgcagtaagtgtaggccattactaaagtgatagtgagcttttaagagaataactaaatgtatcaaatagatagattcttttaaattggcattaaatattaagagaacatcaaatatttttctgataaatattttttaaaaaaccttccatactcagttattaggagtccttggaggacttctgttttctatatcttagaaaagtaaatattttctaagtttggctgttagaaatcaaataagtatattgtttaagagagggagggaagcttgacatctcttctgactggtatcagattactcatttcttttgcagtatgttgctttgctagcttggattctccctttctccctttgcttttctcatgggggcatctgataaaacttaggcttaaagggaatgtatttctactttcaatttatgcttttatcattaaactccgagacatgtttatgcttcatgttctttaaccatgtagaggaagcaagggaagagttgagagaacaggtttatgacgccatgggagaaaaagaagccaaaaaagcagaaggcaagtctctgacaaagcctgaaactgataaagaacaggaaagtgaagtggagaagggtggaagagaagacatggatataagtgagcctgaagagaagctccaggaaacagttgaaccgacttcaaagcagttaactgaatcctctgaagaggcaaaagaagcagcaataccaggactgaatgaagatgaggtcgcttctgggaagacagagcaggaatcattgtgtactgagaaaggaaaatcaatttcaggagcttatgttcaaaataaagaattcagagaaacagtggaggagggagaggaaataataagcttagagaaaaagccaaaagaaacttcagaagatcagcctatcagggctgcagaaaagcagggcactttaatgaaggtggtagaaatagaagctgaaatagaccctcaagtcaagtcagcggatgtgggaggggaggagccaaaagatcaggtagctacctctgagagtgaactaggtaaggctgttcttatggaactgtcagggcaagatgttgaagcatcaccagtcgtggctgcagaggccggagctgaagtctctgagaagccagggcaggagattacagttattcccaacaatggtccagttgttggacaatcaactgtaggagatcagactcctagtgaaccacagacttctgcagaaagactgacagaaactaaagatggctcaagtgtagaggaggtcaaggcagagctggttcctgaacaggaggaagctatgctacctgtagaagagtctgaggcagctggagatggggttgagaccaaggtagcccagagggccacggagaaagcacctgaagacaaatttaagatagctgctaatgaagagacacaagagagagacgaacagatgaaagagggtgaaggtaaccgggatatgatagagctgcagtgggtggagtacatttctagatttgacgcactaatcattggtaaaagtcagccttccattcaggattttcagtctgcctttagaaactacaaagtaggtcgtctgatttctgaaacttggctagcagtcattaacttgttatgccatcatgctagccaatgaaatgatatgaagggtggattagaaatgggttgtgggatagatagggacatagtaggctaggctggcagagaatgctgaatggatgttcacttgcatgcctttggatttttaagtttactgttcacatggtttctcctttgttgtaggaagtaggaacagagcagtagaatccactgaattggtacacttaagcaggcatgccatttaagtcttctggtgcccttatcaattttagttcatagaaatgtttagaggattattcacactaattttaatcttcagggac

SEQ ID NO: 29052 - DNA, 1167 bp, Mus musculus
atctctctaacccctaattggggtgtttcattgtgtccccacgtaggcctcaaagtatattatccatactgttcttattcagttctacgtcagtgtgaattacatatgtgcctttagtatttttacttttctttttttcctgtgtatcccaggctgtcctggaactcactctgtagaccaggttgtcctcaaactcagaaattcacctgcctctgcgactcccaagtgctgggactaaaggcgtaagccaccactgcccggcaatatttttatatttttttgtttgtttgttttgttttgttttagacagggtttctctgtgtagtcctggctgtcctggaactcactttgtagaccaggctggtctcgaactcagaaatccacctgcctttatcctagagtacttggattaaagcatataccaccagtccttcaagatgtgtgttgtttaaaatatgaaaatttcttatgtgtttatgtttttctgatactacttaatatccaagctaaaaagagcttccattgtatttttttcttttttattgattatagaattgaagatgctcctgctccttctacctcggcagataaaatggagaggtaagattatatgatacaattatgtaaacagtttatatctgctcactgaaacatatctgaaacagtttatatctgctcactggggataaaatctgaaggctttacacagagtagtatctctgaaattgtatcttctgctcctctccttttcttagatgtctctagggtcagcaaaacctgttcagggattcatttagcttttttttttttttttttccccaagacagggtttctctgtgtagccctggctgtcctggaactccctctgtagaccaggctggcctcaaactcagaaatgtgtctgcctctgcctcccaagtgctgggatgaaaggtgtgtaccaccactgccccgccatttagatcacttttataaagaaaatttgcacctttaattttttaattggcactaatgtaaacacagtagtaggtaaacctgatatcccttcaacatgtgatgaccattatgaactgctaacagatttttcaaataccggggtatttggaggacattttgtccaaaatgagagcattccttaggggaatcaactcacagtgttgtttccag

SEQ ID NO: 29053 - DNA, 3147 bp, Mus musculus
ctcaatcttttgacattgttatctgcaaagagttacttaagagtaacatggtggcactaaaaagaaaacctctctgggtggtgatggtgcacacctttaatactagcacccaggagtcagagctaagcagatctctgagtttgaggctaacctgatctacagaacaagttcctagacagctagagctgcatagaggaactctgtctggacaaaagggctggagaatatggctcttgtcttgcagaggccctgggttccgttctcagcatacacatggcaggttgtagttgcctactgctccagttctaagggatcttgacaccctcatacaggcctacattcagacaaaacacgaattcacatgaagtaaaaaaggaaaagtgaagaaaagaaaaagaaaaccacttactttaagtaagttatggttttgccttgggtcacattccgaggcacactttttctctcagaggtgttgtaggtaagtttgggtgctcaggactcttctcacagtggcctctgcctctctcacaggcagtccctcgagaggagctgtttgtgacatccaagctgtggaatactaagcaccaccctgaggatgtagaacctgccctccggaagacactggctgatctgcaactggagtatttggacctctatttgatgcactggccttatgcctttgagtaagccatgtttctacaacgtgttctggaagttgaggggtgggtgtggtagcattggtaattgatgatattcacagctgcagagcagggtaagaacaccaatcagtggcaggagcaagcagaggcagttccttaccatgggatttttgcctttcctgcagcccggtgtttaggtctatgaagagagtagcacccagcacgtaccctagtgttccacacatgatgctcttcttttgaagtagcacccctaagattttggccatgaatttctcagcagaggagggtgtgagtagtcttatgtaagcactgtgcccttgtcagatgggcagaacccctaccaaccccccagagaaagtgacattaaggaagctatgctagaggggaggagatagggtctggcctatgaatgaggcatgatggcacatgtctttaatcctagcacctgagaaatagaggcaggtgaatttctgagctcaaagctagcagaactagtttcaggatatcctgggctacttaggaaaaccctgttttgaaaaacaaaaaaaccaacaaaacaaaacaaaacaaaacccaaacatagaaagcatgtgctatgaatatgaagggatgggcattccatgtagatgaagtgcctaaattcttttttttttttttaatttatttatttatggaagtacaatgtagctttctttagacaccccagaagagggcatcagatttcattacagatggttgtgagccaccatgtggttgctgggatttgaactcaggacctctggaagagcagtcagtgctcttaaccgctgagccatctctccagccccctgcctgagttctaactagaaggataagaaagcattgcagttcctaattcttgtcactttatcccttggtcttatggtgtggtccacagaatagctggataggcaggcaggacagtagcctgacttttgctgacacttggggatggggtctgtttactcaggcggggagacaatccctttcccaagaatgccgatggaactgtcagatatgactcaactcactataaagagacctggaaggctctggaggtactggtggcaaaggggctggtgaaagccctgggcttgtccaacttcaacagtcggcagattgatgatgtcctcagtgtggcctctgtgcgcccagctgtcttgcaggtgagcactacaaacagaccaaaggaaaatgtgtgtgcagagcatgaataatcaagtggggaatctccttaatggaggtggcaagttgtcagaggtgttgttgaagaaattctctgtataaaagtggatttgaatgtaaatggggaaaatacctaatttaaaaaaaaaaaaaggaaaatagagttttaaaatttcattttccagtacaaggaaaatgaaattttaaaaataaaacttgtttcttaaggggacaattttgtgtatttagtaacactgtaaagaaaagagaattactaatgacaaaaacaacccccccccccccaaaaacaaaccctaggtaacagctaatgctgaggataggatgataaatgacatcgagggacgagagtggcaagacttgtgtgtgtattcaaatatgtacatattgttctatgtggatgtttcctttagtttttaaattaaaatttacattaagttttaaaaaaaaaaaagtggatttgaagtcctggaagagaatgaactcaccagtgaaaacaagcgagctttaaggcagcagaggttaacagtggagggctattccgctcagtgtagaaggggtcaggtaatctgggtgtggccaccctgtgctgaaggctcttccttgttttaggtggaatgccatccatacctggctcagaatgagctcattgcccactgtcacgcacggggcttggaggtgactgcttatagccccttgggttcctctgaccgtgcttggcgccatcctgatgagccagtcctgcttgaagaaccagtagtcttggcactagctgaaaaacatggccgatctccagctcagatcttgcttaggtatgggactttttttgtttccttccttttttggcttttctagacagtgtttctctgtgcagtcctggctgtcctggaactcactctgtagaccaggctggccttgaactcagaaatccgcctgcctctgcctcctgagtgctgggattaaaggcatgtgccaccattgcctgtctggtatgggacatttttgagaagttctatttgggaggcagggactgagggaattttttatttgaaaaggcctgggggccggagagatggctcaatggtaagagtgccgactgctcttctgaaggtcgtgagttcaaatctcagcaatcacatgatgactcacaaccatccgtaatgagatctgatgccctcttctggggtgtctgaagacagctacagtgtatgtaaatataataaataaataaatctttaaaaaaaaa

SEQ ID NO: 29054 - DNA, 1099 bp, Mus musculus
ttcagtttgtagatcatttactagatgaattgcattcttgccccccttttttttcagtgtgaaaagaacttggtgtgtatgctaatattaacctctcagaagatcaaaattgactgaatagtgtttattctatagttagcaaaccaaagaagaaacagtcattttaatttaggctttcttggtacaaaggttataaaagtagctgctaagagctgtctttattaactatgctaacattgattaccgtgttggtgattaaaatcttctacaggaaaatgtctgcaaaagaatcttttggaaatttcttgttttcattcagacagggtttctaaacctggctggcctggttcttactctgcgtggttcaggttgacctcaacttacagcaactgtcctgaatgctgggactttaggcatgttatcagtgcccctagatcagaaactcagcttcaaagctaacttcttgattgctttttccccccacaggaaaatatgttgtgttcttcttttaccctcttgactttacttttgtgtgtcccacggagatcattgctttcagtgatagagccgatgaatttaagaaactcaactgccaagtgattggcgcttctgtggattctcacttctgtcatctggcatggtaagtttttggtctatgtggtacgtgaaattttttgttatttatttaagtatatgagtactatagctgtacagatggttgtgagtcttcatgtggttgttgggaattgaattttaagacctctgcttgctctggtcaacccagcttgctccagtcagccccgctcacatcagccagccccactctcagtccatccagcccaaagacttattatacattaagtacacagtagctgtcttcagatgtgccagaagagggcttcagatctcattatgggtggttgtgagccatgtggttgctgggatttgaactcagaacctttggaagagaagtcaatgctcttaaccactgagctatctcacccgcccatttttttgtttttagtcagggtaatttttaactcaagctggcttttagcctcatgaataccttgtaccaccagcttcatgagtaggtagg

SEQ ID NO: 29055 - DNA, 1436 bp, Mus musculus
tttaaattaaagtttatttttagaattatgcatgtagaaggtgttgagtgccaggcagttgcacaccgtcagatgtgggctgtcttctccagctgctttgggtttggggggggagttgagggacagagtcttatcatccagtctagcctgtggaatttggccaagataggtctcacttggctagaattcagggctggccttgaacttatttccagagatctgactgcctttgctttttgagtgctgtagtaaaggtgtgtgccataaaacaatgtgtagcctaggttggcttcaaattcataacctgcttgcctccatatctttaccatagcctgtcagcatgtgccacagaagacatacaaggatgaaggggagggaaatacacagctaaacaggttactaattaaaaatctttctcttggcagtgtgtccagctggctggaaacctggcagtgataccatcaagcctgatgtcaataagagcaaagagtatttctctaagcagaagtgagcactggaccatttttctgccaggcagcattgagcagccagaagaaactcttgtactctactcgtgcttaaacacatgatgtggtgtgattccagataagcctttcctacagggctggggatggatagcctttcttccactattggtaatggtctgagctgtgttttgggcagaccaatcttctatcagtcacagaaaacaacctgttaattcttttttcttctttttttaagtatctattaaacgtgaattctgagaacttggtgattcattctttaaaggcaacattggaattttaaaaaggactttattttcatgagtaggtaaaagtgtttgagtgttgtttatcttttttaaaaagaatgtttccccagcatgtgtaccatttacctgcctgttggataccctgggaccatgtgggtgctgggaattgaacctgggtcttctataagagcaacggggttcctaaccattgagctgtctctccagtctcttaacttttgagacaggatctctcactgatctagaacttgatgtatatgtgaggctagtaagctctcaggatctacttttctagtgctggttttataagcatggattaccatagttggccttttgtttttcgagacagggtttctctgtgtaacagccctggctgtcctggaactctgtagactaggctggcctctgaaagatctacctgcctatttaatctgccaggaattaaaagtgtgtgccaccactgtctgcttcatgcctagcttttttttttttttttaaatgggagttccatggagtaaattgcttcctcacaagcatgtcacagctgaactatctccaaagcccctgtttttcttagaaaattgggtttgaaaggttgaaaggtgcctcaggtctggagacaaagcttttggtagagtgcttg

SEQ ID NO: 29056 - DNA, 1520 bp, Mus musculus
ttgggggctggtttgccatccgaggggttatgttgctgccagggattgaagtgccaaatttgccacccagaaagccccctgactgtgtgcctacaagagctggccgcatcactctgcttgaaggtttcaatttccattggcgggactggacttaccgtgatgctgtgactcctgaagaacggtactccgaagaacagaagatctacttttccaccccacctgcccaacgcttggccctattaggcttagcccaaccctcagaacaccctagcactacatctgagcttcctctttccttgcttactaaacctcagaattccaggagagctcgaagctggctgagtccaagtgtctcaccacctgtatccccaggcccttgataacttttccccttcaggatcccactcatagtagatttattttaagtaggatttgggttttgaaaaaaacactttctccttttttagtttttttgagacaaggttcctctatgtagctcagaccaggttggcctcaagctaagagagatccatctgcctctgtcttctccagagtgctgattttttgcactgtggaaaaaccattttattttaggtaggatttcctgataatagtgcttcagacagtcaagactcaatttacattggtcaagataaatcatatgccaaggcagactcaaaaatcagcagttgacttcaaatattagactcatgcccattactatttttttgtttttgttttttgttttttcaagacagggtttctctgtgtagccctggctgtcctggaactcactctgttgaccaggctggcctcaaactcagaaatccacctgcctctgcctcccgagtgctgggattaaaggcgtgcactaccaagcccggctttgtgtagtactcttaagatactatttaagaaccatggttctcactgttcgttcctaaagctgctatcatttaatgcagttcctcatgttgtagtgaccgcaaccataaaattatttttgttgctacctaataattttgctagttatgaatcaattgtcttagggaatccagtgaaagggttgttcaacaacccctgggggctgagaatcacagatttagcagctcctaggggtacccaccacattgagctatgctgaattaatatttaagtaaactacattgaaactgccccgacctacagtgtgctattactaaaggctcaggcaatcttatacttatgctcaaatagatgtactttgaattctggaatgttggaaggacatgatgtcataggattattttgtcaaccctaaccaagaatccagaagaaacttcctgactttacaggatcagaaaggaatattctctcatcacagctaaaatacaagtagttgaatacaatcatatccaaagccaccaactttgtttgcctgtttgttgattccagagatagtttcccaattctgatatttcaaatttcactcccagggtccagggaggttagttggtaaattgtaatgtgctgtttttact

SEQ ID NO: 29057 - DNA, 1224 bp, Mus musculus
ggcttgctatgtaacccagactggccttgaactcaaaatcttcctgcctcaagttcctggtgttaggattacagtcatgggccaccacattttcatttaaccacttaattgtagttggggcataggtacagacagatagtcagaaatcgccagagaatcagcacattcagatcaggcctgtgtgtcttttccagggtggtccagggcctagttctgtgcatggcagtcttgctaatttctttctttttttgggggttggggggagttggctttgttttttgcttttttgttttgttttgttttgttttgttttgttttgagacagggtttctctgtgtagccctggctgtcctggaactcactttgtaaaccaggctggcctcgaactcagaaatctgcctgcctctgcctcccgagtgctgggatgctaatttctttttaaatttaattttattttccttcatcttagaactccagaacaactcccttcctaacctggaacccagcagctctcagttccatgcctggagtctagggcaagaggacctgttccttgagggccccacgatcttccagagtgacctgtaagaacttgtgagaaaaatgaggtgcagcttctatcccaggcagcctcctcatcctctccgttcatgccctctttaccgaggcatcgcactgtgcagccagtccttctccctggctaattcaaaataaagtagcttcattctccctgatgtgttctctgtaaatcttgccccacatgggataggctgggccatacctttccttcttgttacttacctggttcctgtgacccctgcctttgaaatctgacaatcataggtgcacctttgactgagctccagtgaacttgggaagaaatgatctcttgtttggtgagtagaataggttaggatgttgggagtattgaggtgatcacaaaggagagtgtgatgttccggtgggcactagatccagtcagtcacactgctgggaggcttaccccagcttctccctacctcctcaccctcagtagcccagtctgtatgtctacagttctgtttctctgaaatcgagttgtcttcaaaacaaacaaacaaaagccaacaaaaccaaaatctctatttcttattttgagaaaggatctgtttaagtagccctggctgttctgggaacaggctctccttgaactctcagggttctcctgcctctgcctccctagtc

SEQ ID NO: 29058 - DNA, 1128 bp, Mus musculus
cagcttgttttatgtggttcttctgatggtcagtatcactgcagcattaacagttgtttgtggtggttggtttgtttgtttgttactgctttttaaaggtagggtctcagcatgtaaccctggctggctttgaactcccaaagatcctggtgcccccacttcccgagagttgggattacaggcacgtaccacacgttcaccgccagcctcaaaaactctgtgtgctgggattatgtaagctgtgaactgccagatgtactttaaactatttagagagacctcattcatatatcttctacctgttttttttttgttgttgttgttgttacaatatttacaagggaatccagggccttgtacatgctaggcaaacattctgccacccctcttttgtggtgtgtgtatgtgtgtatgcaggagtgtgtaagcatgggtgttctggctagcctcaaacttactgtattgacagggctggttttgaacttgcattgattctaatacttctgtctctagtataggactgtattactgaatctggctgtcttgtgtttaaaaatatactatttttttaattgagtttctaattttgtttgtttgaattgaatttatctttaattttatgcatctgggtattttgcttgcatgtgtctgtgcaccaagtatactatgcctggtgctaatggaagccagacagggcatcagatcccctgggactggagttacagtcagttgtaagttgccatgtgggtgctgggaatcgaatctgggtcctctggtagagcagcaagtgttcttaattgatgagtcatccctctagccccacatttgttttttaaaaatcacgttcatagccgggcgtggtggcgcacgcctttaaacccagcacttgcgaggcagaggcaggtgggtttctgagttcgaggccagcctggtctacagagtgagttccaggacagccagagctacacagagaaatcctgtctcgaaaaacaaaaacaaaacaacaacaacaaaaaaccacattcatatgcattttggttcaaatatggtttgtgcatccaaaactaatgataaagtttaatcaaatccactgtaaatatgccttcatctttggtgcttagaggtgtg

SEQ ID NO: 29059 - DNA, 1135 bp, Mus musculus
cagctcacactctcctgctgggcatgcagagctccggccagccgcagaggaacaaggtgtgcccagaggatagggcgccaccctccagcgggtctcacacagccacctttcccatacagacttccaaatcactaactcgggcatttccttccttccttccttccttccttccttccttccttccttccttccttccttccttccttccttcctaccttccttccttccttccttccttccttccttccttcgttttttgattgtttaattttgttttgttttgttttgttttgtttttgagtcagggtctccctgtgctgcccttgctatcttggaactctgtagaccaagtagtcttagaagtcagagatccacctgcctctgcctcttctgggattaaaggtgtgtaccaccacgcctagctcatgacaacttgtttttgttttccttcttctgtttttttttttgtttgttttgttttgttttcaagacagggtttctctgtgtagccctggctgtcctggtactcactctgtagactggctggcttcaaactcagagatccctctgcctcttcctcccaaaggattcctcccaagtactggaattaaagacctgtgccactaccaccaggctgccattcttcttgtttaaaattttttacatgtattttatgtatggctgcatatgtgagtatacatgagacatgcatgtgtggaggtcacaggacagcttgcaggaattggctctctcctttcaccatgagttctgcagtgattgatcccaggtcatcgatctttgttgcaagtacccttacatgcaaagtcatctttctgtaccctacctctgtttatgagacaggatgttgctatgtagccagcctagcctcaactttgcaatcctcctgcctcagtcttctgctaagtttttcaggtgcatgcattgatctcaccaaacatactactagtttttgttgttctgtttcagtacagctaatttaaagaaggactcactgacgtattacgtcctggttcctttctgactactggtgtttgttcaaagtttctccagctcaagatgggcatggtggggattgcctgtattcaagatggaggcaggaggattaagagtacga

SEQ ID NO: 29060 - DNA, 1173 bp, Mus musculus
gagagataggaagctacagcccacagctaaaggtaagagatcagatcagaaccccaaacttgaccccaaagggagggaagagactgtgagacatttcctctagggaaggctgggttcagaaggaggagggcagtggtcatgggcagtaaagtactaggctctcatacaggggtgacttgtcacactgcttccccgtttgctccctcgttgatgaaatggacaagaaaagtatgtaataaaatactgcttatattgcctgagagtaacccaggcttgctgttctttaggaccactggagaaagtgcctggagggaagcgactgagttcactggatgacaagattccccacaagtctccacgtccaagacgtactatctggctgtctcgaagccagtcagatattttttctcataagcccccacgtacagtcagtgtcttggacccctattaccagccacgagatggtgctacacataccccaaaagtcaaccctttcagtgcacgccaagacctcaagggcgggaaggtcaaattctttgacctacccagcaaatctgtcatttcccttgtatttgacctggatgcaccggggcctggaagtacaactctggctgactgtcaggagcctttggccatgtcttccagacggtggcggtctttgcctggttcacctgagttcttgcatcaggcttgtccatttatgggctgtgaagaatcactctctgatgggcctccaccacgactcagtagtctcaagtacggagtaagagagatcccaccattccggacatctgccctatcagctgcttcaggccacgaggccatggactgctctaacccccaagaagagaacggttttggacccaggcttaaggggaccagcctatgcactggggctgcctctgaggagatggaggtggaagaggaaaggccacgaagagcttctgtctacttctctatctctggaataagcttgcaaacccaggcaaagcaggatgggtgagatgggggcaggactagtccctgcctgccatatgagaggcgtttcagtagttagggccaacctaattttaagcctctgaaatccagcaaggaggtttggttcccatggaccacagtgcacgtcctagacaggaccaaaaaactcttcgtgctaggctgggctggcaggta

SEQ ID NO: 29061 - DNA, 1198 bp, Mus musculus
gccgagaagcctgcgctgcccatgccaaccctgagtttgtgtaagtgaaacgatcggctgtaattttaagattccacgttcccgccaccacaaatgaaagcacagattacctcctgcgcagtctccgaccggccgctcccaagaaaccccgaagggggcgtggcttcggtcagtaggaccgtccagccaatagacactcagcgcgcgcaaggcccacgctccgcaccccgcccgaccactcggaacggaagttgaccctacgggacccagacgccgagaccccgccccatcctagatccgtgtcgcttctggagacgaagcggaagtctctgcgtacctccagaaggctggcgaggggcgtcatggccgcggacagtgacgatgatgtgcctccagttccaacgccctctgacggtgagcggctccccagggatggccacagaagcctaaggggtcctggggagggaaaagcctcggcccggtagctcggagacaggcctgtagttcttcttgcctcagctatcttagactacaactcccagtgtgcagcgcgtgcaactgcaaaacccgaactgttgtagagtggagcagtgaggtgggatgggtggtgtgttttggacggagccggtggttgtcagtcggtaataccagagtgcgtagtcgtccacagtaagtggagcttgggtttaactttggagcactccggtagctgttgaggcatcatgtatatgtggctttatgggatcggtttgtgtttgagataggagcatgctctgtaggctagccttgaactcgtggtccttcagcctaatgctccctagtcctgggattacaggctggaggataaagaatcctcaaaggttatctagtccacttttctcctgatcatgatgcaaaaaagaaatgatttcccagtcccacataaaggcactaaaagacacagatgccctttttccaaatttagggcactgcccatttcagagcttgtgtttagagctggtagatgtaaaatctttaagtgaaagcttgtcagtgggcacccctttgcccacatctagcttggtgtttgctccacagggaccttgtgaaaccatctaaatccatcaacgcccttatccccaggtggtgtcaacaaaaacacacaacctgcagaggagtttgtggttcgggttcctgtggtagacgtgcagagtgacaa

SEQ ID NO: 29062 - DNA, 1149 bp, Mus musculus
ttagctactttttgggttcttctttttcccaccctttatcccccattttcacccccatcactagataggaggaaaagaagcagagagagagaggagagagggagggaaggaggaagggagggagggagggagagagagagagagagagagagagagagagagagatcctagaatctaatttatttcctcttctttgaatatgactactgggaaacagcgaacagccttcctaaatgaccaccaacaccttacaacacaattgcagaaactatccccagctggcaaaagtcacgcctctgctagagcacaaggcaaatcaaatccccaaacctgggattaaaatgaaagcacattcttataatatttctgtggtttttttttttaaattgtcagtacagtatagttttgtttgttgttggctttacttttgcttctctgtgtgtgtgtgtatgtgtgtgcacatgtgactacagatgttctcagaaggcagaggcatcagatcctcaagctggaattacaggggctgtgagctgcctgacactggtcctggaaacacaatccagggtctgcttaagaacagtgtactctcggggctggagcgatggctcagtggttaatagcactgactgctcttcaagaggtcctgagttcaattcccagcaaccacatggtgcctcacaaccatctgatgacctcttctggtgtgtctgaaggcagctacaatctactcatataaatgaatgaatgaatgaatgaatgaatgaatgaatgaataaaaaaatattaaaaaaaaagagagagagaacagtgtactctcttaacctccagtcatgtctccagcccttggttttgtttttaaggcaagagagagagaacagtgtactctcttaacctccagtcatgtctccagcccttggttttgtttttaaggcagggtcttactgtgtagccatagtgcctggaactcttcagaccagactggtctcaacaagcaagatctgcctgtctctgcctcctgagcactaagattaaaggtgtgagtcaccttgcgtgacccataaagtatatatgtagtttttaacaaactaccttgtgatttagccaatagtcttattaaacttctgctatttttgtagtgctagggccata

SEQ ID NO: 29063 - DNA, 1194 bp, Mus musculus
atctacactggtttaaccaattatgtccctttttgtaaaggaacctgccctcagcagatgtcatcattgtctgtcctcctgctttttcccaactgtcccttctctctcctagttccctcctttttctgacatgtcatttctctcctggcaactcttggctacaattccatatcttacctatggtgccaggcaggtcttaggtctcttttttttaatgatttatttttattttatgtgcattggtgtttggcctgcatgtgtgtctgtgtgaggggtcagatcccctggaacatgagttacagactgtgagctgccatgtgggtgctgggaattgaacctgggtcctgtggaagagtagccagtgctctaaccactcagccatctctccagccctacctgcctttatcctaatactaccaaggtggacactatctgttttttagtttggtcgtttggttggttggtttggtgtttgagacaggggctcattgtataaccaggctgtaggcccatgaaattgaacattagcgaccctccctcccttgtacggtgtgtgctctctgctctggtatcggtcaccagccttgccagctgacatttaactttctctgtccacagtttacccagaggattctttagtcttccagtgtgtttgaagtgaactgtgtttcttactccagccttcttattgtgtctctcccagtttcttctcccccatgcctccatgtccatccttacaggggggttcctctctgccctgccctccttccttctgtgtagcagccattattcccagcctggtggaaaaaatactgcaatatagtcggagagcactgtggcagtacaggaccattcctgggggagggcaaaggattgaacctgcgtagaaacctaaattgggacgttatcaggggtttgaggagagcctgtggtcttggaaaaggaattggctactgggaatggtggcgcacacttgtaatcctagcatttggaaagtagaggcaggaggattgtcctgagtttgagaccatcctgactacacagtgagttctagatcaggcaggactaccgagggagcaggagaggggaaggagtaggtgaaggcggatctcacgcctggattcgggaggatgacagaggccaacaagaaaggcctccaggcaagaaaaagccagacagagtctgggagcagac

SEQ ID NO: 29064 - DNA, 1139 bp, Mus musculus
cgctccgactgcctctgcctccctggtacagagattaaaggcgtgtactatcgctcctaattctggctttacataaaaatatattgcttatgaattaaagatgaatatttgtattctgtcaagatggaaaaggtggctgcccagtgggaccactcctggcacccttctttggatcatgaacactgaaagtaatttgctgcttgcttgcctgttccatgcttttgcttcctttacatcaactttagaagccatgtactaatctgtactaatactgcgcttccattagctttgctgtattgtgatgaaaaggcttttgaaattattattattttattttattttatttttttggtttttttgagacagggtttctctgtgtagccctggctgtcctggaactcactttgtagaccaggctggcctcaaactcagaaatccgcctgcctctgcctcctgagtgctgggattaaaggcgtgcaccaccacgcccggcctctaaattatttttgggagcttggagagtcttcagattgctttaaagcacccatccttttccttgaggatagaaagcttttgttcatgcaggctgtcttctggacatgtgttctgcgaggcaagcatagcatggcggcatacataggtaaatgtcagcacttgggaagtggacggaggaggatcagcagtttgaggctagcctaggttagttacaaggtgagacctgtttcaaaaaataaactgagcatgatgttacacagctttaatgtcagcattcaagtttctggtttggtaaatcaactttgggaatgttggtaaacagaactgaccgagtggaaccctggaccgcagccactgttctccctggttctcttgacaattgcttgactgggacctagctctgtcttccctcctagggtctgggtttggtaaattgttgcttctaatgttactgttttgttttcagagaggggcagagcaccccatttagactgagcagcacaggacagctctcaggcagtagccggaccacacaggagccgtattactaccccttgtgcaggtctcatctctgctactttttttattttcttggattttgagaaagggtctctctgtttagccctgattgttgaaatcactac

SEQ ID NO: 29065 - DNA, 1175 bp, Mus musculus
agctcgccccgtgggacactggccagcagtggagatggtgaggagccacaagatgagaggtgctaggggctgctgaggtagagaccaggggctgaaggaagtagttggctgagggtgaactgggcccagggtggctcttgcctaaatgtcagtgccctattcccttcagggtttgaagaaggtttgactgtggccacagtggtagagtctgccctctgtgcactgagaaactgtgtggccttcatgcccccaggtaaggctggactctggtgcatatgaatagtttgcaagtccagaggcggtgggggggaggggggttgggggagtcttcatttccctcctctcctcttaacagccgaacagaacccagccccgctggcacagccagagcctctggtgtgggtcagcaagtgggttgactactccaacaagtttggctttggctatcagctgtccagccgccgtgtagccgtgctcttcaatgatggcacacacatggccctgtcagccaataggaagtaagtgctgttttggcgtgctttgtaattaggcttgctgggtaccacaataccagcagggttgcaccgtggtgtgtgtttctgtgcttaggggtctggggaagaatggtggtgccgggttcctcctcctcctctctacgttcccactttcaggacggtgcactacaaccccaccagcacgaagcacttctccttctccatgggttctgtgccccgagctctgcagcctcagctgggcatcctgcggtattttgcgtcctacatggaacagcacctcatgaaggtgtgtaggctgcggtgggggcactttagggggcaggggtggctcaaaggtagtggctgagggctggggagatggcccagcggctaagagcatggacttcacttccggaagtcctgagttcaaatcccagcaaccacatggtgcacaaccatctgtaatgggatccaatgctttctttttgatgtgtctgaagacagctacagtgcactcacatacataaaataaataaattgtgtaaaaaaaaaaaagtggggctggagagatggctcagcagttaagagcactggctgcccctcagatcctgagttcaattcccagcaaccacatggtagctcacaaccatctgtaattctgtaatgggatctgatgtcctt

SEQ ID NO: 29066 - DNA, 1171 bp, Mus musculus
gcctctgtctcccgagtgctgggattaaaggcgtgcgccaccacgcccggtttaaaaaaaaaaaaaaaaaaaaaaatttaaaggacaaaatgtaagcacaacaggcaggcaagtgtgccctatagctcagcttaaggagcccgccctccagaccgcccaaggtcaagggatttgaggcggggtccgcgtgagttcgcacgccgcaggaccctcccctgtgccagcgtcccaggctcgccgcggccccaggtccttcccggcaaccggaagagacgtaaagaaggcggggctgagttttagaaaccggaccgtgaagctttgcgcttcctctttccagccagcgccgagcgatgggtgagtgttgctgcgggccgggtcgggccgcgggggagcgagctccatccgtctccatcctgcctcccgacgcatgctcggcccgaccatgggccacgggcagccgtggcaagggcctgcggtgggctagggctgtggagatcgctgcggccgcctccggggctccgggctgcgagcgggccaacatggctgccgcgggccgggccgcacgcggatgatgacacctgggtatgctgcacactcccgactgcgtcgtggggaagccaaccttggagagctgagcgtgcgggcagcccgcgcagcgcggggctcgggagcgggctgattggccggcggcgaggcccggttgctcaggcttgcgtcctcgctcccacacacaggcatctctcgggacaactggcacaagcgccgcaagaccgggggtaagcgaaaaccctaccacaagaagcgaaagtatgagctgggacggcccgctgccaacacgaaggtgcgtgcgggggtcggggggaggacgactgggagaggctgccttcccctgcgctagagcgtgtttgctggggaacacgagtggctgtgatcacctttgtaaggctcaggtttctcggtgctggcgactggacatggaagtgtgtccacgtgcagggtctgtgcaccctaatctccaagcttagggtctactggagcctaggagtgggagagctgcaagcttggtgtgttccttactggggttcttcctgtgttagggggggtctggctttttctggaggtaactagggtgatgaaaacgtatccttaggcgtggttatggccgtcttgg

SEQ ID NO: 29067 - DNA, 1171 bp, Mus musculus; identical to SEQ ID NO: 29066

SEQ ID NO: 29068 - DNA, 1185 bp, Mus musculus
ttcctgaggacagggtttcaggaggcagaatgaaggcttggcctcctgcttgtgtgtctatattgcaggtggttgagctctgtttgcaacttgctggagtgttgtggtgagtgtatgctgactgggttctccctgttgttgcagcaaggaccaaactggcttgagctctccgagatgacagatcagccagactatgacttggagacctttgtgaacaaagcagaatctgccctgacacagcaggctaagcaggcgaagcacttctcagcccttcgagaagtcatcaaggccctgcgcctagccatgcaactggaagaacaggctagcaaacaaataaacagcaagaaacggcaccaatgatgacttcaaataaagatctgtttgatatcacactagcctcttcccctccccagaaaactttgggcaccttctggctttggttaggaactgagttggacaggttgggtaaatttcaacctcagggcatcatgcccaggaaagctggggagaggcgatgttcttttcctcagtttggagcgggaagaaggagttttaatgactgtgcttcctcttctcctccccatggaaggggggggggatccctggctcagcatccactgctggtggaaacctcgctgcgaggtgccgctgtgaggtgtgccgctgtgaggtgcgtgctctggaagagaggcggagcttgtccgcttcctgctgcctctgcctgcagtaccaccctcggtctaagcactcatgattttatactttcagaaaaaagttttaagacttctttgggttttttgtttttgttttgaagcctaagaaagtcactagttcttgcctttatgtatttatatgctgtacctaacaataaagaaagaagaaaaaaaacaaaagcagattctgtgtgattatcagaagactatagtgtgtcttgagccttctgagtccagggacagagcgaccaccttgggctctgattttgttttttttttcctcagaccccaagcccacacctgagacctctcagcagggtagagctgtagcctttggcttgtctgccgtagatgtgcattgagctccaggttctctagtgagtggggctggagtcatactgcctgctgttgtataaccctagctacaaagcagcagtgatttaacctggcaggcaagtgctctacagctgtc

SEQ ID NO: 29069 - DNA, 1217 bp, Mus musculus
tggatcgaaggaggtaccacaaaaggcaaagaggtaggtcctctgaggatgcttgtgtggcatctcccatgatcctgtgcagagcatctgtgtgaaccggtgacagcccagcctaatgctgtgctatcctctccagtcttaagaaatggtgctccctggagacattgggattccttttagtcagatgttctaaattgaagcaattagccatttctggtttgtctatggagagcaaattgcatcgaaccctaaccaaggctctgcccactcacctaagcttgagtcctgagtacacagtaccagtgtcagtttgggtaacaaaatctgcaacccaggaaaggaaatgaaggtgtggttttgacaagccttcaaggcataaagccgctgttaatggatggcacaggtgagcatcgtaagagccgctccaggttgggacttgcagggatcgtgagggcttagctgaagcagtacggtggcatgcctcagccagagggcagaatgacagcactggccacaggcagagcagactcagcaggcgatggcagcaggaaaatgcctggaaagggatgggaggaaggcattgtgaaaatgtctctctgatctgtgcatataaaccctggatttctcctctgtctctgcctcttttttacatgagcttagtcacatttccacctataaagtgaaggtgacaatgtctatctcagaatgttgtgaggatttaaccacaaagtcctcctggactgattccaaaatgataggtagtgtgtggaggcctgggggtgtaggtgactaaggtgcagtctctagtggtgttttagagggtgacacagcaggcctgtggtggtgcatacccttaatctcagtgcccaggagccagaggcaggcagaattctatgttcttgaggctagtcagggctacacagtgaaagccttgtcaaaaacaaacaaaagaaaagtatttgtttgtttgtatgagtgttctctctgcatgtacacctttcatgccagaagagggcatctgatctcattacagatggttgtgaggcaccatgtggttgctaggaatttaactcaggacctctggtagagctgtcagagctcttaactgctgagccatctctccagccccagggaaatatatatataatatataaattaaatacatatacatattatatattttatatttatatatatatatatatttttttttcttt

SEQ ID NO: 29070 - DNA, 1203 bp, Mus musculus
ctgcccagcacggatgagattaaggcagagaactatgctcaacttcccaggcccacctggttccatagtgagttcaaagtcagtgtgaagcacagtctcaaactttcaagaagcaaaatcaaactacgccttcctccccggcttaaaaataaaaaagaaagaaagaaaagaaaagaaaacttttacttggtgtaaatttctgtgactccggcttctgcactgccctctggcggcagctcggcatctactaagggaaaataaaataagggcaggcttatttacatacccacaatacattgcgcacggatcagtgcgtaaatttaaattagtaaacgcttattttttttctttcccgttatattttctttacagcgatgtgttttttgagagacctgcgtgaaagcaattgagaagtcattatttatttttgtgtaactaaccaccatcggttatctaggaggtacagtcggtagagaaagctcactgacgcgggtttagcatactctggtttctcttcagatcgtataaatctttcgccttttactaaagatttccgtggagaggaacaattctgagtcttaacccaattttttgaggtcctgctcgtgcagggctaataattctggtttaagattagaacttatgttcctgaaataggaaaacttctgagtagttacttatttcagtttgtctgcctatcttctgagtaattagtactattagtatttagttcaattgaagcctgttcttgggctttctttcacatctctagcagtacctccccagaaaaaggattactaatttagtcagacagtcatgtttatgtttatacagatcagtaagtgctcttattttgtagcattttttttcatgactaaagtctcattatgcaggccaggctggcctgcctctgtgctgcatttaaattagtgtaccagtatgagcatactttctactaagttactagttctaggttcctcaggatgggggtgggtggtaacgtgtctgtaactccagcactgtggtcatggacatgcaggtggattcctgtatccatactaactgacactgcttgggtgacaaagagccagagactaggtagctcagagagctagggagaaacaacacagcaggagctgcagaaatggctaagcaataaaaacctgttgctcttgcaaatctgttgctcttgcaagttttttg

SEQ ID NO: 29071 - DNA, 2842 bp, Mus musculus
tttgtgggttttttgttttgtttgttttcgagacacagtttctcagtgtaacagagccctggttgtcctggagctgtctctgttaaccaagctggcctcaaactcgtagagatctgcctgcctctgtctcccaagtgctgggattaaagacatgcgctgccaccacctggccagttagaccaatctttaaaaagaaaaaacaaaaaaaccaaagaaatccataaaggccccagcgtagtggtgtgttaagagccgactgaaaacaggctgattgaagaccagtaggttgctggctgttgccaagcacctgccttagatactgatcaggtgatgtgcaagggcggatcctagctctcccctgggagtggttggcaagtggagatgttgagaagagattctccgtgggattctgggtctaaggttctacctccaccctcctaccctgtgtgttgtctttacagaatcaccgaagagtcagctgtaactacatttgaggctctgaaggctcgggtccgggagcttgaacggcagctatctcggggggaccgatacaaatgcctcatctgcatggtaagtaggaaggagtcaaggcgtgctctcggtcagctcagtgccctgtgggcttagaaagcggccttcagagggtgagcatacttcagcgaccctttctctgcccacctcctccctaggactcttactcgatgcctctgacgtcgatccagtgttggcatgtgcactgtgaagagtgttggctgcggactctggtgaggtggcgaggtggcgttagactgagtgggtgggcagctgttagtggcactgtccagatgttcacattctgattgcacctgcttgggggaggcaaggaacagcctgaagtcaggaattcacccccaagttgaatgtgttgtctgcaccctcattgaaggtttattcagttctaccctccacgcactcactgcaggtgccctccttcccacccctgtcagaaagatgctggtagtgagtggataagccagacgaggagggcctctgcccctccccctcccattactaagctccttctgctcctgccctgttcttaactcgggagcagccattaaaatgtcgcccggagacagcaataaaaggcccggacgtgggctctgtgtcctgatcaaaggccgcatgtaatctcgttagggccaggcagccacagctggacccagccttgttctcattacccgggctcctgctgtggggccggccaggcggtttgatcctggcgtctccccaacacaggagcatgtctgcctgctcagaagcaacccatgcatccctagcctggctgacaagaatgagggcccagcacaaactgatgcgggaaaaaatggctgcaggcctggtgcccatgtgtacaaacatggcatgccgttctgagccctcccctttcttctctcttcagggtgccaagaagctctgccctcagtgcaacaccatcacagcccccggagacctgcggaggatctacttatgagctagctgtctaggcaggccttgcctcgagcaacgcccctgcccagcctctgtgacagtgactccctctccccttgtacatactctcacacaggttccccttgtacatacatgcacatacacacccaaacacacatagaggactctggagccgcagtgggacagccctgcctgcttgttcttctgaacttggggaccatgcctctttgggctctgcttccaggatggtttgggaagcatagcagggcacggctcggctcctgagatccatcccctagactgactgaccgacagacacacaaacaccagactgaagcacatgtaatatagactgtgtatgtttacaatgttgtgtataaatgggacactttgccctctaccacctcccctttggttgtatgattttcttcttttttaatgactcctggaagcagtgccccttcagagctggctgggagcttggctcagccacctcttagggtgcctgcctctgccatggcatcctgtccctttcccatgtgctcggtgttcagtggtgtatatttcttctcccagacatggggcgtgtgccccaaggggtctgatcccctccttagtcttagctcatggggcggctcatgaggagctgggggcagggtagaatgggaccgagcaggaacagaggctgcagttgggctggctgactgagggtgcctggctgcccagcctgcggtagccgtgctccctgccctcctgtggccctatggtgtgatgctgtgtctgtatctatgtgtctatacaaaggtacttgccctttccctttgtaaactacatttgacatggattaaaacagtataaacaagctgctgtctgtgtttgaagatcttctgggaaggtggtggctgagccagttgagagggtcatcctgtgcagcgttacactgcagtgtgtgaagtcatgggtggggggtggcatccggaagcatcccagcaggtgtggggggtagggctgaggatctgggctcctggctattgatgggtaggggctctaggttaattccttatcgatgtagaatcgtcagctcattaatcacaaaagaggtcagagcttggggtacagaggggatgtaagctctagtccccaacctagggcagaagcagctacagacaagtcacacaagctctgggtctctcttacctttcagtctcctgaaatgtgccatagatcatctgagttccagggaataggggtagcctgggataattcctgcctagatcctcaggtaaaagcagaccttcaagtaaaggactgctcttagctgccaggactcagagcaccttgttagctcgac

SEQ ID NO: 29072 - DNA, 1185 bp, Mus musculus
aggtacatgcgggtagcaccaggctgccttcaaaaggaacagtcctggcataaaatgttgcgataattgctttactgctgagtgttggtctttattttgtgtgtgatttgtcccttaagccagcgtaacattctccccacggctggagaatgcagagagtaaactgaagggctgagcaggaacaatgcgacagggcacactgctgggttttcttttttcctctttcttcgtttctcccttgacctccctccaatcctctccgctcccctcccccccccatgccctgccctagtccccgccctgggctggttggtagaatccttctcccccatctttgacaccctaccaagttatcccatctcttccctgtagtttgaaaagcaagcttcttctttcttcgccttctgcaggcaacagaccaaaacaaaaggataatgatggaaaaggactcttccttctcggggacccaggtatccaggcccggggttgtcctcccattcatttcttacaaggcagctgtgtgctaggacccagtctcatagtccttcccagctttgttgtagtcagacagggttgggtatgcaagaaaactgggggggggggggggctgtggcaccttccaattcctagagaggacatctttcttccgtgtgcactgggactctcctggcctcagtgtactgtcaccaagtaggtagaccactgaccctacctgccacataccaaacccaagattcccttgtctgtggaagaaggatagtgtataagccatggggtggatcagatggtagggtgtgaccctaagtgtgggtcagtctgtactgtcccaggagatcttagtggcttcctctgtttgctccagagggtcagtctcctgccccagtgtaaccctaggctgggtgaccccaggaaagttaacgcttgctctcccctcttcatgtagagcaggcctagaatcatcctacaaggactcagcgggactttgttgacctctgtgagtgtagctctctgtgagtgagaagggattcatcacgcctgggcatgtccttcatgttctccggacttgtccagagtagaaacttgtagaatacagagttcttcagaaactttccatcttagttttctctgtaaaaaatcgagcataatgtacctgccctatggaaatgacagctaatccagactcca

SEQ ID NO: 29073 - DNA, 1147 bp, Mus musculus
ctgagggagttgtggaggtgggggacaattgtgtgggcccctggaatcacgagggaagctgaaatggtaggtacttgccggtcagggccccagagcaaatctgtgtccgtccacccattcgccagcatggcgaggagaccttcaaccgagccaagctgctcaacgtgggcttcctagaggcactgaaggaggatgctgcctatgactgcttcatcttcagtgatgtggacctggtccctatggatgaccgcaatctgtaccgttgtggtgaccagccccgccactttgccatcgccatggacaagtttggcttccggtgagactctcttagtgagactcagacctacccacccccacttcacccaagccctgagtcccagcctcagtctcctcctagcctttggcccctggttcagatccttctatgtatgcactacctccctgggtccttgttacacatggtccctacacaccatctatgatcctgcatcttgaatctccttgcaaccctaacacctgctctcttgtgtcataggttgccctatgctagctactttggaggtgtgtcgggcctgagcaaggcccagtttctgaggatcaatggctttcccaacgagtactggggctggggtggcgaggatgatgacatcttcaaccggttagtagaggtggggcagagagcaggctggtcagggagtgaggaggcacagactggatggggttccttccccttccccgtgcctcctcagtctgcctgtctcccatcctaggatctccctgactgggatgaagatctcacgcccggatgtccggattggccgctaccgcatgatcaagcacgaccgggacaaacataacgagcccaaccctcagaggtgaccccagcaccccaggtgcccctgacccctagacgtcacctcccagtatcccaaatgcctttgatctctgaccccatagaggaggcctctgagcatccttgactcctgaggagtactttccagaggcagctgattcctagaaatgacccagatgttcctgacccctgacctctaaaggtgactcctggcacccctggcctggttcgtagaggtgactagagtttagattccagcttgtgttgtaattgcttaggcacatttccgtcagt

SEQ ID NO: 29074 - DNA, 3056 bp, Mus musculus
cgcggcctggacgcagcgcccgttccctccggcccgtgaaggggcttggtgtcattaagacgggttacctagggagtggccgaaaaaaaaaaaaaaatggaggcctgggtggaggtgctgtttcgctccgggactcttcgcttgtctagatgtaggtggctgacagtttgacagttgggcagttttttttttttcctaggttggggactgtgtctcgaaagagcaaccctttaactcctttcctcattgcttcaggaatctgctacaccatctttgacctgggctttcgctttgatgtggcatggtaagggagggcatggagaggattctcctaggagcctcttctccctgctttggtctgagccccagcccagctcttcagacacacggacctttgggaaatagaaaatctagagatgcaacgtctgggactggtgggctggagctgggtggacactgagttttgtgtggcctccccactcctgccctttcctgtccatagctcaatagctttcttccctgtttccacaccaggttcctgacggaaacttcccccttcatgtggtcgaatctgggcattggcctagcaatttctctgtctgtggttggagcagcctggtgagtgttggagtggcgggacgagtgggaggtgccaagtcgtggcaggtggaatcatcactgggttcttaatcatcctggggacagcaactccttgggctcctttaatcagtttcttacccttcaccaggggaatctatataaccggctcatccattattgggggtggggtgaaagcccccagaatcaaaaccaagaacttggttaggtaagtgtaaaggcttctgcatgtcaaaactagctgcgatgggggtcgggtgacatgctggcttgtgacccgtctcatcgtagcgtgtatgtgagtcagggaaagttggctggggattttctgcagaaatggctgatttccttcttaaagagtttccctccccctcccccaccatttaccatcactgttgccagtattatcttctgtgaagcggtggccatctatggcatcatcatggcaattgtcatcagcaacatggctgaggtaagggaaaaccagcggggacgggtatccattgaaatgcctatgctttccctaaagatcggagggaagaaaaggtaggtgcattaaggaatgccttctgaggacttattctgcccctcacagcctttcagtgctacggagcccaaggccattggccatcgaaactaccatgcaggtaagtgggtaacatagagctcactcggcatggtgctctgggcctttaaccccagtcctgggacgggggtagcaccaagtgagttaagaggccagccagcactacataatgacatagtgagacagacaccctaccacacatacacgcctgggccttacacacttgcttctaccacacgtacacacctgggccttacacacttactcctgcttcctggctccatagctgagagtctcagctctgcagagttggggtgggactggccctgctagcccacactggaccattcctctcctgcttgcctccacctcacgagctacttcttatcctccaggttactccatgtttggggctggcctcacagtcggtctgtccaacctgttctgtggagtctgcgtgggcatcgtgggcagtggggccgccctggcggatgcacagaaccccagcctctttgtaaaaattctcatcgtggagatctttggcagtgccattggcctctttggggtcattgttgcaatccttcaggtgcgagtccccctagagaggaacagaagtgcctcccttttttccccttcccatctcttggtccccctttgtctcctgctctagatgcacgcatctttcctaagtctctccattagcatctctttcctcggctgcctctgaaaatgtctttgtggagtttctgtctctcagggtctgtgttctgtatgtatgacacacttgtcagtagactagcatgtctaaattcatattttccagtgtgtgagtttgtgacttgggtgcttgactgggctgactcttggcgacactaacactgtccatgggacttgtcttctctgttgtacagctgagctcctttgttactgtccatgtctgtttgtctgtcatagtgtgtctgtccgtctgtccacccactggcctgctggttctggtcttgtcactggtcactgtccctgcctgatttgtcctgtttttcctttgcagacctccagagtgaagatgggtgactagatgacctgtatgggtggggccgtgccctactgttatttattgctggttttcctgggacagctggagctgtgtccctcagcctttctggggcttggtgttcagggtctcccctgcactcacctcttgctgcctgttgactctggaggcattgcagtccagactgaaccccagtgtggggagtgggctgctgatggtgactgtgtacagctgtgcacctgtgcccccctcaacccccatccagcccatcttcctagtgtttgtgaaataaacttggtatttgtcccagtcagtgaggcttctgttggccccttgcgacacctttcacaaaggaaggggaggacctgttcactcactccaacctcctgtaactttctgtctacacatcatctctgctctggaccttgctggctcctgggtggcagatcagggtgctaggctggctgtaatgctggcacctcttcattgaagagtctgggctctgagatcctcctagccctatgtctttggacccctgtgcactagacccaaactcactacagctaattctcctctctgtcgctatactcctgaaactccccgcacctggattttcctggagaacagtgttttacatttgatagtccagtatgaacacctaacccttccagaaacctcttctatggtcttagttcctagggccttgttcagctccgcctattcctatacaattcttgattccaacaccaccctaaatcttacccaacctgcttttacctaataagtccttttcagtcaaca

SEQ ID NO: 29075 - DNA, 1201 bp, Mus musculus
ctggggatgagacatctcttactttgccagacttcaactctgatgcacctctttcagagcctttggccatgctcctgctcccaaagtaccaagatctgctcatctcccgcccagctcttcccctgccagtgggatccccgagctcacagcctgagtccctggagcgttttgggcgctgcttccccctgaatccagggagacgtctggaagaatatggtgccttctatgtaggggcttctcaagcaagctcggactccagccttgatcccgacctgagcagactgctcttgggttggacaccagggcggcccttcttttcctgttgtccagatacaggacagacacaagaccagggtgccaaggctgggagactaagagcacgaagactgtatctcatagagagggccagagatgcccgtgtggttgggctgctggcaggcacattaggtgtggctcgacaccgtgaggcactggcacacttgcggaaactgacggaagctgctggaaaacgtagctatgtgttagccgtggggaagcccacacccgccaagcttgccaacttccctgagatggacgtctttgtgctgttagcctgtcccctgggggcactagccccccagccttcgggtggcttctttcggcctgtattgacgccatgtgaattggaggctgcctgcaaccctgcctggcccccgccaggcctggctccccacctcacacattatgcagagctgttgcctggtgagtggcaaggccgcatctgggtttgaaagttggggttggagttgaaaaaaccgggatagctttcttttctccttctacgtcaggttctcccttccatgtgccactccctccacctgagtcagagttgtgggataccccagatgtgtcactcatttctggggagctccgaccaccacctccttggaagtcatcagatgacactagatgttcggccttaattccgaggccccaactggagctggcggagagcagccctgcaggtaaacatgcaagcagctgcccccgctagagttttgcccaggtccagcccacacagcttatcttctttccctctgcagcttcattccttagttctcggaactggcaggggctggagccacgcttgggccagacaccagtgaaagaagccgtcagaggaagacgaggtatcgccatcgcctacgaggatgaggggagc

SEQ ID NO: 29076 - DNA, 1172 bp, Mus musculus
gggcaagattcaggctttcaaaaggtcagcggaatcctgagctctctcccttcctactcactccgtcttcccccaagtcagggagaggcagcatcttgcaggaccgagtcccaccctctgttctgggctctggcaggatccagagtagccagcacctgctcagtcctgtgctgtcctgcaggcgctgcaccagctctactacgaccccaatattgacaacaagaacctggctcagaagtggctgatgcaggcccaggtctctccacaggcctggcacttcagctggcagctactacagccagacaaggtgcccgagatccagtactttggggccagtgccctgcacatcaagatctctcgctactggagcgacatccccaccgaccagtatgaaagcttaaaggcacagctcttcacccagatcacccgctttgccagcggctccaaaattgtgctgactcggctgtgcgtggcgctggcctcactagctctcagcatgatgcctgacgcttggccatgtgctgtggcagatatggttcggctcttccaggctgaggactcgccggtggatagccagggccgttgcctggccctgctagagttgctgacagtactgcccgaggagtttcagaccagccgcttgccccagtaccgcaaaggtctggtgcggaccagcctggctgtggagtgtgggactgtcttcccattgctggagcaactgctacaacagcccagctctcctagctgtgtgcgtcagaaggtgctcaagtgcttctccagttgggtgcagctggaggtacccctgcaggactgtgaggcgctcattcaggctgccttcgccgctctgcaggactcagagctctttgacagcagcgtggaggccattgtcaatgccatctcccaacctgatgcccaaaggtgagttactctccagcttcccagaaagggagcgccccatccatcccgtaggcatcaatggggtgtctgtcatacgcgtcatcctacggagacaaaagatgcaggcgagacacggtccctattctcactgtggcaaaagtgaggcagacattaaacaactaaattatctggtagactattaacacattggcctgttcacttgccctcagccagtcactaagtccgtagcatcctgctcccagcaaataatattg

SEQ ID NO: 29077 - DNA, 1197 bp, Mus musculus
aaccattagagtggggttagcctgtgatccagcaattcttcgtctgtgtacatagccagagtagctgaagtcagggactcaggtatctgtacacccaaggtcatagagtcactgttcataactgcctaaagctagaagcagcccaagtgcctatcagtagatgaagggaaaacaaagcaagttcaggcagagaagtatttttttctgcagaaaaaaaaaaaaaaaaccaactctgactcattgcagtgtgaacccctgaaaacgttacacccagtgcagtaagccaattacagaagggacagatgatggcaattccaggaacattcaataaatacatatttccatcttccggctgaagaacctcttttaactttgtgcatgtatgtgtgtgcatgtgtgagtgcaggtgcatgtgtgcatatgtgcgtatgcttgtatgcacacgcatgtcatgtaaagtccttcagtttgcctgagacaaatctttgttatgcttttggcttgggaggttttcctggaggggtaacagctcttctctcggccacacctccttgcagggtttgaaagcagtgtcatttcttttatcactactactcgtgaggttattgaattacttaacaagcacttgctcggggcttgctcttctctttacctaacgcttgtgtaattaatcagaaagtttcctcctcttctgagaagcctttgcttctgccttttgaggtttctctctgtatccatggcgtctgatatgatgcttattttgcttggtggtctgtggattcatagttttgtttgtttcgtctgattttttttcttttgtaacatctaaaactatatttaagccacagtatctataactgttataaggtataaacaatccaaacacacattttgtatattttttagatttcatttttttggttttttgtttttgttttttgtaacatcttttaggtctttttatatcttctgtctggctctccccccccccccccccgtgggttgtttcctttcctcccctttcccttcctctttcccttcctctttccctccctccctccctccctctctctctctctctctctctctctctctctctctctctttcttctttctttctttctttctttctttctttctttttctgcataatgaacatatttgtagtaactgtgtcaaaacctgacctaggctcat

SEQ ID NO: 29078 - DNA, 1252 bp, Mus musculus
tttggacttgaagaaatctgtttactatgccaactgtatgtctgatggttagatagcactgtggccacgcgctttggggcttggctagctcttagcagatttcttttaactttggccgctgagcttcagctgcatgagggaatgacagcatctacttgctcataaccctgtcataggtgaattatgacaccttatgcccgggacttgcgtttaagactcctgaaaatgaatggtagatttcttacatagcaaggagagggagaaattgggggccctagaaggtgcacagttggttccaaccacgtggtggccttgtcggtgagagctagttataggaagccagttctcacctagaacctgtgcgtgttgtagtttaccaaccttccttcatcaagttttcctgcctgaatctatctgatcagcacctatgtttcagattactctgaccccactgaagtcaaatttgaagagctgaagaatgtcaaactagaagaggaagatgaggaggatgagcccgaagcagccgcactggacctttctgtgaatcctgcgtctgtaggaggacgcctcgtcttctcgggttccaaaaagaaatcatcttccagcctgggctccacttcatctcaggattcagtttcttcagattctgaaaccgccgagtctgtctcttgccagggccaagagaaaacgggagttctcaccgtgcacagctatgccagaggggacggcaaggctgccacaggagagccgagtgtgaagaagaagcgcagtgctccccgcagcatcagcgagcaggagctggcagaggtacaggccctgcaaagcatccggtgaaggagggggcctgtgagggtgaaggtgctgtgggctgtgggagggcaggagaccccccccccccccactgctgcatctgttgtgtcggaatgccaggccatatttcccgtcttcccagtttgctcttcactggctcttaacctttgctctgtgtgtctttcaatgcagaggctcacacctcagcagcagctcagggactgtgccgtgtaaaacgcaagcttggctggctggatgctctgctatggtgggagctcttcctctgactcgttgcctagagactggaaggtttgagtggcagttgttgcagcccagatgttttgagatttgagatgaggtggcagtcttagtcactgtcctattgctgtgacaagacagggtgaccaaggcaactcttacaaatacttacaagagataatta

SEQ ID NO: 29079 - DNA, 2745 bp, Mus musculus
cccacgtgtatttgttctccttatagctctgtggtattgcttgtcccacatggcgtgcagggaagaggagagggagctgtgttcattccgtagccccttcctgagcgccagtgtgtcatgttgcctttggggtcagaagtagacgtagcagtctgtgtaagacggtgggtgagtctgggtacagacaagtggtttgagtagcagaggtgaacacaggcctgggagaggcaaaaaggagaaatggcctttcgagacttcaattggagagtacctgggtagttctcggtgttcagcatctgctcttagccaacagaggccatttctgtggccactggctgcagcacatgcaaacccttgtgtttggaatagctattggctctgttcacactgaccagtccccctctttcctcaaaggaccaataccagctgtgctaccgtgcggccctggaatacctcggcagctttgatcactatgcaacgtaactactgctcccctctcctccgacgctcccccgcggggctccggaggggacccagctcctctgagccataccaaccatcgtccagccctcctgcacggatgctgttgccggcagagcacagcccactgggatcacagcatttcggggaacattgccacaccagtcagagagcccagaacacctgggcaagtaggcggactggcagcctggctctgggccctcgtccaccgggccaagtggagccccgcttcaagctctctgttcagctccgcgttctcatgcttctcatggggtgggaaaagggggcaaagcccccactttttatacactaggcggggtagactgcggggtcctagcctcttcctccgactttgcttttgcaggtctttcactgcagatggggctgctgtgggagttgggacttgtttgttttcctttttgagttcacgttggatcctttcttgtacaacttctgcggaaggacacagtagtaactcgccttccttgtgcagagctagggccctacctgagcaagtcggctgtggcccgggaggcagcgtgactcctgctgtcctccagcctttcagatgagatcctattccagccaaatgcagggaaacactttattttgtttgttttaggttttgtttttccttgagagcctttttttaggccccacagacagtggtgggtggggaggcgataggaaacacattccccagtgtgcatttaacattcatagcctacaaccacagacgtgtctgggggagcctggcaaggcgttcctcgtcaccatcgtgtttgcaaaggttcaaaaaacaaaaatcaaaaaaaaaaaaaaacataaaaatatttttttttaagaaaagaaataaagattcatcccctggcctctacttcagattcgaagtgggaggcaactcaatgtgcctggggctcgccatgggcccacagagtctcgctatcatccccagcgtcgcagtgtggcaggtgtttgtaggctgtgggttctggccacctcgggaaatgaatggcacaggtgagggcctgtgccacgccccacacacctcagggccaagcgggggcgtggctggcccttcaggtcaggccagtgggcctggtagcacatgtctgtcctcagccggacagatgctttctctcctggtttgcagctgtcttcaaatccccccatgacccgctcttcccactccttcaagttgccctcacaaaccaatgtggcaagactactggacttgtatccatggtactatactcagtcctcttatctcagcttgctgaggggcagggagagggtctcttcctctgggcagcactatctagataggtaagtgggggcggggaagggtgcatagctgttttagccgagggactcgataccgacgtccccagatatagctaggctaagtcaagatcaacagtccggggttggtggtgttggatgaaacattcatttttaccttgtggatgctagtgctgtagagttcactgttgtacacagtctgttttctatttgttaagaaaaactacagcatcattgcatacttcttgatggtaataaatttgaataatcaagatttcttacacactaggcctctgtctcagctcctgtatctagagtgtggtatcttaagtctatggctggggtgggttctgaggagtccattccaagaggacgatgagccccaacctgggtgagtgcctaggacgggccagattccagccatggctgcctgaatggaggatggaaccgcctacctgagctgcagctgtggagagcacccagggctctcagaccctcgtctctcctcaccttgtgctgctgtgaattgacaaatgaaggatgtaacacaccatcaccgccttcatcctctcccatgctctaaggaatgggataaccctgtggacttaggaaatgactatatggaagtcaatcagtaaaaaaatcttgtaattcttgccatgtgggtattggacgcacacagtgagaccccctgggctcagggacacagcaaggagggtttactgaccctggtggtcagggggctccgcctgatctcaacatcctgggcaaaccagagaagaaataccctcagcagagttgtcacagactctgtggccctggggaaggcctaaaggaggtgagcgctgcattctgtgtttgtagagggtgagcagaagttagttgggggggggggggcgcgatacacaagagttcctagtggaaaaaagactgcaaaggatt

SEQ ID NO: 29080 - DNA, 1217 bp, Mus musculus
cctgagtgttgccccaggagtccaaatctggctgtcagccgctctctctctctctggggagaggacctctgaggagtatccccaggagaatttttaaaactccggaagggcctacagggacttccctggaggtatttggtaagaatcccatggtataggagtcactagagacatttctgcagctctcagtgtggacctcagagatgcctgtggtgtagagctttaagcctaagttctcctgaacagatgaaatcacctctttcctcctcacagctcatgtcaaaactgctttctctgattaggataaggttattcatgtggcccttccttataggctacaaggagggtctcgctgtgatgtcagaagtatcctgtaatggctatggccaggccaggcccatgagggtccccaggaagagggaacctctatatctgcctcagtagctaatgccccaggggaggaggctcccaggccttgtgtgactctgtgctctcctctgccagcttctggaggccatcgagcagggcgaggagaaacagcggaggcgccggcgccaagcagagcggctgaagccttatgtggcggcccaagtggatgtgctccctgacaccttcaccctgggggacaagaagagctaccgcggcttctacaaccggcccctgtctccggatctgagttaccagtgcttcgttctcgcctccctcaaggaacccatggaccaggttggcctgagctggcatgactttcagaaccccaagaccccaggcttaatctaagaccaggccagcttcagaccttaggagaccccgggtctgcattatcctgagactccagcatcctaggactaggacacccctgaggacctatactggatatcccatgacactaggcctcagggtgtgaagatcagacctaacatggcttcagtaaccctgctgacctgtcacatgtcggtctcactggtctcggtgccctccctgggtttgatggatgagggtggggctttcttgctgtgctgtgctcatagcctttgctgttgcttccttccctggaccccagaagcgctacgcctccagcccctactcggacgagattgtagtccaggtgacgccagcacagcagcaggaggagcccgagatgctgtgggtgacaggccctgtcctggcggtcattctcatcatactcattgtcatcgccatcctcctgttcaagaggt

SEQ ID NO: 29081 - DNA, 1179 bp, Mus musculus
acccctacctgctctgccctcatcgtccctggcactgctggtgggccctaccctgtccactgtgtctctccatgagtcctaagtcctctgtgagcggcgtggtccgtgtgcacctgtgtgcacgtgtgtgtgcgaggggcacaggagtcctgtcttgtctctgtgctgtgtgggcagatggaggttggcctgtttttactctctctgtgtttctccttgtctttttttattccctctcatcctcatcgcactctgccatcaacccaaactctcatctctcagatcagcgagaaggttggtcgttttcacttcttatccatctacagttcgcccaccgactgtgcccgtcagttgggaccagcgggcttggtcggctccctcaggctcgctccagccgcgcctgcccgccagttggcctcttctcggtgtttgggctggctggcaggcaggaccagggatgggtgggcaggccttctgccctgcatgtacctgttgcttgaccctgattcgctgtgtgtctgcatgtccccttagccaggctccgctgttggagtggccacacatgcacggtgcacggcataaaactgtaccctacagaactgcactcagctttgcacccagaccaggctagccctctgtttcaggaatggtcatggggatctctgtcagagaaactaaactacatgcttggcatgtaggagttcagggaagcttctaccatttccccacccacccttatgttgtctgcggaactaagagaaggcagaactgcaggaggcaataggaggaggctaatttagagtgagttgtccccttgagatctcacagtacgcgacacagtcctgcagtgtctgccctgcccttgaggcccccagagccttaccaatgctccacaaagcagactggctgtactgagacttaagaccagccttggtctgcctctcaaagaccctgatggccgtagtccaaggcaggtggcatcattttcatacactgagtaagtgtcccgacattatatcttttctgtctcctaccgggtccaaaccaaggtcaccctgcctgcccagaccactctacccgagcttccaagccagcctctgtgcctctccgagggtacagtgtatgtggctcactgaccagctaacagccctcagtcccatgctgggcagtggcactgag

SEQ ID NO: 29082 - DNA, 1105 bp, Mus musculus
gatgggtgttgccaagtttgatgggacaggaactgatctctggccccagcacttccaacccaacccccactgaaggatcgagagggtggatagactcggatctgggtcagtctataggttcctgggtcagtctaggtcccactgaaggagctagagggtggatagactcggatctgggtcagtctataggttcctgggtcagtctaggtcccactgaaggagctagagggtggatagactcggatctgggtcagtctataggttccactgaaggagctagagggtggatagacttggatctgggtcagtctataggttcctggctccggtggttgaactggaagtctcgggacaggcacctgtggaaggcaaacctactaagggttcgtaacaggcctggcttaggaagacaaatgcctgcctcttttggctgccgatcccaggggtctgaagcaccagacacacaggggtgggtgctgaccctttgcctctcaccagataggctgaggagctctggctactctatcctaataggggcaggtgggttttacaggctgttagccaccggggtttgagttgagtcccacgcttcccctgttggatgccagggctgctctgtgccttgggatccctgattcatcatggtaacctatgtgagctctccccttaaccctgcctgcttaaatgccctggttttgttttggtaagtgctctccttggacgcttaccctgtgggatttgggcggtctttggggtggttgctgctcccgtttctctccatcagcccagccagcaagggtcataggagcccagccccacctccctgattcctgtcaacgcctctgccagttccagttctctgcttcccccgagcagtgctagtgacccaggggacatgcttcacccacactcagcctggcccagcctagtgcttgctcacacaacactcgagtcacctacactgaggccgcaagttctccatatatatatagttaaagccctttctagtgttttgttttatctgatttggctttgtgtggctttccttccttttgtactaatgtttctctctgatcttatttgcattcaaattacctcgccaggt

SEQ ID NO: 29083 - DNA, 1218 bp, Mus musculus
agcctctgcacccagcctctgtcctttccacggcctttcacggcttcacttgtcatgttccccacagtctctgacggtggttttccgagagcccttcccggtgcagccccaggacagtgagagccctcctgcccagctggtctctacctaccaccacttggagtctgtcatcaacacagcctgtttcaccctctggacccgccttctctgagaagtggaccagtgactctgttgattgaatcatggatctataagcttgcccgcttgaggcaggacagactggcacttaggaaccccagggtaaactcagacacagaatgacactaaaggactgagtatgtctgggagaagtgctgctacagcctggcaacaggaacatagctgctgaacagcccggactcgcctcaggcccctgggcctgtgcagaagaggatgcctccttcctgcacacctggtggagtgccagggaatgtcacatgatctgacaagctctcacctctaagagctctgccacttggccatcactgttggacattaccattgagatagacttggttccgatcttgactcggcctgtcaagcacctgtgaccagtcttacctcctcccgtccccactggacctttggttcctcatctgtggataaggagggctcagaagtctcctgtgtccacagcaaccctggaggatttgagcttgagctgtgtgtcccttctcagtgggagggaattaacctggagacattgaagcattagacactatgtgtcccccacccctgtaatatacacatatgagaacgctcagtgtgattttaattcagaggaggggactccggacactaacacaccgccccagggcagcatgcaggtgctgtgcagaaccttactggccagtccgtgggtggccccgcctgtcccagtatgaacgtagccaactcagaccctccactgtgtctcctgcagtaaaagagagacaatgccatcttaacccatagggaaagaaccacccctgtccaacatctgcccctccagtgtcccctcacctcgaggccgatactcgcaacccacaaatccttggtagccctcatcttctagcagctgaaacaggtaagtaaagtctagctctccagagctgcctggctccccgcggtctgggacctgggccacttgcacatgccctggggacagaaggggagaggcatgggacagcacagggtgga

SEQ ID NO: 29084 - DNA, 1203 bp, Mus musculus
acaggagcgcaacagtgacttaaggcagcaagcatggagggacgctggtgctggtgcacgtgcgggctcctgcttagctaacattcttatagagcctgccatcaccttcccactgtgctgcccacagtgttccgggtcttcctgaatcaactattaatcaagccaaacctcctacagatatgctcacaagccaggctgacctgggtagtgctcaactgacttccttctcagatgactctcggctgtgtcaagtagtcagttaaagctgagcagagtacatagcttcccttttagtagttgtaacacaactctgagattggagatgttaaaatcaccatttttatataagggctttgaggatttttaggtaaaattcatgtgtccagaatcacgttgagtagcctgacgaagcgaaagctttgtgcgggttcccttttatctggaatgcatagctatgtccagtcccgtagttgtgatcgatcaggggcttcaggcccggactgaagatggctgaatcctctaacagtctcccccacctttctaacacggctctctcaaggtcctgaaatcacagatgagttagtgcgggttctgcgccggcggctggacgaggccaccctggacatcatcacagtcatgctggttcggaattgcaagctgaccccggccgacgtagaggtcagctgcctgtctgacaccagcatccttttcagactcagccacaggtgctggggacatctaggatagaatccgtggcttcagctctgtctcttgtacctgcagttcatccaacctcctgggagtctcccctcagaggtgctgcatctggtcttgcctccgtcctgcagaccctgccttcctgccctggcctggtacctccgccagaacttactcaccttcctgcactcccccaagtacacagacagcaatagccggaaccacttccaagtgagactgctgtcacctgcccgcactcatgtgtcctcttcccctgcacacccaggctgggactttcctcaggatctttgcatctgtggctgtgcccatgagcccgtgtacacccctgcccgtgtcttctgagccccatgagcacctgtcccctcctccctgttgtcaccctgtgtcttggtgctcacggctattctctctccagcatccactcccagcacagggtggcctccccgacttggacatctacttgta

SEQ ID NO: 29085 - DNA, 1116 bp, Mus musculus
gtacacagacattcttctgatgtcttccatattaatcatatgagttccccaactgaagggagtgtatcgttcatcgctgagtccccacagtggctacatacaggaaaggacaaaggtaggacggtagatgctctgttagcttatgcagtgttgctgctgaggaaaaaacagctagaaaagcgagggtcccactggctccaccccagtgatttctctcgaagcccagatctcccgcactctccaagtgagcacacattctctctgacaagctttgctgcttctgttctccttgtatgctgagtggtaccaccctccacccagtggtgcaaatcagaaaggggccacccttactgtaagaaatgtgtagggcagagcccgaagccagagggggttggctcccatggtcacctcccaggctctgttctgactccttgtagataacaacagatgagggctgctctggggcttggcggttcttaaccctgatgtgctcttccaaccccagtatagagaccgaggacctaagtgagcccgagtttcagagcagccgtgtctctgggaatttagaccctggtccggaaatttctctgacagatgtctgccagctcagaggagaggcacatgatgcccttcacagcctcatccaggtgggaactgggaggggaactgaagtgggtgaagtcctgcttaggccacccgcagattctcccccgggttgaggatagttacgtgtcctggtctagagaagagagcagggtcctttcagggatggctgacctcatggcctcttcctgaacaggagaagttcctggagatcagccgtctgcacttccgcaccgttccctccaatccccactacttcttctattgcccgccatccagtaggcgagaggtgagaattcctaaccttcagcatgcccaaccagagcctctcagaagccttttgagtcttgcttccctgatgcctggatgtcctgctttggtcacctgtctgtcccacttcctcctcaggatgagggaccccgagacactgtggacagaaaaatcagtgacctggagttttcagaagccgagcttgtgggcgaggaaggtgtgtgagccttcaaactggtcaaa

SEQ ID NO: 29086 - DNA, 1162 bp, Mus musculus
aggttgagtttctctctctctctctctctctctctctctctctctctctctctctctctctctctgtgtgtgtgtgtgtgtgtgagagagagagagagagagagagagagagagagagagagagagagagagagagagagagagagaatgtgtgtatgtgtgaacgtgtgacctaagtaccacccacaggcttcgatgtgacctttcaaagattcccagatgctctaactgccgggcccaacccagagagatggccggcagagagcggatcccgaggactaactgtgcgggacccgcccccgtgttccgattcgggctccgattcgggcagggacgaaggctcccagagatgggttcgggatttccttccaaatgcttggtcgtcgcactctcgtgagatttgctcccggaagacccggccctcttcagtgtagcgaccaatcggcaagggcgacggttaagacagttgggttttgaaggagccaatgaacgctagcagcggagagtttaagaacaacagtccggcgtgtccttagcttgtctggaaaagaacgcgttcggcaggcgcactgacgcgctgcgaggagctgggggtttgtgttcgggagagctgagtacggagagggaccgggctgctgcgagctgtggcaggcggagcccaggagcccggcgaggatcgcgcttggtcgcctttcgccccggtagcggtgccatggcgcagttcgtgttcgagagcgatttgcactcactgcttcaactggacgcacccatccccaatgccccggttgcgcgctggcagcgcaaagcaaaggaagccacaggcccagccccctcgcccatgcgggccgccaacagatcacacagcgccgggcggaccccgggccgaactcctggtgagtgggtggagggagctggaatcgctgagagtccgtcttcatgctccctccgggagcctcgtcaggctgtctgacttctctctccctgcccccaggcaaatctagttccaaggttcagaccacccctagcaaacctggaggtgaccgctttatcccccaacgcagtgcttctcaaatggaggtggccagcttcctcttaagcaaggaaaaccagccggaagacagggggacgcccaccaaaaaggtatgattccacaggggtcatg

SEQ ID NO: 29087 - DNA, 1183 bp, Mus musculus
tggtaaaaccctacctctcctttgcaaagtcagtaccaccatgtgctctactccagtggatccatctaaagaaatgtttctccatcttcacatctgtgccaggtccacagctcgtgaccgagaagcctggtctgtagcttcagaatgactaaatgggagacagtcacaccagcggtggcagaaacccagacatcaagctctttgggaaatggagcactgatgatatgcagataaatgatatttctctacaggattgctttgctgtgaaggagaagtatgcctgccccggagtgagggacggtatgctgccaagtgcttccagaaagcacactgtcctatcatggagcgccttactaactccatgatgatgcacggttgtatcaatggtaagaacctcaggactgtgaatcatcaaaggtgcctttgagattgtccacctgctcactgatgagaaccttctgtaggtccaagtgaatgccatcaacagtggcctcaggaagactcaacacacatcgggcgggctgggacagcgagacagcaggctgtggatgtgtccccactgagccaagtgaatcaggccatctggctgctgtgcacaggtgctcctcgggtttcagggacaccaagaccaccaccaagtgccttgcagatgagctcatcaacgctgtcaagggctcctccaattcctatgccatcaagaagaaagataaactgaagcatgtggccaaacctagccgcggatttcccagctgctgcctaataaactgtgagctcctttggtactgttccaaaaaaaaaagtttttccaggtttggccacccagacactcttctgcaaccatggtccattggggcatggtagctgcccaagctggcagtagaattttgtatcatacatgcagtgctgatcaatggagttgcataatcatccttaaagattctagagaggagccgtgaggcccggctatgtagggttggagtccttacgagttatctatgaacctgtgaaatgagttccaagttgcagtggagactctagggtgtctgagatgccaggaacgtgggtgtctggttgaagagagctgcaggtccgaaatggatccagaccaagagagaggccatgtgtgctaaaaacagaaaaagccacagagctagtgctgtccaggtctgctggagcgcacgtc

SEQ ID NO: 29088 - DNA, 1268 bp, Mus musculus
gcgactttaatttgactggtatgaattgtggcttaagatgcgagggctacaggcagggtcctgctgcctcccttggccatgaggaccgtggggcttctcattcccgtccttccctcctaagcttttctgacagtggaagcctatgtatggtgctctgctttctgggctggtatttattctttgattaggctatttagaaagattcaggttttaaaaaatatattgtttttcaagacagggtttcttggtttagccctggctgtcctggaactcactttgtagaccgggtgtcctcaaacacaacagacattgcctgcccctgcctctgcctccggagtgttgggattaaagctgtgtgccactttatgtgacagattcaggcttttatctgcctagtaacccctctctgccattttatcatctcaggaacttgtgctttcccacagttacagtgtcctgatgtttcctggatgggaatggtaagttttgagaatattttcttctgttcccttcatcctgtttgaactgttttcttccttggacatttggctccaaattacattttgttttgagacattctcaaactgtagcccaagctggcctcaaactgctccccctccctctgcctcctagtgctgggattgtaggcttgctggcatccccattcagatgcagcactttagtgttaatggctatagtgtatatgtgtacagtgttgatggtgatcagtcaaggtaatgggcgtttgtatctcgttctcactgccggtgcccagagcttcctgcttctaaaagggcagatggctgtgtattaggcagacctgcctctgtgctgtagacactcagtttttatggctctctctaccctgtctccctttctcacgttaaacactgcccacttcacaattaaggtataaccctatattctatatccttaagcagtccctcatttgggatttattctgctggggttttgtagtaatatacctgtgatggtttgcatattcttggccctgggagtggcactattaggtgtggccttgttggaggaagtgtgtcactgggggtgggcaatgagaccctcctcctaaccagatgggagccagtcttctagcagccttcagatgaagatgtagaactctcagcggtgcaatgcttgcctggactctcatgctccaccttgatgataaaggactgaatctctgaacctgtcatccagccccaatgaaataaatgttgtgcttataagaggttggtcatgatgtctgt

SEQ ID NO: 29089 - DNA, 1268 bp, Mus musculus; identical to SEQ ID NO: 29088

SEQ ID NO: 29090 - DNA, 1196 bp, Mus musculus
ccctcactccacctgcatcttgcaacctcctccccaacagagagagagaaagagagagagagagagagagagagagagagagagagagatctcattgtagaagttgtatgttacagtgtgttccacaggatgccttttttcctcacacttctttgcttgcaaatgttcattgcaaggagtcatcggtctggttatgagggctctggcttctgctacactatcaatactgaaccttgctgggactcctcttggatatcctgctgttgccctgtgtcacggaatcctgcagttttagatctgtaggaccagccctttcacataccccagcacttcatcgatggggcagatgtgggggtgggtcatttcaaagctctggatctggtcctgagaggtatctgagatggtcagttcactagctctcccgcatccacaccactggagtgagctctcctgtcctgccctgacttccccatccgatgctgcagccagcaaggagcagagccaactcttctgctctcatggcttcaggactggctcatctgcaccctcaccatcggggccaggtctactgtgctgcccaggttgggtgcagggagggcatcatcttccaagcgctgcagcaggcaaggggatgggccagctcttccattcttatgatgctggggccagctctcccatttgccataagtggtgaaggaggagggagagaaggagggtatctctcccttgcccctgccactgagcagcagacaaaaggcagggctgcctctccatactcatagccttgggctggcttacccacacccccccaccgtagggccagttttcctgtgctgcccaggtgaggttcagggcttgctctcctgagtgttgcaacaaatggacagggccagctcctctgttctcatgacccaagggccagctttcctgcctgccgtaggtggcaaggggagagaataggggaggacatctttcccttgtccttgcctatgaacaacagacaagttgtgggcccaactctcccatgctcacacccttgggccacctcacttgagtccttaccaccagggtcagctctcctgtgctttccaggtgaggtgcagggtctgctatcttgagtcttgcagcaggtgagggcaggggcagctctcctgatcccagcagggccagttctctctcctgctgcagatcctaag

SEQ ID NO: 29091 - DNA, 1223 bp, Mus musculus
gcaaaaacagaaacgaagagggagaaaaagctcggagccctgtattgtgtagaggaggctgagtggggaccagaagccaggcagggaggtgcaggtgtgtaggttcccacttctggaaccagttagggcaggttgcaagtcccagcatctctactccagggctgtgtgacctggccaggctgtgatctccctgagcctgcctcctcatcaataaataacacctacctcatacctccatggcagctgaatctcaagacaagacctggggtgctgtcattaacagataacccagcacagagggaaggctggtagtggaggtgatagagggagttaggagccctaccgagatgggagaggctgctctgtagggaggagccctgctcaagtctcagctcttctgacagggggtcaccttgcgcaagtggctttcctttcctgggcctcctctcccttatctgacacaacagagggggagggtatgctcttcctgaggtggctggaggaatttgttgagtgggcaagaactcagagagttcccagagtggtgatgggtcacctcagcccatgtttgttttctgtctcttcacaagtagcatggatgcttgtgtctcacgtgaatggggcaagctggttcctgtggacagacacccagatgcgtcacttaggaggtgaaaagggggcacattcaactgggaagcaaggactgtgtgctttcaagcaggaacaggtgccctaggccttcctgcctcccccctcccccacttcttcacagtgtccttactttagatttgggactaacaagaactcactcagaacaatgccagtccatgattggatgctcattaaataaataaatgaatgttatagaataaaactcactcattcttttccctgttaaccagtggacataagtcatgaatcctgcctttgtgaataatttaaaattaacaagctaggcattgggccatgactcacgcctttaattctagcacgcaggaggcaaaagcaggtagatctctatgaatttgaggccagcctgatctacataatgagttcggggccagccagggctacatagtgagatcttgtctcaaacaaataatttaaaaaataaatacatatcaagcctagaaaatgcagctgactgaaaagaacagaaccagctccaagagacttaaacaccagccaaagagcttacaaagactggacctagcccccatctc

SEQ ID NO: 29092 - DNA, 1210 bp, Mus musculus
tgggcacaggaacacggagcaaggagagagaattcagcttcggagccagacctcccgtggtctctctaatgaacttaatgccactttacacataacacacgcggttgtaaacaccatccaaatactaactcgtttaatcttcctaataacccaggaggttgtactattattatgactagtctaccaaagttatccggcagcctagtgaggaagccagagtcctagcgctggcttacagccccgcaccaagcgctaccattttgctagtggccattgagactcagagaggtgtgcaaaccagctcagagccacacagcgagcgcccccaacgggtgccccgcacaccctgggactgcaggttctagcatccagagccagactgtggtcagtagccctccgtccctccccacctccccacagaaccacgcctctcagagtcccgccccggacgtgctccccaggccccgcccccttcgggcccacctacaccccagaaccaatggcggcggtcctataaaaaggcagctccgcgcgctctcccccaagagcagaggcttgcttgtagagtgacgatctgagctacggggtcttaagtgcgtcagggcgtggaggtctggcgggagacgcatagttacagcgcgtccgttctccgtctcgcagccggcacagctagagcttcgagcgcagcgcggccatggatcccagcagcaaggtgagtaacggggctgggagtcccgggtagggatgtgctgccgagcgcgggccggggcgcctgtccgagtccccgcttcctcacgcagccgccgcgcgcttcacgcggtcggggcgggggccgcggatcaggggcccaggcgccgcacgtcgcgcacgacctcggcggctcctcccgcgcgggggagggggccggagcgcggcgcccattggctaaaagagccgagcccccggccgggccccggctaggagcggaggaggcgggacccgcccggagcccgcgccgcgcccggaacccgggccatgggggtggccaggaggagaaggcacttcctccaggccagggtcgggggctgacgagctctgaggacctcacgatgcgcagtcctccagggatgtggggcctttccccggggcaagctactgactggataagatctctcttcacctgtgatcaggcttgccctgtatgggccggatttacggaacccctcctgga

SEQ ID NO: 29093 - DNA, 1207 bp, Mus musculus
gctagagaagggcagggtcatgtctccagtgctgaacaatgtgactgttcccattttgcagataggcacatggagggtagggaggcagtggggcagggaaacccagctagcctgcaagaattcctattggctagactcaggccattgcccttggctttgaatccagagcctttcttccccatctgcactgtccctttcattcagtttggccttcctggtgagggagggaaggttggttcctcttcctcccacaatgtggggctacctgaaatgtaagtatcactcctacctgggtagtgagaccttggaaagccaaaggctctctaactgcataaagaaaaacctgattgctctctctcctcagagaagtctagaagtcagctgggcaggtttgggcacctgaggccaggaagtagccaggtttcctgggagaaggacaaatgtgttgccaggagtcaggcgaggcatatctgaacatgggaacctgccagcattgactttgctctgtagtactctgggcccagacatgcctgtaaccctgtggtttcttcctgcagaaggtgacgggccgcctcatgttggctgtgggaggagcagtgctcggatcactgcagttcggctataacactggtgtcatcaacgccccccagaaggtaagtgtgctatgccactccccatatataccatcacccacacacattcatggtgccacctcggtgtccatcattgacatcaactgaccatcttccctcccagctggaattctagaatcccagggccatagaatggtgctactgtggtaggctgtcttgactgtttcccaaacagcacagacatttacactgatcagtatagtggaatttcatttatatagtatttggggctcctgaaagctccacatctgttgctgggcaagtgggcaggcagtgggggaaatggtcagagaagaggagccttccccagtgccaccctgtcgtgcagtttttatgttctcacacgccagccacttacagcatagtccagttccagactgtaacggcttcctgtccctggaggtcccaggtcaatttaagtaaacatggcatctcaccctgaggtgctgcaggagctcggcctggcttccttctccccattgcacacctcagatctgcccccacttgtgttctctctgggtgtttagactggaaatgactgtggcattcacctc

SEQ ID NO: 29094 - DNA, 1111 bp, Mus musculus
acagctttctttttctcctctaggtattctaagtgccttaaaggtggtccttcagttgttctcatgataacctcgctaagtaggccccataacctccattttgtaagaaagaagcacagagatgtgatgaaactacaccaaggacacacagctagcacagagcagagctggagtttaaatccagggggtctggttctgttgtatgctctgtgctcaacctttgggagacaggcactgagcaatgggggtggattttctctttctctttctcttcttcccctctctctccctcttactgtcccccttcccctccctctccctcgtgtccttccctctccctgcctctccctctccttccctctccctctcctttctttcttcccctacttctgtccctggacccttgctcacacttgttgcactgctggcccactcccactgtgctgagctcagagctgagtcaagtccggtcatgtacagatctatctcaagaacttcccacacaatagttacgcaattcctcacgccgtcacagcccgtcattgcaagcccccccttgttccctgcacccagcagcagtgacactcaaatcagaccatgttgaagtctgctcttgatcatagtgtcttctagtcagctgttcaaagaccgcaatagaaacatggacgggcacagtagggcagaggtggcagttggccctaatgatgtttttcaaccttagcaccacgggtactttgcactggacagccctttggtatttattgtgatgggctgtcctgtattcagtagtaggatgccagcagccagtgtgaccgcaggcactgtagacatactttgatggaggaggggtgctggccaggggaacttcccagaggggaactgcattccctgaaaggtgatcaaatagaaggaaagagcagtctgagatgtgggtgttactgtctgcccagaggatatgagtcagagtgctgctgaagaaactcttcatcctgagggctgaggtggccctggctgctgggctgccacagtgaggtgaagctctctctgtgtctgtgtgagaagcccctccaggctgtagagcagggaagggacccactagccagggcagaga

SEQ ID NO: 29095 - DNA, 1651 bp, Mus musculus
ggttcgtgttggagagcatggcaggacccttgcagccgggatgcgggctgacctgtgtctgttttgcagcaactgtgcggcccctacgtcttcatcatcttcacggtgctcctcgtgctcttcttcatcttcacctacttcaaagtccctgagaccaaaggccgaaccttcgatgagatcgcttccggcttccggcaggggggtgccagccaaagtgacaagacacccgaggagctcttccaccctctgggggcggactcccaagtgtgaggagccccacacccagcccggcctgctccctgcagcccaaggatctctctggagcacaggcagctagatgagacctcttccgaaccgacagatctcgggcaagccgggcctgggcgcctttcctcagccagcagtgaagtccaggaggatattcaggactttgatggctccagaatttttaatgaaagcaagactgctgctcagatctattcagataagcagcaggttttataatttttttattactgattttgttattttttttttttatcagccactctcctatctccacactgtagtcttcaccttgattggcccagtgcctgagggtggggaccacgccctgtccagacacttgccttctttgccaagctaatctgtagggctggacctatggccaaggacacactaataccgaactctgagctaggaggctttaccgctggaggcggtagctgccacccacttccgcaggcctggacctcggcaccataggggtccggactccattttaggattcgcccattcctgtctcttcctacccaaccactcaattaatctttccttgcctgagaccagttggaagcactggagtgcagggaggagagggaagggccaggctgggctgccaggttctagtctcctgtgcactgagggccacacaaacaccatgagaaggacctcggaggctgagaacttaactgctgaagacacggacactcctgccctgctgtgtatagatggaagatatttatatattttttggttgtcaatattaaatacagacactaagttatagtatatctggacaaacccacttgtaaatacaccaacaaactcctgtaactttacctaagcagatataaatggctggtttttagaaacttggtttcaaatgcttgtggattggggccaggcaggttgggttggatgtgaaaagggcagaatagcatggctgtgaccgtccagtggctggggatcctggcagtgtcccttttgttgctcaaaaacctgtttgacctctgacccggaggaaaactccagtcagcattttcataggctactttcagactgatagctaaccctgccagccccgagatggcctcgatgcgcaagcttcaacactatcttgaaagtgaagataggaatcctatctttatctgacaggcttcaagacgtttaacaagcatattttacaactccgtggccataccctgttccccaaacaaaaggagctctttgtgctgccacagtacgttgttgccacgctgtgtatccaaggcagctttcctatttacagaggccacctgagagtgttcaccgtgtctgggcagcactaaacaggcaggtcctttccagagaacctccctcatcgaattca

SEQ ID NO: 29096 - DNA, 1153 bp, Mus musculus
gcattttatgcatgcgtagaatgtattctgatcatattcaccttcattacactgttacccttccttttctcctgctgagcccctgcctctaccaaccatccccactctgatttctctttataattttaagattttcactatattagaggtggaggtaatgagagagcattcatgcctcccatgtgtgtggaggccaggggacaacttgtggaagttggttttccactgtaggttccaggcatcaaactcaggtggttgggggctggagagttaagagcatcaactgttcttccgaaggtcctgagttcaaatcccagcaaccacatggtggctcacaaccatccgtaatgagatctgactccctcttcttgtgtttgaagacaactacagtgtactcacatataatagagaaatcttaaaacaaaaaaaaaaaaatcctcaggtggtcagactttagtggcaagcacttcttcctgctgagccatctcgatggtcttccctcctcctcttctgcttcctccttatccgtgagctttaccagagttgcctgcaggaccatgctgacagcttcttgtcagtgactacagctggaagaaactatcaatccatccttcagcaaccgttagcatccatgaattctctcctctagaatgggccttggcccttggtcttgtgaaggttctgtgccccagtataggagaatgccaggcagagccaggaagcaggagcgggtgggttggggagcaggggaggggggagaggataggggatttttggagaggaaactaggaaaggggataacatttgaaatgtaaataaagaaaatatctttaaaaaaaaaaaaaagggcctcggtttcaatcaggaagtagctggttccgccatcagatttgtttctaacttgccattgagcacatctgaattttcatctttcttagtctgaaaattcacttttttttgttttttttttgttttttacgtgtccctctcaccattgttccccactcccccagtccatatcctccagagaccaagccaccttgtccttggctcctacaccctctttccctctgggtctttaggattcccttcacacaattgctcttccccctgttcctgactcccatctgggccattctggtgaggaaaccag

SEQ ID NO: 29097 - DNA, 1106 bp, Mus musculus
atcctacagcacacagccaggtctaaccccagtcggccctgccctcagaacagcacacagccaggtctaaccccagtcggccctgccctcagaacagcacacagccaggtctaaccccagtcggccctgccctcagaacagcacacagccaggtctaaccccagtcggccctgccctcagaacacagcacacagccaggtctaaccccagtcggccctgccctcagaacacagcacacagccaggtctaatccctcatcacttccacccttttttcttggttcagttcacctatgtctcaaccttaggcagtagattcctgtaggcctcctcgattccttccctacacttgagtgtcaccatggagaccattagcaacatcctttaacacatcccaaggctctgtgtgagcctccatggagacagtagagggcagtggtttggtgttggctgcatttgtagcgtactcttggccccaaccaattctttagttttcagacacccatgtccgacttctgttgttaaatccatctgtaacttgatgtttttccacctgtccactcactttgttcacagaaataatgactctgagacttaatatttcatgaataaatacctcggccaaaagttttgcttgttccccgactagctcatgacttaatgacatgtttattctagtcttcgtcatatcatgtggctggttacctggtctgcagttgcatatgaccatcttctgtgtttggggcaaatctaccgtgcccgactatcttccaggatccttgctggatgtcccaccttataggcttttttattgacaggtgaggcttccgtacagtgcacaagagactatctctacagacttcagtgttagattcttctcagagctctgcaagttcttattttaatgataggtgctggcagttaagtcaggggcctttgaacacactgaacaagtacttataataaagccatatactcatctcaggtccactgatgacgagtggtggcgttgacagtagatgaactattaaatccaccatttccttgagtagaacaaggctggatatgtggcaaggtcagtctaaggcccaggtagaccctgtgcac

SEQ ID NO: 29098 - DNA, 1547 bp, Mus musculus
ccagggagggttctttttggttgaaatgtattggatatgccttttaacctcatcagacaaaggaatcttggtctttacaaggagttgtggtaagactcttctgggtaggaaattctaacagctaaagaggtggatggaggaggaaaagacgcagctgacaaaaataacaagaagggcattgatagccacccgatccgtgtggaggtacagcggctgaagtgagccctggccggggtgatggcagccggaccaaggtctgtaccactggccttcaagaagccatgtctcatccagcaggaggcagtgaggatctggactgagctagcagtactggagttcgagatgacagattgtgtcagctgtacagtgttatctgtgttatctctgcaatttcggtcctaaaagtcagtgtcctgttgttttgttttcttgggaggttacgtgtgggtgcccatagagggattcttctctgcaagagcactaagcactcttagccgctgagtcatctttctagcccgtttgctttgtttgggctttttaccttagagctgtgtgatggtgtggcttagagtgagcaccgtctggcttgatgatgcccgtgtagcattctgaaggctgatggacggccaccctgttagctagtagaatgtgaggagataagccagaggaagactctaaactggttcttgaatgtctggctcgagtgtgtttacccgctcaacagaatgtggaagagaaggacactgttgtgggtgtgcaccagagaagactgctcagacacgggctaagccaacagaaaggctccttatcagctatttattagctggttgatgactccactgggtcttcaggatcccagtgtagcattgagcctttctcagggggagcttctaagcacaaaaacaatgtcctggtttgacatacttcagttagcaagaacatttagccagaagcagaagcaagaaagcaaggttagtgcatttagagattttccccagaactgtggcttttgatggattaggtctttgttttagtgttggcgggtgctgctgtccacgtgctgagttttacagcctgaatggcacgtccaccatggagtcagttgtgctaaggtctggggccctgttatagacattctgatatcttttaacataattagtgacctatattttacttcaagaatcaaccttgggactggagagatggctcagtggttaagagcacctactgctcttccgaaggtcctgagttcaaatcccagcaaccacatggtggctaacaaccatccgtaatgagatctgatgccctcttctggtgcatctgaagacagctacagtgtacttagatataataataaataaatcttaaaaaaaaaaaaaaaagaatcaaccttgctggctctgccgggctcactggatgtaaccactgacagagccccctttccacccctaggaccgaggaggaggcctaactttgtatttacctttccaagttattcggtctataggtaaggagatagtgtgtctagggaactttttattcgatct

SEQ ID NO: 29099 - DNA, 1166 bp, Mus musculus
tgcgcctgcgctttagactgagctccctgcgggtggtgggaccgaggtgctgttatggcggaccccggggttcccggccggtacgaaagtggtacgggaaatctgggggtgaaggaggcggcgggtcctggaggtaggtgggactgagttgcctgggtaggaggtcgcagccgggtggctctttcctgctggctcacggaaggctgagggtttcaacttacgcctgtgttcgggtgtgtatcgcaggagccctggtggagctcaccccgacccccggcggcctggctctggtgagcccctaccacacccaccgggtcggggaccccttagacctcgtggcgctcgccgagcaggtgcagaaggtgaggaatagccatctccgtactttaccctgcctctttgggctcgggacagcctgtgaactcggcagtactgaagttaccattccatttcacacgaagaggatcactctatcccaattcctctgttgttgtttgttttgagacagggcctttctacataactctggctgtcatggaactctctatattatagactaggctggcctcgaactgacagatccaccttcctcccccaccctccaaccccaaaaccctatgctgggattaaatgtatggcttctataccaaattcttaaatagtcacattttattctgcttcccataaggtctttatctgttacccaggagcttgtggaacttaaatatatgctctttctttcctttttaaaaaaacaaaacaaaataaaacaaaaactgctggggttgtagtttactgttgcctagccctgaatttgattcttagcactaccaaaaacagcatgcaaaaaggcacagggtaaaattcctattgaaaaaaagaccacacacaataaaactggaggtagtttcatttgctgtatagcccaggttggctttgaattcagcctcccaaaggctgggtattacaagggtcgctgtcacacatggtgaatttcagtggatacagtcagtattactatgtccagagcttaggcgtcggtttccataataggtaaaataaagaagatatgcaaaataatggaaaagaccgtagaagttttgacagattggttttgattgtttctctctggagctctggatctgtaaaatgagatctttgaggtg

SEQ ID NO: 29100 - DNA, 1148 bp, Mus musculus
atgagattagaggcggagcctcacgaagagtaagtgtttggattggttgaaagcaagaggcggtacaagtttccttgccacgagcttctggacttggggcgtggctcgtctctgggcgtggcttctgtggggggcgggactctggaatgtgccccaggcgagcagtcccgttaagtggaggagcaaggccatggcggtgagcgaaaggaggctgctggcagcgatgctagcggtcgccgccgccgccgccttacgggttgcggcggagtctgagccgggatgggacgtggcagcccctgacctgctttacgcagaggggaccgcggcctactcgcgcggggactggcccggggtggtcctgaacatggagcgggcgctgcgctcgcgggcggccctgcgtgccctccgcctgcgctgccgcacacgctgtgccaccgaactgccgtgggcaccggacctggatctcggtccggaccccagcctgagccaggacccgggcgccgccgccctgcacgacctgcgcttcttcggagccgtgctgcgccgtgccgcctgcctacgccgctgcctcgggccgccctctgcccacttgctgagtgaagaactggacctggagttcaacaagcggagcccgtacaactacctgcaggtcgcctatttcaaggtgcgactggtccggagcccggtggccgggagcgacctggggaacttggggagcagagcagggatgagacggcagggaggcaagggacctcttggctagggagctcttggcggactttgggagcttcacccggttcttatgggcagatgctaaccctaaaggtccagccagtagtgacagcccaagccaagaaaaacctgacctttttcttttgggaaggcctcctagagggaaccgaggcggccgctagggtctcccagcagtacttcattgcaagtgtccaagtgcttctgcaacatcttccttccggttcgttctccaatcatgctttccctgctccctaatccaacagcagcgctctttcaggacgtgggattgccacgtcgccagcaggggctgcctggctccgccctgtggaggaccctctagctagtatttttgggttttttgtttttaagaaaatgactgtcttttgggatgccac

SEQ ID NO: 29101 - DNA, 1972 bp, Mus musculus
ttcaccctagaccccacataagaagacagacggtagggaggtccttaggagggagtggggaggagggcatggctgggtttgacacaaaggtatgctagctagggtgtggtggagtctccaaagaggggtgggggaccctgccagctgttcatggcttcagagacgcttcaggtctccagctgctagttgaaagtacacagaggaaataagccgtgtctggatgcctgcctttccagcgccatcctttacctcaatggcgacttcgatggaggaaacttttacttcacagaactagatgccaagactgtgacggtgagtgctcccctgtcctcatccctgggggctgatggccccagaggacagtagaaagaatgacttactgggcttcctccccaccccagcccacccctaccaacccccagcctgtttcctgtccctgggccaggggctttgggatatgatagctctcctctgactgtcctttgggtctttgtcctaatgatccattgctcttctgaggctttcccccatctcccctccccgcccacaggcagaggtgcagccccagtgtggaagggctgtgggattctcttctggcactgagaacccacatggagtgaaggctgtcaccagggggcagcgctgcgccatcgccctgtggttcacgctggatcctcggcacagtgagagagtaagggctgttgggagggccacttgtgtttccctgagactccccacccaggcactccctgcagtcattgcccgcccaccctccctgggcctttcttttcacgtggaagtggaagagggtggggcttgatgtggagttcttggttcatgccttgggcctgctccagcaaccagagcttaagcctgctgggaaggaggcagtcccagagcccctgtggtaacactaccattgttctcttggaagcggcagctaagggggtgaggggacctctccagaggccctctgagaagagtttgcctttgcaggacagggtgcaggcagatgacctggtgaagatgctgttcagcccagaagaggtggacctcccccaggaacagcccctgcctgaccagcagggctcgccagagcctggagaagagtctctgtcagacagagggtcgctgcacaaggatgagctatgacaacagctaggtcacagttgggtgtccttggactcatgagggtgactcagtccttcagcctggacttcccggcccctcaaggctgcagagtgagaggcgcttctgttggccccccggccagaggatcctgtccacagccttctgcatggtgctactgttcttggagtgggcatagcaggacacactcttctctgggcttggctgtaggctcagaatgcaggcccagaaccaccctggggcctatgtaggcagctgccgtcagcagcgtgatatatttaagtgtctgtaaagacaaccaaagaataaatgatttgtgtttttttcacttagtggtttgttccaagagagaaaatatttctactcttcctgggacgctgagcttggtagcagctcctctaggtagtgtgccgtggcacatgccacatgggaattcctctgtagcctcaggccagataacccaggtaccttgggctgttaccatagaaggggcatcttggtcctcactgcctaccttctatgggaactggatgtcccagatacagcacccaggatggcagcacatcatcagctttaaaggctttcaacatctagattgtcactaatcctcttctggcagagagcaacagtcagcgctgctctggcagggcagccgcaggcttcctgctcggctggctggcctcagagcccgcacctgactggagtttcagctcctccggccacatagctggcacgaagcccacccccttcagcactcctgagatgctgttgtacggagttataggaacctgcggctgagtagtcattggtcagtcgaactatt

SEQ ID NO: 29102 - DNA, 1326 bp, Mus musculus
gtgcaaagaaactggcagtaatagattaagataagacattttattatagtgttgtgcactctagcacaaattagacaaatgtacttttttgattatgagctgcctacattctgaatcaatgataattttggcagaaagctaagcaaagtcttacttcctgtgctctgaagacagtgttgtgaatttgaaggtttgaaaagtaaccttgccaggtttggcagtgcccacctttaatctcagcacccacacagaaggcaggcagatttctgaatttgaagccaaccaggaaatctgaggtctgtcatgcctagtttagcttaatttgactttactagcgagtaagactgtttacctgctctggttctggggttgccatatttttcaattagtgtccacttctcttcttgtaaatcatcctttaagctaaagccaaacagtgggtgaaatgtggctgctagagtgccaattctagagtgtggtccacgagctagacttcgggatggtaattaagagtcttttctttgcagtttggtcatccaacaagaagaaatgaatatgaaattccagcaataagaaatgaacaaagattggagctgaagaccttaagtgcttgctttttgccctctgaccagataacattagaactatctgcattatctatgcagcatggggtttttattatttttacctaaagatgtctctttttggtaatgacaaacgtgttttttaagaaaaaaaaaaaaaaggcctggtttttctcaatacacctttaacggtttttaaattgtttcatatctggtcaagttgagatttttaagaacttcatttttaatttgtaataaagtttacaacttgattttttcaaaaaagtcaacaaactgcaagcacctgttaataaaggtcttaaataataatgtctagttttgtcataattgagtactctctcccacttttagaataacaggtaacaccagcagtaagcagtctgtcaggagtgctgtgaggcatcagctgtagccacgtgagtggggtagagaagctttgtggggccgggctagtctggggtgtttccctctagagaagctccagggcgagcgcactggcatcgcactaaagaactgctgctgagtggggactaatggctgctagttgtccgccaagtccatcaactttttaggccaattctttgtagtagaaactaataggaattgatgaaagacttcagcagccctattaacataaacacacagagacatgttagtgttagctcataccagtcatggtgactgctgtaaatactctgctgtcaagagcatagtgaaagaa

SEQ ID NO: 29103 - DNA, 1237 bp, Mus musculus
atatttttttaaatacaaagagtataggccaagtatggcggcacatgcctttaagctcagcacttgggagggaggcagaggcaggtggatccttgtgagttcaaggccaggctgttctacatagaaagcttcaggtcagccagggctatatggtgagtacctgtctcaaaacaaaacaaaacaaaacaaaacaaaacaaaacagtggagccaggaactagaaataataattttcatcagtggggcaggattcagaattcctacatcagggacccaaagcccaggagtttcctaaattaaactcaaacactaaagagtcataagttcaaaccaaggtaagccagaggctggagttcataggactggctgaagagagaattgtgtctggagccactgtcgccgagcccaagccatgctgcttctgctcgcccgtcaccccccccatcgtgcactagcggtctcaaaagattcaaagtccaagatggcaaccctcaaggaccagctgattgtgaatcttcttaaggaagagcaggctccccaggacaagattacagttgttggggttggtgctgttggcatggcttgtgccatcagtatcttaatgaagggcttggcggatgagcttgcccttgttgacgtcatggaagacaaactcaagggcgagatgatggatctccagcatggcagcctcttccttaaaacaccaaaaattgtcttcagcaaagactactgtgtaactgcgaacgccaagctggtcatcatcacaggggtgtctgtcagcaagagggggagagccaactcaacctggtccaacgaaacatgaacatcttcaagttcatcactgccaacattgtgaagcacagtccacacttcgagctgctgattgtctcaaatccagtggatatcttgacctacgtggcttggaaaatcagtggctttcccaaaagccgagttattggaagtggttgcagtctggattcagctcggttctgttacctgatggaagaaaggctgggggttcaccctgagctgtcatggctgggtcctgggagaacatggcaactccagtgtgcctgtgtggaatggtgtgaacgttgccggtgtctccctgaagtctctgaacccagaactgggcactgatgcagacaaggaacagtggaaggaggttcaaaagcaggtggtggacagtgcctccaaggtgatcaagctgagaggttacacatcctgggccattggcc

SEQ ID NO: 29104 - DNA, 1238 bp, Mus musculus
tatgaacctaaacgaatctacagaacccagtctttggcatttggtgtgctgcaagaagtttccaaactgtaagaaagcccacctaaccttagtcaaaagtcggtccttggttgcttggatccctggtagggactgaccagtgttaactaactgaacttggcttgctttttcggatacagataacaatgaagatggtgccaaagatgctttcccctctggtcaaagactgggctcctaaagcgtttgtagtttcctttaagctggagacagacccggacatcataatcagtcgggctcggaatgctttggaagtttaccagcatcaggtggtggtggccaacatcctggagtcaataaagtcctttgtgattattgtaaccaaagactcggagacagagttactgctgtccgaggaggaggtggcaaaaggcttggtgatagaagagaagatagtagatgaccttcggtctcgacacacagcttttatatgtgacaaaaactgaaggaaatgctcctctaggatcaaacaccagagctcttaccactgataggaactaagattgatcctctgttaaggatcaacacagtgaagagatagtaaacgcggtgtgcaggcaagtgcctgctgggacttcagttctgagagtgaaacactggacgctctcctggatctggaaagtgaacaagagttcacaaagaggactgtgggattgcgtggcctgcagagcagatgagccaggagccgctgcgtgttggcctactgtaaggtcatggtgcgtgaatggtcatgctctgaagaagtgtttatcaagtgcctaccatgtgccagggcctttgtgagctgtgagggtctgaaagatgaatgagcacgtctcatttgggaactggatgtacaaaaatttatgtgcaataaagtatgtgcccacaaagggacacttggaaagggcgggtttctggttttttgttattgttttttttttcttttacaatttagttattttatgtgtttgagtgtttctgcttgcatgtatgtttatacaccatgggtctgcggtacctttggaggctagaagaaggaatcagagcctctggaacttgtgagcctccatgtaggttctgggaatcaaacctgggtcttttaagaagaaagacgtttttactaaaacaggagtaatgcagataaggtagatcacagacctccctacatctactttttgcctcttggcctagatttattc

SEQ ID NO: 29105 - DNA, 1172 bp, Mus musculus
tcagctcacagatggaggaaatcttcactagctgcacacgggacagaggaatgctatctagactacacaaaggactagagatcctaaataacaagaaatcaaacgatagggttaatgaaccagttagttgggtgtagtggaatgccactacacacctgtaagctgagcatttgggaggtagaggcaggaggatcagatgttcaaggtcatcttcaggtatatatatcttatacaaagatagcccgagatattccagaccttgtcttacaatgaatgaatgaatgaatgaatgaatgaatgagagtgaatgaatggatgaatgtgctaatgaaatggacagacattctcaaaagatgaagtacaaatgatcaattacttgtatgaatgaaaattattcaagccgggcggtagtggtgcacgtctttaatcctagcacttgggaggcagaggcaggtagatttctgatttttgggctatgcagagaaaccctgtttcgaaaataaaaacaaaaacaaataataataataataaaaagaaaattattcaaacttgtgctagcttcagcagcacatacactaaaattggaacgatacagagaagattagcatggcccccgtgcaaggatgacatgcaaattcatgatgtgttccatatttttaaaaaaagaaaaaaatgttcaaactccctggtaacccgagaaacacaaaatgacactgagattccatctatgtccagtgagaatggctgttactaagaagataacaacaaatgtagccaaagatgtgaccaaacaacgtttatgacctgctattggggatacgattccagccagggcactggaattcagcctggagggtcctccaaaaactaaaagcagatctgtcctgcaatccggctgtatcacttctgagtatttacccagggaactccaggtcaccacacttgcacatccatgtttattacaacaacacttacaaaagctagttgtggaaacaacctaggcacccatcaacagagggatgggtaaagaaaatgtgctgtaggcatacagaagggatatattttttattttttattagatattttctttatatacatttcaaatgctatcccgaaagttccctataccccccctccgccctgctcccctacccacacactcccgcttcttg

SEQ ID NO: 29106 - DNA, 1715 bp, Mus musculus
cttctttaaccctattctccctactataaaataaggaccagaggaaccaccttgttggaggatttggggtggattcctggcattgtgcttatgtcctagcacataggagacaagctctcagcctacttgatctcttcctgacttcctgcccagctcactgctgacactcccccctcctttccaggtcatcacggagccatgaaccagcagcacatgatgccttcccaagccttcccgatgcggcgccctctgcctccagatgacatccaggatgactttgattgggattcaatagtgtaggcttgtttctgcaagacagcagactccaggattctttttgttcagtgaaaggacggattagaggccggttgagaaaacaaagctatgttaccagtgctatctaaattcctttcgaagacaatcagagattctagctgggtaacttactgcttttatccaacccaagcaagaactacatgtttgtctccctgccagtaccctctgtagctcctaactgttgtgatttggacagctttttgcatatttgtgtcagtttgatgttgaccacaagtgccagactgatttttcagacagagcctattttgctgcgagcagtttatagatacatatgtgtaaatatgtgtacaaatattactgaaaggcttcaagttttttctaattggattattgtatcttgaaaagaaagttactgtcagtttttattccttgttaggccattttctgcaggatgctttcaaatgatacagagagctgaaaggaaatcagtttttcaaagcccagtttcctttatttaatcttcagaaataggagtaatcatgaatccaccgagtaagtcaaagaatctggagttggtactcaaaaacagtgcagagggccgttgttcctgagcaagcttgtcacttgtcattcggtgttgtagagagagtgttgtacctgtcagtgtgattcctcagctgcatcttggcagctctgaaatgtgtgggctgactgaaactgggtattgcttggctcttcaaacaaaccaatgtctccatagtcacttatgtatttattattcaaaagtgttattttaatatttattgctctgtgaatgcacagttctgttggattcactagggagggatttgtctgaaagcatggttatttttctggataaagtttacagacaaagacaatcagaagcattggtccttctcttttatcatcactccttaccaggtgagcgtgcttcctgtcttgcttagccttcctgctgggggagacttaatagctacataggaatttcctggaatttgaatcagtctatttaggcagcaagatacagaggctgggtttatacagcagtgtccctgctgttggtaacgctagcaggggctgcatgcagctccagagtcttatctgcttcagtcttgagtgcagtgactgactgcgtgacctgctgttgggtctgtgtgtccccaacatgaagcacctcagagctttgatcagttgctttgttttgtgtcatgtcacagctagcatgggttgaatgtgttgattttataatgaaagtaaagaaaggagattctcctccccacagtgaatagatcgttaattggttctttacagagagggaaatccattttaatgagaaaatagattctgtcaaatcaagaagaaataactggtcaccagttgcttgttagtgtctctgg

SEQ ID NO: 29107 - DNA, 1170 bp, Mus musculus
agtcgggcagaaagtggtactgccagatggcacaaacctcagaggaggacttttaaatgcaggagtggataagtcagggtttttaccttttccttacaggcagggttctcatctcttcatttttattcagggctcatatcaaatattgtttgcaccaagactcttttttgagtcttgaaaataaggaaacataccatatactgaatcttttctgcccatatataatgacaaagggatttttctatgttgcttgtaggtaagtaggaaacaattagataaagcagtgagattaacccatggttttgggacaatccagaagagtctaggctttggatttagaaacaccaggattcacatctaggctctgctatttctaaccttatgcctgtaaataccctgataaatattaaaaaaataaaaataaataatacaaataagttcttatttcatagtttcatagtttatttcataaacttatttcaaagtttacataaaaaacataagcactagaaaagcaattggctctttatataagtaaagtaaatgctaattttcttgtctttactgttaatgggcttatgctctgcttgtagaaataaagcttttcccgcacacttaccaaattattaggcaaaatacagtaagtattcttttatccgaaggactaaatgaacagtaggaaagagcagtcactttcaacatttggaaataagtttagtcttcacactcaagatacatttctttgggccctggagatatttcagtagattaaataataattatgtctccataccaagtatactctatcaagtgtttcaaattaattagatttgacacaaatttgggtatttgtttaagtcaacagtgggctatgtggctcgagaaatggactgagcttttctgtgagatccttgacactatcaaatttggaattggttccagatatattagtgagcgataggttgtacgtccatcctctctacctacatcagttcactatgtgttcatttatacacattaattcagaagttcaaatttttttattattggatatttatttcatttacatttccaatgctaacccaaaagtcccccacacccactcccccacctacccactcccacctcttggccctggcattcccctgtactggggcatataaagtctgc

SEQ ID NO: 29108 - DNA, 1196 bp, Mus musculus
tatgttcatgggcatctctttctttaggttagggaagttttcttctataattttgttgatatttactggccatttaagttgggactctttgctctcttctatacctattatccttatgtttcgtcttctcattgtgtcttgaatttcctgtatgttttgggttaggagctttttgctttttgcattttctttgactgttgtgtcaatgttttctatggtatcttctgtacctgagattctctcttctatctcttgtattctgttggtgatgcttttatctatgactcctgatctctttcctaggttttctaactccagggttgtctccctttgtgatttctttattgtttctatttccatttttatatcttggatggttttgttcatttccctcacctgtttgattgtttttttcctgtaattcaagggatttttttgtgtttcctctttaagaacatctagctgttttacctgtgttctcctgtatttctttaaggtcgagttatttatgtccttcttaaagtcctctatcatcatcatgagaagtgattttttttttaaatctgaatcttgcttttccagtgtgatggtgtatccaggacttgctatggtgggagaattgggttctgatgatgccaagtaaccttggtttctgtcgcttgtgttcttacgcttgcctctcgccatctaattatctctagtgctacctgccctcactatatctgactggagcctgtccttccagtgatcctggttgtgtcagaactcctcagagttcagctgtctctgtgatcctgtgattctgggatcctgtgattctgggatcctgtgatcctgagatcctgggtgtgtcagagctcctgagagtcaagctgtctctgggaccctgagatcctggtgtgaccaagctcctgagatcctggaattctgtgatcctgtggtcctgggcgtgttagagtgcctgggagtggagctttctctgggtgttgtgggactggctttagagttcgagcccaaggtctgctcagggcactggcccagactggaaggaacctgtgccactggttaggtggagttcttgggtgcccaggtcctgctggtcccggttacttctggtgttggggcagatattgtgtcctcctcagctctgaccctatgatcccgggtgtgttagagcgccttttggcattgcttta

SEQ ID NO: 29109 - DNA, 1191 bp, Mus musculus
agacttagcaaagagtacagtttactgtatgtcaattatgttagttgattgaatattaacataaaaaattaacctctaatggtctgtgtggtagaattagaaaaggtggatgctcagcagacatcaccggacactcctaccatttcttatactggtaatgagtagatacttgatacgtcacaggaaagtaacttttttccttcattgtattttctcatgcttcatttgtgtaaaacctttcttaaatgttagggaataagcaaggctggttgtccctgccccaagtgtatagccagtttgaatccaaatgcttgtttttttcaagttctacctccctagcattcctattgacatgcagtttatccgtagtctgcctaattcccttgccttgttctcctcagtcctacacacctccaagtaatgagttcaagatcagcatgaaattggaagcacaggatcccaggaacaccacatccacctgtattgccacggtcgttggattgacaggtgcccgacttcgtctgcgccttgatggcagtgacaacaagaatgacttctggagactggttgactcctctgaaatccagccaattggaaactgtgagaagaatggcgggatgctgcagccccctctaggtgagtatctagagccctgctctccctggccaattggctagcttccaaaaagtatacatcgtattatggaaaagtctggaacacatccctactcttttctttttttttttttttttcatagagtagttcccctgaaaggccacctaaaataaagtgacttatctttaccttagtgcagggttatagtcctcacacaccctggttaacttaacaagagaccatgctcttcccatttgtgccagtgctcatgggtcctgagagaacagaaggggattgctccatctaacctacctcaaaaacatagaggtgagagacagacagatagacagacagacagagggagcataaagctcttatcaaatccaaaaaaagatgagagagaaaattcacctggaagaaaggatacctggtcctctcccccagttcttctctcccagttcttacttggccattggaattttctcattaaggattcatctattcttttagttaaactaatagttacacttctcctttagatcatagtcattctttttgttttcttggtacctgaga

SEQ ID NO: 29110 - DNA, 1099 bp, Mus musculus
cttaaactacctgctctaaattgctttttttttttttttaaacatcagaacctataagaacagtccttcagttagaatgttgtattggataggctggagttggaacagacaaagacaacgtgttaaatattctcagccattgtcatttgggagccctgggctctgtttccctaatgaaaggcctgactggaaatctgaaagaggaggtgcatgagagggagctgcacaaagagaagaaacttagaacactgcccctcatgaactgggaaagtacagcggctgctgggggcatgcccgcagtgggcctctagtcatgaagaagagtaggggtaccctttctagctgtgactgtgtcccatcaaccccatgtcagacaggctgcaccaactctgagcctctctgcccaccaagctgttcttcatgggaggtttcagcatgttgtctacttgcatcctgccttctgtttacttcttactagtagttttaactgtgcccagacaagccaggcctttgtctagacttctgactcctcctctctgtagcttgtcttctctgcctgcctgttcctctgctctgatacctcattggcacctatatttttctggttatttaccggccctctgcagagccccattagtatctgtagctttttttgtttgtttttcctttaaacctgttttgttgccattcccccacatttcctggagccctttccccttcctgccttgccaccaccttgccctacgacatctgtggacttggctcagctgaccatgtacttacaatgtaacagagaaccatcaaaagttcatatcctgttaagtttccttacctgaactgagatttactgttctcactgctctattttagaaactttcaaacctatagaaaaattacaacaaaagtaaaacgcatcttcacgaagagtcacttttaactttttgtagcatttgctctgttgcactgttcacacatatactggtatctatatatttaatacatatctatgtacatgacttttgtttatttaacacacaagaattaactgcaagtgaaattttatcttgattgtttgttttggtttttcaagacaggattt

SEQ ID NO: 29111 - DNA, 1194 bp, Mus musculus
ctgtctgatattgtccatagaggtgcataattgtcatgggattcccttctcaaaggctttcagatgttcacaaaccccttggaaggcttcctgtgtgtggataaacgtctcagggtttcccacagtgtagtaagaagcagtctgctaagtgtcagagtcaagttcttaccctgatctgagtccctgtgcctgagctcccctggcttcttggaatgtttctgtggaacaaggtcagtacagataaaggactaggggcatcgaaggaacaggttctctgcagacaggcttctaatcagctgtcatggagtatttctgagatgtcctgctgatcagcatctgcttctaaagaaccctcctgtcgggatttactggctcagtaattaaaagcacgtgctctgaaatagtgaggatttgagtttgaatccctactgcccacgttaaaaagtaattgtggctatatgtgctagtaactccaacattgggggtcaaggacaagcagatcttgggatctcactagccagctagcctagttcaaaaaacagtgaacttcaggctcagtgacaaatcctgtctcaagagaatgaagcagaaaatgctagaggaagacactcaggatcctctggcctcgacgtgtgtgtgcatgggcacacacatccagaagcctcctctgagcatttgcatccttcccacagcccttatcctcattgtagcatcttaggactaaagaattatcttccgcctaaagtaactctattccttttcagttgtccttatccagaaaaggaagaactactactatctcaggccaaaaggaacagtctagaaagagagtccagggaggaatccaagtcctgagctcctgagccagaaacaggagtgatacacaggtgtcctgagtccttgtagggctttatgtcttgctgcctcttgttccactcaggaaggtacctggagccagcattctgccagtccctccaagctagtccctactttaactctggttttattattttccaggtgaaacctttgtcctggggaatagcctggcccggtccttggagacacactcagacctgatggattctgccttgaagcctgccaaccttgtcagcacatcccaaaaccttcggactcctggctatcggcccttgcttccctcctgtggcctcccattaagcactgtctctgctgtgc

SEQ ID NO: 29112 - DNA, 1323 bp, Mus musculus
aggcaccttagtagggctctgggtgacctcaggactctaggaggctggaaagccaccactgctacccttcctgccctgatgtgtccttccatgaaggactgaggagggaacagtgggcccggggctggtgctgctcttccccttagcctgctgtggctcccaggcccttctatttatttctcaaggctagccagcctctctccacaagtttagacgagcacctttcaagagatgaggaagacgccagccctaggaccttgaaaggccctggtacccaggccccttgccacctcctgggcttggcatagtgtcccaaggcccccagctcatgccttctcactggatccccagactctgaacttatggtgcagaccttttttaaagagatcctttcttattgctaatttattgcttctggcgtttggacttaatgcttctcttgcaccaaacagttttttggaagagggagaccatcctctggtccagagagggcctctccagagaagtgtggcctatttcagaagacactgccctagggcacttcttctctggaatggacaaagtatttggctcactgagcaaaaggtgagggtctctcttcctacactgggtcctttgtagccccagtcttcatctctgatggagtttcccctctccctgcccccacagctccctgccctggtcagaattgctgcaaaagatggggcctaatgcaattaggtcacggggccccaatggtgggaggaggacctcaaggctggaggagttctgccctctgctagctcctgtgctttcctcctaagcaagtcagcagcactgctgcccccactgccatctgaactattttgtgtccgtttgtttataaataaaaaccaatacaaatgcccgtgtctttttaaccagttgatatccaaatcactcaacaagcaggttaccccttcacttcatcttggttctttcacatgtaaaacaaggagcctgagccggatcatccctaggaactcttgcctcacagtcccaaagaacaggctactgtccaagtgcccacagcactcagcatcgtgcaggccccaggctttctcccagttgcttcactgtcaggttgacaatcatttgtactatagttccatcaagccaagaagcaatccaagagatagcaactccagagcctcagtaggctgctttccctcctcctcgtggggtgagaagaggcaatacagacagccttcatggtacccactgtactgagcaaggatcatgcagcctattggcttacagtgggagcaggtttacaggaggtgaagaaggctgactggagccagt

SEQ ID NO: 29113 - DNA, 1351 bp, Mus musculus
aagttggagactgacagggagatgtctgtccacctctgtcttccatgtattgtgtaagcacacacatagaagcacttacatttctccacttgtcagtcattgggagttgcctgtccctcagcagccttgaaacaggctggtgctgtcaacagaaagcttgtatctggctgagacagaggctgctgcaaggccttgaaggtctgtggattgcaaacataggctcctgccattctcctgcaggaacaggccttgttccctgtgtgctggcagctaagttctgacactttaataaacatcatataattctagctttttgtttttctttacaggatgagtcttcaacttcagctttgacagtttacaactatgattttacatcctgcttttgacacttcttttaaattatgtttttattaagattattttattatgggggaaaagcatttggaaaactttgtcacttgcatgtcccgtcatttatacttgatcctgcaacacatgtatttgtgcgacaataatacctttgcagtttttgtgcttctgtgatgggaaacaggactctggatggaacctgatggtggctgctggctgtggttaagggccatcaaccaccttgttttccagccactcgagtcactgtcattggagtgaattgctgttgtctccctggggtgccaggactcccggtgctgggctgctaactgggtgttgctgacatctcagtgctgctgagttacaggggactaggtgccagctgtggttgccctcgccatccagagggttgtttggttctttggtacatcaaactctgtctgtataaagtatcatataaaaaccccgggtctctggctacactttctattcctggggctgagaaaactccttgcatcaaggggtcaagaaacacggaattttagggtaaccggttctaaagccctctcttgtgtgtgcaccgttggcttgaaggtattttttttcttccagaatggtgttattgcatttgaaatgcaatttgaagttattttcttaatgtgatatggcaatgggcatgaccatgtgcctacagtatggtggttagcttgatgcatatctaacttaataaataatgcagaaccattggtgtgctttctcttgtcactggctggggtgcttttccatgggcactgagcttcaatgccagggcttctcctgggccagcctcagtgagcagtctgagtatcaaactaagatgcaagccttagtagcaactaggatttctcagcaagtcagtttggttgtcatgacatgtgttccaagggattaaaagccagttggtgctgtgtgacgtagcaggaagagaagagaggagcca

SEQ ID NO: 29114 - DNA, 1244 bp, Mus musculus
tttttcatgtactgtatgtctcctaacgggagagttgccaaattccattttaaaatggtccaatgtggtagatttcaaatttgactgcacattgcaataagtggggagcctctgccttcagagaccatgatctgattggttgtgggtacataggcttaggattcttacaaaccccctcagaggttcttctgtacagatgagtttgagaaccactgatctgtttgtggattcaggaacaggtcctctgtgggtatactttcatttttgtattatgagatagcctaagtctagactcctgggtgcaggaattacaggcatgtaccatcccatctggctctcttataaggatttttgcattcatattcataatggcctagccactaattattttctattcttgaatcagtttcagaagtttatctttttctagaaaattaccttttttgttccaaattaaagtgtcactccacccccaaggtcatatagatataaccaaagttacttgctttatttaagcacctattaaatcactttttttttttttttaaatgacaggtgatctgtgttcatgatgtttcatccatctaccgggtacccttgttgttagaagagcaaggggttgtagactactttcttcggagacttgaccttcctattgagagacagtcacgaaagatgctgatgaaatggaaagagatggcagacaggtttgcctcctcacatgcaattgggcgcacatgaattcatcttttgcaggggttccaccatgctgtaataataaattagcactcctaatagaaaaggtgcttggtaggaggagaggtcagaaagctaacaaggattttatgtcagcatgtggtcacagcacagaggaggaggcctggccaggcggggcctcttcccaggcctcaaggcagagagttcagattaaaatattatctctcagcagctcaacagcaccactagcagcccaggggcagagggatacacatattcccagagcccctatgaatgctggcattagctgcagtgctcctgttgtgtttctgttatctaagcggagtttaggaacattccattcactctatagaaaagggctcaacaggtgtgggctgctgccaccttaccctaaagctctgagattgtgtcatggtgtagagcagggtgaacctaactgtagttgggacatcactgtggtggtggtgtttgtttagggtttttttttttacacacacactcccccc

SEQ ID NO: 29115 - DNA, 1668 bp, Mus musculus
gggttctggtagactgtttgctcctggaaaaccactcaggtgtgatgtacccactgcagcctcagctaggagcagtagggatggtcacatggtcttgtgtccatgtgtggccagaaaagtagactgcataggtaggtgttctgaggtccttagggagccactcttattttattttttaaaaggctgtattgaagacaggcttattgggaagctgctctcaggtgaattcactagtcccaaggactgaggccaaggaagtcaccatgggggtctggggtggggggagaagcagcagagagaagagagtagggagccactcttggcttcatttcaccgacttccagcaacagtctggaaaggaggcctagggaagtgtgagcccaaacatttattgagtcatttaaaggtacttcaaaatgattatatgattatatttcttgtttagtcaaaaaggtaccccattatttgttcatccaggcagaaaagtacatcagtttgttttatcagtgaatgtatccagcaagtgcaagtcacaggtttcttttctctttctcagttgtccctcacatcactgatgcaatccaagagtgggtgatgagacaggcattaatacccgtagacgaagatggcttagaacctcaagtgtgtgttattgaggtttgtatgattcttttttttttttaaataatgttagtttttacattgttcttttttttaagatttatttatttattatatgtaagtatatgtagctgtcttcagacactccagaagagggcatcagattacattatggatgattgtgagccaccatgtggttgctgggatttgaactccggacctttggaagagcagtcagtgctcttaaccactgagccatctcgccagcccccttttttggtttttcgagacagggtttctctgtgtagccctggctgtcctggaactcactctgtagaccaggctggcctcgaactcagaaatctttctgcctctgcctctgcctcccaagtgctgggattaaaggcgtgcgccaccactgcccggcttgtatgattcttgtctctgtgaactagttcagtcattcctctccttaaccaccagtaggactatgcccaatgaaatcccacccttccattcctgtccatgcagtgtgcagcagcaggtggaatggagctcaggggaagcaatgctgtccccacgggtgctcccttctgtgtgtgctggatgatctaacacttgtgactcgtagtggcaggatacatttctgtccctcccttgatgttggcagccctttgcttgcctctggcagaatttatttaccctgttactgtcctttgctttgtttctgttctactgtcccttcattccaggactggagttcacaagtcccagcagttttgttataactggtagtttttaagtaatttatacttaaggagatacatataggtttcactctgtctgtctatcctttgtggctctcaagtgaattaaaggtacctaagaattacagtttagttcctggtacaggtttttttgggggggtggggtgggtgttcaagacagggtttctatgtagccttgactgtcctagaactagccctgtagaccacactggcttctaactaacagaattctgtctgcctcagcctctcaagtgctagg

SEQ ID NO: 29116 - DNA, 1204 bp, Mus musculus
acccgctgtacactaactccccaagtcccaatcgtctgtgaaaatccccatgacttgttagaagtgggctcgtttgcctctctacatttagtgccggatggaagtaggctcgcgacagttgttctaatgcaggcaccgtcagggtgcgttgtgtggaaaggcagctggctaggacgtgaagccaagcggcccggcctaagagggagacaagcaggcaccgggagaaggcggcggtgcggggcgagagcacgagatgatttggcccgcagcctgagggaaggcggatgggaggtgagagtgtccaccggctattgcgggaccaggcaaaggccctcagggttccggttagatgcgagtcaccagcatcctctagacctcgggcgaggaagcccacagaacccacaactcccgagacccacccgcagtagccactcaacaagctgcggcgagacgtcccgcgcatgcgcgccctagccccaccctcccctgggcccgcctctccccgccctctgcgtgcgcaccgcctagagcccgcctctcagaaagacggctggcgcatgcggcccggccgagcactggctgcccgaggctcaccacgcgcgcgccggccttgctgtggctgacacgagactccgaagccggcctcaggtaggcagacttcagggatcccggtggaacggctcccgggtgcaagagcctgtggcgccgacagagcccggcgcggacggccacgccgccggggcgataaacgtctcttctcaccaatcaggggagagctggcccggcgttctgcccaatgggctgcatctctaacgggagtggggcgggcagtcccggaacgcgagctgccggctcccgcgcgcgggccgcgtggcccggctaaggaaaggggccgagtccggcgacgcgggcagccgggcttggtgaggtagagagcgcggtgtgccgccgcggaggggtctcccagagccccagcctgtgatggggcccgactggcggccttgagctcctcccggcgctgcccggcgcgcgggaggaaggggcttgtaggttcgctgggcctcacggcccaggctacccagctgctgtctctctttccagcccagcgcgaagatgctggcgttcttgaggccactacgtcagcgtggctgccttacgtccacactcattattttaaatcctcagcagccgggtgacgcgggtg

SEQ ID NO: 29117 - DNA, 1194 bp, Mus musculus
ccctaaacctaccagacagtggcccaccaccaggaaccacaagcatggtccttttatttctccagcagaatgccgcacacaccgatgcacacgatgccacacacttgaaggcgtgagcacaaagccactggatctttcctgggcaggagaggagggtttagagcatccacgtgtctccccaggccccacctcagagtttgacttgctcccctcctcacaaaaggtccaatagtcctctggttgccctaaggactatgttggtgtccccatagtgtaactcaggcctaggccttggggccttgcacacctggagagaatccaggcacatcctcttcctagtctcagcgaggacacgtgtatccagtgctatagcaactgcacctggctctcaccggcaccggtctctgccccactttctcacttcaattggcagcgctgcatattggcacaaacacccaaacactgcgggccccatcctcagttttagagccctacccctttgctcctttcctgctaagctaatgcaggtggcaagagagtgaggggtggggttccaacgacaatactccgggggagacttgggaacaaggggctgaggccgaactgtctgcatctcatactgggacctgcatgtaccagtgccagggcttgggttgaatcctgctcagccctatggtgcccaatctctgtcctaccatctgcatgtaccatcaggccctggatggagcccatcctggctcacttcacttgcattgtattgccccctggtgagccactccaccccctcagagatggagctgtacagagggtctggagactaagattatcctgtgaccaaaggagacatgggaagaggccctccctccttccacgattgaggttcccccaccaacccggttctcagatatgcaagtacctcactttgttaacttattaacttattggtttcattaaagttttcagtaggaagtgattggtcttggttgtgctcggtgcctgaaggctgaggctcctggtttgatggtgaaagtgaaatttgggtttattgtaaaccataaaagcccagctccatatgactcaaggaaaaagaagaggcacgttgtcccagataattaaagcatctaagggatagatttggcttcacctacaggtaaatatagttgatcaaacacatgctaactccttgtctgctcc

SEQ ID NO: 29118 - DNA, 1184 bp, Mus musculus
attgcctcctgcaggctaagatactggtgcactactttccacgcctggggactgagattctacaacagaaagatgcaatattttttattttcttttttccatttttgtctccaaggaatcaatatttcaatattttgagctatgtgtccaatgctatgaaacgagaatattaaataacatatttatggccttttcttgaaacgtgtggttgaagaaataattctcttgtgtgtttcctggcttgggcactctccaccactgctaaggggcggcctgtgctcttccttcctaagggtgtacaggatttccactctgccagttctgccctcagaaaaaaagaaaggggcagaccctttccaccagcattcttctctgccccttccccagaaccttccgaatccagaagatgtggaaacatttcctgcctgtgggccatgaactcattctccacagagagctggtctcctccccgtcccttctctccagacccaggagaaccaggactttgagaaccaggactttgtgcactgctctggccactgttttattttttaaatacattaaagattgtgctcatctccgttgctgcatggactccagactgcatgaaatgcaataaatcttgttttcggtacttgagaatctgtgtctgggacattcatgggggctactcacttgggaaaagcttggaaaggttgatttgtttcaaggttggatgtcaggaaaggtggaccacttgtcaggagctagtgtacaaagccaaaggaactttcagactgagattcttgactggtttacaaatgaatttcatcagaacatgtcgcttgctcagaaaagccttgcctcacccagacgagctacttgtatggcattgtggggacatctttgcaggagaacacgggcttctctagcaaacaaagaacccaggaaatctctgcagccttcgttgtcataatggctcttgccactgtctgctgtagttctcatcaccaaaggcttggatctgccatagagggcagcccgtgccccttgccattcatcatgttagggcttctatagccagagcctgcttcctgtccattgaagcaggagcagcagaaaagagccagcagtgagcaatctctctggcctccttgtctttttccaaccatagttgggcctgctgtcactgtgtgatagtgcaa

SEQ ID NO: 29119 - DNA, 1136 bp, Mus musculus
ctagtccttccaacctgtatggagcagctgttctctccaccagcctgtttctgattcttcacgaagtgccagattgatctctggaaagcatggtgcttgaatcgtgttagatttcattcctatgggattaagagacatgcttcttagctctacagtcagggcccctcattgactgcttgtaagcactctttccagccccctcttccctgttgtgtttaccttctcttctgctatgctctgcttttgagccaatgaacatgcctgttccatggaccttcccagtggtccccactcttttcctgtcttcccattcccacccatcttctgctctgctccatacttcttcctgatgctctctctggttctccccatcctacagtgttctttctttttacggagcacccagagttttcccttggcatctctggtccatgagtcctgagaccatggtccacaggccagtagcaagctggtgaaaactacacaattccaggctccatctgtgagccctagagtcagaattgcatttcagcacgatccctaggtgatttgtgtcggcgtctgagcctgagaagcactggtttgtatgttcattaagtatactgtttgtattgatgcatggcccatcgccagaatatgggaggataatctctgatgccaagtttagcaccatcaggtgatggctgccatgttggctaggttccacagtctatggtggaggagtggatagtggagaaggccaagaagaccgtgtagccttcccacctggaatctctacctgcccaggcctgagctccagctctgtaactgtgcagaaagtactctggcaacccaaggaggagtcgattaatcaatagaaagcagtcctcaagcatggaacagaacttgtccctgtctcagaacacacatgggtgggaatgtctgttattctagcacatgggtggaaatgtctgttattttagcatatgttttggaaaggaaaatatttattgttttttcccctttattatagcattaatgtggtttctaaagtagtagctttagaaaacacaatatgtcacatgaagaaaataaaactgactcatggatcctctctccatcagcgttcatttagtactcttggttgccattcattc

SEQ ID NO: 29120 - DNA, 1151 bp, Mus musculus
tctcctggactgggtgggccagtctgcgtggaggagaagtgggtcagctggtagccatggtgacagcagctgctccctgccagcttcccatctctttaccacaaacctcaccgatgagcttctttgtccggtctagcagagatggggccaggagaatggggttgggggttgcagtgtgtatgagtgtgtatgtgttcaagctcatgcaagagcctgcttcaagctggtgtatgagcctcagcctagggagccagcctcgggataacacacgtctcgctttcctgccaatggaagcaaggggctttgctgttgctcctctgactgggcagggccaaggggaggagacactacatgtgactgtatgaggtgtgtacacagactctgaatagctgtgtggccgcttctgtgtgtctttgtgtgggtgagcgtcttggttggggcatgtgcatatccatgaacacatgtgtctctaaaacgtggatagtgggtttgtatgatgctatcatgtttgaaactctctctcactctctctctctctctctctcttatgctatcatgtttgaaactctctctctctctctctctctctctctctctctctctctctgtgtgtgtgtgtgtgtgtgtgtgtgtgtgtgtgtgttgggagtgttgttgtctggaaagacagaggtctccacactaggagattaggtgaggtttattccccaccccaccctggcagcctgtgcctcttggactagcctgcctcgcccaccacacaccaacccctgtcatcttcccaccgctccctaagtagaggaaggaggggctagagttaggtcctctaccatggtgagaggcagggttcttaggcaccagctccagcatctagcacagactctagatagatgctgacatagctacccaccatcacaactgagaggtgcatatgtcccccacacacctagagtggtgtttgggggtgatcttattagcccctggacttccctctgaacacgctgcacgggggtgggggtggggttaggaaccaactctggaaaagtgtttaccatgttccaggcaccgtcgttctcagcaagcaggtaactgcccagctggaaggcgcacacgtaccaatcttgttttgtaaccttttatctaccgctcct

SEQ ID NO: 29121 - DNA, 2544 bp, Mus musculus
aggccaggcacactagaggatgtactgggacctctcttcccctggggtgttccaacatgccagaggagctcccagtggacccaggaggctgcctgttgaagtagctggccttttcaggcatcaaggtggccctgtccccctttggggttattcctgagggagcatggcttggtaagaggtgccatgggtagggctacttgctggaggaaggagggctaaggttaatttgttttgagccactgtctggaaacctgtctgacctggggttagctgcacgaagctattctttcagggttctactttctttgctcatctgtagacaccagaccccatctggagttctgacacaccagagctccagcctcctagctctgtgggcagcctggctctgcattcaagggtgcctcagtcaccagctctgtaccagcaatactcacccctccacctccctgactttcttgagtgggcccctgctctaggcatcccagctgcctctaccttactacccccttcccttgtctggctagggctcctcccaaccactgagaacactgttggagggactagtgcctgggccagatcccaagatggctgatgtgaatactgaaggctggctctggactgctgcatctgttctcccctccttagctatagggtggggttggaggctgcctgggagatggcaaagtagccctggtttatgtcgagtaggaggaaggacacaggtgatgggtgggagatggggaagactctctttctgcctctctcctagcccatgcctctagcataagtgcctaggcagggagagctatggggataactgtgaagcagcgttggcctgtgtgtggatctcatttgtaccaaagctggggtacacaaagctgtctcagcccaaagggcctccctgtagtcagagtcctgcactcagtgtcaaagaagggctgtgaagaagcccccatgcaaactggggtgaggaggaggaagagaaggaacagaccggggctgtgtccctgcaggcaggagagggaggcgggggccagttctcttgccagcctttctggctagggagtatatatgtatctcccatatcactagatatggggcaaagtgctcttggtctccaagccttaatggtttgggggcaaggagaaaactagcttgtggaaggctgttttcgtcttgcttgaggtgtgcgcacctttaaagcagttaccggctggatggtgtgaaagccatctggagtggaggagtgtcagtgacccactgacaacagagagctttgcagatgtggcgtcgagtcactcccagaagtgggagctgccagcagagagtgtcccttgcctcttaggagggtcagcacaggggatactctagccagaggagggacttgatgtgctgggaactcgtgctgacctgcctacagtcagaggctgtaaactacctaagagatgggcacttggcggccccacctccatggaagatagcccccctccccaattgattttggggaattcacgcttcttaacactgagtaaccccttctagatgctcgctcccacgtgtgggttgtgtaaggctagtgtgtacatgtgatgaggaggctgggtttaacgctctgtttctcagcacactggattgggggctacactgggtgggatgccattccagaagcaggtgtgcccaagtgtgactcctgcctgggctgggagccatctgccctttgaggaaaggacaatggatcaagaattagccgggtgcttgtgagttcacctatcaacaggccacctcacataacctcttgctccaggggtcagtggttgcaggagtgggatttggtcatcccatctcctctaggcaggccagactcgtcggtgatgggctgggacaggagcagccctgcagcgatgctgggctgtgggcaggggcagtgataaatgactcagagcatatgtctctgtatttctgccctgctcagcctgtcccactttttaacagattcctttcctacaaggaaagcagagatgggactctgtgatatgaagcggtctctaggaaatgggccaagtcttggtttgacagggacatttgatcctttggggaggaaccggctccagaggcgctctcatcttgcctctcagctcaccagactctgaacatcacctcttcagcaggttccgggcagtgccagcacactatggggtggaggcagagctgcaggaagctccagagaggaaggggtggtagtgcctggatggttctgctcttggggactcggtgcctggagcactggggtcaagctaactctcccaggggctcagcccctgaccagggaagcatgccagctcttccttaactgccagcctgggagagaccagcagcctccgtttttgtttttgtttttgttttaaagacaactgagccctcccagggcatttctttgaaaatgaaatgtagcacaatcctcaactgtgttcccaggagccctgacatacccagggctcctgatacctcacattctccatcgcccttggcctaggaggcagt

SEQ ID NO: 29122 - DNA, 1223 bp, Mus musculus
ctccaggctttgtaagtctatggcttggagttgctgaggtggctaggggcctgtttcatcccccttggttctcactctgggagcctgtcctcatttggtccatgcccagatgctgctcctgaaaagcccaggtgtagcttcacctctgtgtggtttgccctcctcctcccactctctctggtcttggtgagaaataaccaagggtcttctacggtggacagttccctaggtgctgtaatgtcaccacctaggctgaatcctgagtagatctatgtccctgccagcagtcaggctgggccacctgtcattctgcttctagatgacaggccaggaagagtggacactcagagccctttcaaaggaattctctctgatgggatgagagagagaacgtccttccaagtatttggctttttaaaaccacttcttcccaaatttcttctccaaaactttctcttggaaggcaatttggctgcttcctcagggaaagcagacctgagacttcttagcaactcctgtagcaatgagaactcacagaaggcaggaaccccttttttagaatttccaattgcatcctgcaaagagagagcgcgcgagagaaagtgagagctgttagggactgacaagcacactgtttagataaaagcaattagccttttctatttgagctctctgcagcatcttcccaaaccgtggctcctgggtggcaggtggacagctgggagggaataccggctgcctcatgtgatgtccttgccaatccccctgaggagaaaattcttcacatggcttctgcatgtacagtatttgggcaaaaaacaaaaaataaagtccatttgaaattggttttatgtatggctttctgaggatgttcttcattccaagagagaagagttctgagtatttaaaaagggaagagggatgttggctgggttgcttgagaggtaggaaagaggtacagctcagaaaaaggtatgaagatgatgccggcctcctccccttcctggggtgcttagttgcctcagcaacattcctgagccatgattgaatcagactggcctgttggcttcccaggtggtaccctcagagacccttgctttgtgtctctacagactctacaagacacacccaaatagagaggacaggagagacgaggcaaaggctgactccagccacaccttataaagacagtcaccagtagccaagcttgcagtaagcaggga

SEQ ID NO: 29123 - DNA, 1228 bp, Mus musculus
ctgaactccctgggaaggatgacaaaccagtaagcttgcagaactggaaagggggattggatgtcttgtcacccatggagagattccacctgaaatatttatatgtcactgacctgtgcactcagaactggtgtgagttgcagatggtgtacgggaaggagcttcctggttcgttgacacctgagaaagcagctgttttggacactggtgctagcatccacctagcaaaagaactagaacttcatgaccttgtgacagtccccatcgccacaaaagaagatgcttgggcagttaagtttctgaacatactagcaatgattcctgccctacagtcggaagggcgcgtcagagagtttccagtgtttggggaggtggagggaatatttcttgttggagtcattgatgagttgcactacacatccaagggggaactagagctggctgaactcaagacacgaaggcgccccgtgctccccctgccagctcagaaaaagaaagactattttcaagttagcctatacaaatatatctttgatgccatggtacaagggaaagtgactcctgctagcctaatccaccacactaaattgtgtctagacaagccactgggaccttctgtgctgaggcatgccagacaaggaggcgtgtctgtaaaatctttgggtgaccttatggaactggttttcttgtctcttacactgtctgatctcccagctattgataccctaaaacttgagtatatccatcaagagactgccactatactgggcacagagattgtagcctttgaagagaaggaagtgaaaagcaaggtgcagcattacgtggcctactggatgggccaccgagatcctcaaggcgttgatgtggaggaggcatggaagtgccggacctgtgactatgtggacatctgcgagtggaggaggggcagtggagtgctcagctcatcgtgggagcccaaagccaagaagtttaaatgaatgaaggtacactttcagaaatgttgatcgtttctgttcttaatatacccatgtaagaggaccagtctctcagcttggctctcgtggacagtgttttttatgtttacaatcttgaataacattccatcccagggccaaagatcaagaatgtggagagatgtggtgttagagtgaccttggagctttcaggtaaactgcaaagaagacagatatacatcagtgcagcaaaggtatccctcactaatcac

SEQ ID NO: 29124 - DNA, 1412 bp, Mus musculus
atgttgtttggcattctgcctaacccagtctcccttcccagagtcatggacctctctgttgctttatgttggtcatgtccctgactgtccagatttcctcccaccccaccccaccctctcccagcaccagcaccttagaaactattggcagaagagggcacatgagctgcgggagagtgtatacactgatcagtacctcccttgaggctgagcttcctcgcagacccacagaaaggtctataaaggacaagtgcttggcagaggggaaagtagaaagggtctttattggctataagctgtttctaagtgctgagagttttgcttgaagagggagcgagccatcaagttcccagcttttcaggaatgaaagaagttcagcagtcagataatccttgtgtcttgggtcagtttggccctggccctagagtgaggcaagcccttcctatgaagatgagcaaaaatattattccacttcactctgagtgctttcaggatctggggcttcaagactcactgcttcagtcagccttcattagcaccaaagactccatgaaggtcgtcccccacacaaacataccccttgcgcaccttctgcctactttgagccggatctggcctgtgactagaagaccaacccctacgaggaaatgtggagctcaacgtgtgcactgcttgtatgcgtgtggatgtgtggatcccacctgccgcctccccatctgctctgggtgtatttttgttttttatagttctaggtttacaacagagaggagttaatttatcaacagcctaaaactgttgccaggtcatcttacagtttaaaacatgccatctcatcggtagtccctgctcttttccctctcccatctgccagtctctctgtgccctcgtgtctgagtgctgtttgcccaccttttccaggtgtaagaggcagagagcctggacagctttctctctcagccattgttcaccccacttgaaaattcaaacaagaaaactttgcttcaaagatctcatgtgtgggaaccacagcgcctggttgcctttctcctgtgtatgtgtaaattccttaataaatattgcagggaaagaccctttttgctcggctgtcactgtgttactcttggaagacagtgagacatacacaggatttctgctttccaagagcagctgctgccttcacctttgcatcttaaagaattctgtttttagtaccaagggcaggccagtccagaacacagaaagacctttcttcagtgacagtgggagccatgagctgaggggcctggagctctgcactgtaagggtcatagaacattaggatctggagtgctttccctatagatggaaaagctgagacccagagaaagaacacagttaccaagcatacacccttccttggcagagacaatagt

SEQ ID NO: 29125 - DNA, 1200 bp, Mus musculus
cagctttgtactgtgcaggagatagggacactctgcccattttaaaggagcatcgtgagaggtgggatcagaaaaggcataagtgagttgggcctcgcagctgtctccaccgtcatttgtttgtttgtttgtttgtttttgatagggcccccaaggcatcaggggctacccgggcatggcaggacccaagggagagatggtgagtctgtgggggctgtgaaggagttgctgtggcttctgggatctgaagtccatctaggactgatctgcaatctttcctcttccccagggtcctcgtggctataaaggcatggtgggctccatcggggctgctgggccaccggtaagcctgcttctgtctctaggccctacagtggaggtctatggcttcaaactgggtgctggtcttcatgggctcatgtgacttaggttcttgtcttcacaccagggtgaagaaggcccaagagggccaccaggccgagccggtgagaagggggatgtggtaagttctcaggcaccccttatctgaacagaccccctgaagagtactggaaagggattgtctccatccaaggctggtgtgtgtgtgtgtgtgtgtgtgtgtgtgtgtgtgtacacattggcatttatatatgtgcttgtcagtctggatgggggtgacttctgggtatgggggtgttctcatggtctgtggtgaaaacccagtcattttgcttatgttcagacttcacaagaagtcttaggatccaatcttgtagccactggggtcagacaatgaaagtctagcaaactaactatggaactaatggaatttggtctggatccaaagacatctctaacagttgcttaactctctctctctctctctctccccttcctcccctcctttctctctctatctctttctttctctctcttctttctttctttctttctttctttctttctttctttctttctttctttctttctttctttctctctttctttctctctctctctccccctttctcccctcctttcttcctttctctccttccttccttccttccttccttccttccttccttccttccttccttctctctctctctctctctttcttttttttcccatagcccctttttctgagcagggtctttgtttatttgttttgagacagggtctctttatgtagttccagttgtcctgaaactccct

SEQ ID NO: 29126 - DNA, 1107 bp, Mus musculus
gatggggaccgaggatccccaggggctccaggagaggctgggagacctggccggccaggcccagtggggctaccaggtttctgtgagcctgccgcatgcctgggggcttcagcctatacctctgctcgcctcacagagcctgggtccatcaaggggccatgagcaaccagccaggacagagcctattagtgtctagggtcacttctgggtggacatgtactccagacccaggaggctagatttctcaggatcttctggaaacccaagatccaggggttctgaagacaagttcagtgagggaggggttgggggagggagagcacgggagtaaaggtgaggccaacagagccaagtattggagagccacccctcccaagggaagagggtagcttctcttcctggagtaccaactacccctcacccatgcctttcagcactgggccatcccaccctcggggcaggggggactgaggcttctggtggtccttaccctattcttattctctggacttatttttattgggtatcttttgggggagaataccttgaggtggcagttcttaggccagccctgctattgcctgtctcccatcccagtatttaaacatccatcttccctgttccccagtctcttttgcccacaccactctggcctttgtgtaaataaaagttcctcagttggttacaaagtgacttcttgtggatgaggatgggtctccactgcttgggcaaagtggctgagggccaaaggggagggcaagtctgggtcttccatctgggtacatctcaagttgtgagcactgggatccttagcctgctcgagaaacttctgtagtaagaacctcggagtcgaagcagggttttgattcactgtgtaactttgggcaaactacttatgccatctgtccagtggtgacaagggcttagccatgtcatatgtatagaagtatccatacccactgggttgcctgcactctttcccattctctccctctctctacttcctttatccctttcattccttttctgactcatgtagtcagggtctcatggttttagactggccctgaacttgctatatagctgaggatggccttgaacttctga

SEQ ID NO: 29127 - DNA, 1920 bp, Mus musculus
tttaaatacatttactatctcatttcaaaaatgattttaataatccatttcttaaaacactggataaaattttgaggcttaatatttttaaagcatagttttatctagtatcttatttatcatcaatttgtaaaatggtttaaggaaatgcacaacttgttttatttctgcactatgtggaatctgcatagagggttttaggtcataagttcaaaggtggaagcatcacctccaagcactttttgcaaagcagaaacagagtggtcccaaaccactgcgctgtacctacatggaatttgtttttacctacgtgttgttataatttagcccagccaatcagtgttttaaataaggaagaaaagtaaaaattagtaaggctaatgctactgaaatgagttgttaggcatgctatactgtcatagttacaaagcattctgttctctttcttgccacaccaatcaggaattccctccctccttcctctctcctttccttttttttccctaacataagatctcactctagtccttgctggccccaaattcattctttagcacaaggtggcctagaacctgtatcaggcctcctgcctcagtcttcctaatgttgggattgcagttgtgagctgccacatatcgcttaggaattgttaatagtgcttgaaattagaaaccttttaaatcattgactttgggtttgcttttaagaaggtcttaattttaaaccaggcttggtagcacttacatttaatctcagcaactgaggcagaggcagatggacctgtgagctaaggccaagcctggtcgacatagcaagttccaggccagtcaaactggggtcttaaaggtggtagagtaaaagtccatctcggtttttatttaccctcccttccatcgatcttattataagtaaactagccttttctcattcattttttcccagtaaataatagtatatcctttaactcagctgaaattgccatattgtatacatctcccaatgttaattatggcagaatataaaaaaaaagaggggataacatttgaaaagacataaaggtgaaatattcatgattctcttattacaggaaaatatagttttctatcttttttcaaggacagaagtctctacttttatttttgtaattttttattcacaaatcataagtagaccagattccattttttaaaaattataattcttggtaggcaggcagatgttgacttgcagagaaagcgccataaaagatttccagtgggaaaaggtatgtgcttgactgcttcaaatgtctgtccacgtcctaagtgagagtcctgctgcgcctgccacgcccagtcactggtagcgagtgcctcctgggcattcagtccacagtgtaatcgactctacactatggcatctgcactctgctgacaagtgacaaggcatctgcgatgccttcacatggaccatagtagcgtcagctcacactcagcactgcattgtttatttcctacagctacgcagagcagcccacggtttctctccagcaccctttcctgtgacttcatgctcagataactgcctttccttccttctgtgcctttaaaaacatatttcagttctgcacaagtgagacattaaaaattgccaatgcagatttacgtcctggtgttgggtttgatgtgatttgtgcgtcatacatttcccagatgtgttgatcacctacagaaacagtgccgtctatggacctgtgaacgaacggccctgagtttggatggggtcagcaccagcaccagcaccactcatggctgcctcctgcctctccaacatgtgcatcaccagttcttgctgatgttccctcagaagcaacatttggaattattctttctccattgctgcaacctcaaattgtctggggcttgctttttattgttcggg

SEQ ID NO: 29128 - DNA, 1099 bp, Mus musculus
gacccacttaaccttagttatggtttctattgcagtgataaaatgccatgaccaaagcaacttgggaagttgtgtttctctcatatatatatctgcctgcaatggttctcagcctgtggatcttgacacctttgggggtcccatatcagatatcttgcacatcagatatttacattacaacttataacagtagcaaaattatagttatgaaatagcaacaaaataattttactgttggggatcaccacaacatgaggaagtaaatatattaaagggttgcaatattaagttgagaacctctaatgcataaaggaacattgcttattgccttgctcctcatggcttgcttagcctgctttcttgtacaatctaggaccacctgcccaggggtggcaacatccatagtgagctgggccctcccacatcaatcaagaaaatgcactacaggtttgcttagcatcctggtaacatacagtgttgtgccctcttttctagatgaattctttcctgtgttttttcttgtttgctgtattaattggtcgaagggaactttttgccgcctttggtttttatgacagccaacccactctgatcggactcttgatcatctttcagtttattttctcaccttacaatgaggtaatgtatgctttttaaaactaccatataatatagtttttgcctgtttcaaatctagactctttggggtagtgtaaaaaaataaataaagttctataatcttctagttcctcactgacagattggacagtataaaagtagccgggaaacctgagaggaagtaactgaagtaactgagtgctcataacactgtcaggagataaatgagagaggtggcgcctagcaaccaaaaccttgttgtgtacctcagagctgcaggagctggagtccagccatgtgatcaccagtgtaggtgtgagaaatctgtgtgtgagaggacaagacaaattataactgaataggtgacagctagcctggaaagagctgtgtgacagtgttcctctgactgttcacagcaactctaaagttccttccaggacccactaagccaaaagtgggtatttcactagtgagcttagaa

SEQ ID NO: 29129 - DNA, 1239 bp, Mus musculus
tgaactcagaaatccacctgcctctgcctcccaagtgctgggattaaaggcatgcgccaccactgcccagctcagcctggttttttttatacaatccaggaccatttgttgaagaatggtatttctcaatgtgagctgacccctcccttaccactcatcaatcaaaaaatgtcctcagattttcctacaggtcaacctgataaaaacattttcttggttgacgtttcttctacccagatgacccaccctagcttgatacaagttgaaaaacaaaacaaaacaaaacaaaacaaaacaaacaaaccaaaaaactagcggacatataatctcagtgctattgaaggtgaagtaggaggccatctgaaattcaaagccatcctaggatacataaaaattacaagaccgccgggtggtggtggcgcacgcctttaatcccagcactcgggaggcagaggcaggcggatttctgagttcgaggccagcctggtctacaaagtgagttccaggacagccaagactacacagagaaaccctgtctcgaaaaaccaaaaaaaaaaaaaaaaaaaaaagttacaagaccagacagggctacaggagacccaacctcagaacaacaaaaaggtggatattgttgcagaagaactttttacttttcagcttcatttcaatttaagtacccacataagtcctcttagatagtgtccatacagaaccttttcagtacttctctacaggggagcagttattttcttctgaatgagaaagcccaagttcattaaggttgagaggaatttgtaggtaagatttagaaagggcttttgttggggtgggcacagatgctcttgtagtcgcagagaagcagtactcatttgtttgtttgcttgattattatttaaagagttttttgtttgtttgtttttctctagtagcaggaataacccaattcaatggtccctttgtggagagaaaaaaaaatcgaaacaagcccaacttctagtacagaaataatcataatctggcataaagcattcagctgatgctgcctcagtttctttccagaggttattcattcattacatgactattcattatatggagaatgtcctcttccccagatcatctaattaatgcttaaataaatgcttaatttatttagactaattaaatagaattaaatagactaaaagaggaaatttcagaattttgaaagcttttttttttttttttttgagacaaggt

SEQ ID NO: 29130 - DNA, 1176 bp, Mus musculus
ataatttacaaatactggttcatgttacaaaagaaggagtgtggaaaaaccccattcttcttaaaattctgtcacaacagccagtagagacagaggaaggtaagtcttaacactctattggccatattgagttctaagagatttgaaattggttattgattaaaattttgtacctaagttttttgttttgtttttctgaatagtaaaaaatagttgctaatgtgtgtgtgtgtgtgttgcacactagaatcccagcatgcaggatctggggacaggagaattggttccaggtcagcctgttacagtttcaaacaaatatttgatattttacttttttctataagaattcttacttttagtgttgtatgtctttgtatttgctttaagttgtctcgaattgagtaatgattctcatatggagttcctgaaatgaagattaaattgatacagttcttttgttttgttttgttttttgtttttcgagacaaggtttctctatagcctggctgtcctggaactcactttgtagaccaggctggccttgaactcagaaatctgcctgcctctgcctcctgagtgctgggattaaaggcgcacaccaccaccaccgcccggcgctagctaacattttattaagtatgactactgtgttcatattgttcagggtttttgttgttgtctttttgtatagtaagcagcttagcataagggtttgtggggttttgggttttttgtttttgtttctcacatgaaataacctgttgtgtgtgtgttcagaagacatctatgggctagggtctctccttccaccttttcattgtggagaatcttacctcagattgctaggtggtcttgccagccttcaggtgtttagatttttctattggccatgacctttggggacctgtttggaaaagataattttccttcataaatgtaggcaagtgggagactaacaaatgattatcagtaagagctgttagagatcatacactgccaatggtgggttatgctttgcttttgttttgtttttcaaagcagcgtttcactgtgtttccctggctgtcctggagctcactctgtaggccaggctggccttaaacacacagagatctacctgcctctgagtgctggaattttaaaggcatgagccaccaccactcagcttatggagta

SEQ ID NO: 29131 - DNA, 1201 bp, Mus musculus
tagctgtttgtggtccttttgccctacacattgattctttaatgtacagatatgttgcagttatagcaaacttgagaactagagagccttcagaaccgccaaagggaaccgttgtaacaattcagataagagtactagggactgggaataagtcactggctgccaagatggtgggagactgagttgttttctgaactagaatcaacaaacttgatgctagtttcaaaattattttagtcttgacttctgaaaagaggtggaaataaaaggcaaaggcatatattttctggtgaagatacttggttttgtacatgttggactttgagactaaaatacaccatccagaagaaaatacaaggatttgagataatatagcaaggactatatacttgaggcagtattctgatagtaatctgcctggaacttgaataagaacaagcttgtaaaagtttttaaatagttaagcatggtgcctaaatagttaggtatagtagtctttcaaacatgcctatctgattttacttgtttgtggaataaatttgtttcctaaaacaaagaagaaatttcatcaatttgatctctatagaatgccactgaacttgaaagggtactatttatcatttttcactcccttgccagcttcattggtgtcttctaaaacaaaacaaaacaaaacaaaacaaaaaaacaaaccaaggaaactttttctaaaatgcttctgatgggatttggtttacatgaataatttatgttatttgaatgagtataattcattcaacctaaccttgcattaagaacagataaaactttgggagtttagcttagtggtagagaatttacttaccaagtacaaagcccttggttcagtctccagcagcgaatgaatgaatgaatgaatgaatgaatgaatgaaatgaaatgaaattactgaatacataaaaacattgaagattgtttcagtggttcttgaaatgctaagcatgatcctagtggctatgttaaggagactccattatttagtttaaactaacgtgggggaagtaaagaattaggagtataaaactacaagtcaagaagctggggaaatggcttagcagttaatagcaaataactacttttacagagaccttgagttggtttgcaccatccacattggatgactcatggggatccagtgtcgtcttctggccacctcagccac

SEQ ID NO: 29132 - DNA, 2473 bp, Mus musculus
gcaggtcagtggatcttcaccggaaggtgcagcttctcggcatcagcgcagctgcaccacaggctgagcttacagagcttcaggcccagactggggcaccgaagctttcagctttgggggtcattctaccaacaatcagtccctgagggttcacaacaccctggaaccaaacatcagaatgcacactattctcctaacagtgagcatggggggcaggagccagggagtctattaggttctaaccaacctagttttcattgttgacaagtgaggccaggcttccactcgaccaaaagctaaggattgccacccagcattccaagcagacttgtttcctaaaagcatccttcatctgcattccatcctgggtcagcatcaaccacaacatagcaggcattcccttgcagctgcagtacagtagcagtgtccttttctgaggaaggaagtcttaaaccctttccccccaccccctgggatgactgccttgattcccatggggaacaactttaaagaaaaccaccacagcattccaaggagtctggcgttcctcctccctgccagatgactgtcattgcctccactcacccttctgcttgtcactcggcagcttagggcctctgcgcaggaacctgactaggactatgacctccacggcggctgtttaggtctcgacttacatcagaatcttgcacagcattgcaaaatcccagtgctccctctaggacacactgaccaaaatatgcaacctttcctttcctatttttttttttttttttttttttttttggtgggaaaagaggaagaaagattgtcctgtgacttctgcccattacctgaggcctgtggaaataaacctttatgtacttaaaattatacagaaaatagaataaagttaataccaaacttgtttagttattcacctgatgttttcagtacagagatgtgaaaatactgaaaatgataccaagtataagaaactactctttattatttttaaagacaatctcaaaactatttttagatcctcccacttcctgcccttaaccctcatccttttatttgagtaggtttgagaaaggaaaaggaaaaacaggcagtgggtgaattctgtggtgctaatggtgctttcatgaaaacagtcatttctccaaacccgtgctctagaggacccatctagaacatgctgagatctcagcatgggcactagggagtccatgctcaactgtaggaaatgggggatcagggtggtttcttctttaacaatcaaagttatcatctgtttaataggagggaaaagaagtctacaatattccccaatcattttcttgaggaatcaaatcagcagcagtttgatgtatgctggtaaataggatgtagggtaggaatgccaaagccccacctttttagactatttctcccgttctttgcaatggtgtgacatttatgccacttataatattaagggcaagaacagacacctggttttcacttctatactccctcactatctcatagtatataagacacacattgctgtaggctgtggtgatgcatgcctttaatccctgtacttgaaaggcagagggggcaggtgatctctgtgactgtgagttcaagaccagtctgctctacatagtgaattccaggccagctagggttacaaagtgagtgaaaccctgtctcaaagaagagaagagaagagaaggtccatttcctttcctaagcaaccctgctggcagttcccccctgtgtgactaattctgttactgaggattaaggatacaaggtgagctctgaaggggacgtgatggtaggcttgtggggtgactgctaggtacctctagagggcaacacttacacaggaaaacagtcttaagaaatgatggggaaacatcatgcacggcccacacagcagtgcagagaaattgcttgtgtgaacatctcagacctgggcttttatttgctccaaatttgtatgggttttgccctcagagcttgtctctttttcacttctgtctcttttaggcacaattactgatctgcaacaacagactcccatttcttaaacgggagcttgaccatatcacaaagttgtaaaacaatctccatggttattagctaattaaacttgaatccaacaccatatggtgatagcaggcggcaaaggataagattgagatcttagatctttccaagtagggtatgttagatgataagaggagagaagggctggttgcaggctagattagagttcagggctgagcatgaactatgtacatggcttggaagagctgtggtttcatgaactctgctataaagtgccagggcttcacttaagaaaaggtatgatgtgggcagtaaaccattctttagatatttgaagatggtccccttccttagccagaaacactagctttcctgctttgtccattttctttagccccaggcggtcctgtagagagaaaggacataa

SEQ ID NO: 29133 - DNA, 1858 bp, Mus musculus
ctggggctaaagaaaatggacaaagcaggaaagctagtgtttctggctaaggaaggggaccatcttcaaatatctaaagaatggtttactgcccacatcataccttttcttaagtgaagccctggcactttatagcagagttcatgaaaccacagctcttccaagccatgtacatagttcatgctcagccctgaactctaatctagcctgcaaccagcccttctctcctcttatcatctaacataccctacttggaaagatctaagatctcaatcttatcctttgccgcctgctatcaccatatggtgttggattcaagtttaattagctaataaccatggagattgttttacaactttgtgatatggtcaagctcccgtttaagaaatgggagtctgttgttgcagatcagtaattgtgcctaaaagagacagaagtgaaaaagagacaagctctgagggcaaaacccatacaaatttggagcaaataaaagcccaggtctgagatgttcacacaagcaatttctctgcactgctgtgtgggccgtgcatgatgtttccccatcatttcttaagactgttttcctgtgtaagtgttgccctctagaggtacctagcagtcaccccacaagcctaccatcacgtccccttcagagctcaccttgtatccttaatcctcagtaacagaattagtcacacaggggggaactgccagcagggttgcttaggaaaggaaatggaccttctcttctcttctcttctttgagacagggtttcactcactttgtaaccctagctggcctggaattcactatgtagagcagactggtcttgaactcacagtcacagagatcacctgccccctctgcctttcaagtacagggattaaaggcatgcatcaccacagcctacagcaatgtgtgtcttatatactatgagatagtgagggagtatagaagtgaaaaccaggtgtctgttcttgcccttaatattataagtggcataaatgtcacaccattgcaaagaacgggagaaatagtctaaaaaggtggggctttggcattcctaccctacatcctatttaccagcatacatcaaactgctgctgatttgattcctcaagaaaatgattggggaatattgtagacttcttttccctcctattaaacagatgataactttgattgttaaagaagaaaccaccctgatcccccatttcctacagttgagcatggactccctagtgcccatgctgagatctcagcatgttctagatgggtcctctagagcacgggtttggagaaatgactgttttcatgaaagcaccattagcaccacagaattcacccactgcctgtttttccttttcctttctcaaacctactcaaataaaaggatgagggttaagggcaggaagtgggaggatctaaaaatagttttgagattgtctttaaaaataataaagagtagtttcttatacttggtatcattttcagtattttcacatctctgtactgaaaacatcaggtgaataactaaacaagtttggtattaactttattctattttctgtataattttaagtacataaaggtttatttccacaggcctcaggtaatgggcagaagtcacaggacaatctttcttcctcttttcccaccaaaaaaaaaaaaaaaaaaaaaaaaaaataggaaaggaaaggttgcatattttggtcagtgtgtcctagagggagcactgggattttgcaatgctgtgcaagattctgatgtaagtcgagacctaaacagccgccgtggaggtcatagtcctagtcaggttcctgcgcagaggccctaagctgccgagtgacaagcaga

SEQ ID NO: 29134 - DNA, 1124 bp, Mus musculus
ctgccggcctgagtcacatcctttcccctggaatctgggccttacagagagattcagaggggcaccgcttgcattcacctgatgcccccagaaggtaaacttacttcctggtgggttgtcagtgtacctctaggaacgctactcagccaacaaggagagtttgctccagctgtgttctgcaactccctgtggaatcaaagtacagccctctatcctgggaaagtcaccaagctagcagccgtcacgtgagcatctttcaggagatcctaagctttgcctgaaagaagagccagcctttccagaactctacccaggaaagcagatctgttcctgctggccctgggcttggaagtaggggtacagtgtgggggacagacagtaagtaacaacatgtggctctcaaaaaccagctaccacttccaaattggctcccaactgtgatggcctccaattacttcctggcctcaagtcctagaggaagcttcggaagttgctgttgtacctgttggggcaggacttctaggcaccaagggactcctggaactatcttgggaggacaagtggtgaacaggctaaagtctcatctgaatggcttgtgttttataagctgctgcggggttgtatgctgtgggcgtcttttgtttttgtttttgcttttttttttaatactgtatttttgtatgcttttttgcaaagtggtgttaactgtttttgtataagaaaaacaaaaaacaaaaaccctcctgttgcaagggtctggtttattttgaaaggtgcatttacctgaaattttgtatttagttgtaatcattaattgcttgattttaaactgttgccttctgggacatcttctaataaaaagatttctcaaaaaaatgtcagagtgggggtagcatacgccatctgagtcttcctgaaccagagaaaacttattttggagtagccacaagcaatctgggtggctgcatttttctaccatgttgctaacctggtcattccactctgggtccctgaatgccctttcagacatgtctaaacaatgtcctgtcggctcagtactctgtgagaacacaattctctagtgaattgcagagtgctgaattgtaagttacaaggcttgaaat

SEQ ID NO: 29135 - DNA, 1208 bp, Mus musculus
gaaggttggacttagacgctgtcagtgccacaggaagtcaaagtaattccccagactgtgacccggaacgcatcgagggggaatcctcggggcagcacaatcaagagctgaaggccagtgtttgagagacatgcctagtggcctttgcagagacgtggggatcaagcccaggagggaggggagtgtcgctctcccacgcctggactgaggaatgctgggcagaaggccccaccatcttctttcattctgtgctgtggtctgcagtggaaacagcaggcctttcagctccttgtgtgcctgttgtgtctggtaatgatgtagttcagagtgggatttttttctttgaaccttaaaggttttattttagaacgaggcacagatcgcacattttctacttgaggatcttttttagtggtgaataccaagattcagtgcatcctttaaaagagcgttcttgtccctggcgctggctaaaaatagctcgtttccagatgcttttgtagatgactgaagtattgtaaggcgcagtcaggagctctggactcgagaacggcagaaaggagtagtgcagagagatgattaagcaaactctcccagctctgtgaatctacagaagagggggtcaggctgaggtggttgtgacctggatcttgaagactaaaagacacagagtctgctgagctgctcctgtgcatggtggctgtctcttcatctagggcagaaatctatagattcttttgaaatgtaaataaaaagattgtaaacgccctatagtttctatacagcatgctgcattgtcaatttggtagctttttctctttctttttctttctttcttttttttttcaagacagggtttctctgtgtagccctggctgtcctggaactcactctgtagaccaggctggcctcgaactcagaaatctgcctgcctctgcctcccaagtgctgggatcaaaggcatgcaccactaatgcctcgtggtggcttttctcaaactccatattcatcatagatgtagctgtataccaaacacttacattcctcaaagatccccagagttccatttgagaactctgtgaggagtggaggaccatctctgataccaaccagtgtagacaggaatgccgagggaggccttcaatcccaggtctcgggagacagagatagatggatctctaagttcaaggtcagcctagtctacagag

SEQ ID NO: 29136 - DNA, 1185 bp, Mus musculus
gtgtgtgtgcgtgtgcgtgtgtgtgtgtgcgtgtgcatgtggggggtgtgtgtgtgcgagcgtgtgtgtgtgcgtgtgtgtgcgtgtgtgtgtgcgtgtgtgtgcgtgtgtgtgtgtgtgtgtgtgtgtgtgtgtgcgcgcgtgggtgcgtgcgtgttcatgtggggtgtgtgtgtgtgcgtgtgcatgtggggtgtgtgtgtgtgtgtgtgtgtgtgtgtgtgcgtgtgtgtgtgtgcatgcgtgtgtgtgtgtgtgtgtatgtggggtgtgtgtgggtgtgggagcgtgtgtgtgtgtgtgtgtgtgttcgtgcatgtgcatgtgcgggtgtgtgtgtgtgtgtgtgtgtgtgcgtgcgtgtgcatgtggggggtgtgtgtgtgcgagcgtgtgtgtgtgcgtgtgtgtgtgtgtatatgtgtgtgcgtgtgcatgtggggtgtgcgtgtgtgtgtgtgtgtgtgtgtgtgtgtgtgtgtgtgtgtgtacacgtgctctcgccctgacaaagtattcaccaccccctcatgtgtttctatccagagctgggcagcctggtacccactacgttagggtccaatctaatgatgggggacaaggagcagagctgctagggccggtgcactattgcctggccaaggagcagcttctccaggactctcagaaacagaacattgaaaggagcagccccagtccctcccagcttctgtcccagcctccaatgggcctctgccttgtgctgggcagggtaggagtcgctgtctgcagctgcttgctccaggcactgaggagtggatatttagtgggtcttaatttgtgaacctgtaaaatgggaaccttggcttagcagcacccataggctctcagtccagcccaccttactttgagaggctccaaatgaccccagccctccacccctctacctccgcacagcagctcccccctctggctttgaggagttcggcccagggctgctctgaagctgctctgtgtgtgcccagaagagcctgggagaccagttacacaaaagataaacatgcgactgagtctggagcactgatggcttctgtgtcccccagcagccagggctctgggacttctgagtaagtaagccaaggcctgccctgggcccaaggctgccccttgggtcatttgtagggtctgatactgtggctttcaagg

SEQ ID NO: 29137 - DNA, 1130 bp, Mus musculus
caggcagcgttggttcaggagcaccggcaacagggataagcagctctgacttccgctgccctgacatgatctgataggacatgtggcataaagatgacctggcatataagggatttagccccaggaaggaaggaaacaaagccacagggaaggtattacagctttccaaacatgccaccccactcaggggacagcctagccttggatgtgatctctaacagacaactctcagcaacttgcaggaggcaacagtaaaaaaaaaaacaaaacaagcagtttattttagcaaagaagccacctagcagctacagacagttcaggacaggtggcggcagcacactgcctatgctggctttcaggcccagtcatgcctgcagaaggcctgggcactgcagatgagcagctgctaaggcaggtgaccccaaggaaaggcttgtgctctacacagcttgctgcacagggcccagaccaggcagttcccctcgtcttacagaggtggagcagagagcgcagcctcacatgtactctccacagtcggcaatcatcaccttctgctttggcttcccatccttgctgccctgagcctgtgcgggcagaacagagaaatcaggagagacgcaggatgcgagagccgctagagcatcatcctctccccagacattcagggacctgctctaaatgcccccttccaggacatcaagagccctccccaactctcccactggggcacccacccacgcaaggtccaggcaggaagcaacttccaaccacccacctcgatctgccgcaagacatccaggccttccgtgacctccccaaataccacatgcttgccgtccagccaatctgtcttatcacaggtcaggaagaactgggagccgttggtgttcgggccagaattggccatggagaggaggcctaggagaaaataaacttgtcagctccctccacactgctcccagcccatggtgcatgtgctgatggctgccggtgcttctgcatactggctcaggccatggaagggtcctaacagacacagcaccttgtctttccctcactacagaaaaaggatgagtgggctgtttccgtttttattttttccttcacatttatttgtcttttcatttata

SEQ ID NO: 29138 - DNA, 1099 bp, Mus musculus
gcactgcccttcgccggcacccgcaaagatttggtttcccccttcctgggctgctgtaactgtaaaccgccgggagtccggggcctatatttatcacgaaacgcgtgttcccaaggcggccgtgagcgcagcatctgattgcctcttgaaaattttttgccccctttacgaggggatttcctactttaatttttattttttaagcctcaagccaggacagctggagagtacaaactccaggagcgggccatattgtttttgagagccttttgtcttggggcttttgcagtcccgtgcaagtcgtcccgcacacgggtcccggctcggagcctccctgctccagccttctccggcgtcgctggtgccacctgtgcgctgcggcgcgtgccatagctcctcggagccccttttgtcctgcagtaggccttgttagaagtcctcctggcggggctcggggtcgtggggggtggggagatgaacgctgcagccagcagctaccccatggcctccttatacgtgggcgatttgcactcggacgtcaccgaagccatgctgtatgaaaagtttagccctgcggggcctgtgctgtccatccgggtctgtcgcgatatgatcacccggcgctctctgggttatgcctacgtcaacttccagcagccagctgacggtgagtagtagcggtgtgcacacattcgggagattcctggggaccttgggaatcctgaaggcggaggccaaactgccaggaccggggaacataacagcatgttgcctgagaagccttgggtggaagcaaaatgagccaggcatgtggtcatgaccctggcttcagtctcccaccacttgctaacctgatgaccttgggctactgggtgggggtggggtagagcaggggttggaacccaaggagatttgtgtaattcgggatccgaataaagggacttgggtattctagtgtgtctagccccactcaggtagaagtgggtctggcactcagtgcattgaaatgacacctgaaagtgtaggttgcaaaactgggggctctaacctgaactgactgacttgggatggctttagggcagtggaaagcaaggagagc

SEQ ID NO: 29139 - DNA, 1160 bp, Mus musculus
ttaggagtccatagaattaaacttttggaaggcctaggtacctcaaggccggtgataaaggtgtgacagtttatccttccactttttgtttggataaaaataggcaaggcgtggtggcaatgcctctaatcccagaactctggcagtagcagactgtgtgagttcaaggccaacctgatctaaatataggttccaggacagtcagggctatatagagagaccctgtctagaaaaataacaatgagaataaaaaaaaaaactggggtggaatctagttagtcggtgggcctcagagtcccttgaacatgagcttagtccatggtgaggatcttggtgtcccgaggcaggccatcttcatacttttttaaatttgggattagtagttcaggaatctttctggcatggcatctgacagtcctcttagttgatcagcattcctaattgatgtgtgttcctctttgacagctgagagggccttggacaccatgaacttcgacgtgatgaagggaaagccgatccgcatcatgtggtcgcagagggatccctcgttgagaaaatctggggtgggaaatgtcttcatcaagaacctggacaaatccatagacaacaaggcactgtatgacactttctctgcctttggaaacatcttgtcctgtaaggtaagccccggtgaaatgatgttagcaggctagaggagaattactgcatcttgaaaacaagataaatgttgtacctgggtgtggtgttctcttggctggtgagataggggctatctagggagttccaggccagcctggagtatatgcaagatagtatcgaagggagggtgccttagaatttgagacaattggatgtgataactttttaaatttctggaagcagattctttctctttcagtcctggggattgcacatggcctgatgccagtgttctaccactgagggtgttttggcttggctttggtgtttttattagcattttggtgacatgtagtggtttcataatggtatttcatgtatatatgtgcatatgtgtcttaatatcatttctccattaccttctcttagcctgctccccataatccatccctagtgacattcttgactagtgtcctgctctgtgtgtgtgtgtgtgtgtgtgtgtgtgtgtgagagagaga

SEQ ID NO: 29140 - DNA, 1176 bp, Mus musculus
tctgttctttggtgataggtaagaccctaagtgtcaaggtgatgagagactccagtgggaagtccaaaggctttggctttgtaagttacgagaaacacgaggatgccaataaggtgagtgtactgtgagggttgggaagagcctgtgggctctacccattgcatgggagagcagctagagtggtgggtagtggagtggagtggtgggtgtgcagcatcagcactaatgctgggccacagttaatgtatctgcaaactcgtgtcacctcggatactgttggacgattgggacagatggttgttccattcttggatagggaaactgaatcctattgactaggtagggcagtgtgctggacccttaccctacttacagagggacctgaaacattgagcattgccagatcatcaggcccttgcctataaaatttatgcaaatactgggttttgggggccaccactacccccatcccaccaccccaagcgccctctgcactaaatctttcccaggcctgctgcttggtgccggtctggggacagacagtgctatactacagcagaggaaatccagacgggtcgtttccatctgccctggggcctgtctctacaactctgccacactccctgagaatggagacaattttgaagatgctgaagctaggggtgggaactaagagcagaagatgtgtctgggccagtaactccgatgctaactccacttcccacgggagtgtagcaggcttcagaggtccgacaacgctgattatcagtccagcggggaaaatggtttttttcttggtgttctggactctgctccagaagacgaccatgtctctctgcattatacatgtcttcattaaagatgtatattttctctctaggctgtggaagaaatgaatggaaaggaaatgagcgggaaagccatatttgtaggccgtgcacagaaaaaggtagaaaggcaggctgagctgaagcggaagtttgagcagctcaagcaggagaggattagccggtaccaggtgaggtgggctgctgatttgagggtgttgatgtggaatgtttgacgtgcctgtggtatcttaggcttctgtgggggctgggcaaccatatttacccccacccccgcctccacaaaggtcaggtttaaaggttgtcacctaccaaatcattacagagc

SEQ ID NO: 29141 - DNA, 1499 bp, Mus musculus
tgtattttttaagatttacttacctattatatgtaagtacactgtggctgtcttcagacacacaccagaccagaagagggaaccagatctcgttacagatgattagactcaggagcttcagaagagcagtcagcgcccttcactgctgagccatctctccagcttctggttttgtggttttaagttagggtcttgctctgtagcctaggctggcctcaaacactattcccctgcctgagtacaggggttacaggcaagagtttttgtttgattggttttggttttcccagacagggtttctcagtgtagcactagctggcctggaaatcacctgcctctgcctcccgagtgctgggattaaaggtgtgcaccaagcactgcctggctacaggcaagactttgaacttgacaggtgcctaagtatgttgttcttgggaagtgactgtgtatagagatgtagttaacagtgatcctctctccagggggtgaatctctacattaagaacttggatgacaccattgatgatgagaaattgaggagagagttttctccctttggatcaatcaccagcgcgaaggtaagagcgtgtgccagcgtgggtttggaaacaattttctgttgttgggttaatggtgttaattgtgttggtggtctagagagtaccgtgttctagcatattcctcatgctctggagaagtaggtttgtaatatgctatctacttgcacaactggagcttgggccagtatcccaatcccccaagcgccctctgcactaaatctttcccaggcctgctgcccggtgccggtctggggacagacagtgctatactacagcagaggaaatccagacgggtcgtttccatccgccctggggcctgtctctacaactctgccacacttcctctcttgagaatgaagactttttaaagatttagtgggcctttgacaggaaagtttggctgggcagccatggttctgtgggcatagtctacagtaggtccttggcacttaggggctgtgacaggctggtgtctagaagtagtgggttatgagctgacagaattcactgattggtagaggcacacacgaggcctttaggtagtaagaaaggcagttgggtggcgagggagggtttgatggtcttctgtgtaaggtgttgccatttgtattggtgtgggctttttgttggttgtctttcatacagggtctcacttttgtagccctgactattttagagctcaccatgtaaaccaggctggcccaaaacttgcctgtctctgcctcctggatgctagcaagaaagtgtgtgccaccatgccctgctatggatgttttaaatgatcacttttggagtgctggcaaaaagaacccagaacggctgtggaggtgacagacagccctggcaaaaaaaacttctggttcctcttgctgtcacccacttgactggccctgttggcatattcccctgcaaagccctattaacaaagtccaggtgaca

SEQ ID NO: 29142 - DNA, 1099 bp, Mus musculus
cccctacatagtcagatatacacaagcacccaaaagaaagcttcacacagtgtttggagcttatgtagccttagctgtgggccaaagcacaagcagttgtttcagaacatggagctgtttgcttgactgggccttgcccaggctgcttcagcataagctgccttgtgaatcattgcttgtctttctctacattctctcaagccaggatttttcttagaagcgggtactacttcacctgtaagggctctcacaacaccactgttgattattagtgatcctctagtaactgctaatctattaaaaacacctgcaccaagccacagtcctgtagaaaagttaaatttagccaggatatttggcatatcatagactcctggtgctggggtggtagacaaggttaggagttgaaggtcagcacttcgatacctactgagttcaaggccaccctaggttagttaggagaaaaaaaacacagaaaactgaaatggagctaatgaggcgtgtttactcaccgtggctcctggcgccacacatactgaaaataacgtaagggaaagattgaagagagggctgcatgtacagacatctgtgaactggcacgtgcttgtagtcctagcccttgcttggcacaggaatcaagaattcaaggccggccaagactacatgaaaagcacacattatgtctcctgtggccttgtttttaccgcagggccttgcattgtgaagcaggtttgcttggtcaggaccttttggcttcccctttccatgcacagtagttttaggctgcatagcgttctatcctcaccttgttccccagagacaggactgcggctgcctcctttttcacatggtctccttagtactaaccctactgcctatgctggttcacaggccccccagcctgcagtccacgtccagggtcaggagcccctgactgcctccatgcttgctgcagcgcccccccaggagcagaagcagatgctgggtaagttcgcctgcttgcagaagagagcccggatgccagtgctcactgggcttaggcgctgtggtgaccgcaaccgttccgcccataggggagcgtctgttcccgcttatccaa

SEQ ID NO: 29143 - DNA, 1228 bp, Mus musculus
ccttcatggggtttgcgggctatcaccccgccctctccatcctcctaccccaagcatagactgaatgcacacagcatcccagagctatgctaactgagaggtctggggtcagcactgaaggcccacatgaggaagactgatccttggccatcctcagcccacaatggcaaattctggatggtctaagaaggccctggaattctaaactagatgatctgggctctctgcaccattcattgtggcagttgggacatttttaggtataacagacacatacacttagatcaatgcatcgctgtactccttgaaatcagagctagcttgttagaaaaagaatcagagccaggtatagcggtgcatgtcattaatcccagcgctaaagagacagagacaggagaatctctgtgagttcaaggccacatagaaagagcctgtctcgggagcaggaaaaaaaagaaaagaaaaaaagaaccatctggctagtttacagtaaaggtgagagagacatttcacaacatgtgtcctgggcctgacctttctgcctgtgagcaaaggaccctgggagcttccagttccctctaccactgccgccatgctgaccagtttggggctgggcatcgagacaaaatgaacccttagcagaagcaaaaacacaactgaagaggctggttcaggctggcacatggtaggtgtcacctctcctactagctgatggcctgcaccagagatcttcctccaaatgtcccacgatgcacctggacaggatccccacatacatcctcagcacagacctgcggacggccacccagctgctcagaggaaaggacctttccttcttctctaagaagagccatctatcccaccgagggcacagtaacagccctccaaccaggcatggggcaaaggcaaaagggaagagtctcagcatttgcttatgtctgggaactaagaacaggttggtcgccaaactggcgtcaccctgggggcccagcagctccatcctgtttctgggacctgtgagtcaaagaaaaggcccctgtcccaggggactgacaggtggtaattaggctgagttgggtggggaggctcggaaaccactgctctcctggggcagccgctgggagctggagtgtttatttgatttctgacttgctaagcctgtaatttacctgcgggaacagagtccagctgcccaaactgtgtcattaagagcagatcctggactcat

SEQ ID NO: 29144 - DNA, 2307 bp, Mus musculus
gctggctgactgctactcctcctgggaacctgaaacttggccctccccacctgcacctctgttaccatctgctcacacccactgtaacctcaccagctccccacctatgccgtggtgatggagcggctttgaaaggtggtccagctgctgggagtagttgctttctgctcctcatcaggatggagtaggtagcctcacaaaccagaaacggctcagctcctgctgtcatgatgaagtgtggatctagaatggctgtgatttccccaagaccatgcagcgagtcaagagctattagccccagcccccagcccccggtcggtcacttgtgtttccatttcagtgtttgctccactaagtctcctgcttgattcttcaattccagaccctaagaagtctgccagccgtcctgggagtcgggctggcagtcgggccggcagtcgagccagcagccggcgaggaagcgacgcctctgactttgaccttctagagacgcagtcggcttgctcagacacttcagagagcagtgctgccgggggccagggcagctccagacgagggctcaccaaaccgtccaaaatcccaaccatgtctaagaagaccaccactgcctcccccaggactccaggtcccaagcgataacactgtacaagcgccccacaccactatccactttgaatcctgctccatacattgggtgtatatttattctgaacgggagaagttatattgttaaaattgtaaaagaagaattgtgttatgaagctgccttatttttttttcctttttgtaagttactattttcatgtgaatatttatgtagataaaatttgcttcctggtaaccctgtaacagatagggcccagagatgaaatatttgaggaaaacaaaaggtcaagacgcaaatgtgtattaaaaagaaaagcctctaaatagggtttcatgtggtgcagggttataaacctgctttatcttttaggattattcctaaatgcatcttctttataaacttgacttgctatatcagcaagataaattatattaaaaaaataagaattccgaagtgtttaaggaactcttctttctaaatcacagacacctcagttagcgagaattaaggagcggacacttaagattgcatttccattgttttactgttgtgtaattttagctgaagagacagaacctcatctagatagcttttgcacatgatatagcaaagagttcattgcaatactgtcttaacataatgtctcaatactgggtgttaaagggcgcatagctgctaggattcaggggtaaaggaaacttcagaacattggggttttaaactgatctgtaactaactgtccaacccagccctcagtgactcctgtgctcaccaggccccaggccctggtgagggggactccttggtggcactgtgaattacagatttgctgatctgctttttttttttttctatttatttaaatggtcgatcaacctaccataaactgaggaatgaattccataagcccagtttgaaatgtggacctaaaacacttgctcatcctttaacggagttcaccagcacacctgttcaccagtcccgtttgcttccgtcttttttgtgtgtaataaagtcagctgaccaagtgaccacagaggggctgtctggggctcctgttttttagctgctgttccttgtcagctctgaccatgttgctgtgtgattatctcaattggttttaattgaggcagaaactgaagctctaccaatgaactgtttaaaaacaagacacacttttgtattaaaattgcttgcagtaacaatgttttgtaattcttggctttattctgaaccactactttatatttaaatgttaccgctaaggtataaaaatgttgtagtacttaaaaacatcattgaacaagagttttcttgatggaaaaaaatcatagaactcattacttttttttctttatcttaccttgttaattttaacgaggcaccagagaagtgggatgttttcacacagatatagggaagggatcctgtctacctacatattacaacagatagtgtgagcagggcagtggtggtgcatgcctttaatcccagcactcaggaggcagaggcaggtggatctccgagttcaaggccagcctggtctacaaagtgagttccaggacagccagggctacacagagaaaccctgtctcgggaaagaaaaaaaaaaaagtgtgttgaatgtaccttgggatgggcaaacttcccaagcggtgtgctgaagtttctgttagatgatagtcacaagccagactttt

SEQ ID NO: 29145 - DNA, 1222 bp, Mus musculus
ttgacttagtcttcactggggtcctcttaactctccagcacactgtattcagaaggtgaccccttctttaaggagataaacatagccgggcagaggtgccgcacgcccttaatcccagcacttgggaggcagaggcaggtggatttctgagcccgaggacagccagggctacacagagaaaccctgtctcgaaaaaacaaaaacaaaaaggagataaacatcataagactgcagtgctcacttgggcagggtcttcagaagactccaagtgaacaaatcaaacccatctttcctcctttacccttgggacaggagtcagagtgtggccgttgggagctaactttaccccagcagaaagattttacaacattgcttcttagcttaatctttctgcttttctacttgctaacctttttatgacaatgtaaaaatataaaatcaagttcagaattcttcccactatcacgtcattcctgaatacagtctgctttctaggggactggggttgtaagtgtacattaaggtgttctcgctaactgggtttccccttgattccagtttggagattctcagcagttgcggctggtccgtattctgcgcagcactgtgatggtccgagttggtggaggatggatggccctggacgagtttctagtgaaaaatgacccctgccgaggtaaggaagcacctaccatgggtgacgtggtaggatggaatccgtccatgccgatttccaggaagcattgaagggggtctttctgatttttgtcctattaaggtgtctgatattatcccacccatcacccattaggtcggggtttcaggtacaaaaatctgaagaagctgtcagagaagaatgaaatgagaactaagagttttggtgtctctgggctctcacatttgggaggtagaggcaggagataaggagttcaaactcatcctcaggttcatagcaagttcaaggctagaatgaaagcccatctccaaaacaggaaaaaactgtattggtgtgacattacatttagggtgtgacaatggtactaacctagaccaaagccttgtgtatacttccaagctcctctttcgtcgagcctcagcgcacgctaagtccctaccatgcataggactagtgactgttctaagtaggggactctaaagggcttatatcagccaccacccccaggcaacagaagaccctcagtgtagtttgagcagatagtag

SEQ ID NO: 29146 - DNA, 1169 bp, Mus musculus
agatattttgctcagttcataatttgttttgatagatccatattagcactttcctctaaagaattttgaagcaatggtgaaatttttttttcatctgctatttttttttctcagtatctcttatctcaagtagggttatggctatttcaaataaaagattaatgcatgtattaaaagcctaaaatgaaccaagcacatgcctttaatttcagcacttgggaggcagaggcagggggatttctaagtttgaggccagcctggtctacagagtgagttccaggatagccagggctacacagagaaaccttgtcttgaaaaacaaaacaaacaaacaaacaaaacaaaaaaaaaatccagaaactgggaggcaaacgtaggcatatctctctgagttggggattaggctagtttacattgcaaatacaagacagccagggcctgagaatgggaacctgtttccgaaagaaaaaggcaaagtgtttaaaatgtaatgagtagcctctctacattttaaaacaaaaagctcttctctgctcttacactcttgctttatcaaccaacaggtcacaagacaagtggctcagtgcaagtgtgcaaaaagattccaagtggaacagattggagagaataaataccgggtaaggaagagaaaagccaaccatttgtggaggtcattgcctccggggtcatcctgacacacagcagagcagctcatgctgcctgttccctcctgctgcctccagaggcccagaacccaggccttcatccctaggtgtcaagtttcatgccctgtgtagttccatctgaaaagctaccattattacccaggtagactgtagcttatagttgacatggtagaaaatatttcatagccctcatctcactgctgagcaaaaccttaggtgcctttagaaacagttttattaaaggacttgtgaagcagagtctgagattcttcctgtaatcccagaacttgggaggcaaaggcagaagcagaagcaccattgcaagttcaagaccaactctacatagtgagtcgcagctaaccaaggccatatcacaaaaatgtctcagatatttttaaaaagcatggatcaggatgctgggaatggttcagtatataaaggtgcttgccaccaagcctgacaacctgagttcaagtcctaaag

SEQ ID NO: 29147 - DNA, 1193 bp, Mus musculus
gagagaattcctagcccatctcctgccactgctttcacactcgaggaagagtgattcctctcacaaatggtgcttcatgtctctttcgtgtatcaaaatccttcacttgccccgactgctctcagcagtacgatcctgatcccttagctggacacaggcctctcctgcctgcccctccagcctcacttcgtgctgaccctttgattggaccctctcttcagtgaatgaagagccctggtccagcactctcaggcttcctgttctgtcctgactctaccctctcccagagctgtccttcccaattcttgagttctttttctgtcgcctctctttttttctttctgtatgtggggtgtttgaatccagggctttgcatgtattcagcaaatgctttaccgctgagttatactcacagcccactttaaaggggtgagaaattacacagagcagtctctcacttggacggtttgccatgggtttggcctttgttagtaagaactttctattttagatgaagaaaattctaaattttctttcctaatttttatattttacagtcatttatggaggagatgacacgcaaacaacctgacgtggacagggtcaccaagacatataagaggaagagtgtagaacccacccatgcacctttcatggagaaatcccgcagtggtagcagtatgtgtccagccccactattctaggttgcttccttcctgctgattgcagatggaaattcacaaagtaccatcataagaattgtgtttgggtttcccaaatcatactgactctgaaccacaatctcacattttgaagccttacttttctaacaatgcttggaatatttatgtattggggtaattaatatgaagctacaaggtggtgaagcctgttctgttgttcagcagtggcctttccattgtacctgcgttgcgctggtcgagttgtaagataattccttggggagtccactgctgggtttgtgttgctgtgtccatgtcactaaggctgaggtgaccagatatgtgtgggagctgggtacacagggaggcagcagtgttggagtttgtgtgcctctgtgctagtgttgccactcctgcctcttcagttaccaaatggagacagtgtgagaatctaggtcatatatatagctttcttgattttaagacagtatctcatgtcataggccagcc

SEQ ID NO: 29148 - DNA, 1107 bp, Mus musculus
atgagtgtcccctgtaagggcagaccaattcagatatggcataccaaagtatataagagattgtcactaaattaaaataggagtaaggaagctggatagatggctgagtgactaagaacacttgttgctcttgcagaggacccaggtttggttcccagcatccatattgtggctcctcttcatgatcagttctaggtgatcaatgcccataactccaggactaggggatccaacaccctcttttgacctttgtaggcaccaggcatacataggtgcacagacatacctgcaggcaaaccacttataaaataaatctagtctagacataattgattttaaatctttgggcatttctctcacttgttattagttattagttattatttccaactgttgtaatatagaagttaatctgaatagagtttaagcagtattcccttttaacagttagaattgtgcgcattggttctttcttccttctttcttttaaatcactgagttttgtatgtcttcctcagacagcacaagttggaagaagccttactgttttcaggccagttcatggatgctttgcaggctttagttgactggttgtacaaggtggagccacagttggctgaggaccagcctgtacatggggaccttgacctcgtcatgaacctcatggatgcccataaggtgaggagcaagaattgggaagcaaagccagagccttgtctcgatccgcaccctgtgttgtgctgaccacctagagaggagggaatgcttggtgaggagctctggaggagcagccctctgtcttctgtgtttagacaaactttaaccacctttaatctctgagtccaagggtagtctggtctacaaggcaagctccaggacaaccaggaatacatagagaagccctatctccaaaacaaaacaacttgttgctgggatttttgcaacagtcacaaagaatttaccagaattggtttgattcagacttggaggcatgtgaagaggttctccctgtttatctcttcatccaatataagttgaaattgcattcaggggaaaactgtaaagaaatccatttccactaacacctatgggaatgggagaatttat

SEQ ID NO: 29149 - DNA, 1074 bp, Mus musculus
cctgattttgaacactgttctttcccagatagaagagcacaaggtaattgtgccttaagatgatgttaccttccctttaaaaagattcattcaaaggagtgttccttcacctgtttgtgtctaagaagagtactgtgttccccacaggtttttgctaatgaagtaaatgatcatcgagaccagatcattgaactggatcaaacagggaaccagttgaagttccttagtcagaaacaggatgttgtcttgatcaagaatttgttggttagtgtgcagtctcggtgggagaaggttgtgcagcggtctattgaaaggggtcggtcactggatgacgccaggaagcgggcaaagcaagtaagttataaatgaggcacaacttggtgggcagccttgagtcccgaacctctgaagtgatgctcagaggtgagctgtatagctcacacactgtttcctgttacaatgtatatcatacttgattttagttccatgaagcttggaaaaaactgattgactggctagaagacgcagagagtcatctggactcagaactggagatttccaatgacccagacaaaatcaaacttcagctttctaaacataaggtaaaatagagttaattgctgtgagatcctaagcttagtattcaccaaagtttgctatttgctgaaaatggaaaccagagcctgttaaaaaaacagttgatacatgttaaattatcaagaagggactaggaatgtaaataatttggtaacagtcccttttcttttcttattgggtattttctttaattacatttcaaatgttatcccctttcccagtcttgccccctcttccccccaaacccctatcccatcccctctcttggcaacagtccttgcctggcatgaacaaggctctcgtttgactccctagcacctcatgaactggctatggtggcatgtgtgtgtaataccaagaagcgaaagatcagaaattcaagaccaatctagaatatgtgagactttgtctccaaaaaaaaaaaaaaaaaaaaatcaagatgaaagccaagcatggtggcaaattgtagcactttta

SEQ ID NO: 29150 - DNA, 2573 bp, Mus musculus
cgtgggcggggctcagatgagaagtagcacagcagcccagggaggtattactagcagaatttgattcaaatgtttttcccatagatgaataatgcttgggagaacttaaataaaacgtggaaagaaaggctggaaaaactcgaggatgccatgcaggctgctgtgcagtatcaggacactctccaggtgagaggctgggagatgctcacaaaagaagtacaagtgctgctctctcttgtcatcttctaatagtagtggttcaccctctttactgcagtgttgggaaacctaagacagtcttgctttcacatttctggcctacatttcccacttctattgagaaagtgttgatataaaatacatccaagtttcacttactactgccatttttattgtcattgcctgcttgtcatagttgtacccattcagctgctcagtgaagctggcctaattgtgtaagtcactgcttgcttgtggaccaaaacccacacaatcatgaagcccaacactgataaggagatgttccttctcttctaacgtcatggttttctttttatgtatttgtgtttttatttcaggctatgtttgactggctagataacactgtgatcaagctctgcaccatgcccccagtgggcacagacctcaacactgtcaaagatcagttaaatgagatgaaggtctgtacccaggaaaggctttgaaaagagagttccttatttttaataatgaagacgtcaattaatgttagcattaaataaatcttttataggagttcaaagtagaagtttaccaacagcaaattgagatggaaaaactcaatcaccagggtgaattgatgttaaaaaaagctaccgatgaaactgacagagatattatacgagaaccactgacagaactcaagcacctctgggagaatctgggtgagaagattgcccatagacaggtaaggctagagtaggtaacatgggttggtgagctaccctctgcccgctctgatttcctaacaaatggtctttgtcttgtcctgagcagcataagctagaaggtgctctcttggccctgggccagttccaacatgccttagaggaactaatgagctggctaacacacactgaagagctgctggatgctcaaagaccgataagtggagacccaaaagtcattgaagttgagcttgcaaagcaccatgtaagtgttttcattcctacctaactttgccagtttgagaccagttactgccaccagaagcttaatatcatatggaccttaaggagctaggttcaatgacatcaaaagagataaattatgtcattcaacatttctttaggttctaaaaaatgatgttttggctcatcaagccacggtggcaacagtcaacaaagccggcagtgaactcctggagtctagcgctggagatgacgctagcagcctgagaagccgcctggagaccatgaaccagtgctgggaatcggtgctgcagaagacagaggagagggagcaacagctgcagtccacgctgcagcaggtacgcacgggggaggggcggtcacgggagggaaaggaggccatctggggttgaaccccttttgaaaagagcagcttttgatggcaggtatttcaggattgtttgcagttcaggttggttactattcagttagtcacactgaccaacttgttttgagattcaggtgtttcctatagcaagtcaggcttctccccagattgcagtaggcatctattgtgttatagggagatctgaaggatcttgctaaactctagccataagcaagcagatagtccctgtccagagataaaactaactactctgcctgagaccagcttcagaatcctcccagtgtgttcagatcattccaaaagtttgcctttacagctgattgcttactgatactgctgatatgtctttttttcaaaaggcccagggtttccacagtgaaattgaagatttcctcttagaactcaatagaatggagaaccaactttctgcatctaaacctacaggaggacttcctgagactgctagagaacagcttgatacacatatggtaacagtttcttcaaatggcacaaaagcattcagtagcctctctgagagacttatatcctgggagtctgcgatgttagttagttagttagttagttagttagttagttcagctcttctacagacttcagtccagacttgggcagcaatagaaaggaaagagtcagctagaaaggcgctggtgagctggtaacttcagtctgtctgtccatttggtgggtaccagaatgttgactagaagtgagatcatcaccaatatgtttgtattcggtaagagtttagagaaatctgaaaggtgctgacaggattttaagagagcctacaaacaacaaaagcaacattatttctaggcaaatccttaaaaaaaaaaaaggacaaatacattattacagactgtttttgaggtctttcggatccttaaaattttttttattttcttggtgagttgattgtcttcctattaaggaagaattctgggtttaatttactaacagctcatacttggaac

SEQ ID NO: 29151 - DNA, 1134 bp, Mus musculus
acttctcaagtaatgagtattccaaaagtctgtggaattcatttagaattcagaacacatttccctattgaaataaggttacaattggaagctcgattcccatgccaggaaacaaatgttcctttttaacccctaatgtgagtatcacagtatcaatagtgggcagaacataaccaccttttgtaacactttccatgggaaatttacagaaagtgcagtgagaacactggaaggaagcctttccatctcagcccttttgttttgatcttactggatattttgtgtggtgttttcagattgcttctgtggatcctttatgagggagagcaacataagtagaaaaaaacctagagtagagatccctgctgaagtgcagaggagaggtgatagtagtaaagccacactgaactataaataatgtcagggttacatgggatttcagggagaaattagattttgaacttagagagcttctgttcacatctcttctttgctccttcagaaatccaggacaagctggatcaaatggtgttcttctgggaggacatcaaagcacggtctgaagagcgagaaattaaattccttgatgtccttgaattagcggagaagttctggtatgacatggcagctctcctgaccaccatcaaagacacccaggatattgttcatgacttagaaagccctggtattgacccatccatcatcaagcaacaggttgaagctgctgaggtaacaaaaacacaaaacatcatctcatatgtatgtcctttaacaaaatactgtatccacgttgtgagggtatgcatgtgattgtatgtgtggtggcgtagtggtgatgatcatgttttgttttgtttccatggttttcttgcagtgtcgaggattgaacctgaggtttcttgcgtgctaagccccgaacccttgagttacattgtgttcgctgccaagccaaactcaatgttttgaaaactttgttttgttttgttttgtttttttaggtctttttgttttttgagacagggtttctctgtataaccctggctgtcctggaactcactttgtagaccaggctggcctcgaattcagaaatccgcctgcctctgctcctgggattaaaggcatgtgccaccacac

SEQ ID NO: 29152 - DNA, 1169 bp, Mus musculus
ctagcttgggttgctgaaaccaagcggaagctgatggctctcggtccaattcgtctagaacaagaccagactactgctcagctgcaggtgcagaaggtaagtatagaagagccaggcgctcccgtgtccttactgggacacgtccatgtgcccgtcccagattaagtagaatggtttaataaatgacggtagaaattcatcgataaatacttggcttcagtgagaaaaatatgttttgttttgtggataaataaacttttgaatccgagaaagaatagttaatgatttcctagataatttaggaagtaacgtgtttttgtgaacaactaaaatgatgagcattgaaaaatagttttgaagataagcacagatgataggtaaaagttaaacgttaagaatatcccttatgtctttttaaagctaggaatttcatttgtcctgtctgacatttcatcagtacaggcacagagcagggtcctttcacttcctgatgtaatcatagttcattttcaaaggctttctccattgacatcattcgacacaaagattcaatggatgagctcttcagtcaccgtggggaaatcttcagcacatgtggagaggagcagaaagctgtactgcaggtgagttgcacttgttattcagctgctggttttttaaataaattatttagtttacatcctaatcgaagcttcccctccctcctatccgctcagtccctcccttccctcctcttcctctcctcttcctctccctttcactgaaaaggggcggcctcccatgcatatcaacccaccttgccatgtcaaggtgcaataggagtgggtgctgcttctcctattgagcccagacaaggcagcccaggtgggggagggagacccaaagacaggcagacaaagcccctgcttcagttgttaggggtcctgcatgaagaccaagctacacatctgttacacatgttaggggcctaggtcatgctgcttttcttaatcgtggtaaattgaaactgaaactacaacataatgtcttcaaaggatttttcttttacctgctggactttctggttactgttggttagttaggtccgggcatagtggtgcatgcctataatcccaggacttgagagactgaagcaagagagtctcaagttccagaccagtctgtgttgt

SEQ ID NO: 29153 - DNA, 1275 bp, Mus musculus
ggttctaagtttgcttgctgtgtcacctataattcacctccaccattcattctctaaagggggcactgtttggagaccagaagacaagtgaaaaggaggcgagggagatggatgcgggcactagaagaaaaagaacaagaacaaagcaagggaaggaattaaatgggggaggtgcttcgtagttagttctaattctgctgcagtatcaaaagcagttcttgatgcacagaaatctttgtgggtatttgttatgttaaatgcccctagttagagcattaaggaatagaaagaaagaaacactgtttttacacagacagtgtgactcaaatcttgcagacagttgtaaataagcagcagctaagctgaaagtcaggcaggtttcaaaatgattgaaaatgtgaggcagagaaaaaaagagctgaaggaaggaggtcagtgccctgctgggatgtgtgctggagataggcttcccccaaccccccagcacacactgctgctgatgggcttaatttagcaaggtgtggcctgaaaacctttccctccttaggaactgaagaaggaggtcatggaacacaggctggtgttggacacagtgaatgaggtgagccatgctctcctagagctggtgccttggagagccagagaaggactggataaacttgtgtctgatgccaacgagcagtacaaactgatcagtgacactgttggacaaagggtagatgaaattgatgctgctattcagagatcacaacaggtaatgtttataatgctatgtgctagtgttttaggtcatgggatgtatatgtggtgtccagtgctataacctacataagtacaggctcaagaagaataatgagatcaaaataaatagaacaaacatactttaataatggtaaacacagccaggcatggtggcgcacgcctttaatcccagcactcaggaggcagaggcaggcggatttctgagttccaggccagcctggtctacagagtgagttccaggacagccagggctacacagagaaaccctgtctcggaaaaccaaataaataaataaataaataaataaataaataaataaggtaaacacttggaagagttttgatccagattaggaccaaaatactcaaccacttggtacagagaaaaaacttgcaagaagagccctatgttaaagctattttttaaatttatttgtttttgggtttttgttcatttgttttacttttatatgtgtgggtgttgtgtttgtatatatctgtgcatcatgtttat

SEQ ID NO: 29154 - DNA, 1107 bp, Mus musculus
cgaactaagcagacagtgacagacagcacattgtttatagcttaaggaccaagtccggagtttcagtagaacttaacttacatgtgtcctcctgagaagaaaagaggaaattgattttcactggtttactctggagtttgtcagactgagaaagttacacacttgttcatgtgtcatattgtaagatcagcaatagttagaataatgttgaatgtcataaatgagttgtctatatttttgtcctatttgattaatgttagcatgttaattatacataataatgggtttcattatggcactttcattcatgtacataatatactttgatcacattcacactccattactctctctgctttctactcctcctcttcatcttcccacctagccctatttctactttgtgagagagacctggtgagtgtcacgaaaatggctcacaggagtatgcataccctgccagtggctgtactactgaaaaattgtctttctctctcccatctactgtatcaaatcctctgtgtcacagatgctgtgcacgtaatcacagctgctgagaacctagtgaacagcacgtcaggtttgcacgtcagcattaggcgcatacacactgcttcacgggacacagagggggacagataaatgtcttcagggcttggaactcaatagtcttttacttttttgagtcagggtctcatgtagcctagactggtctggaacattatattgctgaggatgacactgaatttctgctcctcctgcctccacctgctaagtgctgggatcgcaagtgtaaacctcactttgtttatgcagtgcttcccgcatgctgagcaagcattgtgccagctgagcttggtctccccagtcttctacctattgtgtcagtgtgacttctgtttcaatgtagttttgtttttagtatttcttattttgtgccaagcatggtgacacatgtcttcaaaaccagctcttagaagactgaggtaggagaatttttttatagagtttcaggctaaccttgactacataggatagatcatgtttcaaaaataaccaggtacaatgaatgtacaccaatggataaaaaaactttttttaaaaaac

SEQ ID NO: 29155 - DNA, 1147 bp, Mus musculus
gaacctcagtctgagtccgttactttggaacacatgtccaaatctgtagatattccagaagtgcaaaatgtaaaaaatttgagagactgccaggacttcaaattccaacagcacagtgagagctctccccatgaattccagcctctgggctcagaagctgcagcagcaagtggtaacacagatgaaatgcaggagcacagattctcaagtgcaacctggcccagggccatgaaaagttcctccaagggaggcttcagtgagaagcagtatccccttggggacactgcctgtgcagtggaactaccacctctctctccttgcttgagtgaagagctgttggatccagaattgcatatgcttataacacctagcctgagagaaaaaacagagtctgagttaaaatttgaggaggatgagcgatggatcatgatggaggcagaggaggagtgggaggaagagaaattgtcagaggaaagaaagagtcttgttacaaatgaagagactagtttggcagatccccttgaagaaagtgaccaagcaaactcagtaccagcagtagaggatgggtcggatcgtgtggctgtctctggaacttctgaccacctcgctcttcatcagatgtgctgctctgttgacctgcagccaactagggatcagcttgcttctgtccccaggggttctccccctgactgcacctgtgtgcctgcaggtgacactgttatcagtgaggtgaaaaacagacctgatcaggggctagagggtctgacttcagggctccagtgccctgttgaagcagagcagctctctgacacagattctgtgcaaatgtttcttgaacttgagaaggaatgtttatgtgaagaaggagtaacttcttcagctgagctgctgagtcaggcctcttctgaagggctggccccaacccaggatgcagaagattcacttttaattagtcattttccaggagctgccttagaacaggaacagcatgtgggttttctaagtgtgaggataaaggaccctgacactggattagatggtgaatattgcaatgccctggattcttctcaggtgcctaaagctgttgaactttgtgctcagcctgatagtgggagggatgcctccactattagcaaggagtgtgaaa

SEQ ID NO: 29156 - DNA, 2268 bp, Mus musculus
aaaaatttttatttcatatgcattgatgttttgcctgcatgtatatgagaagaaggtggaactggaactcccctggaactggagttgcttgccatgtggttgctaggaattgaacctgagtcctctggaagagcagccagtgctcttaaccactgagccatctctccagccccactttcagttttatgacttgtgtcagatcatgttgtgtggttggtcagaagattgagtcagatgcaatgtatataggaacctgattttgttcttatttttatggcagattctcaattattatttgtttcttattcttaagattagactatacattgttagcaaacattttaaaccccatgttcaggcttgattgattttaatttcattttcttatgtcagccgaccgcatgaacagacttcaggcagctcttgccagcacccagcaattccagcaaatgtttgatgagctgaggacctggttagatgagaaacaaagccaacaagcaaaaaactgcccaatttctgcaaaattggaacggctccaatgtcagctacaagagaatgaagagtttcaaaagaaccttaatcaacacagtggttcctatgaggtgattgtggctgagggggaggctctgctgctttctgtgccccctggagaagagaaaaagactttacaaaaccagttggttgaactcagaagccactgggaagatcttagtaaaaaaactgcaaatcgacagtctaggctcaaggactgtatgcagaaagctcagaagtatcaggggcatgtggaggaccttgtgccctggatagacgagtgcaagtccaagatgtctgagctacaggttaccctggatccagtgcaactggagtccagcctcttaaggtccaaggctatgctgaatgaggcagagaagcgccgctccctgctggaaatactgaatagtgctgctgacattctgatcaattcttcagaaatagatgaagatgagatccgagatgagaaggctgggctcaaccagaacatggatgccataactgaggagctacaggccaaaacgagctctctagaagaaatgactcagaggctcaaggagttccaggaaagcttcaagaatattgaaaagaaagttgaaggagccaaacaccagcttgaaatctttgatgccctgggctctcaagcctgtagtaacaagaatctggagaagctaaaggctcagcaagaagtgctgcaggccttagaacctcaggtagactacctgaggaacttcactcagggactcgtagaagatgctccagatggatcggatgcttccccacttgtacatcaagctgaggttgcacagcaggagttcttagaagtgaagcaaagagtgagcagtagctgcctgaccatggaaaacaagctagaggggattgggcagttccactgtcgagtccgagaaatgttttctcaattggctgacctggatgatgagctagatggcatgggagccattggcagagacacggatagcctccagtcacaaattgaggacgtacggctcttccttaacaaaatccaagccctcagatttgacatagaggactctgaagcagagtgtcgaaaaatgttggaggaagaggggacgttagacttactgggtctcaagagggagctagaagcccttaataagcagtgtggtaaactgacagagcgagggaaagttcgccaggagcagctagagctgacgttgggccgagtagaggacttctataggaaactgaaagcgctcaatgatgccgccacagctgcagaggaaggagaagcgcttcagtggattgtgggaactgaagtggatgtcatcaaccagcaactagcagattttaaagtaagttttgccctccttttttatttcgtttttctctctaatgcttaatttttagacatcagttgagagtctgtctttttcacttggtttcttattcttacttccattaccaacaaaacatattgtgtagaaatctaagagtctcttaggtgtctaagaaaacagttttgaacatttttcaattgtggtttccttctatctttacagccaattaaggatatggaagaaagccttgtctcttagtctaagaatctcttcatgatttcttgatttaatagacttggtaactgcagttaaagtgttcatggtcctttttctcaggctgagctgtgagccttctccagaaatgctagttctgtacacattgcagagaaaccttattgatatattatgaaacagtgta

SEQ ID NO: 29157 - DNA, 1295 bp, Mus musculus
gttttccattggtgtcactagagaatattcaaaacactgcctttccactaagaaacttacattttctccatagagacttctccctaccatgcttcctcaagacctcggcttcctggccacccataataataaatcttatttaaaaaaaaaaaaaaaagaagaagaagaagttggttcttatttccgaaacctcttggattccaatatggaagtcaagtcatagtcttagtggcaagcacctttacctgctgagccacctcactggcccattcttccttgtgacaactgtggtagcttttctatctggtccctagagttttctggcttattttcaaaatgggctggcacagtccaaactcagtttttgttttgacactgcttttagatctgctttctctgtgtaaacatctctgtgttatttctgttccagtttatgctgaaggaatttgaagcacgaaggcagcagcatgagcagctgaacgaggcagctcagggcatcctaacgggtcctggagatatgtctccatctgccagccaagtacacaaagatctgcaaagcatcagtcagaagtgggttgagctcactgacaagctcaactcccgttccagccaaattgaccaagctattgttaaaagtacccaataccaagacctgctccaggacttatcagaaaaggtgaaggccattggacagcgactgagtggccagtcagccatcagcacccaacctgaagctgtaaagcaacagctagaggagaccagtgagattcggtctgatttgggacaattagacaatgagattaaggaggctcagacgctgtgccaagaactctcactgctcattggtgagcagtacctcaaggatgagctgaagaagcgtttggagacagtcgccctgccgctccaaggcttagaagaccttgcaggtatctaaagtgaataacaaaaggagtggctaggcaggccaagaatgtagaatgacccttccatagtttcttggggctagcataaggttccacttatcctttcttccagtgacaataagaatggagtggttgttacacagtgaacattggggtgtatggagcgtcactgtgctcaccacagtgctggagatagactaacaccgcatcagctagcctgcaggcactcacctctggatgtactgatgggtggccttatagacgcttttaaccacagcccttgttttctctatgttgccaatgcacatgcatagccaaccccatgattgcaaatgagagtgtattttgggatttttaagatttttttaaaaa

SEQ ID NO: 29158 - DNA, 1170 bp, Mus musculus
ctataagtccaacatgtagaaggtagaggcaggaagattggaagttcaggctttggctggcctttgctatatcagattatctcaaaacaaacaaaaatctagtctagcagtaatctttctctatctcctggctgaaatagtctccaaattatttctcagaaatttaaaagagaggggctagaagaatattccaagttgattaatcccaacagtatgaagtaagttgacatcttacttcacctcctcacttttgttaatgtcacatttacttagcattttatggcattcatctgtgtataaaatgccaaagccagaaaacagattagtgttatgttttgttttttactttgtttatttaaacaggaactttcgaggaaggtaatcagtagttgactagaagagttaggagggatgcttgatcctgacagatcatttaggagtaaaaaatgaagggaagaaggactatcaatctcattgttttttcccatgatactagatcttacagagattcagtgtgacatgtttgatgtaaattcgaagtatgagaaactgtgggaagtgctgcgagaacgacaggaaagccttcagactgtcttcagcagaatggaggaggttcaaaaggaggcgagctctgtattacagtggttagaatcaaaagaagaagtcctgaaagccatggatgccactttgtctccaaccaagacagaaacagtaaaagcccaagcagaatctaacaaggtactgtgtttccattgtgagctgcacctgaacaggaggggaggaggtccctgcaggggctcctgccccagtctggggtctaagcctgaatggagtctattctcgactggaattggtggtatgtttgccctccaaaattttaacatacctcattccagtctccgtgacaattcttgttacttataaaataagaaatggttatgattcagatttgggggagggggcatgttttcaaaaagaggctagctccctcctttcccacattattagctcattgagaattgagtcttattttccacgtgatacaactagatagctaagcttttcttgtccaggcatttttgcaactcttaggggaacctaaaaattgtggataggtatttattcttgagttggaaatgtatggtgcaggagagaagccttaacagttaa

SEQ ID NO: 29159 - DNA, 1128 bp, Mus musculus
ctccctccctccctccctctccctccctccctctccctccctccctccctccctctccctccctccctccctcccttccttcattccttccttttatgagacttctataagtcttaatgtgtagctctggctggtccaggaatcactatgtagaccagtctgtctacagaactcacggagtacctcctgtctctgccttcaaagcattatgattaaaggcatatgccactatatccaggataggcatagtttcttgtcaaaatggtgagagggttgctgcagagatggttcaggagttaagagctttagttgttcttcaggtgaccggggtttggtttttagcacctactgtctgtaactccagtcccaggggatccaatctcttcttctgacctccgcaggcatctggcatgcacatgtaacatgtatatacatgcatgcaaaacactcatgcgcataaaataaaatggtgggagctacgtttctaacagttgtccctgctgatgaggaaggcccagatgactcatttaccaatctggttcttttactaggatcttatatctgactgggaaagtaaaggagccctgctgggagaaatcaacgccaagggcactgccttagaaagtctcatcatggacatcacagctcctgattcccaagccaaaacaggtgagtataggctctgaaaaatataataaatgcatttaccgctctgcttgtggcctttggagatgttcctttgtttaattaaaattaaaaagttgaatatgagaagaaagaagatccacaaagccatattctctttcattctggtctgtttcttactgtgctgaacaatgctgctccattttgaaaaattcttcttgtaagtaagtgaattaacgggcctacttagggctaacaatgaatgtataactacattttttatcttagggaatctttctattttgagcatgtaaatgatacaggtatgataccatttttagccgtgggtgggtgtaagtgtctagggagaacctaggtatttgtgagtctgttggtacatcaaaggctggcatacttcttcaaagggaacataaatgttgtgctcagttgcatgaataatctttggccataaccaaatctttt

SEQ ID NO: 29160 - DNA, 1220 bp, Mus musculus
ctgatttgcaaccttaattttgttaagaccagagactttatcttaattatctttagtccttggcatgttgcataatttctgttcttattaaatgccaaattactaattaattgaatttggctactttattaatatagttcaaaaatattccatttgttttgatgttaattatttttaattaatatatacaatttaaatactactttctgagtattttgtttgtttgagtttttgttttgtttttatttgaggcagggtctcactatgtagccctggctttcctggaactcactatatagaccaggggacctcatatttacagagaccccttgcttcttaatcccaggtgcttgaattaaaagtgtagactattttgactgctatctgtctgtctgtatgtatgtattgtgggctagccttgaattcactatgtagatcaggctgacctcaaagttcatctgcctcaaccttctgaattaccaggattacaggcatatcctaccatactcatctttttattcttaaacatattttataaaaatagcatcctgtgttttttctcatggccttgattttccagattccatatccagccgcttccagaacctctcttgtagcttggatgagcggtctgctttgctgcagaaggcaattgctcagtctcagagtgttcaggaaagtatggagagcctgctgcagtccataagggaagttgaacaaaacctagaaagggatcaggtggcatcactctcatcaggagtcatccaagaagccttggccaacaacatggtaagagaaccttactcctgagagttacactaggagatgagtttgccatttctgtagtaatattactctgagaaagtagcagaagagaatagtttctgtccaagaatcttgtaataaggcttgaagatgatgactgatctatgtagccgttctgctactggggctgagaatgtaactcagtaatagaatgcatgcttattaacatgggaagatcctgagttcaatattcaacaccataaaaaagaaagagaatttttcttcctaatttccaaacccctgttgaatccaaggaaaagtgttgggagcaaataatttggtgaagtgaatagagaaatacaggatgtaccattcttcaggctcagtcacagtcctccaatctccttgagcatggagttattacaaagttagtagatggctcagatctactagca

SEQ ID NO: 29161 - DNA, 1215 bp, Mus musculus
aatcacttcattcagaatggtgcacttagaaaatgtgaaaaactacatttttatttaatagttttagatcatagttcatcatgaagaagtatggagactgtctggtctgctatccaagactggcaggctccattctgctagaatcatatcgtccttttatttcttccacttgtactcagagacagagttctagccctgcctggtctacagagctagtttcaaggcagccaggctacacagaaaaaccctgtcttgaaaaacaaacaaacaaacaacaataacaaaaagaaacaaagaaaagaaaagagttctctttgaagacaagttattgccaagtaaaaattttgctatttaatattgaaggcttgttttttgtttctttggtaaattatcatcagaatgtcagagattatatacatatatgtcatccttacagaagactgaaaggactaaaaggcagtcacctttgtttctctctgttaaggatttgcagggtgacattcagagtcattccacctcatttgccactgctgtcaaagacattgaagggttcctggaagagaaccagaccaagctgagcccccaggagctgacagctcttcgagaaaaacttcatcaggcaaaggagcaatatgaggttctccaggaacggacacgggtggctcagaaagagctggaggaagcagtgacatcagccttacaacaggagacagagaaggtagctggcctgctactggtttttcaaagacacattggagcagtctttagagttacagaagaggtctttaggagtcagtcttttcattctcaaaaaatatccaggagttcaggtcaggagtggtttgtaaaaagtgtattttaccaaaaacaaaattaaaacttgctagctctacttatagtttctactttggctttgataagctataagaaggaaaaagcagatgatatgatttttttgccccaatattgattggtgacctatgagtattagaaaaatatctatggggctggagagatggctcagcaattaagagcactagctgttctgccaatagtcctgagtccgattcccagtaaccacatggtagctcacaaccatctataatagaatctgatttccttttggtgtacataaaaacgtactcatatgaatatctctaatttgggcatcatttggggtcctaggctttgtttcccaggcagctgtacagttgc

SEQ ID NO: 29162 - DNA, 1172 bp, Mus musculus
ggaaaaggggtgtgatgaacaatgtgctcaccaaatacatccacatacaaaggctttaaaataagttaaagatgactaggtaggtgatagctaagtgagatttataatttgtttaaaatgagaatatctgtggaaggagtaaagacatataaaataaaactatatcatgcatttttagatctaataatttaactgaacaatgaatttatattatttcagcatccaaatttgtggtatatgagtaaggctaagaaagcaaggaggtcattttgattatagttgcagcactatgagcatagcgttatatagcattgacatcactaagaatcatggaatatgtgtgagatgccaaagttcagtataagagactggatgtattcagataatccattcatggcaacaatagagcagttttgaatatagtttggagagttcttgccttgagagaaatctaatgcttcgtccttcaggctttcagaaggagagaaggaacagatctctgagcagttgcgtgtgctgaacaagacttaccatgacctttgtgatggttctgcaaaccaactccagcagctccaaagcgagttggctcagcagacggaacaaaaggtatttttactttttggctccatatattatggaagccttttaagtggtatgaaagtggctttgctgattgagagtcatgttcactagcttgccatgaccaatgtgacttaatatttaacctcaccttagcagccatttgtcatgtgtttctttactggggttccatgatgtgttggtcagtcaaaaatatcagagggcatttatagcaaaccctctgtttctggtccactcccacctccacccacattttaccattgcatattggaaaacagttaatgagaatttaaattctgtatttgtatctgatcacaggtcactaagattttactcctttgagacattgtcacccaagagttgatagccaagggttgtggatattggcaagaacatgcttataaccctcttccttctgtagcgtgaccagggagagtgaacttcactgactgagacgctggttcccctcaccatccatggccatcctgtcacatagcacattaccagttctcacctcaccttcacttttgtaccacatggaagtcattatagttgctgtcgattgtcttaag

SEQ ID NO: 29163 - DNA, 1199 bp, Mus musculus
aggctccacttgctaaagatggtatatcctgtccaaacaacacctagtaacagcgactgagtgctcaaatgcctatgaggatatttttcattcaaaccaccatgtaatagaacctcagataatggcagaggcaccaggcaactagtttcttaatgttcactgcatcatttttgaataacctttggagtttcaaataaattttagtgggtgaaattttccaaatatacaaatatgcctgtcacttccacctttaaatattttcattagagaaagagatatgtctcagtcacttttctgttgttagggtatgataccatgaccaagtgagcttatagaaaagtttatttgggggctggtgagatggctcagtgggtaagagtacccgactgctcttccaaaggtccagtgttcaagtcccagcaaccacatggtggctcacgaccatccgtaacaagatctgacgccctcttctggtgtgtctaaagacagctacagtgtacttacatataataaatcaataaatctttaaaaaaaaaaaaaagaaaagtttatttggggccagcagtttcagatggttaatgtctgtgatcaccaatggagaaagcatggcagcaggtgggcaggcatgacactggaacaggagctgagagttcatctggatctatgaacaggaagaagagcacatactgttgaaattacaagtcttttgacacctcaaatcctttctcactgagccttctcccccagcaaagccacaccttccagtccttccccatcccatcaattggggaccaagtaatcaaaacatgagtctatggatgcactctcattcaaaccaccgcataggataagcagaaatcttcagtaaggcataatttgttggagaaaaatattagaaacctccatagtgtgtacagtaaaatgccatgacattattaaaaataatgtaatagatttaagtgaattagcatagaaagtgatttatattatattaatatattatactagatataatgattccagtaagaactatgtatcaacaaaggtacaacactgcatacaaacaattttagaagtgtgtttatgtgtgaacgtctcagagatagactctagtgtatataatatacattcccattcccgttttggtcctatgtagtaagtatgcaatctttttgtaattacaaaaatacttgcaagca

SEQ ID NO: 29164 - DNA, 1124 bp, Mus musculus
caataaatacatagataagtgtaagtaaagttattttataaatagtcacactcatttatgagacagaatcaatatttctgacaggtaggatggcccaatatttgccaacctgtagtctaaacaaacactaaatgaagtccagcaagaaaatactaagtttttgttgtgtgatatgttagctatgatcttaagtaaaggaagtcaaatttctcttgtcctaggactatgagttgcagcttatgacatataaagccttcgtggagtcacagcagaaatctccaggcaagcgccgccgcatgatttcctcttcagatgccatcacacaggaggtgagtggatgggaggaaaccatgtcttctgaggggaagtggggggagtggctgtgcaaggtgggttgggaagagaggagggtctgtgattgggatgtgaagtgaataaataaataaattaatggagaagaaaaagaaaacctctcatttctcttatctttctgttttcttccttattcaactgttgaattttacttttctggataataacttatctaaattgttcttttgaactatagttcatggacttaaggactcgatacacagctttggtgacattaacaactcagcatgtaaaatatatcagtgatgctctccggcggttggaagaggaagaggtgagaatagttgggtccccatccttttgaaaaaatgattaaaaatactgtgcctcaccaggcatgatggagtatccctttaatcccagcacttgggaggcagaagcaggtgtaggccagcctgatctacagggcaattccaggacagccaggactacacggagaaaccctgtcttgataaaccaccaacaacaaaatgctatgcctcaagcagagggcgtagctcactagtattgcttgtagctaacatgtaccaagtcttcaagttgatctattaatacatactagaattcccatgcctcatcttttaaaagataaataaaattcatgcagacattttttttatagtgaccatgttctagaaagtttggttgttggttctttaaaccagtgttcctagaggaaatagttactttctacaagccccaggtcacatacacagcctggtttatgtgta

SEQ ID NO: 29165 - DNA, 1194 bp, Mus musculus
ttagtgggttccagtcacttctgtcattttgatgccttgcttatgatgtaaggtatgactagtagagacagaaaattcttctttcttaggctaaggaggggaggaaaatatgtaggcacaggagtttaatcaactcatataagtctgtattgtctctacttaaattactaccctaaagctaatgagattgacagatatctaaagatagtaacctctatctttcatcacatcctgctacaagaaattacagtctttataaatcataatcctgttaccctgacaatagtctgtaaagtaaagatgtaaatggtaaatttgacaggcattatcttgagatgctcggctccatagggttcctcagagctcttaggattagttttacttactgttaggaccctgggtacattcacagacatcactctgccttgcatcacttatccccaagggaaatcccgcccttcatggttgagcccacctggaggcctgagtggttgctctctatttgtgttaacattaggattcttgacagtgcttgcatttgttcctccaggcaatctgaggtagaaagtatccaggaagttctgagagattaccgagcctgccatggaactctcatcaagtggattgaggaaaccactgcccagcaggaaatgatgaagcctggccaggcagaggatagtagagtgctgtcagagcagcttagtcagcagacggtgagtatgtctgcagaacaagggacaaaatagacactagctcatcttaagatggcaatactgcagcaattaaacctcttccaaatgagcagacatctaggtcccctctgttgtttgtgattttgaaaaagatactgattttacatttaggccagagagagacccattaggtcatctaatcctgattttctatggctatttattgaaactattaaacatctccattttatttcttgatattatattttattacactagaactggactataggggcttgaaaaactatgagtggaagaaaatgatttaaagcatttttagttggtgttttactttaataccatgtcattaagtacatgaggtctgactttaattgtcttgattacaggcctggcttatatactacttactagctagaaaacattgaagaaattaaccacctttcagtattctacttccttatccttaaaatagcacagttta

SEQ ID NO: 29166 - DNA, 1233 bp, Mus musculus
gtaagaatacacagagtatagagtgtgtgaccacttgtctacttttattaacttacatccaggctacaactaatggcatacctctgcaaccctagcccctggagttgagactcgaggattatgagttcaaggctaacatagattatttaataagactgtgaatgtgggaaggacaaggaacattgtacagtggagtttgagggatagtatggggtggggttgctactaatgttgtttagattggaatgttgattatatagatgaatttggttattgaaaatcaacatgtttacagtaattcactcattcattcaagacaaagtctcactccgttaccctggctggcctggaacttactctgtctgcttttgtctgtcctgtggtgggattaaagatgtgtgccattatgcccagcagatttgtgtatttttgaatatatgtttatcgagtcaacagaatcaataaaaaaagagagagagagaataagtggtatttttctattctaaagaattgtattctgttgtctttagcttcgttccttagcaccaggagagtgccaccaggttatgaaaaacctccaggcccactatgaagactttctacaggacagccatgactctgccctcttctctgtggccgatcgcttgcgaatagaggaggaggtggaagcttgtaaagcccacttccagcacctgatgaaatcactggagaatggtgtgtgcatgaggcagagggagagagggagggagggagggagggagggagggagggagggagggaacatggaagaaggaaacctttgaagggtgctgacagactccaaacacagacaatcgtacaaagatgaattctcaaaatcatactgtggaataagatattttggttgttaatgataatgaaagatttttttttaatttttattttatgtatgtgagcacattgtagctgtatagatggttgtaagccttcatgtgtttgttgggaattaaaatttttaggacctttgctcactctggtcaactctggttgctcaagcctaaagatttttttattattatacctaagtacactgtagctgtcttcagatgtaccagagagggtgtcagatctcattacatgtggttgtgagccaccatgtggttgctgggatttgaagtcaggacttccatcagtgctcttctccactgagccatctcaccagcccccgtcacatttcttcagtaccttaatgct

SEQ ID NO: 29167 - DNA, 1164 bp, Mus musculus
tggatgttctgatgctgtaaatagtgagtgtggaaaccatgaggccgctagacatacacaaaacgtgctctgaaacataaaggagaaagcattaaatctggtaataagaattcataaaaaagccagcatttaaattgtgtcttgtattaatagaattttatgtcagaggaggacattttgagctgagaaaatagtgaagcaaagcctgcctgtcagtgctctgtctccagtgtgtggtacttgtatggtgctggctaactagccttcctaaccatgtttgctcttttctgtgcctcctgagttctcccagtctactcagggctagctcagatcctattgtgttttgtgagtcccttccccttaattccataggttttgcccttttctgagatccctaggcatttgcagtttatacatcatattttggtatcaatcgttttatagactccttaaagtcaggcaggaagcactgttttctttattgcttcttcttctacaatagcatttattctataaaattaaattcaatttgcaggagttgacaatggaactggaagggaaacaagatgtatttcgttctctacaagatacagcggaggtgttgtcacttgagaaccacccagctaagcaaacagtagaggtatgtgattgtaaaatgtgtgaagttaaaagtattgtgataaaaattctgagatcaggagctttgttcttccaaggcctggtagaaattccacatcatttgtgggtttttttttttttttttttttttttttttttggtttttcgagacagggtttctctgtgtagccctggctgtcctggaactcactttgtagaccaggctggcctcgaactcagaaatttgcctgcctctgcctcccgagtgctgggattaaaggcatgcgccaccacgcccagctcacatcatttgattttttttttttttttttttttttaaagatttatttatttattatatgtaagtacactatgtagttgtcttcagacactccagaagagggagtcagatctcgtgatcggatggttgtgagccaccatgtggttgctgggatttgaactcctgaccttcggaagagcagtcgggtgctcttacccactgagccatctcaccagcccacatcatttgattttatattggcttct

SEQ ID NO: 29168 - DNA, 1147 bp, Mus musculus
cttaatgtattcctttctatttcaaaatgacttgcaaaggtatgctagcacatgtgactttgaaacactggtaatctactgaactcatttaggatgcagagtgtctaaagtcacatggcaattcagtatttattctgttatgaccttcaggagtcacaaacactatgctacttccttccaattaacactttaatttgacatttgccttgaaaaataccaaactagatgatgttaaaataccacttcgcattcctgtaataggttttcaaaacactttctctaatatagtctaatttttatttttaccatgtgcttgttaaataaataacgaacaatttattttaagcatgtgttaagtctcttcttgtacttcagggtcatgcgcctgcaggatgagctggtcaccctgcgcttagagtgtacaaatctataccggaaaggccatttctcgtcacttgaattggttccgccctctactttaaccactactcacctgaaagcagaacccctgaacaagacgactcattcttcttctacctcctggtttcgaaaaccgatgacccggactgaacttgtatctatctcatcctctgaagacgaaggcaatcttcgatttgtatatgaactactctcttgggtagaagagatgcaggtgggtgtagtccagaaagctgtcttaagatggccaggttgctttgtgttcttggtagaggaaaaccttaattgctaatcctgtctgcatctaagaactcttcttattaagtgtcactttgcctctccactatttagtccaggaggccagtgtagcctaggctgttcttgaactcatgatcttcctgcaccagcctcctgaatgctggaactacatatgccaccaggcctgattcctttctgctaatattctaaatgaagagagtcagtatagattataacaatcccacactgtttagcatctgttactttctgctgactgtgccctaagtggtagcttgtgggacacttgcacatctatgtattgcaggtatctgttctgatgcttcctttttggaagaggcgtttattgttccgtttttgttgttttggtcatatctcttaagattaagcaagactgatataaatatatttattacacatgtccaatggcact

SEQ ID NO: 29169 - DNA, 1196 bp, Mus musculus
aaagagattctggggtattgagtagtattgagatttcttgtggtaatggttgggggagactgtcttaaattcctgagagtgaagtaattgcaaagaagcagatctgcagtgttaacagagttctaatctttcttctacaaggtagctttggtggtttagggttgtgtccatttgctgctagcaaggaataatctgcgggtaaatgtgtgtgactttaagtagcctgttctgtgtataataagtgatctctaaaaagaaaacagcctctcccttctgccagcctctaaccacttcctgtaagtgacagaacacagatctctgtttcaccaagtgaaacatcaattgtattttcaccaagacagctcccttctcattctttttgccttcacaaatacacatacatacatacatacatacatacatacatacatacatacacacacacacacacttgaaaaggctgcagataaggatatctacctggggtatgtagaaaagcgatatatctaaggataatcatatcctttcagggatatttatacagattaaatgaataacatatgagggtatttttgttgttgttttgagatagattctcctcttatccctggctggcctgacactctactatattgaccaggttacttttggacttagagagaactgcttgcctgtgctgggattaaaggtgtgtgccgccatacctggtcttgaaattgcttatagtagttgcataaaaattgttatattttcttccaggtaatttcatctttgaacattatagcccagaagcttctctgcttgcttctccactgtggagagtgtcacagttatctttgtacctagggcatctttcagaaggctgggttttttgttttgtttgtttgtttaattgagtgaatgaagcactatttcacaagggaatccttattttttaattgaatgactgaactgttctgttttatataaaaaatgtttcactgaactgtgccattgatttttattcttcactgtttactcctttaacaagcactgttatgttacatttcattgcatttcatatgctaagcagaactggtttttggtacctggtccctcttactccaggattcctgaaaaggatcattcacatgtcattgatttcttctctttctctttgttcttgatttattctgatcagatattcctccaccaca

SEQ ID NO: 29170 - DNA, 1203 bp, Mus musculus
ttgcagcaaggccagggcatgaattaggtgtctggttgagaagctggaggaacaggtggcctgtgactttagcataaaacttccgactggaaaggtgcttttgtaatccatacttaccagaagtttccatcaacggccctgtcctttgaccctcctccccttttgaaatagggtcttactatgcagccctgtctggcctggaattctctgtggaccttgagctcctgcctctgcctccgcagtgctgacatttaagtgtgcaccactatccccagcactagctaccccttgactctctatttcctctctagggtctcctaggcatctgttggagatggaatataaggagttaaaccacactgaacttatagagaacgattaaacagtgcttaaggaataatttagcttctttatgggggacaattggaaacctccaggggacagatgtactgttttgactgacaagtctttgctgaccatggactgcctgccctcattctttttcatgtttagcagcaaggcgagcttgcacacagccgtctttcctgctgtccaccgtcgtctttcctcgtattcctcctgttctcctgcctcctccatgctgctctgattattctgagaaccacttatgcccacagcagtttgggtgccactcagttgcctttgtgtgtggtttctggaaggccttagggtgaaggatagatagggttggcacattggaaagctatggaattggtaggagaagcaccaaagtgggagctgaaggaagctgggtttgcattcagttgtactcctgaggaactgtttgatcctgggcaggctactccatctctctaagtcttgggtttctgcttctataaggtggggatgaagactcttgcctttatgaatagaaatagaaatgatttaagttatatattaaaggacattgcctggcacatatattaagcacttagttaagtctgttagctttgctgtgattgacaattcagaatgatttagattgactatggttagtttttttgtctcctctcacggtgttagtagtacactttatatgccatactttgaaattgtgcttttcttggtctttgttagagtcaggtagttgtagcacacccaagggtcttggggcttttagcttcgttatctccagcacctccctgaagctgctccagatacacaaagtgaagaaagcagtgt

SEQ ID NO: 29171 - DNA, 1142 bp, Mus musculus
aaagttgtgatccttgttcctctgctttcccaagtatagtacatgccagctaccatgcctgcttcaaagggaggtttgagtagattcttaacccaatcttactgagagagcacagaaatctgcggtgctgggttttgtcagggtattcataaagaaaggtatgagaatgtacctttgtgcatacaaaaccccactcttagaggactctgtctgtttcaggcacgaaacctacctgacagaatgggaacctcacccccaccctgtaccctttcttaaaaaactcaggcaggattatcaaacttcacatggacgttccctgaatggaaaagactcagtagaaattccaggcttttcttgggccccgagctttttagcatagctgttcagctcttaatcattggcataattccaattccaagacagcctgaaggtgcatcagtggtggcatggttggagactatagggaatctacctgtccataaaattagagaatataacttaaaacattttttaagagacagttttgctgtttaattctgtctggcctcaaactcaccgagaactgcctgcctctgttaacctaatgttaaccacattagggcagctctgactcagatttaacaataacctcaagtagatgtcttagtgtgctggttactgtttgtcaacatgacataaactagagtcattttggaagaggaaacttcaattgaaaaaaatgtccccagattagcttgtgggcaaacttgtgtttcattttctttctttctttctttttttttttttttttttggtttttcgagacagggtttctctgtgtagccctggctgtcctggaactcactttgtagaccaggctggcctcgaactcagaaatccgcctgcctctgcctcctgagtgctgggattacaggcatgcgccaccatgcccggcttgtgtttcattttcttgattggtgattgatgtgggagggtctagctcactttgggtagtgccacccctgggctgatattcctgggtgttagaaggttgaagaagccctgaaaaataagccagtgagcttcctctttccatagtgtctgcttcagttcctgcctctaggtttctgccctaagatctggccctaactttcttggatgat

SEQ ID NO: 29172 - DNA, 1099 bp, Mus musculus
cagaggagaatgctctactttagctggacacgtatgcatgcacttttgcacacatgtaagcatttacctcattcagatatgcacacacacacacacacacaatggttgagattcacctgttgtggctgtgccccaagtgccaggatgaaggcagaggcagtggggcctgggccagagacagccctttgcctgcagcagtctgagttccatatgaatactctatgctcaggataattcaggatttttgacttcattacacagaagaatttcaaaacaagccagcataaaacagagttgagagtttattaagtttcaatatagatttaagcagaggtttaacagaccaaggggctcgagtgtaattctcaaggacaaagtcatgcatgtctttataatagtcatatatatgtttgttaaactcttctaaacttattacattcattttgtgcatgtaagtttgcattgcgtgtgtggcggtcagaggacaacctgtgagaactggttctccttccctttatatgggttccagggatcaattttgggttgtcaggcttggtggcaagtgctttaacctgcaatgattttggtggcttctgaagttacaccttaaatgattgctaaggcacttaaatgctatcacaaggtagcccctgacctgaggtcgcaagggttgtacaggagtttttatttttgggattctcagaaattgtaggcttccatttaggggagtaaaatcatgtgcgtccagggcttcagcatacttgattgctatttaagcattcttatttggaatctatatagaaaaggaatctttttgttaaggatatagcttagttagtagtacttgcctggcattcgtgaagtcttggatttgatcaccagtcctctgtaactgcatgctagccagccacatgcctgtaatcccagaatgcagatagaggtggagccaaaattcaaggtcaccttgggtgcatagtgtaagaaacttgtttttaacaagcttatattatacaattaacagaaaataatctgagaagttctgttcccagacatatagcctgagacccgctttcttgtcagtgctatcaaaggagagggg

SEQ ID NO: 29173 - DNA, 1180 bp, Mus musculus
gttgtacatcctagcactcaggaagccctgggattgcttcctagtccttcatatactgagtgatatgttgaatgcctgtaatttcagcactcaggagttgtaagaagaagatcagaaatttaagccatccttaactacatagtgagttccaggccagccttgggtacatgataccctgttctcaaaccaaaccaaaccagaccagactaaaccaatatggaaccaaccaaataaaccccccaaacaaacaacaggcatactaacaagcagacgtaaccatcgtaaaacaaagtctctgcggatgaagttctgatgagcttcaaatcccacagcacagggatgtatgtgggtcggtgctggtcgttcagagatggcatcactggtgaggagaccagcctgactgactggtggctcagtgagagtccccgtccgtctcagtgaataaggtggagagtgattgaggaagatacctgctctcaggcttccacagcacatgtgtgtgcacacacatgcacatatacattttgaatacatacacgtgaatgcataacatttgtgcatgtgtgcatgagcacacacacacaggatcatgcagagagagaggaaaaagaaaaaggtaaaactgtaatgtgaatgcgaatgcgaacacctgtgttttatgcactgggcaggagtgacaagggtgagacactcactactctaggagccaggcactttagatcctagagtctagaggttcacattgcagttgagtcatgaaactagattaagaggtgatagagacctggagagattgtgagattgttcataaccacctgtaattccagttccaggagacctgaaacaaaggcaccaggcctgtgtgtggtatacatacgcacatactcagacattcacataaaataaaaataaagagagggggtggggtgggggtactagaccataccttgaattccagttttagggaaccagagacaggtggatttctaagttctctatgaattcaaggtcagcctggtctgcatagtgaggccagctaaggctacaaagagaaactgtctcacccataaaacagagagagacaaagagacagagagagagagagagagaaagaaagagagactgtgaactgtgagattgcaagagatagagacagagacatggcaagaatactgactac

SEQ ID NO: 29174 - DNA, 1117 bp, Mus musculus
gacagggtttctctgtgtagccctggctgtcctggaactcactttgtagaccaggctggccttgaactcagaaatccgcctgcctctgcctcccaagtgctgggattaaaggcgtgtgccacaacgccccggcttgggccccacttctgctgtaccccgagaaacattgctgactcacttttatctttaggttttcatctgttaaaatcaatcagtgatttattggtatccataagaatacagatgagctgctggcatacattatgctatcactgttttttaacgattttcattgagataacttacattttcaaagccatttcacattcatcttatttgagctttataacagtaccccatacattcagtattattaagactgggacatttggacccagggccaaccacaggtttcagagctctggatgagggttttacatgggtatagaggaaccctcacaatagagcattgacttgagttagttgagatgattgtgaaaatattagtaaaataaagctgctggtgtcattgctggcttttagcttctgaatgataggcacacactgaagtgccttacaactctacagttctgaactgtggaaaatttcttttcctttttttcgattgaggcagagttttgctgtgtagctctctctggactggaactcattatatagaccaggctgggcttagagttatagaaatccacctgcctttgcctcccaaatgctgggattaaagatgtgtctctcccccaaccccccagttatggggaagtttgtagtatataagtctccgagaattttatacatagcaatgcattgcaaaatatatgacttggctaacacagtggaaagggtaaaatgaggatttggaatttcttactcaagtaattctccttggttaaaagtaaactcagtttggcctggtgtggtggcgcaggagtgtaattgggaggcagaggcaggtggatctcttgagttcaaggccagcttgatctacaaatagagtctcaagagacccagggctacacaaggaaaccctgtctcaaaacaaacaaaaaagtaaacccagttcttctttttttttttttttttaagtacactgtagctatct

SEQ ID NO: 29175 - DNA, 1193 bp, Mus musculus
ggcctgcctggttgaggcaggggtctagttattattattattttttttcttcctctcagaaataaagattggtctcggagctcggatttcagcccctgaaggctggcttgcgaagcagttcagcgagttaatgtctaatctccgccgagtgctcgcagagaaagttttgacaggccagcagggctgcgggctgcctttccctaaccgccctgagtggaaggcaggggtgcgtggccctggagccccagctttgatttatcttcagtgtgctctggactgcattttttttttttttgagatgttgattttcctagaaacttcacaggcaggcacccctacccccctcttgaaaacctgctctcctgtgactagccttgcctttctttccacgtgaaggagagaaatcttcaacccttaggactgaggccagcattcttgtttacaacacctacccagtgaaggaaaactaaagacaaagctgtaacccccgcctcccagcacccctggccccacaaccctggacattaggacgctacctgggagtgcagcttgggggaaatcagatgaaatggtgaaggactcgctagggcggctgatggttttttgctgtatcagctcctgtaagctgttcggtcttcctgcctgcagggagttttctgtcagcccccctcccccttctcttaaggaacggggattattgcggagcacaaagaggttaggttgtgcggctgaacttctttgaaaaactgctgctcgctgagtggttccattaagtttcctttgcagccttttgctttgccctcctcagagggaggatacgctggggctgtcactggctctgactgctttcaaccagcagaattaaaaacacaaaaaggaagaaatctcagtacctcccagggtcaagttgctggtggcttctagctgaaaggaagttgggctcccctgttatggcaaagaggaagtagggcttggatgggttaccggcgggcgttcagacatccccctcagtttgactttactcagacggactttgttccagtatgtaggaatgtgagtcttctcagacacaagtctatttctttcctaaagacactgtatttgtattcatttattttaattattttacttttatatacgagtcttttgcttgcatgtatggctgtacaccacaagtgtacctggtgctggag

SEQ ID NO: 29176 - DNA, 1493 bp, Mus musculus
ttcttctttcttcttcttcttcttcttcttcttcttcttcttcttctttcttcttcttcttcttcttcttcttcttcttcttcttcttcttcttcttcttctttcttcttcttcttctttcttcttcttcttcttctttcttcttcttcttctttcttcttcttcttcttcttcttcttcttcttcttcttcttcaccaaatggcggatgacgccggtgcagagggagggcccggaggacccgggggcccaggattaggaggccgcggaggcttccgtggaggattcgtaagcggtcgcggttgtggccgtggccgtggtcaagaccgcggggctcggggaggtaaagctgaagacaaggagtggatccctgtcaccaagctgggccgcctggttaaggacatgaagatcaagtccttggaggagatctacctgttctccctgttctgaaaatcatgccagtgcagaagcagactcgggctggccagcggaccaggttcaaggctttcgtcgctattggggactacaatggtcacgttggtcttgatgttaagtgctccaaggaggttgccactgccatccgaggggccatcatcttgcccaagctttccatcgtccctgtgcggagaggctactgggggaacaagattggcaagccccacactgttccatgcaaggtgacaggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacttgacccccgacccctggaaagagactgtcttcaccaagtctccttatcaggaattcactgatcatcttgtgaaaacccacaccagagtctctgttcagaggacccaggctccagctgtggctactacataaggactttgtacaagaaaaataaaagaattaagtctgctttaaaaaaaaaagaagaagaagaagaagaaatgaaagcagttcagactccgggatgtgttttgtgggttgtgtggtttatttttgttttgccttacatataggaatgtgtactggctggatcaaactcggtgcttcattttttttaattagatgtattcatttatgtattgcctgtgtgtgtgtatcatgtgacccgcctggagccccaggagtcagaagaaggcattagatcctctaagagtagagttatggatggtgctgagagttgaatcaggttccatgtagaagcagcagctgctcctaaccactgagccctctccccaacccccaacccccaaccccagcattggcatgttaggcaggcaactgagcctgctttcttgttttatcttgaggtagcatggctaaaccaggtcaactttgaattcatagtgatcctccttcc

SEQ ID NO: 29177 - DNA, 1493 bp, Mus musculus; identical to SEQ ID NO: 29176

SEQ ID NO: 29178 - DNA, 2091 bp, Mus musculus
tgggtaccaggtgtgacctcaagagatggctgctgtacactttttgcaactggtttgatatcacatttcagctccaactttgcatcctgagaacacttaaatgtttctgcaggtccattttatacaacttgaaagaccttaaaactttctggttgccacaagcatatctttcttttctgctcatccactaaacagctgtgccctactgtgataggttttccagacaaagtacctggaacagcagtctagcaaagaatgccttcagtggcactcaacacgtggagtctccccaagcacagctctgtgagaagtgtgagtgtgtgcgtgtgtgtgtctgtgttttaagttattatttgtattgtgcaaaaaaaaattttgatcttggggattctggctgtgaatttgatgcacgacaattatggttaaaaacattttcttggtctacagaagatcattaatgtttggtgaccatataggttgtaacagtgggttgtttatttgtaggtattatcgttaaatacagggactgtttccaggcacagaatttgaaatgtaagttaggatggacattagatgtgattatgatgatctagggaaggtctgcagtcctgaatctgcaaatacgtggtgagaaattagaacaaactggagacaggctatcagtacatggactctgcctagctgtgctggaaaaatactttgactccaagccttaaaatatcctgtggagtctgagctcacctcattcatacagtcacggagctccctgaacgctgaacttctacagggaaaagatctcccctggagcggaagatcagggtgtcctcggagcgtgtaacaagtgcggggctgggccaggctcacagcactgctacctgggaggagccgctcaccttcgcatcagttccaacatagaatctggaccctttgtccaggttaccccaaactctcctgaggtgtccgtgttcaacccttagagcttggttttggcaataccctgcctgaagttgcttattggctgttctctgccttggtcccaaggctgtgagcagaaagcagcctctgttttgaggaggtgggatttaagtatacatttatttttactgtgacttgttcaggaccacattttacaaaatgccttgtttcctttactgttgttttggaaaggaaagttttatgaaaactgttttagtttgaatatagaatagttatattaattacggctttattttggaaaaatcttgagttttaattcaaatgtttgctaataccttccaaagtaaggtgatattcagagacagttgttgtgatcagctggcttgcggacatttctggggtattcacatttgaagattccttattaatgaatgtctttgacttaaatctaaccaaaaactgcaacattattctttgtacattttcattatatagtgttaacaagcttagttgcaaacgaataaaatacttaagctatttgtttaccttgccttcttgatgctgtgatgatgtgtattagttcagataactctcataaggctgctataaccattcccacagttccacagcctgttggagatttacagactctgagagcccaccagtgctcttttaataattaaagaatgactgacttgcttaaaggacagtttgtttcatcgcttctttctccagcgtagttccttgttccctgaagaggagccatagtaatggctgtgtgtggtgggtaaaggcatgtggggctgccgagacttgaaggctgctcaccccaaggcctatcagacaccatggtgctgtgcttccttagaaagcattccgtcagtggcttctggctacaagtggctttcatgatgaacagtcctgacacctcaactgctagcaagcagtgcctgcaggctgtctttaggttatcctctggggccactgagtgtgatacgttgtggttggcattaggtagggaatgaggctacatatttggggccctggaagcctgtgggtctttgaagttcaaggtcatccttggctacattgcattcaaggccagcctgaactatgtgagtacaggagcccctgtatatatgtatgtatgtgtgt

SEQ ID NO: 29179 - DNA, 1126 bp, Mus musculus
atcaataataaaaaactatcttagaaaaaagatttttgaggtcactgggcgtggttagccaccaaattcaggtcctctgtaggatcagtgcatgcaccattgaaccccttccagcatttctttctgtcaaggacttgagtgaagacaagatgctgctgaatggagtaggaaacgtatctgtgcagttcggctacacgtcaggggcttcatcataaagtaaaagttaggggctgtagacatggctcatgggcagatgtgcgtgggtgcaggcctgaagaactcagttcagtgcctgaatcccacaaggtggcaggagaatcatctcctgagagttgtcttctgagtgtgcatacctgcatactcataagaaatataaaactaaaagttctgaccaggcatgagagtataagcctatagtcctagcacttgaaggcaagagggtcaggaattttcgagtcatctctgactacacagtaagttagaggccagccttggctatgtaagactgtctctaaccaccctactagagtatgtgtggatttgtgtatgtatgtgtcctcacatcttgcttaccttacaaagttcatgttaggatcagattaaatacattggatataaaaatgccttgcaaactataaaggattacttgcagatcagtctgtcagatctgccttgcaaatcagtactggcacatctgtaagtatcatagaattggaaaggttggttgtagcctactttggatcaggtttgaacatgaaaatctacagtacctatactgctggccacaaacacatataaagtcctatagtggttaaagtatatagttatacaaagtgagtagggtttctttctttctttctttctttctttctttctttctttctttctttctttctttctttttttttaagatttatttatttattatatgtaagtacactgtagctgtcttcagacactccagaagagggagtcagatctcgttagggatggttgtgagccaccatgtggttgctgggatttgaactctggaccttcggaagagcagtcgggtgctcttacccactgagccatctcaccagcccgtgagtagggtttctgataaaatactagttctggtgatctc

SEQ ID NO: 29180 - DNA, 1203 bp, Mus musculus
ttcaggtagcagagggccgtgctctcctcgcctgatcatgaccatgcacaatgcaacaaagggaatttaagacagaaagacttccccacagtccccccagtgaagggacaaactcattatgtcactgaagtacttagctcacttttctttaatctcgatgccatggcttttattctatgctatgtaggctctttacgaattgtttttgaccacagatgaccctaagggctcctgcgaaccgtcctctggggattggcggaagcatgcggtggtgcagctgcagcgtgtgcaacttcacacactctgcggtcggttgtctgacaccaagtgtcagctgtgctactttgctttgcctgagatatgaattcataattgttccctgttgttcatggctgatacccttcccactgatttaggctttcacattttctttactacacatgcccagtagtcacattccaaagccactgggccccttgagtgcgtcagtgcagctggtgagtgaaatgtactcaggtctgtaacctagcagtgagacttggagcacttcctgcagatgactgactgttgcgaatttacatggaccacggtgatatccaaaggaaaaatgcttttatatttatagattatttcattgaactatatgtaaaatgggtatcaataaatgtatttactccaaagtcagtgtttgttgtgtgatgtgtaagagtgcttcttttctcaccattcctctgtcctttgctgctgtgtgcagtcaccattccttctgttcagcacatctgcttttgtcttgagatcattttcatggcccatttctgctgtggagtaggtgtgggctcaggtgagaacatgtttggatttgtggttttatgttaacagacctctctggtactggggagcatccagagcctggcatgacttgtacattgcatccaggcagaacagtaaggaggctgaggtgaaacaggagtagaaagagcatggtgggctggctcagctggtgaaagtgcttgtcactgagcctggtgacctgagtttaatccctgggatccacatggcagcaagcaagagcagagtcctgcaaattgtcttctgacctccacagatacactgtagctgatggctgcccctacccactaaccatgcaaaagagcccctaaaatcatggtaccaagtttcctaggtactcattactaacctttg

SEQ ID NO: 29181 - DNA, 1101 bp, Mus musculus
gcagcagctgcaagcgccccatcacaggtgggagcggcggcggcgagggcgcaggtaagagttcggatgtaacacgggtgaggttaaggggcagcagtggcccccagacctgcagagctaacctccagccttcctccaggactcggtggaggcaagtatgtgtccttcgaagaccgacattggcaccacagctgcttttcctgtgcccgctgctccacctccctggtgggccaaggctttgtaccagacggagatcaagttctatgccagggctgcagccaagcaggcccctgagtggaggatcctgactctcctctttcccaaaccaagagttcaagactttggcgccttttctgaaccacttctggggcccaacccctccctagaacgggccctcccccaacccccgctccccactcattgggacttcaggattcagtcacccaattttaacacaccccagtggtactccccgacccaggcccccaaatctgggctgttgtggaacacccatgacttaagcctttctccaagtctggattccagaaatgttccccacatcaaggctctgacaccccagccctccaaacctgaactctgaggcctaggcctctttaagtcaagacttctagggtagattttttttttttttttttttttttttttttttttttttagtttttctgcaggtgcctaagaagtcttcaaaaatagattgtacacccggtttgacctcacccccatcccactgctctctctgagctgcagctgtatgtatagcagattaggggctccctggttagagggttgtaaggtacagggtgctgtccagcctctgagtaccatgttatttcagctccatgttgccctgcaacaggaagcaggaaggttgctcgccctgtttccagagattgcaataaagcagtgtgaggggagcacgggccccgtgtatttgtcgagaggatgaaggaaggttgcgtggctgagtcaggcttttgaaacctcctagtgggcgggccgtggggtggggattctccccaggaagaggatcccctctggcagccacgcgggtccctcttgagcttggccaacctccccact

SEQ ID NO: 29182 - DNA, 1213 bp, Mus musculus
gagtttattcaccagttcctctgcggtccactctgagcctcactactcctctcctgttttccttaaggcagccacaattgtcagccccacctgtttcagctcaagaactgccttaagctggtctgaggctgctggaagaatggcagccacctgtttcttctacctgagcctagacctgccccttctccatgccattggctagcacacccatgctgacttgtgaagacatgggggcaatccaccatagtagaactgacgttccacattcaactctagttatttaacacaaatagctccctattcatttttatttaaaagttttaagtaactgtactttgccttattcagccagcctccaggacatgcagtcagtgagttccccatatcccgtactgagcatctcatggtcagatacttggactaactgaagtccctgaaggagaatggcttggggcggcaggactctgcttagaggttcctggataaacaacttttagccatccagatgcttccactgtccaagccgcaaacatgttcatgcatagggcacctgttccctttctgctcaactccaaggcctctcagtcgcccccaagagcactgaagaaagggggttctggtgaaacaagtgggattttgtaggatattcagtcctcccaactgtatataatgcagcacctctcatatatgtaatatattttaatgaaaatgtatttttaatggtgactatggttctctctttttttagttatgtgtatgtgtgtggtggtggtggtacatgcatgtgtgaatgtgctaggagaggccagaggctcagatctctctgaagctggatgtgagccatctaatgtgggttctggtttcaaaagaactctaaggtcagagcagtcagttggtcttctcttccccaatcctcctctctcaagagatggtagttcctggcagctagtcctttgtggcttaagaacagagcagctgatctgtggcatgctggtgcgccagagtcacttattcaaccttactcagagggaatggcacagcagtttgggcctgaaccctgatctagcctctaagagcactgctccaacgtaaacattcgagagaagtcgttcatggggtaaataagcattagcttatgtgagagtctaaaaattacatatacaggaatataatagaaacacgagaaaagtatcttcttgggctttgaaatatt

SEQ ID NO: 29183 - DNA, 1102 bp, Mus musculus
ttgcagtgtttgcatgtagcctgtgtacattctcttatatactttaaatatttacaatatttatttgtgtggaggcacatgtggaggccagaggtcaatttcgtgggtttgttttcttccacttttacatggtgtcccaaggattgagcttgacagcgtctgtcgctgagccatctcgctgctggcctccttctgtttactcatgatgcgttcatacagtataggcgcgttagacgttgttggggggctaataggtggttctgtacatgctctgcacaggcacttctttttaactgtaaccattttcagtccataattggctaagtctatgaatgtaaatccccagattcggagggctgatggcccagggagctgtgagggcctgtcacactgggtcctggggctaaggaccagtctcttacaaccatgtcagctgctgtggcaactgaagagtgagtgaggctctgctcttctctcagcacggtgatgaaccttatgatggagatagtccctgctcttacccttcggtgatggttgaagtttccgttggtaaagttagtacacagtcatgagagggtgattgccgatgtaagtgaagtgtcaggtgtgcgggaaagatgcatggtactggcttttagaggagggtgctgttgtgttgtgtggacatggagaggttgtggaggacctgggaggcagtgagacttgaattaaagcaagagtctcggaagtcagagaagggactagacctttccagtgacgggagagagcgcaggcaaggaggtgggaactgagactcccagaggaccagtgtgctgtggtgagtagctctaggccagcctttctgctctcctgggtcctgggtcacggaacaaacagagcgtcggaaggcctgggaataccctgaatatcctgcctagacactgggaccctatctgggagaggccatgtggacattgttttagaattgttctggcaatgacttcaaaactaggcaccaagactcacgcctgagtgattgagttcagggaacacagagcatgacctgtgtagcagtgagagagagtgactctgtgagcaagcacttgtgtaaggtcctgtcagt

SEQ ID NO: 29184 - DNA, 1149 bp, Mus musculus
tcttcctgtgagcacagcagacaggctgaggctcctcagaccctccgaaacgttaagtgccatggatgtgtcagagttcctgtccctccagagcctggacaccccgtccaatccggttcacagtgaagcactactgcaggggtagaggaaagagcctggccggcagcttctccaggggaagggcctgtgcgcacacccctccaggaacagggtgagcaggaagtaccggctgtgatgctgccgtcatggggtcagaaattggaaggatgaagaaatctgccatctgaaagctcacctttcagacgtattttctttactcgtatcccaggaacatccattttaaggaactgatctttggaggaaaaaacaaaaaacaaaaacaaaaaaagaaaaaaaaaagctaagttataagtgaactgtctggctgcactgtgtgtcacttttgcttattgttatgtgaacttggaaactaaggttacgtgtatgcataaaagttctaaatgaaagggtgtggtttccatcactttggtactgcccatcatttgcactggggtcactgtggattgggcaggagaggccactgtgcctgccgggtgttgcttctcttctgtgtctgtttaatccgaggcagtacctggagggccagaccaccgctctatgaaagcggggagtggcaagggcaggcgtgagttagactgggtgagttgctttgttgttggcacttggtttctgtggagcttggggtagatgcagagggggctgccctgtgtcctgcttagtcctagcgggcagctgcaggcctcctggccagagggaagatgtggttctgcagggccccgaggcagttgttgacagctctgttgataatgtgctagaccctagagctatctagcacagccacagtcttgccttcttggctctttccatctctcagtgcttgttagtgcttgaggcttgaagttcatctctcctacggaagcgccctgttttatcctaaagtgaatgagaggcttctggccagtggctgccagggtcttcctgccttcgatgatgtttgcttcctcagagcagaagggctgcttttccagagaaagtgcagagctaaaggagttagatggtgaggcagcaggtggtcggcaggcattctgg

SEQ ID NO: 29185 - DNA, 1199 bp, Mus musculus
tattcgcccaggctggtaagtatctttcctgtgcctctggggaatgtgagggaggttggagaaaagagaagatttaaagtgcaggttttctccaggcagtgttaattcacgccgttaatctcagcacttaagagacagaggcaggcagatctcttgtgagttcaaggctagcctggtctacaaagcaattccaggacaccagggctacacatagaaaccctgtcttgaaagcaaaaataacaaaaacttaaccaaaaaagtgcatatcttcattaccattttaaagggaccactaagggctgccacagagaggtgttaagtgggctgggactaaatttgctggtatagctggctttttaagattcatcaagtttgtttaacagtgggacagtaattagaattaggctactcagactttggtgtactccatcttctgagaagtcaaactcttaactaccttctatcttcctcagtgccctggaaaacactacatcgatcctccagcagaaatatgggctgctcccttcacaggggtcctgttcatgaaacttgggaggacccaaggaccatgctggatactatgtgtctgctactggatggcaaagcctcactgcctgaggttcctacatctatagcctagctttttaggcagcatccttggctctgaatcctgtaggccagccagaagctgcagggtgagccttgtccccgggggaaggttatatttatttattctgtacatttatttgtcagccaagaattaaatggagggaaggatgttcttagagtggccttattattttaagtgccccctctcacccccaccccctttaagtaacttgagtacagaattagaatgcattaaaagctgctttctggggaacagtgacatttgatgtcaaaccagccagaagcactaatgcagtctagaatagaagtcttaggaccaacgcagcaaagtctaggagccgagggcaaagctgtctgggtacaggggagtggttattggggaaattattctaggggtcccaagtgaaatattgaaaaataaaatcttgacttttttcagccggtgactttctaatttattggtatagttttatgtgtaatttatttagcttctttgtttatgcagaagccttttatccttgttcatatgtctaccaagtatttacataattattttggggtatttgaac

SEQ ID NO: 29186 - DNA, 1230 bp, Mus musculus
ctattgcctgtcaggtgctggggaatttgagcaaggtttccttcccaaagcttacaggatcctgcttttggtataactgtagctagcacctcggctgttttcgctctttgcagctacacccaggcctgggagttcagctattttttcctccaagataatacctctgtgacccggagcctttcccagatgaacgtttagctgcagagaggactaggtcactccttttagctgcctaggccggggaggccactcactagggccactttcagtgctactgtgatttgtattaagtatgaaatggtgtatgccagtacacattcctcttccagttctcctaagtgctgaccactaggtcagtctgggacacatcagtgtatggctaggctggctagctttagcacagtggagatggatctgcttataagactagtttacataagatttctagggagttaacgagccagtgcttactcacaaataaactaatgctacttgcaaggatccttggtaaagtaaaacctgatgaatattttcagcaagattcttgaaaaggaaatgttcactagacccttctggactggtttacaggctaaagctgagcctttaactctgggaaatggctgcagatggaggaggtgaaatactggtcactgcaaggacaaccagcccagtcaccgacacttaacccccgagacagatcagctgggctgaccacccagcttgcagcttagttgaaagggctggatttaaccctgcatatatattgtggatacagcaaggcagcaggaaggagcaagcaccctcagattttctgaagactaatctacatcaacagccataatgcacacatatatcttgactgagaaatcctactctaaggaaataactcaaaagaaaaataaaccatttacaactgtttgtagaagcaatatttaataacaacaaaagaaaatacagttcaaataccccaaaataattatgtaaatacttggtagacatatgaacaaggataaaaggcttctgcataaacaaagaagctaaataaattacacataaaactataccaataaattagaaagtcaccggctgaaaaaagtcaagattttatttttcaatatttcacttgggacccctagaataatttccccaataaccactcccctgtacccagacagctttgccctcggctcctagactttgctgcgttggtcctaagacttctattctaga

SEQ ID NO: 29187 - DNA, 1309 bp, Mus musculus
gaagggtaggtaccacaggagtcggacaagcctggagctgggatcctaatacgtacatcaggggagagtcatcctccagcatctgtgtgcctcactgcctcgtttaagaaatgagtctccactcagatccaggcttgggaagctggagagacaagagcacttgcgcctgcagaggacccaggtttggctttcggcaaacatggcagttcatctgtaactctagttcaggggatccagtgcattttctggcctccacagacacgagacacctccacacacacacaataaaaataaacagatctttaaaactgatcctgtgcttgagtagactgaagagctgactagactagtgtgccgggcacatcttgaatgacctttccttgtttcagagccgcctcgcccagatctgcagcagcatacggacgggccgatgagaggacaacaggacacacagtggcagcagggactgtggtagcagagtgcacacatctgtccttcttctgtggggtccttcactgccaacacctgcaacggtgctttgtctctctgacagctatggtgtcttgctgcacacttctagttagtgggaattttagacggggaacacagggctagtcagggcctttgtgtgcttggtgtggagtgactgagaaccgtctatggttcaaggtcccactggggataaactgcttagagcactgtcctagagggcaagtgtagccttcgcctccgggcccaggcaggctatgcagtcagcagtagggtctgtgctccatgcgggtccaggcgcacggctctcctattctgttgtcatttgtgccctctatgggcaggtgtgtttcaagttggttttctgttgctgaggctttcatacacatcagttaccatctcagctgatttgtctactgaaagcttgctgttttcaataaatcttagtttgccatggttttaagtcagtcctcggtcatctgcattcactctggttatttgggagctgcagctacatggccatgcctggacagccgccttctcgggagtgtggaaacatttccccaagatccagggttgtggtaactcagaccaggcctgttccccacgctgtcccaggagcttaggaggatggaccatcagaggatgggacttggctcacttccttctctacactgctccgtgcagtttggctcctgggtccctccattgagctactttgtgctggagcctctccaggaccccccctacaccctgtgctcactgaggggcctccctcctgtgctggcttcagctttctgtggtgaccctagaggtcagt

SEQ ID NO: 29188 - DNA, 1198 bp, Mus musculus
ggaacggagccagatcacaagttttgtagggattggaaggagtttgaatctgtctctctttgcgataataaaccattggagaatttaaaatctctctctctctctctctctgtctctctctctctctctctctctctctctctgtctctctctctgtctctctgtctctctctctttctttcaagctgaggcttgaatccaaagtctgttgttactaaaaactgctctactccagcctaaaatttaaaggcaggtatgacctgttctgatatttgcccgctcttgctggaacacttttagaaaggttcagagggcaaattcccatcagctcatgcactgggccgagaacaggcttctctctttttctctttctctctttttctcactaaacccaggactgcccggtgccctggacgttgctatggaagggacgcttgacggttgctagacccgggggaggcgggagcaggacagaggcggagccgggtcagccttaggcaagcgccgcgcgctctcaggaagtcgcgtagcgcgagcggaagtgacgtcgcgcgtgttcagggtccaacgtgcttcacacaggacgctttcccggctgggaagtcgtgaagtggtttacctcgcgagtagcagagcggtgtcggtactgtcgtcaggatggtgaagcccaagtacaaaggacggagcaccatcaaccgctcggcggccagcaccaacccaggtacggcggaccgggcgggaccaggccgcaggagccgtcggggacggaggaaggcccgttccggcctgggcggcggacccgaggtctaggcacctgctctaaagttgggggatgagtcacgccagcctctggcagccccgaggcctctcaggaggaggtgtagagaaaggcaagttaaaagtgggctagggtcctggagtcctggcacatgcctgtcatcccagcacttaggaagctgaggcagaggggatcacgagttagtggctatctggactacagggtacagactgaagacacagagtggagtaggttggcccaggtggcattttacccttaaccatagcattcgtgccaccttagctttgaccgtggaatcagaccatgcataagcaacacttcaggtaaatatagtgatttcaatagaggtggttttgagatacgagaaattcccatctacagggcaaacaaaacaggctt

SEQ ID NO: 29189 - DNA, 1147 bp, Mus musculus
cttccatcttgctgtaggagtgcaggggttacagtcctggggtagggtgattggctttacctgggttctggggtttgaactccagtccgcaagttctcatgccaagttgtctcctcacagagccatcttttcagcctccaatgagcttgaaagcctctacaccccatgagtgagtcggcagtccctctgtgagaacacagggatccaagcacaaagaaagctccttcttctgtctggggcctgtcagttattgagcccgtttcttttgtgtgtgcttgtgtgtgtacatgtgtgtgcattcatgcgtgttgaggggctgaggtcaacctcaggtgtaattcctctacatgctgtcctctgtgtgtgtgtgtgtgtgtgtgtgtgtgtgtgtgtgtgtgtgtgttaccagcttggaatctgatgataggagtaggctgtctgtgacccacccccctaggatctgctacttctgtccccacaagtgacttaaaaaaaatatgtcctggggatcaggtccatgtttgatgctcatgcctgagctaccttcccagtaccgtcccccatccccagcctgacacttttcctctctttaaatacaattttgtattttgagacgggtgtctcagactggcctcaaactcactacgcagctcaagatggccttacacttctgatccttctgccttcccttcccaagagccaggatgacagccatgcaccaccatcctagctagcttttaggcagtgttagagatggaacttggggctgcatgcatggtaagccagaaccctacaattgagctacatacatccccggcccttcacccgtgactgtgttcagtcaggagttagaaactggagcagcatcccgtctctcgggaggaagatggttaacggtgatgctctaacaggtggctctgtccagatgtcagatccagaggctcatctgggaaaccttatgggaagaaagtgagtctggtcagcatctgaaccagttctcaccatttggaaacttctctctgtggctgtgaagatgaaatgagaaaatgtttgcctcttgtactgacctcatatcctcctatctccctgttttcggccaggttttgagggtgaggctggcgcctcttgggctctttgcatctctttg

SEQ ID NO: 29190 - DNA, 1146 bp, Mus musculus
tagctgtggaagaggggtgggtatcccaggatggtttctgatgattgtggctgtctcattagaaacatgattacttcagaaggccaggcacacaggggtggggatggggaggtggaggggtggaagcaatggagtgcaggcccatagcgtggggctcacatcccatttgatgctaattggttggatgatggtaattgtcccgttgcagacagtgtgtctatcccctcatttaatataatcaataaggtagtatagctcgatgcaaatgaagtgtggggaagctgaggggccatttgttaagtcatgttctaaatgtgttttgctaattagctgtagcggggctcctccccctccccccagagtgggagcgggtggccaccttgatgccatgttctcttcagagaagcccactgaagactcatcagggaacttcagggaacggcgagattttgtcaggaccagctgaagtgtttcctaagacagcaggaagcaacggttccataagacactgcccctcaactcacagactcccccagcttgaacctctggaagcccttgtctcttccatctgactgggaggtgctaagcggctaggactgtgctttctccatcagacagctacccctctcctcgaaagtctcactgagtcaaaggtcccaatgcccctgctctttttcaatcattaactcaaggtcctatggaggccatggatgctcaccagttatggtgtcctctagagcaggaccgtgacactgccgtcccctggtagttgctcagatctcatgtctgcatctgtttccctgtatgctggagacagcgagtcagggatactgcatgctggtagacagctcagtacagtggttaagaagagactttgtatccagactctttgggtccaattctctggtccactaccttcttcctgtgtgttttagcccagttccctggtcttcctgtttggaggggtcaggttcacgcacaggtttcctgtgagatttcactgaggtaatatatttaattaataaagtgaattaataactcactttaatacttgcctgcgtattcatgtgtattcatgtgtgtgtagtggccagaggacaatcttgggtagtgtttctcaagagttgttccaccttggattttttg

SEQ ID NO: 29191 - DNA, 1164 bp, Mus musculus
cccagaccatttatatccaagagccctgccctatttgactcccagcccgaggactggggtgctgtactgatgccaaacgtgactactggagcagggccagctttgggtggaggatgggaaggatttgaggcctctgggcttctttggagctgcctgtccttctagagcttgaagttgaacctcagctggaggtagagcaccaggaatagggaagcagagtgaggaggaggaagaggaggaggaagaggaggaggaggaggaggaggaggggagaggaggggagggaagacatgctgcaacccaaagatactactgccttggctaggctggatgcagtctctctatccccatctctgggatctgaggcctctctcttggctggggctgcagggatcgaggccctggaaactgagcttctctgaagcatgctgggtgcttctgctggagcggctggagcttggagcccgaatccctcctccagcagccaggcgtcgtcgctgagcacaggaccagagagggtttacctgcaggtgcaagatgggctctctggcctggggagggtgttccccgccccttctctttgtgcctcttttgggggctgaaattccctcctagacaaggagatggatcgctcagcagtgtgacagagtgttcaaacaatctgtcttgaatagatgaattgcactgctctgtctttttgtaattgtgtctatcagagggagaggtcaaggcattgattgcttggatggtttgcaagtaacaaaggagagtgagggagagagagagtaattggattgtagtctgcgggaaaaaatgatcattgattattttatatgaatatgtggaagatgtattctgtgtgtgattatcaagggctgccatggaagaggcatattgttctgcgttttactattattgtcatcattattgttgtttggatggatccaggtcttcagttaggataagcagttagactctgagccttgtcagccaaatgagatttagtgaccttccattggggacttggatttataggtttataatctacaagctgcagcggagggttgatggacatagaggacagaggcttggatttcctcgtctttctgctcttaatgaactggatcactttgataaaattctattcttcttctttccacattt

SEQ ID NO: 29192 - DNA, 1250 bp, Mus musculus
aaaatgtcagcatcaagggattggggttttttttttcccttcccttaagaaagcagaaggagagcagcgccttggaggtcccgtggatctgtgtcttgcttcaacagtgtttgaacggaacagacccggggattcccactgtactcgcttccagccgcctttacaagtctctccagtcgcagcctccgggaccatctcctcgctgccttcggctcctaggaccagtctgcaccgtctcttcgcggttagctcctactccggatcagccatgacctctcagattcgtcagaattattccaccgaggtggaagctgccgtgaaccgcctggtcaacttgcacctgcgggcctcctacacctacctctctctgggcttcttttttgatcgggatgacgtggctctggagggcgtaggccacttcttccgcgaattggccgaggagaagcgcgagggcgcggagcgtctcctcgagtttcagaacgatcgcgggggccgtgcactcttccaggatgtgcagaagccatctcaagatgaatggggtaaaacccaggaggccatggaagctgccttggccctggagaagaacctgaatcaggccctcttggatctgcatgccctgggctctgcccgcgccgaccctcatctctgtgacttcctggaaagccacttcctggataaggaggtgaaactcatcaagaagatgggcaaccatctgaccaacctccgcagggtggcagggccacaaccagcgcagactggcgcgccccagggatctctgggcgagtatctctttgagcgcctcactctcaagcacgactaggaggcctctgtgccttccaaggggctcccccctctgctctgcaccagcccgccctgggacctccacctgaatgaacctctcaagccactaggcagctttgtaaccgccctggagcctctgtcaagtcttggaccaagtaaaaataaagctttttgagacagcaaaaaaaaaaaaaaaaaaaaaaaagaaagcagaaggaaaaaaaaaccaatcctgctttggaaatgtggctatttttatgctgtttgtaattttgtgtttatttcctgtccttttcacatggactctgggctgactcattgattcaccaaacattagtggaacgcccactctgtgtcgaagagcgcagactgcagggctggggtgcagctgcgtcctgagcctgagctctggagcatttcaggggcatcatgggagatccaggtagtga

SEQ ID NO: 29193 - DNA, 1132 bp, Mus musculus
tcccatatcacatccaagatcataatctgagagagagaaacgtatgcatgcttgcttatgctcagcttgagttctctattcttactcagctcagctctcgatgtcctgcctagggaatggtgccacccaccatggactgggttttcccacatcaactaatttaattaagacagtaccgcatagagagaactgcagacccgtttcagacaatccttcactgagacggtttcgaggggattctatgttgggtcaagttgacagttaaaactaactgtaattgatggacaggcgtgtgactgaccagatggatagatggatgaatagatgactgtatagacagactaatggatgaatgataaacagaatggtgggcagaccaactgctgtgtgaatgaatgcagactgtcatgtgggcgtcatgccctcatgtcaacccttagaacgctaaaacaaaagcttcctccaatgactctcttcctgggcaatgagtggatgccatagcagtctccagggaatgtcagagatgagggagaaggaagtgtgggtctctgggtataggaccctggggaaagctcctttagcctgaaggaactgagtccttcctcctctgagatgccatagtgaggagggaggggtgagtccacatccttcattgctggggaccactctataagagatcagacagaaaacccccctggtgtgctgcaggcacagaggaactcaaaccctcttctagctttgcagcaggaggcctgagagatggcaaagaccaacagcagcctggagggacaggaagtaccaggccctttgaggtttagtaacagctcctcccactctctggagcctttgaaaagcctctgcccttagtggcttgtaagtcaagactctcacccagacttgtcctttgtctctcaaggaaaactcatgctgcccctgatgtggctccagagacacatgcaggaaggaccactgcctttgcccaggcttgtcacatgcaaattcccttagccacagggcctgcctcagtcctgggaactcctgtgctttgaggccagtgttctgagcctggctccgtgggaggtgggtggccttgactttagtgtggactggctggcaggaggaggtgcatcct

SEQ ID NO: 29194 - DNA, 1136 bp, Mus musculus
acctgggccgttccagtcaaacctacccatgtccagcctcgtctggatcttgggacctagggagagtagagttcttgcaggctccacatcatcccattcaatatgggggctctgtgaggctgttaatgggactcttaggtctggtagtttcttctgaaatagccttgttgaactgcaagcatatgaaggagcccgctgtgaagaaggattgggagctgtctcatatagaggtgttgggatgctgactgaaactgaataaaccgtccatgcttcttcaagttctcttctgcctgcccagatgcctgattcatttctgcttagagaagttttaccattggtgcaggggtttctgagtgcagggttgccaggcccagggaggggttctactttgcagagaggtgcactggggacatccccctgcatactcccagcagtgtattaagcctcggtgactccaagctccatttgcataatgaacagaagaaaaggaggggggacaagaggctgctggtgactctgtcagagaagagctggcaggaccatcctttgcgaccacccacctggacatctggaatggagggttggagctgccgagggccacccaacagccttcctaggactgaggcaagcttcttgacctccatgtgtaaacaccctcacccagtgaaagcagagtctctgtagaaaaccctgctaattaaaagcacagtctaccaagtttagatagcttcagactcccttaaccagcaggatttcccctttttctgaccttgtctggggagtccgaccccccacatcctctatctggggaagttcaaatagtccttggcagacctacaagttcaaacctcccctccatatgtacttgcccagcaagtacctgggatttctggaaggcctctccacacagatgaggcattcacagaactctagccaatgatttttatttacctgaaaactcctttcccaccttccagggtccatatgtagcctcggttcaccctaaataaaatacttacacacaagctaagatcatgtaagagaggtgtctcacttagaggtattccactgaagatcgtggggaaaagccttcatcttcaagagctgttactgctaagatactctgagaagacctt

SEQ ID NO: 29195 - DNA, 1180 bp, Mus musculus
tgtttattcccggagctgttttctctgctgcctgcctgctgccacctcctccagacacacagaaagagccaaatgggcaggagtcctgccagcgtgatggagtggaagcctgagattagcgcctgcggacagacagatgggcgagggggacaatgggcatgcagcctaccctcaccccaggcttcctgcccagggccctgacccagggctggctaggccccagctaacatggccccttccattccttcccttcccaaattctgtcctcttttgtgacaccctctagctctgtccctcatcctccctgtccttgctactgccccttcccacttccagctcctgctctgctgtctaggccctgctggttggtgtccttctcttgatcttccttcagaatctagacgtatcataccctaaaagggggttggattagaccgacttctggctgcacacacttggggggacatttaaccctctggaggagaaataaaggcaggagggagaccgagcccctgtgtcatgtgttctgtgaggatatgttaagctgactctgcccagggtggtggtctgcaggagtgcagagagccatgtgttgggtcttgtgaccttgccaaggtgtccagcatcaccaggtccagtcccctgctcccctgggagctgtccttctctaagtcccttgttgggctttcttgctttgagagactcccatgtcttcccactcataaaacaactgtcctttgtttgcattcccagtgcacctattcatcccaactattggtgtgggaaatctgactggctttcaccgcacccctccaggctgtgtgcaccctgagcaaggcctttgggcttttttggtgctgctgtacaggtgtctgtaagggccttgcccagtgcctggcacagagcaagaacgcacaggtcctgggctgtcactaaagcgaagggggaaggatgtgcgacttgtcttgaggaaggacagcagcagcttgagggttgcatccttggcatcttgggcctggcagcacctcccggggccgatgtcctcaggctctcaaggtaaagctagcagcacgtttgagagcactctgtcagcctcctgttgtatggatgggccctgaggctcacacatcgtcctcagctgctgaaggaaggggcttcttgctgcctgggtccctgggtg

SEQ ID NO: 29196 - DNA, 1109 bp, Mus musculus
aggcctcagctattcccaatctggctgccgaggaggaagcccagcggtctgaaggaagaggtgtcactgagaccaatcctttattctgtccattatcagttcccagttctgagaatccgtgtccagaggttgccgatcctgtcacggaaggcctcggatgcaggctacatccaccccttgtggtctaccgggcagaactgagcccaagtcttgttgtccaagagcaagaggggaggagaggaggggacccctgactgtgagccagaggctgggggacagggcactgtggatgtctgtgtgcacacgagtacaaatgtgtgttagtgcacatccgtgcagagcatctgtacccatgtagcatgtgtcagggtgttgaccagccattttctgtcttgttgtacatgtaagcaagccatgtgctgcctgagactgtgtggagccaagcacccctcgtgtacattagtgcaccccgggaagttgtcagtatgggagcgtgcaccctgtgtgcaggctctgttgggtgattctggtgttggggccacattagtgtgacaggtatgcatatttatgccacctgtcagcctccatgcatgtgtctgtatgtctgtatgtttgtgtgtgtgtctgccatgctcagatgtacacacttcaccagagattggaatctcgcacctgtcccttcctgccctgctgacagggttgatgatagtggcccagagccctgctgttagtcatctgtccacagctgccattttaggaggggaagcaggtagttagccagctggcgtatttccggaatttcagtaaatggatgagttggagtcccgtttcgggcaccaggctactcagcttttagggggtgttagtgttgctgagagctggggctcaggtgggtcaatcctctgttactatccagcctggcatggcctgaagcactaccacccacagaagagctgtactggaaaggctgccactgcccttgtgacacacataggaatgtccttccgttcacgccttcagctgcctatcctttctgtacttccaggtgtgggtcaaagggcccctctactcggcgtgagcttgtgtctgttcctggatgtctccctggg

SEQ ID NO: 29197 - DNA, 1195 bp, Mus musculus
tctctctctctctacttctccagactttcctcatagatggaataaaattcccgacagaacaatgtagtgaaggaaggctttacagtttcatggtgtgggggacggggttcagcatctggaactccatctgtggaggcaggagctggtagatcgcttgttatatctctgggtcagatcaggaacctggaagctaagacctcaggttggaattggggccagctgtaaccaggccagtctggtcctgtctctataatcctacatctgataactaggtcctatagccataagatttcacagcttcccacaacagcacccccaactgggggccaagtattcaagcacgtaagcctgtgtttcccattaaggcttcaatatcctgtgatactctggtctctctggccagtgttggagaagatggttgctttggggcttcatgctcacagactcaagaaaagttgccattagacggtgtgatgaggttttttcccaaggttttcatatggcaggcagaaacctggaagccacatttttttttctttagttttcccaaataatgaaaacaatccaaatgcccatgagctggcagatggataaacggaatgtgatgctcaggaacgataaatgctcaggaacgatagttagtactgatgcatgctacatattagtaaacccagacacactgagcacacggagccagacccagaggaacacccactgtgtgatcccatttgcatgaaatgctcagggagaaaaatatttggagacaaaaggcaaattagtggtttcctggggctactggtgcaaacagtgagatggccacagggggtattatgggatagtggagaaattctgaaattgggctgtggtctgctcgtctgacttcttactcaaaaccaccatatacccaaaacaggtcagttttgttgaacaccaacaatatatcataaaagctcattacttactgaaagaataaaggcttgtctataaacacatgacaatattaaataagcgacggctccccttgcccaaatggctcacgcccaccggatcctgttccactcttctccccttcctgcgtttcctcagatctgcagcagcagacacatcatggacatttccacatctctatgacttttgaaaatagctgcacgtggtgatacatgccttaagttccaacactccagaggcaggcgga

SEQ ID NO: 29198 - DNA, 1301 bp, Mus musculus
atccagctgtgaaccatcagctcttaacctaccgggaaacccacacggaccctcggccggctgctcgggcttcatctcctcttgtcttgtctatggctttctgaagctgtgaaggccagcggaagcacatgcctctcaggctccatcaccaaccatctctcttctcctccatagccaggtatttctggcaggcctctgccgaggccgcagaacacggaagatggctctaaagctcccctcattcccctcaagccaggccttctagcacgcagccacgagagcagagactccgactcgggacaccttatgggtgtttggatgaggctgccagtgggagctcaaaggcagtcatccatacctggacagaagcaacgcttcagcccttaagggctattcacctgggtctgctcatctcaatatggcttcaccaacagcagcagccccttggcaacatgaaaagctgtgtggaaaggaggtgtttggtacgggagaaggaaacacagatggagactgtgatctcagatgcttcgggtcagtgtcctgagccacaaacgtctcgagagtccccaggaatgcgaacgaggtcgtcatcacagcagattgttctccaaggctgcacagaacagagaaggtgccctccctcacaaggaacgtccaaagactcagttgacattggtaggccagcagaagaaatatggactctataaaaatcccacaggcccttcaaccaatagaccaactttgctggcaaacaagccagcagtcgggaccctgggttctctaccatctactcattggcgatttcctgtccccggccatttgaatttggcctccctctgtcatcctgagaagagaagagcggtctcagctgaagcgcaagccaagtcaacagctcctcagaagaggaattgctgtcccccctccacagactaactttggggtaggtgggagaagccagaggggacctgaagaactttctgggtacgcccaacctaatgagccccctaaagaaagaaagctttcagggacaggatataagacctccagaggcccccagggtaggaagggagtagctgcctcctggaagattaaccaaagacccaacacagagacacaaggccattctggcccctgatctcttttctggagcagctatggtcttaggggattgaagggagaccccagaggagaagccagagaaggtgacagccaaagggatgagcagatggcctgtggttccatctctggaggtttgaaaccgtcatggtcattggaaaggatcagatgtgaggggttaggca

SEQ ID NO: 29199 - DNA, 3942 bp, Mus musculus
gtgtgccctgaagacagcacgggagggcagaccagactgctgtgcccattgggtgggtgtgtgctatacaggaggagtcgtaaaaatggaatgagtgagtgtgtgtgtgtgtgtgtgtgtgtatgtgtgtgtgtgtgtactcatacccatgtatgtgcagacatgtacctaagttccaattcaaatcctgcgttgaggcagcagagcagttagtacggcagggtaccaggatgtgtcagcatgcctgctatgggagggatcactggccacagctttcctgagggctccatgggaaaatgcacagggagacaccttctggggctcaccttctggggtgatgccttctcctttgctgttcatagagtgtcctgttgagaggggaaaaattcttccttccttccttccttccttccttccttccttccttccttccttcctgcctgccttccttccttcctgccttccttccttccttccttaaatcacccctactgacaggatcctcatgaaaccattgtcaactccgttctcatccgctgtagtctttaaccactgtcttctgttgtccaataccattttataacacacacccacctccatgttcatatcacacatgtgcttttgtgcatgacactgcagacgtgtcatgttctttcgaggctatgcacatatgtagactgtgatgggagaagggacggggtgtggttggtgggaagggtgttcagagaggtaatgaccactgggtgacggcagtgggggtgggggttggttatagactcattccgggaagaggggtggcgtgctgcaggatctcccctcccacctgagccttatatccagaggtatggctaacgcttgccctctggctgaagtcctgtgtttgttctagagaccagcccagtcccaaacagcctggagaccaccctgcccagctaagctgtgtctctgccagggtagggaagggagtcaagagggaggcagatcattcaagtgaaaacctgtcccaaccccctaaggggtgcacagagctgaggctggaacacacaaatgctctgaggagcaatgggaaacacaaagattggtttggatggagcagatgggacatacctgagcaggaccatggctggctggctctgtctgatcatataggccagccccgaatagaagaatgcctcacacaactatgtctgggcttgagctccacctatttataccagccctgtggtggggcagcacccattctgtccgggccctgggggctattggacaaagactgcctctaccttggcctgtgcctgctttctcttatggacagtcactgatgaaatttgagcactttgtgggggctcaggtggctcctgggcagttgtgttggccagtgagttggacttagaatccttgaggtaagagactgcccctcggtcagcctggactgtcacagctggaagagcacatgctgagccctgcctttgtagcatgcaatgcggggaggggtgtgcagattaaatatctccacgagggagcggaagtcagaccaggctcacgttcaccaagaaccgtctgtcccttcctaccttcctttctggtccagggagggctgaaggtggggtgcagctgctgctgcttcatgccgcatgaggccatgctacacacacacacacacacacacacacacacacacacacacacacgccccaaagccattccctactgtaggcaccagcatctgaacatgacaaactccatggtccacctctggaattgccctgcgtggatgcccacctggaagggccttcatgccatggacaaacaaccgtatggagttaacatctgggacccacccagtccagtggacagatctgagaattgggtccaatcctgtgcgcagatctctgagtaagatatatctggatgtcccaggttgttggagcaaggtgcacatctggaataggcctaaccacttgccacggtggaaggggccttgcccttttgtctctgtctcctagagttgaaattttagagctgaggtatatgtgaagtcacagaattgttttagatagaaggctaatgttctgtacaatatatatatgaatgtaaaaaatatatatatgcttatatatatgcacagtgtatatatgacccacaacccctgtgtatacaacccttccctgcacgtctacacacaaagtgtacagaacccagccagtatgggtggggacccagtgagagacaggggctgcagcagagaggtcaggtttacacagccctctggatcaagccagaccttgccagcatcagtactgtggaccacgtcaaagaaggcagactagtgcggaggtgacaggaaagggacagccatggatgagcatctcctccagggagtttgtatgaggcaggacagcgggcacacctgaggaaaacggccttgctagtcgttgatccctgagccaatatcacagtctagtcccagtacctagtgccagaggaaaatggaagtagattgccaggcctgcccttatccctgcctgcagagtagcctggaaagttgtcaagctgcatctgaaatcacccagatgtcagaggatcctgggtggcaaaggcctcacatatgcaaggtgcccacagctcagggctagagcgtgtctcttttgaagagaacagcccgagggcactgccgacatgcccgttcagcatcctgataaactagttatgaatctagttcttctaccctcgccttctagaatagaggctcccaaatcaccccgcagctgtctggtttacttttatagaccaaaactctgaggcctcccagtagtagaaaaaaacccatagattcagatgctagctaagagtctgccccagttcattctgagacaggtacaaagtggcagggagctatcaaggaaccagagagattcaagatggcagcgcctggccttgcacagccccttactgtctgccagtcctcgttgttgttcttctcccaacagggcagctggtagaaagcctctgtcaggtaggtcacagacctctgtccctgccgcacctggatctgtctcttgccagtaatttgaggccttcatccctttcctgggtccgagcatctctagagtgtgctggggagaggagacctgggctttgcttttgtgtggtctgcagcctgccctttgcttcaaccccagcccttgggccatctacacttaaaagccaggcccgctcctgcagccacggccaagcgcaccgaaatctccagctgccgctgatgagggtcctgtcctggctccacagagaccagaggctccaagagccctcacgccactgtgctctgaaaccccactttatccctgcctgggctgacttcctggctgggcctccgtggtggggacctcagctcccagctcttgggctgagcccccagacagtaccatgggactctaagagccctggcctgtcccactacccagaccagagtgcctggacaccccctcccccaactcccactcaacaaggttcccacacactggtctctgggccattcagggggtgccctttgtggacatgcagaatttctatgaatatagttttttgtaaacattttgtaacgatttgggtttcatagtaactgtgttacttgccaatcattctaagcggatgtaaataaatttccaaacaaatctgattattttcctttttaagacactgtgatatatcaaagtgcacagtttgctgtatgaagtaatatggttttaaattttaaataaatgtttttagaaaatgggtcccttcccaaggtgtgttttctgtccctcatcgcccttcagaaccagaggtctcgggcggtccacgctggccatcttcctcccaggaatgacagtctccagggaaggacaccctgtgctgagctacttcaggctcctggttccatttcagacatcagggtga

SEQ ID NO: 29200 - DNA, 1106 bp, Mus musculus
tccatgctggtctaggattaaggcctttagccaaggatggccttgaacaacaacaacttcctcctcctcctcctcttcttcttctttcctcctcctcctccttcttctcctttttgttttttgttttgttttgtttgtttgtgtttttttcgaggcagggtttctctgtgtagccctggctgttctggaactcactctgtagatcaggatggccagactcagaaatctgcctgtccccgtctccggccgccatagggagaggagccgccgccatgtccgcgcatctgcagtggatggtcgtccggaactgctccagtttcttgatcaagaggaataagcagacgtacagcacggagccaaataatctgaaagcccgaaactccttccgctacaacgggctaattcaccgcaagaccgtcggagtggagccggcggccgatggcaaaggggtcgtggtagttatgaaacgcagatccggtcagcgaaaacctgccacttcttatgtgaggaccaccatcaacaaaaatgctcgggctaccctcagcagcatcagacacatgatccgaaagaacaagtactgccctgatctgcgtatggcggccatccgcagggccagtgccatccttcgaagccagaagcctgtggtggtgaagaggaaacggacccgccccaccaagagctcctgagccccacaccccggaagcaataaagagtccactgacttccaaaaaaaaaaaaaaaaaaaaaaaaaaaaaaaaaagaaatctgcctgcctctgcctcccaagtgctgggattaaaggtgtgcgccatcactgcccctctggccttgaacttctaatattccttgccttctaatactccagtccaaccttcagagtgttggactggaggcaaatacaactacacttagctggtacttgatataggattgaggagaggggtgactgtggtggtttgaatgagaatggccccaaggctcacatgtttgaatacttggtctccaggtggaactgtttgggaaagctgaacgggcgtggccttactggaggagctgtgccacccagttcaggctttgaaatttcagaggctcacgctattctgtcc

SEQ ID NO: 29201 - DNA, 2185 bp, Mus musculus
tgcccaagcggcaattcggtagcatgccaccggtccgacggctaggccacgacgcacagccaatgacctccttggacacagccatcctggcacaacgctatctgcggaaatagtgccctcagctagggcactagcccagcacacctcttctcggcccacctgaggcccagccatcgggcctgcctgggcccgggcccagcagtgctggactgattctcccaggctgcagtagggatagggcagggatagggacagcccaggtcacagccagggtcaacagaggtaccacagagctaccttttgggatgattgcttgattgtttttttatctgagaattctagatagatagctaatctgcttttaatcatgacattttaatctacctctgtctctttaaccacgctgtctctggactgagtgtcaggagggaagaggggagtctacgctcacaacccaggcactggacagctgcagcctggctaggccactgaccccacagtccatataagctgaccatgcagctcgctgctggcccccagtaagcaccccttcccaccgtccactccccgtccccgggggcctgccctcagtctaagctttggaacactctcacctcacctgccgcccaagtcaaatctatttatttttttactgaacccaacttgtatctctaggttcagcccttggccactctggccctgagcctggctgaatagcagggcccgtgtgtgtaggctcccttctcaccccaggcacctaggagccctcttgccagttcctctctcgctctgtttccagacctgtctctctctctgtcctggcagcttctctgaggtgctgctcgtttgcattagtcccgcctcctccatctttcatgtggtacccaggtaaatgtggacatagtgtgaagggacctgtggccaccagaggatgctctgggcctactgaggacaggccacttgtgctcagagaacctcacctcaccgcagaagtggtgcctcttccagaagactctggaagattacctacttgggggtaggccttggagggaaatctgtaggggtggggaccttcctaccttcctggcttgagaacagccctgctaccctttttgagccgaaattttgaagtggatgcccgtcttgccagaaacgctgttctctccagaatgcccctccctgcactggacttggcacacccaaaaccaagcaaagacccaactccggaggcctacctcctgtgtaccctcagagagggcaatgtcaccctcctggtaggtagtcctagacccctcctgcctcttgctctccaatggggagaccatgtttcctagagtgtgagctgcccctcaccccctgaaaagctgactcactgtgagtgaccttgggcaagtccccaaacctccttgtgcctcagtttccccatctggaaaaaatggggccacctcttgccagcagtagcagggctgcccatgccccttcctccccatgccccatatccagccctgggctcctgtgcctctgttttgctgggtctgtggagcccacttgagcccagcagttaactcccctggcactcagctctgcctctagttcagccgcccagccactgagagtcagggcatggtgctgcgggggagggctcttttctatatttatttgatagcgataagtctccgaagggagtggaaatgcagtcagcctgggcccttagcccatgactaccctccagtgaggctctgaggcctggctagggccctcctgggcagagcccctgcctagcccttcaggcctgatgcctcaggcctgattccctccttttaaagcaataccttcaggtctgccatgccatcagccagcctggttccttctgagggcaacctgggtctggtggtatttctggtggtgcagatgaggggagggtggggccctcgctgctgtcaggcactgagaagtcctgttgtaaagaaaaacaaaaacaaaaaaacaaaaacaaaaacaaaaaaaacaaaatggaaaaagtcacaaaaaagtttgtataaagacgtatttttgtactacatggggactcttcctgcatgtcagcaataaaacttcctgatctggagccaccatggtctgtagcctgcctctgtgcttgtccgtgcgctctctagccctccctccatccctgctcacagcctgg

SEQ ID NO: 29202 - DNA, 2221 bp, Mus musculus
tgttagtataactttcaaaattcttttgaacaatggtattgtaaatactaatagtatttacataatggtagtggtggggtaggtggggttaaatgagatgatgcctcttggtcggtctgcgttttgaaggtgtcactgtgcagtgtttgttctgttgcattagttcttggagttccttagttacagcagggatgttcctcggtctgagcctgtgggagctttgagtgggagaagggcagaaaagaaggctgcgggaggcataggcgctctggcctgtggatgggtagagtgctagcactgatgccagtcttcttcccttgcagcatgacgaccgggaaggcgagggcagcgacaagtggatgggccgaggccgaggccgaggagcctttccccgggggcggggccggttcatgttccggaagtccagtaccagccccaagtgggcccatgacaagttcagtggggaggagggagagatagaagacgacgagagtgggacagagaacagagaagagaaggacagtttacagccctcagctgagtaggggccgctcttgatggagcccttgcccggggaagaaaggcgctgggagaggctggtggagctaaacaaggagcctcaagaagatcctgaaaacgccaccccacaacccacttgccacacagaatccatcccacgacagcagagtgtccctggtgccatccgtctcactggacagaggacaggacgttgccaccgagcctagatgagaccacacactgggctcctgctgctgctggtggtgtggggggtgggcagggtagggagaaggatgctgatgcttggactttgttttggttttgttgtcccacccccactcccaccccaattagaaaccaagttttcttcattgcatttcatttggaactaaatgggaatttggttttcagtctcttcctgtcctgagttttattaagaaatccttttttctttttcttctttttaggggatatatagtaatattagtgtaaagattttaatttgggcaactttgactcttaagagaaaacaaagcatgtgaataaaaattgaagtgttcacctcagtttgggaccaaactgcttggatcttgtacaaaccggttttgtatgttgaggaggagtttaaggcctttctgaccacctcgtgttcccctttctacacagccatgtatcccgtggagttgctcccagcctccccatgcaccctgctctgtctcatttctcctgggctgggcttcccattctccaccagcagctccagtgtcccaacctttgtagtcctgctggtcttcagcaagaggagtggaaactggagggcagtttctggacggttttctaagaaacttctgaattctattatctttacaaatacaagatgagaaaataattttttcaatattttttattaatctttttataaaatgaaaagaaacgcctatgattaaggatggtggttatggctgggtggtctgtggggttgtgtgtttttgggtttttccttttttttttctctttaaccttacgttttgggttgaaacattttcagatgttggggggcatcctcattaaagggtccttgtgcttgccttccggggcagcggtccccagcaggtgaaccgctgcctgcgcgcatctgttggacgccgactgcaccctcctccctccccagccttcgctcttgggttgttgtgcatacttccctttactttgctaatttcaatagttatgttggttttacttgaatgattcatgtttaggggagaacaaaaaaacacccttaaatttttgtttcaactcctcctgcaaataaaaacaataaatgaagtggcagatgtaaacggactgtgtttgttgcttgtgtgagtgaccctgggttaataggtcccatagaatataccatagttttcgtctctgggaagaaggacttcttgttctcagtggaggctgtgcattctgtgtttttgactcctccaagaaccaaacctagctaccatgccagaagtcaggactttggcttccttggtgctggggcaggggtcaaggctgcagtgagctggctcggcctttatatgttaacccacaaggaagaggtgagcctagcccaactggtaaactgggtggaccctaaccttcagactcttgccagcccttattaaaagttgattcttgctgcctttccccaaggagaatctgcagtagt

SEQ ID NO: 29203 - DNA, 1127 bp, Mus musculus
tgttagactgataatggaggccatggttgttttgtgttcttcatgtgtgatgcatactcaccacgggcctagaaactgttgtgtcactgaaaatgactggggaacagagaggaaaccccaggtctactggtgggcaggggtgaaaggggtgaacaggttggtgttgacttggttgtttggtagtttggctggctgacagaccagtcttgattttgtttttttgtttctctctcttttgtttctctctctctctccctccctccctccctcccttccctctctctctctttcttgctttcttgctttctttctttttcaagacagggtttctctgtgcagccctggctgtcctggaactcactctgtggaccaggctggcctcgaactccgcctgcctctgcctcccgagtgccgggattaaaggcgtgcgccaccacacccggctttctttcttttttttaatgtaggaagcaccgcagagcaagagaccggtccaggtcctcctcctcctcctcccagtcctcccattcctacaaagcagaggagtaccctgaggaggcagaagagagggaggagagcacctcaggtttcgacaaatccagattggggaccaaagacttcgtgggtccgaatgaaagaggcggcagagctcggggaacctttgtaagggcctcctcctaatcctagtgaaatctcagtaggataccagttcttttgcctctggtctgagctagctagttgtagattgtttggcttcctaagcttctacattcacttgtttctctgattctaatcacttccaaagccttttatagcttcccctcccagacttttcccctgcaccttagatcctgattgaaggaaggcctctgactatgtacaccccctggactgtctacttgggaggggtggagaaaggattgggtagaaactagtttaagtactagtgactcgaaaccagcttcccattccttgtcacaaaatgttctaacagaatgcaagggacattctactgctcatatgagtctctgttcctgttgctgcttttattcctacagcaatttcgtgcaagagggagaggatggggcagaggaaactattctggtaacaataacaacaacagcaac

SEQ ID NO: 29204 - DNA, 1761 bp, Mus musculus
tcaggctggcttcattctctgtttagcagctaagagtggcttaaacgcctgatccttatttacctcccaagggtgggttgataactgtgcactgcattgttactgctgaagaggggggattcccacaggaaccttaggagtgagtgtaaaaaggtaattctgctggttctttctgaaatacgcctacccctgagttgcagtgtaacttttaataagttgcttgagcaggtttctatagggcagtgccagccctaccaaagaacggtaacggggctaccaaatcactctaaggtgtcagaagaaccaagctcgcagaagtagacacctcaagatattctgtagtctttcttaattttgggggagtgggtgggttttaagacagggtttttctatgtagccctggctgccctggaactcactctgtagaccaggctggcctcaaactcagaaatccttctgcctctgcctcccaaatgctaggattaaaggcgtgcgccaccactgcccagctctatctatctatctatctgtctgtctgtctgtctatctatctatctatctatctatctatctatctatctatctaatatgcctttgtattttgcctgcctgtgtttgtgtgagggtgtcaaatcccctggaactcgagctgaggacatgtgtgaactgccatttgggtgctggaaattgaacccagaacctctggaagagcagccagtgctgtgctcttaaaccactaagccactctccaacccccgagctcgcacctgccccgttgggccagcaattaaaagcagttgtttgattcccagcatccatatgacaagctggaaccatccagccctggcaattaatgaacaccttttggcttcctttggacactgttggacactgcatgctttagtgccagagtcaaggacaatgattagattttatgactattcttattactctgtctctgtacaggtggcaaaaacttgtttgttttgttttgggtttggtttttcaaggatagggtttctcttgatagactggtcttgaacttactgcctcttgcctcttgagtgctgggatgaaaggtatgcaccaccactgcctggctcaaattgggacctcttgagagtcttaacttctcaaaagtcttgcactgagttttggagcggttgggtttttacatcctggtcatgagaagaacaactgtaagtctctccttttcataagtagttattaaaatgagggggagctgaaggaagtaggaggacgtcttagtcaaaggtctctatttttgtatgaaacaccacaaaaagcaagttggagaggagaaggtttatttggcttattcttccagatctatagtccgtcgctagaggaagtcgggacaggaactcaagcaggacaggaacctggaggcagagctgatgcagaggccatggagggtgctgcttactgacttgcttccccggcttactcagcctgccttttatagaacccacgaccaccagcccagtggtcctgggttccacagtgggctgggccttttccccactgatcactagttgagaaaatgccttatatttggatcgcatctgagccttctttctgtgatgactgtagtttgtgtcaggttggcacacaaccagccagggcagagggcaaagtgcttttttttttttttttttttttagtgtgtatgaatgttgttttttcctcaaatgtctatgtaccatgcgtttgtctggtgctgaaggaagccaagaaagg

SEQ ID NO: 29205 - DNA, 1166 bp, Mus musculus
taaggcacagttctactgactcttaaatgctgagttcataaattgttagaacaggtagacaggtctgataaaactggaatatagctatgaaaccagagcaggaacaggtgctgtgatggagcaggacgcttaggaggcctcctgtgtgtctcccttgtgtctttataactaggtatctggaggagcagaagactgagaatgggaaggataaggagcagaaacaaacaaatgccgataaggagaagctgaaggagaaagggggcttctctgatgctgatgtcaaaatgaaatctgatccatttgctcccaagacggactctgagaagcccttccgaggcagccagtcgcccaaaaggtataagcttcgggatgactttgagaaaaagatggctgacttccacaaggaggagctggatgagcacgataaggacaaaagtaagggaaggaaggaacccgagtttgatgatgagcccaaatttatgtcgaaagtcatagccggtgcaagcaaaaaccaggaggaagagaagtcaggcaagtgggagagcctgcacacagggaaggaaaagcagaggaaggcagaggaaatggaggatgagcctttcacagagagatcccgaaaggaggagcgtggagggtccaagaggagtgaaagtgggcacaggggctttgtgccagaaaagaatttccgggtgactgcgtacaaggcggtccaggagaaaagttcatcgccgcccccaaggaagacctctgagagccgtgacaagctgggaagcaaaggagacttttcctcagggaagtcttccttttccattacccgggaggcccaagtcaatgtccggatggactccttcgatgaggaccttgcacggtgaggagcgctccttgttgaccctcagggctctcaggcctaaatagtttccttacccagccttcctgaggatggaagtgttgctttgctgccaccgtcggtgccagtacctttatgtctgtccctggagtgcagatgattatggcttacagtgatggtggcccctgagcattgttggcctaaagaatctttcagcccttgctggctgcctctctttgtgtctgggaacttggagcggccattctggtctgttttccctccaagccgactccacccacattgttttacctatgaagac

SEQ ID NO: 29206 - DNA, 1202 bp, Mus musculus
tgtttgtttgtttttttttttttaacgagaatgctgtgtaaaaaaacattccccattcccttcctctgcagttctaggtctcgttccagatcatattctccagctcataacagagaaaggaatcaccccagagtgtatcagaatcgagatttccgaggtcataacagaggctacaggaggccctattacttccgtgggcgaaaccgaggcttttatccatggggccagtataaccgaggtggctatggaaactaccgttccaattggcagaactaccggcaagcatacagccctcgtcggggccgttctcgatcccggtccccaaagagaaggtccccttcaccacggtccaggagccattctaggaactctgacaagtcatcctctgacaggtcaagacgctcctcatcctcccggtcgtcctccaaccacagcagagttgagtcgtctaagcgaaagtctacaaaagagaaaaagtcctcttccaaggatagccggccatctcaggcagctggtgataaccagggagatgaggctaaggagcagacattctctggaggcacctctcaagatataaaagggtctgagagctcaaagccatggccagatgccaccacctatggcgccggttctgcatcacgggcctcggtttctgatctgagtccccgggagagaagcccagctctcaaaagccccctccagtctgtggtggttaggcgcaggtcaccacgccctagccctgtgccaaaacccagtcctccactttctaatgcgtcccagatgggctcgtctatgtcagggggtgctgggtatcagtctggagcacaccaaggccagttcgaccatggctctgggtctttgagtccatccaaaaagagccctgtgggtaagagtccaccagctactggctctgcatatggctcatctcagaaagaggagagtgctgcttcgggaggggcagcatattcaaaaaggtaagtatctcgtgtccccatccccaagtggtccctagccagcagcttagttgtaatgatagcgcctgagttagtgctctgcttaacagtaatagagtagcacctgttccctgagttcattaaaggcatcacccgaggaagccttagcttaactccagctttcctgaatacttattgtaatacaagtttcttccgattagtcttcagtgatgtttattcatttaaaaa

SEQ ID NO: 29207 - DNA, 1541 bp, Mus musculus
actcccaggccagcagctgcaggctagagctgtggactcctctgggcttcccagggaggtgaggtgttaaccctgaacccctacatccacagcctgccaagcaaggagatgccagggtccctggtaaatggcctgcagcctctcccagcgcaccaggagaacggcttctccccaaagggaaccgctggggacaagagtctgggtcgcacagcagaggggctcctcccatttgcagaggcagaagccttcctcaagaaagcagtggtgcagcctccacaggtcacaggtggggactctagggaccctggttctggcacccagctgcatcccacccatccctgcctggggctccccgggcctaacctttatccctctcccttcccttagaagttctttaagcaaattgccttggaccgaggtgcagctgtgaaggttcctccatatcagctcgtgggtgtctggaagagaaagagacagaacaaagatggaagtggcctggtggacccctgggggcagagttcctctttgtttttaatccgcaccttacagactggtgatgtctttggctgaaagcaggactgcccctcagtacatccgtgtgcttacacgctcggacacccatcttccccatacacaacacacacacacactcatagcctctctggtcttccccctggggaaggaccacttgtagtatttgccttggtttgctggggtacagtggatgtgaatactgtaaatagcttgtgctatgtggaagaggcgggtagggtacaggaggcagaacccccctcccaagtctccctgggcagatcttcctctatttaactgtaaccgagggggaacccaggtctgggaatggaggggcacctcgggccacacaatactggttgcttcaggggtgatgccccctgtcctcgcctggaatcagtgttattacatctgatcaaacttctccggaaataaagggagaaaaattctgccaaacctacgtgtccttggatctgggggagggggagggggaagagaggtacaagtaggtgacctgagctctgagaccttcaggagcctggggctggaggctgctacaccctgattggtgtagcagtcctggcctccctgtgctatggtttttttagtttggttatgaattccttcctttatttcctcaacagatattaattgctgtgcgtaacctagaagtacagaactagggaaaggcacagcctctgtgcgtgtggagtttctacccagacagcgagcatcacagaagctgggctttctgctcagcatccctctgccccttattcctgttcactacaaccctgacctctccaggtacccaagttctttcccagtaccaactcaccttagcaaaggtggcacctagcccacctctggccagtgaattatgacttcggtgacccaaaaatgatggccctgtgggtcatggataggcttgcatgtgtgcatgtgacagttccagccagcaggtgtgaagagaagtctcccgagagttttgtaaaggaaccccatgtgac

SEQ ID NO: 29208 - DNA, 1219 bp, Mus musculus
tccaccatctgtgcctcttgtgttgacctgctctgtctgatgttgtcccccagatcgcagcctgcagctgagcgcatgggagagcagcattgtggatcgtctgatgacgcccaccctctccttcctggctcggagtcgcagcgcggtcacactgccccgcaacggcagggaccagggtaggggcagcggccctgggagacgccccacgagggcccgggcaggggccagcctcgcgcccgggccacaccccgaccgcactcatccctctgcagccgtgccagtgtgcccgcgctcggcctccgccagccccctgacgccttgtagcgcccctcggagcgcgcaccgctgcaccccgtccggggagcgcccagagcggcgcaagcccggcgccggtggcagccccgcgctggcgcgccgccggctggaagccacgccggtgagtggccacagctaaggtgggaacaggctgcctccaggctggagtgcgggctctgctaacctaacctaacctcttcttctcctcctcctcctcctcctcccttccatccttcgcctccaggtgcagaaaaaggagaagaaggacaaggagcgggaaaacgagaaggaaaagagcgccctggcccgcgaacggaacctcaagaagcgccagtcgctgccagcgtctatcagacctcggctctccaccggctctgagctcaggtgggcggggcgctgagctcaagtgggcggggctcacctcacctggactttcactcttgtcaatcattcccaagtactttttaataagagcagatttttccgtgttcttgtctctccatttctctttttcttgattttttttccctttgaaacagtctccaactcctgagccctcaccatattcttacctacatgagtttaggactagaaatagattcccgggcctcccacacgctaggcaatcacccccatcactgagctatatacccagtcctttcagtattttgtctttggtttttcaagacaggatttctctgtgtacccgtggctgcccttgaactctagctgtggaccaggctagcctggaactcacagtgatctgactgcctctgcctcccaagtgctaggattagagtcctgtgccaccctggctccgccccttttcactaagttgcccagccctgaacctgtggtcctcatagttgctggggttacagcagacctgtgccaccgcactttc

SEQ ID NO: 29209 - DNA, 1099 bp, Mus musculus
gtagggatggtggacattcttgcatatgtagggatggctgccttctctggttcatgactttcctcagccctcacctagtcagcccacttccctgaccaagtgggaatctgggacatcgaataggcaacccagcttgggctccaatttgggcacagtcagctgcccgagtgacacactgaggatgagggcctagtctccttcccgcagcctgcaactgcaaggcagcctagtggactgctcacttcagtttccaaagggggaatctgcctgagacagcaaggaaaaaagtcctgcctgggactctgagtccttttttttttctgccacacctaagaggaccagctagagactagtatccctgtggggccttttcagtctcctccttccccaggtcaaagccactaatccaatgggttctggcggtaagagattagtcaactcccagagggagccctgaaggctggttcagggcagagctgccagaccccaccccaaagcctttagagaaggattctgaaacgtctgtggattggagctgtagatgtcactgaccagcgttgacaaacaatgtcaggctttaactatgacaactccacttaccttgtgcatttttgtattttggttcttcttcttctttttttttttttttttaaagattaagcttttccacttgatatttcatttctaacctggtacaggaagttcctctctacttaccacatatcacatatcaggttcaggaaaaatgcaccgggaatcagagaaaatgggatttcttttcaattgaaaagacaacgacagtgctgttattgaccacccccaataaaacctgttgtagaaacacatgctctgactctggcctcgatacagacatgtttcatgggcagccaggtgcttctctggccccttgaggaatcgtctccattacagcttctcattcaggctcctgaggcccttagagcactgcctgttcccctgctgccgcctcagcgccaccaggcaaactcggaggcagtctatgaaacccaagaagggcagtggctggagccggattgaactttgctggaacattcctgtaagctctcaggagcggtggagc

SEQ ID NO: 29210 - DNA, 1179 bp, Mus musculus
tgcctggtacctgtgccctgggcactgtgtggaggccttcacagtgacccgcctttcaacagccctgggagagagagagagcaaggattaaagacgagcgcaggactaagtgggacccttgcctggccaccagcaggcttgttgggtcccgagtagtcttacaatagagcctggggtctcaggcatggccctgcacaaagctgggagtgccagctcttggcaggaagcaaggtcaagttcctgtgccctggctttcccacagggaatggcattgccgcctttgaatctgtgcccaccgccatctactgcttcctgcgctgcatggagcctcaccctgagatcccctccaccttcaacagtctccagaggactctcatctactccatctcacttggtggggacacagacaccatagccaccatggctggggccattgctggagcttactatgggatggaacaggtgccggagagctggcagcaaagttgtgaaggctttgaggagacagacgtcctggcccagagcctgcaccgagtcttccaggagagctcgtaagggccgcagcttcggtgggcttgtcagacccatcaggaccaaggacaactcagattggactccacagttcccttaggttgccgcacctgccctcaatcctagagggaagactgaaggtacccttggggctggaatcttgagacagcctgtggaacagagaggagctggtgccttcttggggctgcagctctggcttgctgcagggctgtatgacacccagggtcctcagaaatatgaggggccagggcaggtcttgttttggaggggtatgggtggcactctttgtcatccaggacatggaacttgggaaggtggaatgacctctgggaggatcctatctcccggttgggttctagccagtgtgacagcctagtgctgagtgggcggagccagcagcaggctgtttggctcctgagaccggcattcagcccagccactggctgcctggcccggcccctcactgcagtgggctccttgacagcttctggtggatgtcacagcaataaacagttttttataaatcccagcatgtcctgttcctgtctccactggtggattgtctttaagtagtaactccctgcctggactgcatctttccagtactggacacaaggcagtagctgc

SEQ ID NO: 29211 - DNA, 1311 bp, Mus musculus
tgctttcttaaactattcattcctctttcatatttatttatttaaagttattatatagatatatttatcacatttgatttactggtgtgtaaaaaatgctatacaaaaagtacatttttagggcctagagagagatgctcaaatgttaagagcacttattgtgctgtcagaaccagaattcagttcccagcacccacactgacagctcacaaatgcctgggactccaacctccccccaccccggggggggtctgatgcccctcctggccacagtgggaacatatgcacataagtaaaataacaaatttatacacaccaggcatggggtcatacatttgtgtttctgatcagcctgggcaacataagaccctgtctctagaaaaagaaaaaattcaacccatctctagtcaggtgtgagctgtaaccaatgtgactgttaaaaggtctccctaaaagggggctattaagaaattattatgcctttgagagtagaaaggttggcagagcatatgccagagacttgcctgtcactcacactggctctgccactcatctgttccgtgacctctggctttttcttccccctctctgcctgtctccctggagtggtggcacctgccctcacctacctcaccaagtccccttgagaatcagtttgtgaataacccttgacttcccccagagaaaaagctattcagaagttcagaatggtagagagggtctgagggctcctttcctgttggtctctgtgaaagtgtcttcactacggcagatcgtttttatgagacaagcatgagagacatggaggcatcatgatgtggtatgtcctagctcttccccgccagaggtcagtgcgtgggcacatttttttctttgtactaaccgctggcagaaacataagttttcaaaactaaattcctttcggtggtgctaaagtagttgcagctgcactttgagttactggggaggccatcaggctcccagagtttattgccccgttgtctccaggtgcctgtgtttcctgtccacctcagctgctgttctgccaggccttccccagtgctccttggcagatacttggtccgtttcccttggagaggtgggtgggttctaagagcaaagtgtcctgatttcacttgtcacttggcttcaccttaaaaactcccaccatcatttatctataaaagttagagcataagccagacacctctagtcccagctcgcaggaggctgcagcaggaagagcacaagtttgaggccaaggctacttagtgagatcctctctcaaaagtcagagagactggccagctg

SEQ ID NO: 29212 - DNA, 1170 bp, Mus musculus
tccttccttcacccacaaagtgttcactgaatgtcagcatgctgattggacgagcttgttaactgttaaggagagactgggtcaagtggctcttttttttttttcccagccagtatagctaggtcaccttgaccactgtatcttcaattttattgtatgtcagcattgttccaagtagatgggcatagcatccttttacactaatgttcttgaggctgtctgaaatccagttttcttttctgaaagcttttgggtacctgagcttctgtgggaggctccacacacccagatacctggcatccatcggtgccacatcaacaatgaaatactgggtggtttgtttaagttcacagtccacctcttcagagccgagtatctgtgcagggaagtgtaggtcatctataaaagaaccttcgagaacagtcctgtgagtaaaaaatctgtgcaccttgctcagaaggcttccctgtgtttgttttattcttcccagtaatggactatgtgcacgtctgtaattttgtgtttgcagtttaagaggctatatcaggctagggatgtagctcgtggagaagactgcttgcctcacatggttgaagccctaagttcaatccctagtgcttcacaaactggcttggtggtacattcctgtaaccccagcactcaagaggatcagagttcaagattctctttgattatgtgctgagttggaggccgtcctaggaaacttgcatctaggcttcatcagagactggatagggaaattaattagtctggtatttcatgccaaaagctttcatcttcatgacttttgtttgaaaaaagaaaacaaaaaacaaaactgcctagacttagctgtttgataatcctcagctgaaagaaggaatggttccagtctcgtatgtgtgtgtggctctacccttattggaggatccgtggaaacaggaaggaatctatgaagacgctgaccagtaaagctgtgcaagcaggcagtgaaggggaatggggagacagtttccttgctggaatcctagaaaccatgtgttagtatttcccaaattcacagataacagagcagttgctgctgtttgacacagatgtcaaggaagggtttgtattagctctttgtcccaaacccagagctgtgcctgctcttggcaaactaacatctta

SEQ ID NO: 29213 - DNA, 1107 bp, Mus musculus
aatgtcaatctgaacaacttatagaatcgattctcttgttaagaagagttgagagtttaatgtatattcttgatggcaaatgtgtctgtagagtgtgcatgttacatgtctatattacagtatctaagcactggcattgataccatatattaataattctgtagctgctatatttattgaggcagagtctgacatttactgcactaaacaatgagacaagcaagatgccaggcagtcagacacttttggtttcttaggtaagtttaaggacataaaacatgaaggtaacgaacagcgggtacttgaaacagtgctggcttcagtttagtaacagaatacctttgctttagaaacgtggggtttttacattgacatccacatgagggtcttcagtcttctcagtcctgggcttgggcacatttctacataaatacggatgaccttttattttattaatagataattatcttttaacaattttccaggaaaaaatagtctggaaatacctctgcttatgacctattagtttatttttgttcctaaagagaatctggaagggactccagtaggaatgttctatgtgttttggaaggcatttgataaagattcatctctaccttctagcagagagactcctcaccttcaaaagacccaacaacttttctaagccaggctctctatggtgccagtagcctaataatgactttcatcgtgtcttgtagatcgcagggtggcaagtgtgtcttggggaattaaaaccagatgctgctgagtagaaatggctcgagatctcagtcacaggcggtgtgagcacttggagcccagccatagaagtgaagcccagagagctatccatccaaaacacgtggtgggcctttcagatgcttaattcttaggaaattcactttggacactggtagaatagtttgttccctttctgattaaaatttttagagtaatgttttgccaggaagtttaactgacatctctgcataattttgactgggtgtcagtaaactaagttatatgttcagttaagccaagttaaggtacacctataagcccagccctcaggagcatcagtaattcaaagccagcctcagcaac

SEQ ID NO: 29214 - DNA, 1142 bp, Mus musculus
taacccttttaatgcctttacctcaagttgcttagcagcacaactatctctgcaaaaaagtaaagaaaaattgaatggtggtttaaaaacacacaattacacaaataatgattgttcagttatatgtgcagaaaaagtaatgtgcatctattcttgtaaaggagtctgtattttcaataccctcacattacttcatgtgcatatgtatctagatctaggttactgatgtatatgtgtctgtgtgtatatcttatagttcatttccctggagaactctttccttgtatccctccttaggccgcactcgtttcctttactgtctcccttgccttcagcatctatactttggtccctatagctacaagtgacattcctatgttcacacatatggttcacttgaaggaaggtttgacaaattagacttctggttttctttatgtccctattcctagctcctttcactcacacaggagtcctcagctcctgacgccatgtttgtgagcgtctgctcccttttgctctggatttaccacatgtgcactgtgtttggaaacagtggcaacctggggattcttttttgtagtgagtttgttaaagctgctctaaatacgaaaccttgtcggacatctttctgatcagtgcaaatgttctaaagcctctgtttgtatgagttatacctggaaatccctccaaaactcgataggatggaaaaaggaaggaattagggttggtttggtttgttttttgctagtttactcactgcccttataccttaatgtgattttctcacatataaatatatacatacacacacacacattgaagtatagctccctttgcctttatgttcattagaatagtgctttaataattataaactatataggctatatcttttctagaactagaatcgtgtttaagaatggagacagttttttgctctcttttagtgcaataagcagttttacaggaaagttctgtctgtcatcctcaccgtggatagcaggaagaacagacatccgtagtttaaagggaacaaagtaatacagccttaatttcagaaggagagcttcataattttcagttttaaagcaattccttaaaataattttagccaaaggagtaaaaccgatcaaaggcgc

SEQ ID NO: 29215 - DNA, 4376 bp, Mus musculus
ttgtcctcaacccctctccccatcttgtcatatccgacccccttggaccaaaaggggcatcactagtacccaccatacacacagttgtctcatgtgactcacagtgctaaagactcatgctcaacagcctgctagggtcagctctgcagccctgtggtcaaatgctggtatgtttgggtttgctattctagatgagaaagtgggtgggaagagggcaggaatttttaggagccttaatcagaaaaggtctagatttgtttaagaaaaaggaaaacagactcagatcaatattttaggatactagatgttttcatgggttcagaatccactttgtaggaagatttttaatgctaatggtttgggttgctcctccccagctgccatcccctcccatcattcctctccacattctctaccccatgcaccttttccctgacagacatccagccctcgtaacacttaaggcactatggcacttagctctgaggtgacatgaccctgtcttccttccgcctgctggtgggtaaccagtgccttcccgcaacggtaatgctgcagaactgcaaccttttgtacctttctctgtggggtggggtgtgggtgggaaaggagggagggagggagggcagaaatagcccaatgccagcgagcctccagccagaatgccagctaattttcatttgaaggaattgacttccataatcattgagcttttaaaaaaaggtcacaacctcaagatggttaaaatccattgacatttgcactttcagacgtgacaagtctccgagctgctgagatgactggcccttggcctttcccctttagcttcctcttttccctggccccaccaccaccctgccagatctagagttactgtcatagtatttctcattcttggcttttttacccctgatggtaaagtctcgtttcaatatttcttaactggggtgtcttacagcagaagatcgtaaggactaaaataagaaaacaaaaaatctaaaggttatttttataccataacttgagtctattgccaaaatctggaaattccctcccatacctgatgagtctgcattccagaaacatggagccgtaagagggaactgtggaactgacttgtgttctggcctagctaagtagggggtggttgtctccccaaggtggggctcagcctctgtccttcctctgtgcagacaaagccttgttctcgagacagcctccctccagggcgctgtcctgccctcttccctgtaagtgcatcttccccttttctggactggactgtcctttgatccctgactaaccgagactctagcacgtcctctggacaggctggggaattttgctgctcccatttgcttctgtttacacaaatgaaattttcctgtttctcactagggcatgtgagtgggtggcatgggcttttctttttctacccctctcttgaggttctggggttcagctagctgtcttgcaggactggaaaagaagtgggttctagctttgtctttgctgaccttgaagcaaggccccctctttccttgaccattcttttttcttcctgcattattgcttgggatgggaaatttgaacctccgtgtacaggttccccttctgaggagcctgagcttaggattgccctactctggcgatgaagccatgatatgttagctctagcccaggcttagaggcccgctggagaaaggaagatctgaaccctggcctatggagtcaaaacctttccccaagagcccatgtatagacccagatttgctatgcaaatagtccagattcagttatggctggctacattattcagtaacttcccaacaggtagcacaaatattccttatggaaaaagcccaggactgttcagtagttcctcctgtacttttctgctggctacagtatggagtgccccatgggcacaggcccagccggagaacagaacggagggctctgggaagaggcagctcactggagagcctacattccttacacaagtgcctaaacagagtgatgccaacactccatctgccctgtccatcgccttcatagacagtctacttcgtgttccatcaccctttggggagggagctctttgcagacagtgtgttgtcaacttgggtacatttgggggcttggattaagggcactactccaggagggtccaatcattcaccagcatttgcagatgcccatagggaacaggtggctgtcacaactcccagcaacaagattttgttttctcctttttctttgcctcactctctccagttgggttttaagctagaatgaaaagcagtttcggtcctttggtatttatgtgccattcatgaaataaaagcaagagaatgctgggcacgatggcccatgtctgtaattctgttatctcagcactaaggctgaagcagaagatttgcaagttcagggtccacctgggctactcagtgaattccaggccagtgtgcactatgtagcaagaccatgtctccataaaaaagaccaagaaaaatgacttgggtgacagatcttgctgtgattttaaataattctttgagacttaactactgaccatgtgggttcttctcatttaaaggcagtatgcacacattacaaacagtgttgccaagcctcagcttgtttggatttggtttaagtggtgcattgtaccgagctctgggaggattccagcctcatcttagacagctctttctcctcccccaactccctcccatgcctccaccccacccccactgttcggctttccctttcctcttctggccttccctggcttccttttccttctccctcttccctcagcttgcttgctggctggcctgcctgcctgtctgcctgtgtgataatgaattctctgcatggctgcaatgatcccactgttagttggcaaggtcaggcttagctcattgactacagaagaccaaaatcctgtttctcatgcccagtggtgttagccctgggttgcactgtcctcaagcttacactaggtcagagcagcaggcctgtcaaactgacaaaactagtagggtttctggcaggttcaacacctctccattctgtggaggggcttggagaagaggcagtgaaggagaccgctgctttgaattcagtccagtgtgaccgattggttgaggtgctattggcagcctgttggggtcggcctggagctactgttactgggaacttaaacttggactttgactaaagttgaacagagtatgaaactgttctagaaatctagttctcaactgcgacatagctcctctgtgactgagcagcaaggctttccaacaggttccttttaaccagaattctatgaatgatgccggggacacagttttcttagctggcccatagaaggtctacaaggctgctaagtgttgtagacctggcatctggcatcacataggaggatggaatttcttccctttcaggatagaagagtcacctcttacctagccaaaaggcagttttgggaattcctgtcaggaggaaaggtttggttttgttttttaatttactgggctttagatggtagttcattatgccttccttgggcagggatcatggcagggatacgcaaggcactctaatactcggccttctaagcaggctgggaaagggggattctctggttttctctttctccccacttactaggacttgccttctccctgagccacgagagaggctgggttggtgctctccccttactctgctcctactgacttagaacctctggctgctgtatgatagcccaggaaagggaatggaaagaatgggctcaaaacaataatgtaaggaaggtggtttccttccttaaaaagggaaatcagaaactctccaagaattgtgtaagtaaagacaatgtgtctgaatgcactgagtcctctggtgtcatagcaataaggaaaaatgaattgactttctgtgcatacagtccagcctgactggtgtatgatgttgcacttagcagccatgtggtgggcatgtgtgactactctgggtttcactttattttctaaactttttattcctctcaagtccagcatggatggggaaatgtccctggagccccgcagctgtgtacttgtttgcatttgtttcccattgagacttgtgtttgtgtcctgctttgagctgtaccctgtcccgtccattgtgaaattatcccagcagctgtaatgtacagttcccttctcaagcaagcaacagcagcacaatcttgtgttttataaaaacaacagtggcttttatttctaaagtgcagtctgttttttttttcctaccacaaaataaatggttggtattaattacatctctcataggttttagggtggaataatagattgtca

SEQ ID NO: 29216 - DNA, 1151 bp, Mus musculus
agccactggcacaaggcagtttaaattgagacattgtggattcctagaggctgtgtcagaagaacgtaggtgtgggaatgagagcaaggtgatgatggagagaaaactgctaagagtttagagacccagagagagggattgttctacactttattttattatttctaggctagctcagatcgtttgctctttttccttttgtttttgctcgaccgactgggaattagaggttgtggaaggttcaggatagacctgagaacaggtgcttccccctcagaaggtctctgtgggtgttggtgaactgagggccaacagtgtcaccctaggttgtgagaagtgtgggttttaagctacactgtagactacaaatcagaagatgactttaatcagacctgccggttgataggaatgttgaggcttttggcatactgccgaggagtagacaatagaaagcagcataatacatgggacagtgcctcgattttgaagggcttgcaaaagcctgacatgatactctcagcttccacatgccacgcctgtcttctgcagggaggtggtggaatacatggtccagcatttcaaaccgcagatctttggggatcgcaagcctgtgtatgatggaaagaagaatatttacacggtcacagcactgcccattggcaatgagagggtaaggccagggatggcgctaggtctgtgagcccagggaagcccacctggagtctgtgagtccagcgagccttcttttcttttgtgtggaaaagtatattttggggcatgatgagtcagggtagatgcttactgtgtgcctatccctaaacagtgagattagattagacgtaaaaataaaataaaataaaatagaaagacccaaagaatttccttctagattaaggaggccagaagcactggggcatcatctgtggagattgggtgtgggtttttattctgggttttttttcttttttaatttaagatttatttattattattcataagtacactgtagctgtcttcaggcgcatcagaagagggtgtcagatctcattacgggtggttgtgagccaccatgtggttgctgggatttgaacttaggaccttcggaagagcagtcagtgctcttagctgctgagccatctcaccagccctat

SEQ ID NO: 29217 - DNA, 1186 bp, Mus musculus
tttttttttctttatttggttggttgttttttgttttgagccagggtcttgagtatcccatgctggtctcagactctgtgtattccaggatgacgttgaacttctttgtttttgtttttttgttttttgtttttttttttttgttttttgtttttttgagacagggtttctctgtgtagccctggctgtcctggaactcactctgtagaccaggctggcctcgaactcagaaacctgcctgcctctgcctcccaagtgctgggattaaaggcgtgcgccaccactgcctggcaacgttgaacttctgatcctcctatcttcttgagtggtgggattttagacatgtgtcaccatgctcaatttatgctgtgctgggattcaaacccagggtttgtgcatagtaggcagagcactctttttttttttttttttttttttaaagatttatttatttattatatgtaagtacactgtagctgtcttcagacacttcagaagaggcccggctacagctggagcaggaggaggcagagctcctcacctacactcgggaggacgcctatactatggagtatgtctatgaagatgctgatggacaaacagaagtcatgccgctctggacaccacccacccctcctcaggatgacaatgatatctacattgactcagttatgtgtctcatgtatgagaccacacccatcccagaagctaagctgcctcctgtttatgtgaggaaggagcgcaagcggcacaaaacagacccctcagctgcaggccggaagaagaagcagcggcatggtgaggcagttgtcccgccccggtccttgtttgaccgggcaacacctggtatgttgaaaatccggcgtgaaggcaaagagcagaagaagaacctgctgctgaagcagcagacaccttttgccaagcctctgcccacctatgtcaagtcctcaggggaacctgcccaggacagtcctgactggctcattggcgaggactgggccttgctacaggctgtaaagcagttgcttgagctgcccttgaacctcacgattgtgtcacctgcccatacaacatgaagaaattacattgagtgaacatcgtctcctgaaaacttccaagtctgagtgtggataagtcttggagggagctcagcaatgtcctctcggggatcttctgtgcatccctc

SEQ ID NO: 29218 - DNA, 1457 bp, Mus musculus
ctctctaggtcagaagaaggggactgtcgtcaatgatgtcaccgtctcctaagcggctaaagacaaacggaagcagtccagggccaaagcgaagcatcttcagatacttggaaagctaacgccatccaggatgccagtgtctgtggaaagtactcagagtaggtctggcggggagggtgggactgctgtttccgccgatgacctccccttccctcagaatcaactcgtaatgagccgagcttcccttctccccacacagctctcagcagcactcttctctcctagtgttatttttcagtttggccaccaatctcagcacaacagagtgcccagcatcgacttacagaataattgaagtctcacttcttccgttaagcacttgacattttttcctagcagtttcctgggttgacaccactttcaagtcaaggtgttcagaggaagaagaaagtgtggcattatagaaaattgcagaaagcactgaaagccagcctgggatgaggctcccacagccacacggcccttaacacagtaccaggccgagaagcacgcacccagctgttgcatcgtcctgttccttctgtgtcatgtaaacttctagtcttgatctctgattaaccttcatcgcctttgacataaggactcaagctggtacctagttgagaaagaggttatccctccctttctgcaccttccccaggactagagtttcaacttaaagcatttgttccagagcctccctcccttctgcagaaacctgaccactatttattgctgctttggggccgagtttcttgccctgaccatcagaggacattttaatatttcatcactaatattgagagcagaccagtagaatttaataaaaacgttgaagagaactgctattagtcgctttctttggctttcagaaacataggccagttctcttctatcagagcagaattcagtgctgctttgcaaaaaccatggcaggtgaacgttggcttcagtgtcgaaagctgagcgtgagaagttggatgaggttgtgtccgtcctttattgagagacataaagcagcctgttcgactgatgagattaagatgtaggttttctgttaggtgctggggcttttggtttgggtttttctaatactcaggatgctgacttggacagaacatacatttgtatatttgtaatcttgtaatgggagaaatgtgtacaaagctgttttaatatgtatgtaggttttcaataaatctcattgccttgtgggcaggatttgctgtccagctctagtggtcatttcttcggtcagtgcctaaggtgagagagggtttcattttcaggatgctccctcccgggaactctgcgaccagcgtagagggtgctgcagctgcccctcactggcttctccatccccaggaagtgatcagacaacccactcagtggtctgaactcagagctgctcatgtgga

SEQ ID NO: 29219 - DNA, 1190 bp, Mus musculus
aggattcatcagtggtcttaggggcctcggtcgtggcggaggccatggccgtggtcgaggccgcggggctcgtggaggtaaagctgaagacaaggagtggatccccgtcaccaagctgggccgcctggttaagtacatgaagatcaagtccttggagaagatctacctgttctccctgcctattaaggagtctgagatcactgacttcttcctggatgcgtccctaaaggatgaggttctgaaaatcatgccagtgcagaagcagactcgggctggccagcggaccaggttcaaggctttcgtcgctattggggactacaatggtcacgttggtcttggtgttaagttctccaaggaggttgccactgccatccgaggggccatcatcttagccaagctttccatcgtccccgtgtggagaggctactgggggaacaagattggcaagccccacactgttccatgcaaggtgacaggccgctgtggctctgtgctggtgcgtctcatccctgcccccagaggcactggaattgtctctgctcctgtgcccaagaagctcctgatgatggccggtatagatgactgctacacttcagccagaggctgcactgccactctgggcaactttgctaaggccacctttgatgccatctccaagacttagagctacctgacccccgacctctggaaagaaactgtcttcaccaaatctccttatcaggaattcactgatgatcttgtgaaaacccacaccagagtctctgttcagaggacccaggctccagctgtggctaccacataaggattttgtacaagaaaaataaaagaattaagtctgctaaaaaaacaaacaaaccaaccaaccaaccaacattcttgggccaggcagtggtggcgcacgcctttaatcccagcacttgggaggcagaggcaggcacatttctgagttcgaggccagcctggtctacagagtgagttccaggacagccagggctacacagagaaaccgtgtttcaaaaaaaaaaatcaacaaaacaaaacaaaacaaaagaaccaacattcttgagagcacaacactagaggagcaggcagcttatgaaggggacaaaggcaagggtttggggtatagctccatgatagaatatttgcctagcatgtctcaggccctaagtttgatctctagcactgaa

SEQ ID NO: 29220 - DNA, 2768 bp, Mus musculus
ttccctcccttcctttcttcctttctttcgaggcagggtttcatgtttcccaggctgggtctcaaacttgacttgtagccaagaatgaccttgaactccccagccctcatccccaccttccaaggattagaactacaggtgtctgccccacacccggctgggctttctttatctatcacggtctaccactttcagctcggttctgggccgccctgggaggaacatgcatgttatgcctgtggttctggtgttactgacaacgtgagacgggatgggaagaagttcagaactgttacctaagaaaggatgctgtgtatttcccgtgttcccatctcaactttgttttctctcttttgcttgtttcctcctgtggatagttctgaaagtgtgaagcagaggagtgatgtgttctaccttcagccggagcgctcctgtgttcctaacagtcccatgtggtactccacattccccatagaccctggaaccctggacaccatgttgacgcgcattctcatggtgagggaggtacatgaagaacttgccaaagccaaatctgaagactctgatgctgaattatcagattaacatgaaggaaagctcccgttttcatgcacactggtatgcaccaagctgtgatgcactcagctgttggaaagatgttgaaatgcaagtcctcttgacttgcttgtttggtgggaaaaacggtggctctgagccgtagtggactgcaaatgtaacctgaggggagaagggtgagtggattgggagggagaggagtggtcatagacatcttcgaaagactaaccagtttctgagtggtgcataatcttattttctttgggaataagaaattgtggaatatttttaaggaaaactgttgtataaaattctaccatagtaaccttagttagaaggggtagctttgcagtgagaccctggctgcagtaggctacttgagcaagctgtccatgaaagtcaggagaggtcactgcacagctgagagtggcatcagatgaggacagggagactcagcctggaagatccaataaaaatactcaagtttttataaaaaagatagtggtctggattgattttcactgccaacctacttatgtgaaggatagaagcctttagtcttttaactgaaggcccctcacatcagaggacacgcccttcattactgttagtgagccccttttcatttagggtcttgccttctcagctgtgggtgatttaaggtaaaaaggatgatatttcagaaaataactatgtacacagaaaatctgtggagctcattagaccctggtgtcttgaagtatttatagaaagcccactaaaatgcccgcttctctgggtgctgctgtctcctggcctcagctggctgcacagaagtggggcctccctttgtgtccagttttccccatggcatcctttcttccctgtcttactttcctgtcccaaatgatgctgcttgttctttgtcccagcttctagaggcccttgtcatttcaaaaagaataatctgtctccacaattctgacaaatgtgtgggcgatcccacaaagacacagtattatgtagctgtccgagttacggtagggaagattgcagtaggttcctgtgtaaaagcatttggaagttgaccttattgccccagggaacttgcaagttaggaattgtggggctggagtctgaggtgactgacctcacacatccatgcgacctttctgctgctgtattccagactctagctcgcacaggtctatgggaagcgcaaggcacaggtgtgtgtgacattaccaggtgtctccctcatctccattctcagtttctttcctacaaattttgaatcaagcttttaataatgttggataattactgagcttctttaattgacgttaacttgagcttacagcagacctgagagaagtcataagcttctccagactgtcacctaagacttcagtgtgtcccatgttataggtgggagtagcaagttggttgttttgttttaaacaaataaaggtcacttaaatacatcagaactttaaaatgggcctttgacgttgtgtacttagtggttctgtccctctgcttgtaacaaatatcctttttgttactaagaattatgtgaaagaagtaattctgccccagtctgtatgattaactccatctgtgctgtcatttctgacggggaaacttcttccttccagaccttgattgatcggagggaaagcagttggcctgtctgataagtcaccaataaaccatccaaaacaccaggtgtcatcctgctgtatcagttctgatttgtgtgaacactaacatttcccatctagagttgtatgaaaaacaaatactgttagcttagtatataaattgatataaaataccaaaaagaaaaaaatgtatcttttaagagaacaaccactatccagataaacgactgtatcgggcttcagctgcatgttagtgcaggggcttcagaccctaaactaatgttaaaaactggttgatcatcaatcattcctcctgagtgtagctgtttgctgtgtcaaatcatttgttttttttattttgttaaaattgtgtaaaaccatacttactccttcctccctctagggggagtgaggaacaaacccaacaactagcacctgagctcggcctgtcccgtccttggtctctgtctctggattttctctttgcaggcaccacagaactattcccttagaataaaatagtatatttgtatttgatgggtgagttct

SEQ ID NO: 29221 - DNA, 1099 bp, Mus musculus
tttatttatttacatcctaatcccatctccctcctctcctccctttcacttccccatcttcgtatttttaaatggttagaaacttgaaagaaaaatattttgtgatatgaaaattgcatgaattcaaatatctataaataagccttattgttgagagaaagtggccttcttgggaaagataaaagagtacagggtagagctgggccgtcccgttggagtgctgttcttcctggtgctgcttctgtttgctgcatagagaagaggtgggagagcagtcagcgccttactgtgctccgcttgtacaagtggagattacatggctctctttgttcttctccgccctgtctaggttacatgttctcccgcattgaagaagagcatctgtgggagtgcaaacagctgggcgcttactcgcccattgtcctgttaaacaccctcctttttttcaataccaaatacttccaactaaggaatgttactgagcacttgaagctgtcctttgcccacgtgatgcgccggaccaggactctgaagtacagcaccaagatgacgtacctgaggttcttcccgcctttacagaagccggagtcagagccaggtgtgctgttggtagatgaggtttctgtttgaagtgcaaagatggttatcactgaaggtcatggagggcacactgaaacttctttaacgttttaatatttttctgtttctgagtatgttacaagctctcaaaataggagactttttggttcattttaattttattaacttaagttagaaatgctgacttaattgtatagtgccgggatggcgagatggttcagaggttcagagcactgtctgctcttccagaggtcctgagttcaaatcccaacaaccacatggtagctcacaaccatctgtaatgagatctggtaccctcttatggtgtgtaggcatacgtgcagacagaacattgtatatataataaataaataaaaatttttaaaaatattgtgtagtgtttccccctccccaccccccgatttagttgggtagattcccaaataatctacatttaaaacttaccagagtatttaaatctgtaaccatggtgataagc

SEQ ID NO: 29222 - DNA, 1226 bp, Mus musculus
cattttagagggttagagtccatgagcatcccagcagacaatatggaggcaggcaggcatgagtatttagaaagcctgtccccagttacataccttgtccaacaaggctgcaccctctaatgcttcccaactagtaccaccaaatagggaccaagcattcaaatacataacttgtaaggaccattctcattcaaactaccatattccacttcctgacctctataggcttgtagccatatcataatgcaaaatgcattcagtccaacttgaaaagtcttcatggtctttcagtctcaacattgtttgaaagtctcttgtgagactcaagacaatatatcagttgtaacctgtaaaatcaaagcaaatatgtacttctaatgtacattgatacagaatatttattaatgtttgaaaggaaggaataggggcatactgaggaaatactggaccaaagcaagaccaaaacccagcacagcaaactttaaatcctatagttctatgtctgatgtcaaatggtttagatggctccacccttccagttttgttgactacgacacacttctctctcctgggctgacttcatttcctatctgtagctctctaatggctccggcatcttgaacatctggggacctgtccagtgcaatcttgactttcctttcatagctttacaaaatggcctctctggtcctccagtaagggactccccctgcctcacacctgacctaagtgtctctccttagcagcagaggaagattgatgtcacaaccttcactactgtattctttatgactccaaagccagggccacatgaacaacactgccaagtcctgctgtttgcttgggattcggcttgacccccttgaatcaaatttgcataagctttcatttgttgctgtttgtttatattttttggtttgggcttgagatttccaactatatattttctcttacaagtgggtgattatcaggttttgacttttattgctagtagtctgtttgctggccttggagttcaccagttctgatcagagcaggcggttggtactctgttctgtgatgactcacagtctctaaatcaagtgttaacctttgttctccacagggtctgtaaatgctttcctattgggaagtcgtgcctgtaaccatttccctgttgtgtagctttcttcattgagagaacaaagagagccaggtgcaatatatctgtaattcctgtattttca

SEQ ID NO: 29223 - DNA, 1224 bp, Mus musculus
atttatgatttgggaagatttttcttgacagtcttccagtattggctttaagtctgtttcttgtgtgaatgatttatggaggcctgttttatagcttggaatataacctattcaagtgaactgataacagaacacatgacaatgattatatctcagtttcttaaatgttggtaggaactgtagcaatttcttttcatataaattagattaaatgctttcttggagttctgagaaagggtcctctatcatctggactttgtgtggaactaagaatgaccttgtacttcctcaccgtcctacctccacttcccaaacactgggacaggtgtgcagcgctacacctaaaaaaccatttcagccctgaattctgaatctttatgatatgaaagtaaattttatttttactcaataggattattttcttttcatctctgagaacttagacttttaaaattgcaaagtaagtttaataggttgaattttttggaattctcacaggggaggaagaagtctgtggtacctgtggaacccagaagtcttattcaaggagccttgcaagggtgctcagtgtctggaatgacactgaagtatatgtatggggtaaatgcctggaagaactgggttcagtggaaaaatgccaaggatgaacaaggagatctgaagtgcgggggtaagtagacattgtattttgatgtgtggatctaagaattagaaataaagtcataaatatattcaaagatgattagagcttggttttatacagtcccacttgattactgttatttacctgtctcgttaggaggtgaacttgcctctgctagtccgtgttctgactccttaggaagtgctcaagaccatgccctctctcaagaatcctcagagcaaggctgtaaaggtaaaagttgctaatatctctctgctgtaagttacgtatagtattggagtttaaatttttaatgtgtgtgaatattttgcctatatgtgtatatgtggaatatgtgcatgcctggtgcatgcagaagccagaagagggcattggatcccctagaaatggagctacaggcagttataaaccgtcatgtgggtgctgagacgaaaacctgggtcctctggcagagcaatcagtgctcttaaccactgagccatctctccagcccctagtaatattgttgatttaagtttgtaaactgaccagatgtggctaggtttgctagtcttggcact

SEQ ID NO: 29224 - DNA, 1190 bp, Mus musculus
agcagtatcaactccacacagctgggaagaagagctgaatcattacgcattaaagtcgaatgctgtgcaagatgctgattcagaactgaaaccgttttcaaaaggggaaacagagcaggatctggaggcagacttcccatcaggtttgtacctcatagacggctgaaggtcgtcatagacggctgaagtcagaagattgggagagctccaagtttgcagggttaaacggtgtgaagtgttcgggagtcttctgcctttataaatgtgaatatctgttgcaaggttcttgtaagtggttaattttattgtttgcaatttttaatgaccttttcaacagtaactatttacggatggtttccttgctaactgccgtttcattcatgtgttaaaatccgttgtgcatcttaactatataagcggaggtctttatcacggagactggactgatgattactgatactagtcttatgagctctcttaagtctgtgtgttacatacctcacactgggctttctgctgcttttttcagaatcttttgacccacttaataaaggacaggggatccaggcacgttctcgaacaagacgaagacacagagatggattcccccagcccagacggcgagtaagcggaagcttaagtttacagtttgtgttcttttgtttagcagtatttattagttttctgattaaaagctttgtaggagcccaaattaagtattttcattctttttttttttttttgttttttcgggacagggttttctctgtatagccctggctgtcctggaactcactctgtagaccaggctggcctcgaactcagaaatcctcctgcctctgcctcccaagtgctgggattaaaggcgtgcgccaccacgcccggctcattcattattttttaagtgttttagtttttaaggttttttgcttttgtttcttagtgtgcaaaaaagaaaaccaacaataccatttattacatatttatttctaatcaggacgtttcctttggtatttaaacttacagactttgacttactactttaacaatctttttatagccctgagagagatcagggttaaagagtacttgttgctcttacagaaaaccaaggtttgataaccagcacctacatgacagacagacagctcacaactgcctgctgctccagttcccagagcttctgggtg

SEQ ID NO: 29225 - DNA, 2448 bp, Mus musculus
aaccgtctttttgccacaaagccagagcttcttgactacaaggtaagtgtgggctcctagctgctgtgcaagtgcatgcacacaggattgtgagtttcagattaatgtggctacttagtcagaacttctttttataaaatacagaagaaataaaacagcaaagtataggtccatgataagagtttgaatataaactcaaatacactctgtaaatgtattttttgactttctgtctcaaaattgcaccatttgggtttttcatttttgagataggggcttactgtgtaaatctggctggcctggaacttagtctatagacaggttggttttgaacttaaagaggtcttgtctcttgtctgctttctgagcgctaagattaggacatgccatgtgctcaactgcttaccatgtatttttgaattaagagggatgaaaatttctataatataacccaaatatctaattactaaatgtttctttacagggtaaaatgtttcagttctgtggcaagaattgttgtgatgaatataagaaaatcaataatgtaatggcaatgtgtgaatactgtaaaattgagaaaattataaaggagactgtgaggttctcaggtgctgacaagtcattttgtagtgaaggtaattgacaaatagtaatcttactgagcgtggcggtggtttctaatgtagttgttgactaaagggattactatgccagtctattttatcctttgtacagaccctcaacatcttttttatttattgacagataatttgctattttgtctagttctttaattttatgtagatattaaaatgaagtcaaagatcttctaaagtacagtacataatatggcacacaggatacatttaaccccattagcttgatggacagctcaaagacctttaggtcctgtcctcatttctagatggaaggttttaagttctagtagcaccctgagtttgtgtttctgaataagtatatcaaagtgaagctaattttctcttttttagataatatacatgtttaggaacgttttacttgactctaacatggtactgttatccttcttgaccagtgtctttcaattatttaactattatacaaattaattacatttcacattacatcctactataaacctaggatatgttcacactttaaatgaaacaaaaactttatgcaatgaaacttacaatatataacatatagttcagtctgcacacacacagctgtctagttttgatatataactgacttcttgacctgtcagttggttaagtcccatgtgtgaaaacattattattattcagtccatattaatttttatcttttctgatttcttaggttgcaaattgctttataaacatgacttgggaaaacgctggggaagtcattgtaaaatgtgcagttattgtttacagacatctcccaaactgatacagaataatttgggtggaaaggtggaagacttctgttgtgaagaatgcatgtctaagtatacagttttgttttatcaggtaaaaaaaaatcattcatattatgtacaaagaataataatttgatgattaaatttcctttaatgttaaatgttttgtttcttagcaattagtgcaacatttgggggatttaaatttactccttttgtttttaacttcttgcagaagatatagttgacttatggtattaaaatattttaattattattcacttatttaaatacatgaatctgtcttctgaattctgaaaaaaattgtttacatttttaaaaacatctttgtttttatttttgttaaatttatttattttatgtgtacagtagcacatacatgtcggtgtaggtgcatgcatgccgtggctcttgtgtgggaaagagttcagatgagaacttgtgtgggtattgattctctttccactgtgtgggtcagaaaatcgacctcaggttatcaggcttggccgttcttacaggcccagaactttgtttttcaattgctacttttttttttttaaagatttatgtatgtgagtacactgtatctgtacagacggttataagccttcatgtggttgttgggaattgaatttttgaacctctgctcgctctgatcaaccccactcgctctgatcatccctgctcgctccagtcaactctgcttgctcagttcctgcttgctccggcccaaagatttatttgttgttatacataagtacactgtagctgacttcagatgtacctaccagaagagatcgttggagctcattacaggtggttgtgagccaccatatggttgctgggatttgaactcaggacctttggaagagcagtcggtgctcttacccgctgagccatctcgccagccccaattgctacttattagggtattctacatatatgaattggtttttaaaaaaagatttttttttaatgatgtcattggtaggattggtgtg

SEQ ID NO: 29226 - DNA, 1185 bp, Mus musculus
attaaatatgttgtattctatgtacttgttaaacttatagaaaaatacttgtgaaaaccaggaatagtcaagtagcacagatatttagcattaaaaagtggctttattgaaatctctaaggtgagcatcagttagtatcatttcctaatgtgattttaacacaattaagttgtgttagtgttatctttaaaaaatcttttatcactaactgtctttgggaaatgcttgccagctgttgtggcttttggaattctagcacttggaaggctgaaacaaagaagagtaaatgaatttcaggagtagcctctgctttatttctgcctgctgttttaaagctctaggatttactcagacttggctctatttctgtcttaggccctatacattcaacaggatacatcactgtaacacaattgacttttgattttaagatcagtgcgaatttttctgtaggagtagaaggggatcccaaaaataagattgaaatattgagagtaatgttattttttcccctccctctctctttttcagtttgaacagaaaagtgatgcagtttttgatgaaattgtagaaaactgtaagtactatttgagaaaaaaagttgtcttcagataggttaagtctggatttagcacttactaatcattagggtgtttagttagtattgaattgtgtgatggtctggtttgatttagctttagtgtcattaagttgaggtgtttagattcttttttttttaagtaaatattctttcagtttttattatattacagtatagcagtattttgtattagtatgaatgctatagattgtacttaacatcttttacaggtttttttttgttttttttttttagttttccatctttttagatgctgtatgatagattataaaagtaatacattcaattatagtacagagtgaattaagtagaaagtaaatatttttattataattttcaaaagatttaatgagctttaagagcttaatatatctttccagactttttctataaatgtatacatacatatagtatatgagatttatgttcaggaaccacatgaatattattcctgttctttttaagtcacctatgtagacatctttttgcatcagtaaaaaaagatctagtgtatgtcttttttttattgctattgggtattttattacagggctatactgtaa

SEQ ID NO: 29227 - DNA, 1220 bp, Mus musculus
taggctccatgtctagacatagataggtttatacatttaacagtttctgggtccttagtgtaatataactgaagcctcaaatttttctttttagctttttttgtagaaactatacaccttaagactttcaaaagaatacaattgaaagtctgttcaagtagttttgtagtgtttttgtttttcaaaagatgaattgtaggaacagttaaaaccttgttcagtctttatttttattttgattagtaattagtaactgggctattttgagtagaattttaagtggagtgcttgtgtgtagggttctgctgttaggatatgtgggttttattttactttgtgttttaaagtcaaaatacataaaactagatggataatgaagtcattcactgctttactgcagtcaccctagcttgatgataggctgttttgggagataacctaaaacatggattcataacaaagtgacagtgcactttccaaaactaaaaaaaagctggactctgaagtaggtgggctgtatattgtgcttgtaacaatgcagaaacatactgtgcatgtatctctagttagtagtgatggctctgaagtgtggaatgctgtgagactgtggcaaaataagtttttgatgaagttactgtgccggttaagtggaaaaaactatttttttgtgctttttcttttttgtagtcttggtagcattttattaacttcattccaaccttttaagatttctgcaactttgcagatgtgtcttaagatcttgaaaagcacaaggtttcttatgcagcacatgccactacctggtgagtaggcctttgtccttcattgagcgagttgcttttgtctgactggactttgtaggcttggagatgactttgtgttcatacctggacaatcgtgtcagtggattaatctgatgtgaattttgtagaactcatttttggaatgggttttcacatctgcactaatttttgaatttttttagcactacagggaagatctattctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactacatttaatgaactgtta

SEQ ID NO: 29228 - DNA, 1745 bp, Mus musculus
gcgctttgggcagggaggtgcgggtcctgtgggtggacagggtcctagaggaatggggcctggaactccagcaggatatggtagagggagagaagagtatgaagggccaaataaaaaaccccgattttagatatttaggctttcattctagtttggttttgtcttttcttgtttagataccacttaaattcttggcattttagtaagcaagctacctttttatggatgttagcagtttattgacctgatatttgtaaatggcctgtttgggcaggtaaaattatgtaacgcagtgttcaaaacaggagaaaaaattttttcatttacttttttttttaactgtataatgtttctcaagttaatggcagtgtaccttgtgccaccgaatttccaaagtgtaccattttttttttactgtgcttcaaataaatagaaaaaatagttataatactgatcttcaactttgctattcatgcttctatgcacattaggctaggtatttcacttggaaagcatgagcgtgtgtaggcctttgagtggcataagccatttctgggaaatgtaacaggaggctaagtactgctttctacaaatggtgcccccccttgttaaaaagaaatgcatactgaagtaattaggatttgtttggcattataggaagcaggctggtgctcagcatttttaaatggttatgttagaaaagttgaacttgcaagtcttaattcaggaacatgtattaagattatggatgggtgaaaactattggtagtgagagaaagagtttgttattttggttaaatggatcccttatggccctatctatgattctttccttgaaagcttttgaaaatggaaagatcatcttgttgcgtttctccctgttgttttttaaaagaatcccaagccctacaaatggcttgtactgaacttttgcatttgaattaaagattgttaaacatgaagccttttcatgtattacttcaagtgatttaaaagatgggacttagtcgggaattttaacttgaagagttaagggttagccaactataaggactagccttatgtactctaacatacaccttcctgtgttacttctatggagcaaagtctgtagtctgaaaatactggttctcttggagaactagtggtgactgttaccaagtaggactgtcaagtagtctcactatggagttgaactgtttttatatatcagtcttacagtgtagcattaaacctggagatagttgcttaggctacatagtaaaaatatgctttcctcccaccataagcttggggatgttttgatgatgtcagttcattgttaacttcattgaatttcctttcgttagagcaagagactttctgacttgatgataataaagtagattggttactgttgggagcttgatttcttcccagtgtaaagatgttaagaggaaaattaacagtacagaaagtaattgaatagcttggctctgttcttagttacatttccattcaagtctatacattctagaactttcacttagaatgtcttcatccttttcacctctatccttggtgctaattggcaaaagaaattctaaatcacttgctgaggttgaatattgtgcttgagtacaaaaggagacctattgtggaaacgtacttcatgcatacataggaaagttgtactatttaaagtaaaacactactggattataaaaagcatgtcatcaaatggttgtatgactgacaggtttaca

SEQ ID NO: 29229 - DNA, 1691 bp, Mus musculus
tgttaggaagaattcagtgttgtagttctcaaaaaaacgtgaatccttgtgtcttgactcagttttgtggttttctttagttacattgtaactgaagataaaagggaacacagctggttggtgggtgagggaaccaaaccatacttgacctggggtgcacagagcaccttggttaagaatgtagtatgtgatactctccttagtagcaaacttgacctctcattggtcagcaatgtctaattcattatgcaatcttgatagcactgcaagttgaataaattaagactaaatgacatagagtggtgggtttttttcctgggttttgtttctttttgtaatgtgatcaacattttctaggtttgggcttcatggaaagagttgttactaacttgggtttagatggggatcttacaaaaagttcaagttatgtggcttgtctgaatgtttatactccaaacttgggggaaactagtgtgaaagtgacttatatttgaaaacatgttgggaatcattccccaccataagacttcgtcgtattctgtagagtgagtacatttgttcagtgtagctctttgaacttccctagctttagggatgtgattgattatagtctaaactgttttagaatacctaagtcttcaaagcaccttccttgttgcttaggacttgaactttctatcaactgttgttccagacctcaattcaggttacccttggtgtttaactagcatgcatgagaaaacagctacacttgtaatgctttctgctctataactggaaagtttggttcattttgcatacgtgccgctgaaagcttcaggactgtgagaatttcctttctgtgcatcaagaaaaaatgacttgctctttgtcaggcaagtcagatggtggggtagttactccaagcaagcaacttgtgattgctgatagatgaaatcagtatggtgacttaactttttatacaatacagatcaaacagtgtgacatgagaatcactaacctgcctgaaaccctcctgggggaattgaagtgtcatagtctgtataaatcggtagcaggtgcctgttaccgtggctcagcgattttgaatgtaaacgaaagctcagacttgcttctgaacagaaacagattggagagattatatttgaacatagacttgggatggggtgattcccccccccccctccttggtctgctttaagattattaggcctttgtacatgagatctagaaactattgacttaaggtagagtactgctagttaatttgaatgaaagtgtaagttgtgaattttaatagtatattgggtttttaaaacattcaaaaaaaaaggctgggaaataaatgggttccagtaatactatatgctaaggtgcttgcattgtatttcataaatcttgttgcaaccaaaattatttttttaatgaaaactaagttcagaggtgtgatgccagaatgtattatctactatcgtactgttaggcccttggagcagttcccggtgcttcctgaaagatgaaatgggcactcagacaaggctgcctgcagcctcccagcaatgcatactctgactctccctaatgaagagatgcgtgtgattagttttggtctttaaccttattgggggtgcatgtctcctattgttaatcattgtcagctgcagtgacatgatccacagtcctgcatttcc

SEQ ID NO: 29230 - DNA, 1638 bp, Mus musculus
atcatctgagtaataaaaatatttctctgctgttatatacctagagctcctttaaacactgaatgctgaatttagatggcaaataattatgttagtgctgcttatagagaatcctatactataacttgttcattttactgtgttattgcaatggatatgttttgatatttttattatttgaaaactgcttaaacaagtattattttaccatttgtcctaagaactcagccagtgagtccagcagtggtgttggtaatagtgcggaccagccaggcctcctcccaccttgctcggtgctctgtgaggacacagctgctcccggtgagggagtagagaacaacagtgagaaatccatggaaggaaatgataggctgtgtctctcaaagtccacattaacagaacagaacattaagacagagcctccgggagagccctggagcccagctctccagcatctgcatcccagccctgcagacaatatcgcattctgctattcttgctacttgttcttccagaaaaaatttagctgtcggagagaagcttttgcaacccaaggaactgctgactgggagaaaatgctgggaaatttcagaaagcatgaagaaagtgacgtgcacttaaagtcactgcaattttggaggcaataccagtttctcgatgctattccgtgtgacaattcatctgtttattcaaaacagattgaaggaaataaaaagtacctaaggctcatcattgagaacattttatttcttggaaaacagtgcttgctgttaaaaggaaatgaccagtctgtttcacccatgaataaaggcagttttttggaattgctagaacttagagcaagagatagaggagaggtatttcagctcatgagttcccacgtggacttctatagcagcacgcttgtccaggaggagattattgaaatgataaaggatgaaatgttgcaagacatcgtgagtgagatcaacgcctcctcagccttttcaataatctgcgaggagatagctggtagtgccgctgagagacagctttccgtgtgtgtgaggtacccacaaaagacgccaagtgctgtcttggttaaggaaaggttcctggggtttgtgactgccgaggaggtgactggggtccacgtgcatgggcggatcaaagcttacctgcagcaggttggagttgattttaataaaatatgtggccaagcctatgatagtgccacaaattttacggtaaaattgaatgaagttgtagcagaattcaagaaggaagagccaagagctctctatgtgcattgtcacgcccattttttggagttagcggtgattagcttctgtaaggaggtgaaggagctccgcgaggcactacacactctctgctctttgttcaacacagttcatgtgtctgaagaaatgttggcaagtttgcaaaccatgtgtaagctaagtctaaataaaacttgtaagaaacacacgtcacagtcgtgttggccagcccacgaccatttgctgctggccgtgacggactgccttccggaggtcgttgaggtgctggcgtcagtgtcacgccggtgcgcaggcacagctgtggctgccgagctggaggacctgttggccatggttaccaagtttgaatttatatttt

SEQ ID NO: 29231 - DNA, 1178 bp, Mus musculus
tgctcttaaccactgggccaactctacagccctccagttttttttttccacagccctgtctctttaagaagtcaatcatatcggaagtgagaatgctgggacggctaggtctagggcatgatgggaatagagggcgggaatgaaggccgggaacgtccaattacctcaggtctagcgcataaataggagtgcgcacgcgcagttgtcaaggcgttgcgttgccattcctcaggcgattccagtaaagtaatttgtcatggtccccacctgagaccttgaatgcttttgtgcattctccgactggcgtctcattggaggcgggtgtcctaccgggctagagaaagccgctcaggcctgtgggcttgtgagggggcaacgtaccacgtgcccaaacggggcgtggccctccacgtgactaggcgccgcaggaagttctgggtaacctcacgtgacaggaccgtccccttctggcgggggcggagtggcagctcatcacgtgaccggcggcgggctgcgccgcggtggtgccgtagcatcctcaggctcgctgcagttggcggctcgcgcgctccgttggagactgagttcctcctctggcctttgggggacaggctggggaattctggttgcgaacgggaacgccggagagcttgcgacattcagaggagggatacgcgcctgtagagtgttacaactgtggcaagtggtggaaagttctcgacccggcttcgcaacagggttttaaaaaacctgttgtttctatggctggctggaattgatgacaggccttttgcgagggtttcctttatagcttggcttacatttgtactaccgtttgggaatctgaagagagcccagacaggggtttctagcagccattctcaaccctcacagggtcgcatatcaaatatttacattacaattcgcaattagcaaaattacagttatgacggagccacgaaataattttatagttgggggtcgccacattaaccgagtttatgaatgttgagaatcactggtttataggaagacgttagggggagttgcctccagaatgaccagttggcccacctctaaatgggaacctagcgttctagttgtgatgacgtctgaggctctgaagtggctttaggatgagaaatcggttcttattgttagtgcaggctgaggtagag

SEQ ID NO: 29232 - DNA, 1197 bp, Mus musculus
tttctagtaactttctgaaggccattgtgcaacttccatacagctgcagacccagagacactcagggagttgggtggtgtcagattcctctagcacgggtgggtttgaaggccagatcgcgtggacacacacccgatactccgcaccctccacaatgagtacagcctgtaaggaaaggcctcagtgggcgggtcttagcggaggtggccatcagtgggcggggctgaaagttgggcgtaaccgggtgggcgggccggaccgactgtagtcttccggtagggaggaagagtcgtccaggaaggcgggcgctgctatgtcgttcagggtaggcgtgttgcgggttctgcttggcgtcttcttcgcgctcaccggggctgccaagctctttcaggtctcggcccccgtgtcacaacagatggtgagcggcacccggggaaggacagtgtgtgctcggttcccgggggcttcatgccttcgggctcgaggccgcctgggcctttcctcctattttctacaccttctccaggtgggagggcacgggacttaactgctggctgagcatgttgtccccaggccgatttagagttggagaagtgatgggactcaggaggtccaggaagacaaagtgaaaaagtgacctagcacccctctccaccccacatccaccaacccattgttccaggttggggaggcagaattttactttatttggtttttgtttgtttgtttgagctggtcttctgaatgtgtccctctggctggctggcccggagctcactcagtgtagtggctggcctcgaacttgcagagatccacctaccccaacctccagactactgggattaacggcttacctaccttagaaatcttttttaagcttgaaactagtcatgatggtaaaatgtaatttaccaaaacattacacagctattcaagcaaggctcaaagtagaccaatctaactagactcctcagtgtcccacgcagcctgggacagaagcatagaagtcactgactgtagttccttatcccgagagggtctaccagcagtttccagaccctcagagaagccaggctctgtggaagacccctgttgccacctcccaagcctgggtactactacgattttcttctccttttcctcctcctcctctcctcccttcctccttttttcttcttcctttcctctttcttcttc

SEQ ID NO: 29233 - DNA, 1170 bp, Mus musculus
gctttgctgaccaacagcatatggacgtgggcccagctgccagggccccgtacctgctgggctccagggaggccttctccaccgagccccgcttctgtgctccgagagctggcctgggacacctttctccagaaggacccctgagcctgagtgagggtccatcatcagtaggccctgagggaggcccagggggggtgggggctgggggaggcagcagtaccttccccaggatgtaccccggccagggccccttcgacacctgtgaagactgtgtgggccacccacagggcaagggtgccacccgactgcctcccacactcctggaccagtttgaaaagcaattgccagtccaacaagatggcttccacacactcccataccagcgaggtccagcagggcctggtcctggacctggatctggcgctgcccccgaggctcgcagcgagagtcctagccgcatccggcacctggttcactcagtgcagaagctctttgccaagtcccactctctggaggcacccgggaagcgagactataacgggcccaaggccgacggaagaggtagctctgggggagacagctactctggtccaggctctggaggcacccccacctcccaccaccaccatcaccaccaccatcaccaccaccaccagtcccggcatggcaaacggagcaagagcaaggaccgcaagggggatgggcgacaccagaccaaggccacaggctggtggagctctgatgacaatttggacagtgacagtggctttctgggtgggagacctcctggagagcctggtggccccttctgcctggatgctccagatgggtcctacagggacttgagcttcaaggggcgttcgggcgggtcggaaggccgctgccttgcctgcactggcatgtccatgtccctggatggacagtcagtcaagcgaagtgcctggcataccatgatggtcagccagggccgggatggatacccaggggccgggccaggcaaggggctcctgggtccagagaccaaggccaaagccaggacttatcactatttgcaggtgaggcttggtgggatagggagacctgttttgagtcctccagtctggtcagctgggggaacgatggagatggttgggtggtgtctcagtgttggaggtcttggaggaaggaggc

SEQ ID NO: 29234 - DNA, 1148 bp, Mus musculus
tctgccaaatcccatgctggtttgacagttacacactccattttattctttatggttactcctgtaattttaatgtgcatccttgacttcatctgaaggagacaaggcttcctactcttgctctgaataatgcacagtccttagggtactttaattttgatgacctctttgttccctttttaagccatagaaacttatttgggggtgggggagggaggttctagctcagtgacagaatactttcctggcgtgagcaaggcccaggttttccccccagtgtccacacaaaacccactgtttccagaaactctaggtactggaaatgaagtattagcataccagctatggtgctgtcctctgctgagggacttgtgttctcatagtgtttgaaaaaaaaagacattttactgttgttattagtattacagttatttatttattactcatttatttatgcacttttgcctgtgttattgtgtgctttggcacacacgtggaagacaacttggaaaactcagatctgaggacatcagtcctggcggtggcaatcacctttacgttctttgtcatctcacagtgacaatgctcactgtctgtccttcagtgccagggccttgcacatctgtggtaatactgtactactgcgttatagccccagaattcttttgtctgtgtgtcctacagtgtacatgtagagatcagaagacaacttgtgggggggtcttgttctttctctcatgtgggtttcagagatcaaactcaagacaccaggcaccacgacaagctcctccactcgctgagccatcacctgcccttagaatccttttaacttttttatttaaagaaaatgatttttgttgttgccactgttgtgcttttgagacggggtttatccatgtagccctggctgtcctggaattcactctgtagaccaggctggacttagactcagagatccacctgcatctgcctcccaagtgctgaggctaagaatgtgtgtcaccaccttccggtctctttttcaagctagtcttgaaattactatcttcctgtctcaacctcttgagaggctggataacaaccctgtaccgtcaggcccaataaatcacatgaaatttaatggaggtctcttagggttttactgctgt

SEQ ID NO: 29235 - DNA, 1508 bp, Mus musculus
accagggggcgctcgagcccgttattctttggagaccggtacaggggttttgaccagctttgacctcgtgcgcctgcaagcctccagtcccagcgatgtggccaattctagacgctgtcccattgggagactcacgaaatccatcccatggggaacttgcacgggggggagggcgggggacggggcgcaagtagggatgctgcggtgctccccgcggctcggctcagctctgcgctctcccgacaggaggagaagaaggtccctccgccgataccaaagaagccctcgcgggggcggggcgtgccggtgaaggagcgctccctggactcggtggaccggcagcggcaggaagcgcgcaagcggctcctggcggccaagcgcgccgcctcgttccgccacagttcggctaccgagagcgcggacagcatcgagatctacatccccgaggcccagaccaggctgtgacccgcccgggccgcccagtccgacccgggcccgcggttttctacccgtactgtacacccagcgtcgaggtcactgtgaacgcgggcagctccgtgcgcccgccctgccggcaccgcacgccccggcttctgcccgccgcgctttcgtgggttttttaccttcctgatcccacgcaaaggcgcccgggctaggctgggggtcgtgcctctccgccctgcgcccctcacttggaactcccatcttcctggtccgacgctttgaccccctcacctttttccccccatgggcaccatctctgccattattttacccctccacgggccaggccgggccgggtcccccatctgggctctgcgtcccccccacaccccgcggggctgggcttcgtggggatcaagcttcgtggctttttatgaagaatcccgaaccccgcctaggagcccgccccaccttcccagggctccaccctcagccctctgcccacagggcccagggaccacagtggctggaccaatccaggaccagggcgcctgggcctctcccctttcccacatctggggaggggagacaggggctttccctcaccacacctgtggctgttcccacatccctttgagtatcccaggaaaaataaaaccgcagaactgcaccggagccaaatctctccagaagaggccacctgggggagccggggtgtctaataagatgggggtgtgggaaaggaagacaaagggccaggagcttgagcattcttggttcgggacctcaggggttgtctaagccctttgggagaagagttagctgagagaaaggggatcccggtcatcccaataaggacttgtgccttctgagaggggtcctgctggtgtgtaaaggagagggaagggacccattcgcccctcattcaaaccaggtccctttgcctcccagccttgtcccacgttcagtgctcggcccacggcacgtgtacaaatgagcatagatggggtgggagggtgggtggggccctggttattgttagaaatcaccgaatgcgcattcgc

SEQ ID NO: 29236 - DNA, 1666 bp, Mus musculus
cacccgggcaagaagcatggcggcctgtggtggacctacttgtttagcctcatcttcaagctcatcatcgaattggtcttcctgtacgttctccacacgctctggcatggcttcaccatgccgcgtctggtacagtgcgccagcatagtaccctgccccaacaccgtggattgctacatcgctcggcccacggagaagaaggtctttacctacttcatggtaggcgcttctgccgtctgcattattctcaccatctgtgagatctgctacctcatcttccacaggatcatgcgaggcataagcaagggcaagtccacaaagagcatcagctccccgaagtcctccagccgggcctccacctgtcgctgtcaccacaagctgctggagagtggcgatccggaagcagacccagccagtgaaaagctgcaggcttcagcgcccagcctgacccccatttgaaccaggtgctagagaaggggtgaagccgggaggtgctgcaggtgaaggggtcctgggggcgccaagtgctcccactttgaattcactaagctagccaattgtgtttgaagcaggtatttgtgggtgctgggctctgtgctggctacctggtttaggtagcataacagacccagcttccgagagacatttagattagcaaatttactacaagcatgcaagggtctactagcgctgggatggtacacagggcttctacctactgcaggggactgcccggctgggcaccctctcagaaaaagcacagtgaaagaaaggagatggggctctccatcagacatagcaacagcaaaaagaactgggggatctcagaggagaggtgctggctttggactggggacagccagccagagggaggctttactactcaaccatgagaaggtttggcacaaccttctggaggccaaagagcaagtgtggctagcaggtctactgctgcttgagacacacccacgggtccctctcaatccccctttgccaacctctaccttctccctcccaccagggtgctgagccctctgcaccctgtagccaggaccttggaggcatgcgtatcctgtcatatccccggcgtatatccttgacatatccaagtccgtttccttaaaagcaataaagttgtgttttatacaattcggttcttccctccattctccttaaactttcacaactccctgaagtcaaaggaggcagcactgggggaaggaaagagccctgaagcttgggggtgaagctagggtggatagtgagtatgacctaggctgaagcctgctttgggaaagggtggagttgctgatggctgctagcggcaagggaagaggaggcagtggaggaggcggggatagacacacgtgttggaattctgatttggccaccagagggcgctgcagccttcctaaatcagccttgatttgagcacacacacactccctcgctcagcccatgtccccaccctgcatccacacactctctgctactcatgctctcacttatgtacactcatagtagagtaagcatgtagccactctagagactgctcacatcccagcctcgcccagctcaactctgtcaatttcccccaaacttattcacaccagctggaagagagtcttggcctgcccacgtggaacctaaactcaaggtgctagct

SEQ ID NO: 29237 - DNA, 1195 bp, Mus musculus
agagggagagtttgccaagtgctggagaatgggactttggatagagaaggacaacatttataaatcaacagagggcaaatctgatagctgaaagaaagccagggtggttgagtcagctgaggggctagtgtttggattgaggctgaaatgaaccaggaaagatcgtgtaatgtattctttgcagatccctgttaatgatcttggacctcatcctaaaaacaagagcaagtccttggaaagatttatcacgagagttgacgcccgtggttgcagcgtggattgactgaggcagggctgcctgtttgcagtgtgagggaagggcctgagaaagcacaatggccctaaccgggcagggtgtgctcagtgggcatggagagaggaagctgggctttacaaatcgagactcacagaaagatctgctgatttggttgagtgtggggaccaagcacggggaagaatcaaagtgacactcaggtctctagctctgaatgtcagtgtgagtcagtgagtccagagttgccgtggatgtgcagatctgaggaagccaagatgacttccatttcaaacatgctaagtttgagatacaaataagatacctggtcactccccatcctttctggggccattgtgatccctagcccccttgccttgctctctaccagagcattcgttatgattcttgacatcttcgtagctaacatatcgggcttttcagttccttgacctccttactcccaagctttttccctacccacgaaaccttacctatccttacctcccacactttgtctgcacatctgtacaacagcatcatctcctgtcttaccagatcactcaatctggttctcacgagagcgattcctcttccccatcttgctcactgcttgtcacctctcttcacaacccccccccacacctcaccccattctctcctagcttagagtccccaggcccctatagtcactaactgctagatactccccagcccttgcttttgcatatgtccctccagtgctttgcctgctgagaccttctccaagaggcatctgttgctgggcctttgaagaatcacacaactggaccaactgatcttgatttaaacgtctgacaatgacgctcaagttgagtccctggcatttctaagccatcctatacttccctaaaacttttacccaactttccaagagaactagag

SEQ ID NO: 29238 - DNA, 1100 bp, Mus musculus
gggagcctcttgtaaaaagagcaccgtgtctccctactttaatctaagtccatctaattactagtgtctcaccttcaggtaagcggcacctaattgcctggacattaacagcaaagaacagaaagtaggttcccttggagggggaggtcggagggggaatagcccaaggctcgaggactccggatgactggttcctggcatcaacacccaccctcttttatgagcagggttgctcgaacttaactacctgtgcctccatgccagctctgcctttaatagtcaagtaacctttatatacacctctaaccctcagtttctctgagctataaaatgggggtataatactgcctagtcctgtgatgacacatctctgtgaagttctcaagctgagcaccccctaacgtgggaaatgacattctcgttcccctgcaggagcagccagcccttgagtccaccatgaactggagtgtttttgagggactcctgagcggagtcaacaagtactccacagcctttggtcgcatctggctgtctctggtcttcgtcttccgtgtgctggtgtacctggtgacagctgagcgcgtgtggggagacgaccagaaggattttgactgcaacaccaggcaaccgggctgtaccaatgtctgctacgatgagttcttccccgtgtctcacgtgcgcctctgggctctgcagctcatcctggtcacctgcccctctttgcttgtggtcatgcatgtggcctatcgaaaggctcgagagaagaagtaccaggaaaagattggtgaaggttacctttacccgaatcccggcaagaagcggggtggactctggtggacatacgtcttcagcctctcgttcaaggccaccatagacattatcttcctctacctcttccacgcattctatcccagatataccctcccttctatggtcaagtgccatgcggagccgtgtcccaacacagtggactgcttcattgccaagccctccgagaaaaacatcttcattgtcttcatggtggtcacggccgtcatctgcatcctgcttaaccttgtggagctgatctacctagtgattaagcggtgttctgagtgtgc

SEQ ID NO: 29239 - DNA, 1176 bp, Mus musculus
ctgttcttatggggtagttccagatagtcataggaggaagccatctgtcccctcctgcagccccaggagaaaacaagaatgtctcaagccaaaacaaaagccctagccccagagcagaaaacctcagagtgacaggggtaacctgcagaagtttccaacacccgcttcctgcctccgctgcaccctacagaaaagaagccacagtgccctttctccagcatggcttcctgcctgcttccttcccagttcccccgaaaccccaccatcctgtggggcagcagccaccacccacccctcatgtgactcagttctaaaaggtggcctctgtgagcaaccaaccagcctcagaatgccagagccaggcatcagaggagcagggcacgagtggggtggggtgggggtggggggtgtctgtggacaaagctcagctgcgaatgggccccggtttctgaggccccctgactcagcctcaggagacctatagcatcccatgttcccccaacctcatcgatggagggctggacttggactacctgtcctccttttttatttttttggtttttcgagacagggtttctctgtgtagctctgactgttctggaactcagtctgtagaccaagctggcctcgaactcagaaatctgcctgcctctgcctcccaaatgctgggattaaaggtgtgcgccaccactgcctggcgaccctgtcctccttgaaccccacagatctttccccaaggaaagaagatgggaagcagaatccacccccacccccacagactgtcccctctgaagatgtcactgtccccactgatgggcaggtatgctccggggaccccacttcacctctgtctacccagtctatcctcacactaatcctattggataagaaccccccttgttgcagatgaaggaacagaggctcagaaaggttaaaacaattgcaaggatagaataggctgatgtgatcactcggcaggcaaaacacccttgccccaaaacctgagggctcagtcccaggaacctacataggtgagaggagagaattaactctacagagtcatcctctttcttacacacacacacacacacacacacacacacacacacacacacatgccatggtacacatatatgaacacacagagtaataataataattattaataatttgttt

SEQ ID NO: 29240 - DNA, 1122 bp, Mus musculus
ctcactctctctcctcttctctagcccctaaatcccacaaatgtccgaaccctttccattcaacataaaaagtgcacaacgaatgctaaattaaaaaagcaaaacagattcaagtaaccttcaagtcaaaaaaagggggaaaaacaaacccttaactgtcaccctgagctgccatgtgcagaactcaccctccactcctctccgctccccccaccccctgttaagctgcagtggccattgcagggagctaggcatttgcagtcgctctttcctgcacagacgttgcttcccctaactctgatctgtgattccctttgcatacgctctcagatgccaagcacgtgaggcatgatggtaaggggagggtcaaagtcagacagatcataaaacaagcaggggacagtcacagaaagaagggctgagtttcttgaaattcactcggcagctgccttcagtgaaatgcttctctctcccatacttatcagttcacttggattccaggaccaatcttgtcacttcgggcagctttaatggctttcttttctgccagctcaacactgtgacttctacacccctggttcaccaacaggcacccccccccccgccggccccctccccagggccttccacaccctcacagaactgacacatttccatggtccagaaaacttatcccgtgggaggccccctcgctcctgagtcagcattccgaggacggaatgggattatttttgagggacgggcttaaaaatctgctccaaagcttcaaggataaagaggggtagagaaatgccctcagcacaggaaatggcctaaggctggagtccatttgccccgttccagatttgacttacccaacatgacaggattatcctgtgacatagagcttaaggaatcattacttagagctacacgcatgacaattggggtgatcactaaaagtggtttcccttgactccaaggtttgtcagggcttccttacttttggattttacaatcatgggatgctcgtggcagcaccagggactgtgctgagatctctgtccctcatctgggagacctagggagtcggtgtgattagccccacttacaacgtggaaaccaccacacgtggatgtgaag

SEQ ID NO: 29241 - DNA, 1448 bp, Mus musculus
ttggcgggaaggggctctccctaggggtgcagctgggaggaggtccgagtacctcttcagtggctctcaggggccatttctgtggaaggggtagaggtaggtggcacagaagatggggctttgcgcttgtaaatactgatagcactggcttcctccaaagtcccaacgttctagcacccccctcttctcctttctctgtcccccattttccagggggtttatggtcagggctccccaacctgagttgggctacttccaagggcagccagcaggcctggacagaggtcttgaaagcccttgtcttctcttcccccccaccccactaggcctggttaaccttccgtttccagcttctcccacttcagcctgttcccacggcaccggggtttctactcctgtaccctctgcaggtggagagagagaagctgggcccagtttggccatgcctgctggcacagacgccttaactgtgtggatgactgtgtgactgggagcctggaccggctgacaggccatgagctacccactggcatctccaggttttttgtagcaaacagccacttagtgctttgtcctggactccgctcagcctgaggctggggaatagaaagggcagaccccaagagttggagattagaggtcccctccagatagcaagaggtttctagggaagtcacctcacagcaggcttgcagtatgtccagctggttggcaaacacgaggaagctgcagggctggaccatgtggccaagcctgcgcctcctgtggcttacctgcctgcccacccttcgcacatacacccgtggcagggagtgtggaactgaagactggctggaggcactgcagaagcagcccttggctttctactcccacacttgcttgtgaaacgtgtaccagctacctaaggagggccaaggcaggaagggccagggcctcctctgtccttaccaactctgggaagtcagctctgccggcccgagaggggcgggcactttttcagcttgctataaccccttccccatacctccaggcagggttggaaatgaaggacttttttaaccttttcttttgtttttaaaaaataaatctgtaaaatttgcctcttctgtggctttctcccagtgatgacgtacctaaggtgaggaaaaggatgagccctgggctggggaaggatgctgtgttagctgaccagcgtttttattacacctgcctagggctggatcattgagttgtccataccccagatcaacatccctcaaaggaaaaacccagctctgagcctcctcacctgccattcccaccaaggccacctggagaggccgcatctcagactcctgcctccaggaggtgtgtctggacagagctactccatctcagactcctgcctccaggaggtgtgtctggacagagctactccatctcagactcctgcctccaggaggtgtgtc

SEQ ID NO: 29242 - DNA, 1149 bp, Mus musculus
caccctggacttgacatctggctcccttaggatcctgaggcacaaacaatagccgccttagttgacttcatcagacaagaatttgcagtcagctccctggtgacttgcaagatcactgaaagggatggaagaggacagcctttgccagagtttccaggaacagctcccaccatctagagggtttgtgtcttgtgaccagaatggtgcttccatttgcagctgccccacaagctgctggctgccaccatccacgccagaaagttattgtccgtgtctgtcccaccacaccacaccccccaactcgggtcccagttctacatctttcagagggattctttttgtggaaacttgagtccagaacctagactttgactgcaaagcactctgagaaatgtagtttttcctcttccagcctcagccacaaagttatcatggaggtggaatagatccatccacaatttccttgccaatgaatccaactgtgaagaactcaggagaatccatgaatccacctgaaggccttggctttgaaacagaactgctaaaaatgtcctgctccgtgactctgtccctgcctgtccctgcctgtccctgcctgtccctgcccagaggcaacaacttagggaatcagtagcatcagaaatagagacaaaatgacttcccagcctgggccttcctttgttgccccaggtcctcaattctgtacttgggattcagtgagcatgtccatctccggtgagccagaatatgaacttgaggggttctcactcacaactgccatgtgctagccccccctgagcaagaagaatcctgagtcctgctcttcctctcaactcccagacaccaggccacgcctggcagtatttttatttaaaacatggccccttttgtgcattctgatcagtttgtattaaattaaagttacagggcacaggtgtacgttccattcattccgacgaacgcaaagcgatgttccaccctcaggaaggggacagtcattggcacggccagtccagttccccaaggcagccctgctggatacagatcaggagcacagtgaagtccagagagaggatgtgacggctgagaagcccacagcccacactggacagtgagatctgagttctcggccagcaccctcatcaatca

SEQ ID NO: 29243 - DNA, 1160 bp, Mus musculus
atcttgtaattacaaaacaaaacaaaacaaaacaaaaccactcctatgtggctggggttttttccctttgtaagcttaacatgtggccgtgtttttcagactaatctgctcagagttttgctgttgctgccaaaggccgtcttcctaatttgatttcggcttttaattccctcctggtggctttccgttggctctgtttatgtgtagtctgtagtcctgagctacggtggggtggtggctgactgggtggggcttgcagcgtggcactgagcaagaaagagcctgctcattcattgagtttcatccattctgcttttgctgggttaagagccttctcgcttatgtctgtctcattcattcactcagcaaaatgctctcccagctgggaatttagctgtaagtaagcgatacaaagcccccttttcatggtgctttctagaaaactcaacaatgagcatgtgtgctgttgtaggtgggaagtagtgaagttgggtgaggaagtttgttttgaagcagcgtcggtccctgccgactgtaggctagtctagaactcgctgtttcccacagcctggcttggcgctctcagttctgtctcctcctctctaaatgctgggattccaggaggagtcacatcaccacacgcggctggactgcacttttagatagccatccgaggaagtctcctctgagattttgaattcacatttgactgaggtaggagactgagccaggtggaggatgagtggaagaactttccaggcagaggtcagggccagtgcggagcgccgaggaggaaataagcctgctgggcatgccttgtgatgtcagcaccgtcatgttctcggtgactacgaatggctgttctgaggagatcagcatcgtgatgggctgatgtaaacagagtccttgaaagaattcttggaggagaaaggacagctaggctggccaagcctacggggctagagtgaatccacgtatgggaggcgagcaggcaggttaaccttgacttgaaggttaactgttgttcactcattgtggttccggagtctcctcttggtcttttttgctggccttgttctgcatatgtctaccatgaagcccagtgaggcagaaggttttgctttgcctgtggccttccatggcgctgcaagttccttaca

SEQ ID NO: 29244 - DNA, 1779 bp, Mus musculus
acaggcatttgccacctgtccatatacatatgtgtgtgtatatatgtgtatatacacatatatacacacacatattacacacacacatgtgtgcacatataccaaatggcatgtgacatttgggcttcaggtaagagctggaaaacctgctcgctggtggtggtcaggattgtgtttttgctttaactgcagagttgtagcctcagcaggcctgagagctttcagaaagctggcagagaatgtccaggatttgatgcgtctggttgcatgccagtcttccctgatgtttgtttgtttgtttgttttttaaaaaacccattttgttctttgttgtttcctctctatttcagcctagtaacagaaggccaggcgagaccgcacccctgctcatctccccgccgtgggatccctgctcttaggtgctgggcagagggaagagggtggtcatgggaaggaaggatggatggatggtgagggaggtggggaggggctcctcgagagaagattggaacagtggcagtgttataattagtaaggttttttttttttacacatagatgagaatttttaaagtataagcaagggaaaagattaatttaaaaaaaaaaaaaaactgtgattggagtgcattggtgcagataaggagacatggtattatttttaagcagtcagcctctgcttttctctggaccacaaagctaatgctctctaagagacctcagcttctacataagaacctcatggatccccaggcccagagcacagcagtcaggctgggcctgtgcatcccgtgcagaggagggggctgctgactgccgggggctccccactccataaagcgagaagactgacctgcgcggatggaagagacggggtgtgaggttatgggtgccgctcagcagaccatctctcctggaattgtggggagcaaggggaaacagatcccacacttaagacttcagagttgcttgctctagtgacaaagccttcagccactcagcactccctagtcttaaaaccttgccttcattcatccacgggacccttttagataactgaacaaggcctaggagtgtagctcagtggcgtgtgtgtgcctggctctgtaaagccccggcttcagtcctctacagggaagggttgggggaaaagctaaaatgtcttaagctaagtcatccaaggattgtccccctcacctcctgggactgggattgcccgacaacactgtgatgtatttctcaatgaggtgcctttcataactgaccaaatgctgccatgtttggcccctgagtcaataaaatatgttgaaaatttgtatccctgttgtggagttttttgaggaattctggattgactacaaaaccaaaaaaaaaaaaagatgttgaactctggccccgactttaaagctggttctcatggttagctcgctgtcctgggaagtacacgtgtgcacgcctaagcacccttgcagctgtcggcctctgtggtggatgacaaaccccagtggttagtcagtcacatacttcgttcccgtctcatctgaaaaagagccttggtgttgctgtcttatggccttaaagtctgtaaaaaaaaaaaaaaaaaacaaaaaaacccagcccctggctcagtgcctaccacagcaggcatcagataaacgtcgggtcagaacatacagacagctatctgcttcctgctgggctggataattaggaacggacagcagtctgcagcctggcaagcctgtgtgtgcttctatgagtaagtcacatcgctggccac

SEQ ID NO: 29245 - DNA, 1184 bp, Mus musculus
acctttctgctggagtctccctgcccaaatgtgacttgagtgctatgtaagatgctagttattggaattggcagcctaatatgagacgaggtccattttacacaagttcttgcatctgggtgtgcagctcaggtgttagaatacccacttaggatggatctccagcaccacccagtcagccatggggctgtgcctgcaatccccatgcttgggagctaaatgcagagggatcctaaattcaggagcatcctcagcagtttcaagccatcctgagataaatgagaccctgtccccaaaacaaacaaacaaacaaacacagcaagagttgttaatatagtcagccttccagtaaagtattacacactttgggatcgtcaggcaaaatctcctgactgccttgttctcatttcttacatacactcttaggaataataaagtcagactgaatttaacaaggggtgttttatctttccttccctacctagcagatgacatcaagccatgcccacgatgcagtgcttacattatcaagatgaatgatgggagctgtaaccacatgacctgtgcagtgtgtggctgtgaattctgctggctttgcatgaaagagatctctgacttgcattacctcaggtaggtgggacacatatccattgccttgtccttctctgcccttgctcagttaggaaaagggctaccaaagagccatggttgatgtcatttacaggaggaggaaattgtaagacgctcctttaaagcacgcctggtgctttctccagcagtctcggtgactgacttccattaccttcctttctcacctgctgcgtggcttttaaggctttccatggctggttttagtcgacctttctaatcactgctgttccagacagtctgagctggcttgtttacagtgtctcttgcctccagatttgttcacgttacctcattgttctcagtgacctctgaccacttcagcctcctttcgtacccctttatctccccttatttcagttcttggtaggcttgtttgggtttacttactctctcttttttttttttaagatttatttatttattttatgtatatgagtacactatcactgtctttagacacaccagaagagggcatcagatcccgttacagatggttgtgagccaccatgtggttgctgggaattgaactcagg

SEQ ID NO: 29246 - DNA, 1182 bp, Mus musculus
gataagggcagatgtcagcaatactaagggcttcctcctgggagggaatgaggttccactcattgtctcgtgacttccatccctgctgaacggggctgcaaggccaaggctccttaagggaggtccttacctccaatccagttagagcaataaccactttttaaatgtaaaataaagacaaatgaaaaggcacatccttgtcttttggtaaatgcccaaacgttgccctctttttctggcaattggcagcaagtcaggatgtgtggaggagggaatcagtcctcttccattttggcctgcagcttcttagggacatgccagccagccaagctggagttggaagggaattctcgaacagatgggggtgcacgtgtaggagaagaaaatagctgctccaccatcgtctttctgaggctcctctctaagcccagcttgggctgcctcaccacataggtatgcaagcatctgctcagtttcttaaaacaaagggttttcctctcaggagagggctgggcgcttattcctgccagagggctgaggttctcatctggggtgggggtatggagtgaagaactgcagaagcagctttctgcagaaatcattcggtattcgctctgcgttcttctgggctgttaaaggaacatcattaagattccaacagcaggttgaaaggcaggcagaggaatgacaccattagccaatgagcagaccagtaaatagggcaccttaaacactcccgtccagagccaggcgagaggatgtcagatgtgcagggtctgaaagcagagggagaggaagtcctcagaagtccctgaacagacagaatgccaaaccagaccccagagaggctccctctgcccgtctgctttcaactaagacgcggagaggccctgggtagaggtaggtagtggtgtctggagatcctgctatttgagcaaggtttccagtttctccatgcccgtggtacaccgtaatggatccgaagggaataactatccttctagcttagaggtttgtcctttctcctgtagtaaggatctcactcttcctgaatcaactgttacttgccatcaaatactacagctattatttaagaagtggtccctctgttcctttcaggtgactccaatgatttttgcaatttgggaaaggtccaggcagctctgagaccaagaccacagc

SEQ ID NO: 29247 - DNA, 2754 bp, Mus musculus
ttaaatgaaggtaattctcttttgaaggcctgcattaagtcagaacagtcaggctttgagtaaaataccagctgtaagggcaggcagactcaccttccagtctactgtaaggaagaggctgttttgcaagctaagagccggtattattattgttgacttgtgaatagatagaagtcacttttaacgacccctctttttaaatttgagtttcttgaatacttgtcagtattttaatgttgccaattcagtacatttgaaataggagaaggagaaaagtcctgttgaagggctagattaaaagtgtaaatcctctcctttctgtacctattagctgcctttttaaaaaattattagtggcttttttcactctctattagatatatttcgttcataatgtttgaaatcttacacatcttaactgacagaagacagctgaataacccttgttcaatactctgtggtcttgtgactggttggtttctctgccccattgttttcttttccttttcccactcccagtgaccggttagtcctgaagctttgcagtaagtgttcttatgtcctgttagactgagacatggctctcaggtgccctctgtctgctgaagaaatcctgtcagaatcctgactgtcgttaggccggcacagaatcctgactgttgttaggccagcacaattgggatgtctaggaatcttcagttctgtcttcggaacccgagtttatgtgttgctgctgttcaaggaaccttcgtcctatgaaatccttgggagagtcactggcctctcccgttggttacaggtacccttataccctggatgttagcgttgtagttgtagcattgggtccattgtttcacattagtgtttgagcatcttgggaaagtacgattgagcccgtgcaccgcaccaccaccatgcaccgcgtaaggtgtggtgttccaaccaaagcgctaggctctgtgtactgtcttaatggatgtcctaaaagatctgtatttcttacaggcagctctagagatcattctgagagggtttacaatatgacactcctgctgctgcagtcactgtgggagtgattcatagttgcctagcctctgtctcattttatatgtggctaacccaccctgaatagtctactctgcctcagaaaaatgatctttttgttctgttttgtttttgcttttcaagacagggtttctttgtatactcctggctgtcctggaactcgctcttagactgggctggccttaactcacagagctctgcctaccttgccttctcactgctgggagtaaaaggatgaatcaccattgttggactgaaaaagtgactgtgattaggaaaatcttgattttgtttgttttgttttgttttgttttcaagcctttaataggtttggataaatgttcccaagtgtgtgttagttttatctagtgaaagttttttcttctttccttccttttttgcggcagggtctcctataaagcctaggctagccatcaacacactatttaacccaagatggtcttgcacttctgatttttctctccctccagcccctcacccctcagacaggttttttttttatgtagccctcctgtctgggtagaccaggctggcctcaggactcacagagattcacctgcctctgccttcttagtgctgggattaaaggtgtgcaccaccactccctgcttttgacatccccccccccgccccacccgccacccccagaaagacttttctatttcttagttatttggtttagattctgggaccagactttgaaaggcagtagtccagtcacctctcttgatgggcacgcttgttgttgacctcagttgacttgtccaagatgctgtgagttagcctgttagactgagatatgccaaacaacccacctatgggaccaaaacaaagtgcagattagctaccgctggagtagctagcattggggctgaatggttcccacggggagcccagggagtggagggacagcaaagctcctgctctcctgctaccaggaggaattaagactgaatgtataatgggagtgctgcctctgtcagagcagatgagtgacaggttaactagaaaatgtgacaatcacatttcctctagcgcagataattctgtttttccaaagtgttagcagctaattaaatctggtggactgggggaggagagagctgttctgtactggttaacatggtattctttaaggagaaaaaagccaaagaaaactcatccggcatgttagccttaaagatggtactggccagaagccggggcttaatctcttcagagctgcatatctcttatgtttgggtttggcctctaagtcttgtagattaaattaattcttgctgtatttttaaatttgagtaagggttatgtgcatttaactgtgttcctgtcttttatcatccctggggacgttcttaccataggggtcttgacaaagcaaagctaaaatgtgttgttgataaatagttcctgtgtaggtcaggagccgaaataacaatagctctgcagctcatcgggctctgatttactcgagttgttgtcggggtcgattatgaaactgaagtttggtgcctccttttttatcatgtttttccccttgtagcagttgtgtttaatgtcattaaaaagaaataaaagttctcgtcagtggcatatgtactgtggccgtctgttccgggctttggaggagcactctctgccttcctctgcgtaggtcgctctgcttgg

SEQ ID NO: 29248 - DNA, 1698 bp, Mus musculus
catttctcttagaggtggacatttaggttgcctctaatatttaactgtttcgaataatactgatttaaacatccctgtgtttctgtgtgcatttgaggtaggtaattcagtctgataaacttgcagaagtgaggattagtaaatcagatgatgttgccaagttactctccacaaaatcacttgaacttatgctttactgggagtaagtgcttgtctctacagcctcaccaacccaaatcagaaatatcttatttaaacatttattttcataatgctagtaagattaaatatcttaattatttctcaagttacaagtgactgtgcaagcaacagcatttgagatcctaggatgcctcctgtatacacatagtagattggagttggtttaagatatttcttgttcttcagcacaaacttcctcatatttttccagatatgacgtgttcactcttgccctctgaacagtcttctggtgcctcttttctgcctaaaagcaatgcctcatttccttggggttccttggatgaagatgagttggatgactccttgttggagttttctgatggagaagaagatgatggccatttcagtttcacagaggaagagattgagatgctcttgaaggacgatgatggtgggcataatgagtatagaccaagaaagagtcaaattctacctgatattcctcaagaaaattctttgtacagcttgggaccagcagctgaaacccctggcttcctaaaactacctcaactaagtacatcagttggtcatggacctactcctagtaaatcattaaacagacactttgtacttgaaaagaatcttataaaagtaactgttgtcgcaccatttaatccaacagtttgtgatcctgtgcttgataaagacaagatcgattcctccaaagaaacggaaaatcctgcctcccttcgggaacagacgagagaagatgaccctcaacctaatgagagtaaacgttgcactgagcctgaaggggtcagtcccaatacctctgcttgggatgggcccctgctttcttctccttcaaacaataacatcgaacaaactgcctctgataaaaatatacctgaaagtaagaaacctacccctgtgttctctcagatctccaaccattcagaggtccccaacaggaaaaacagtggctcacataaatcaggttgtgaagtgagaattccagttgtgtccagttcatcaaacagagtaagtacattttttcaagacatagtagaaaggaagttattttcattcagaaagaattcctatgtacttaacttccatatataaaatgcataaaactggttggagagatggctcagtggttaagagcactgactgctcttccagaggtcctgaattcaattcccagcaaccccatggcggcttacaaccatctgtaatgggatccagtgtgtctaaacacagctacagtgtactcatatacataaaataaataaataaatctcttttaaaaagtaaacatataaaaaccccctgtggccatcatatattccacaatgataattttgtttgcggttagcagaatttgtgttcaaatgaattagggtttgaatcctgattgacaccattactttcgtttttcaacctttgatgcttcttcaaacttctttttcttttatcttttgatttgtggtttgtttttttttttctttcttt

SEQ ID NO: 29249 - DNA, 1171 bp, Mus musculus
ctggggctgggaacctcattccacccatcctattccatgccgggagcactgctaggctctagggagtcagggccatgtctttccaggactctggcggagagaaccggaaatttaaaaggacctataacccaaataaaacacgtactgaaagttcctatgactgaagttctgaaaagaaataaggggcgagctggccgaagagatggctctgaaatggaaagaaagtactgctcttacagaagacccgttttcagttcccagcacccatgtcaggttattcggtacggcctgtatcaggggatctgacgtcctcttctggcgtgtgtgtgtgtgtgtgtgtgtgtgtgtgtgttgtgtacacgcgggcgctgagaactgcatttcagacagggaagacccaaggggaagcaagaatattgtagaacagggagaaggctaggctcagctccgtggtaaagcatgagtaaggccctggactcagccttcagtgccctcacacaccctttgtccaaggacactgatttaaatggaataaagcaagcacagtactgctcggccaccacaactccctgccaacagaaccgtttccatccctgcctgcccgtgcctctgatgttcctccacagaacctattgctgtcctttgacatgttctctaaggagagacaggtaggagccaagtcatgaggggcttgtaaactttgttttacaagccagataaagactggactagaattacgctaagggcggttgcaccaccaagctatttttttttttaaatttacctatcctgggtgtggtggtacatgctacctgtaatcttaatacctgagagtcagagacaggggggtggctgcaatttggaggccagccttgtttacataatgagttcctggctaggtagagctctatacagagaccctgtcactaagaacattcattcacctcttcgaagggtacattttagtcagttcttgtatacccacaaggttaaagttctagaatatttttattcccaactcccccgacccctagaaaaatgtgaaccaacctgagcacacgctgtaatcccagcatgtaggaagtggaagcaagaagatccagaatttaaggacactttcggtgacatagctgaagttaaggtcatcatgggcttcataagaccctcagtg

SEQ ID NO: 29250 - DNA, 1146 bp, Mus musculus
catcccggctggatatccgtgtgggcaaaatcctcagcgtggagaaggtagtcactcctcaccacatcccagagaggcagagaagggttaggtttgtatgtttccatctgtaggaaacctagctggagatgggaagtagtgtccctggggtctaattgcaggtggcctctgaacctagtacacagccaggaacagagggaacttggccatcatgatgcccagctaggatggaccagcttgcctggaccagctttaggtcttaccttaggttggcctcttacagtggggttgtggatctgtggggaggagggggcttcccttttgcagacaggtcatgtctcccagtcattcaccagcatttaatccactccactgtgggcatcccccgtttatctatttgtacattgggggttgggaggactattctggggatctaactcagtggtcaggcttggtagcaagcacctgtacccacggagccctctctggccctctgacaagaatctcttgctggcagcacccagatgcagatagcctttatgtggagaagattgatgtgggggaagctgaacccaggactgtggtgagcggcctcgtacagtttgtgcccaaagaagaactgcaggacaggctggtggtggtgctgtgcaatctgaaaccccagaagatgagaggcgtggactcgcagggcatgctactgtgtgcttctgtgtgagtgaggatttggtgggccaggcccaggggagggcgagagaccgaggattggtctgtaggatgtcttcctgtatgccgcgtgcaagccctgagaaaacagctcccttcctgatgatgctaaaagatgaggcataaaggggctgctatacaagttctgtgagtaagacatctgtgtccagatagactgttaaagtaaaattacatgggtagtcaggtgagggggcacatgcctttagtcccagcacttgggaggcacaggcagaggcaggtctggtctacatagtgagttccagagttacataggaagaaaaaaaaaaaaaaagaagccgggcggtggtgggcacacctttagtcccagcacttgggaggcagaggcaggtggatttctgagtttgaggccagcctggtctacagtgagttccaggacagcca

SEQ ID NO: 29251 - DNA, 1796 bp, Mus musculus
ttaaacagcggcagggatcatgctcatggtgcgatgtattcaccgttagcctgctgcaggcagcctgggggacgctcagcagcaggaccctcagcataggtatgaagcaaggctgtaggtttgatctgtagcatttcagtgcacaccctggtactgcgctgggtatcagtgatccagaggtctttgtcctccttactcatggatataaatgtgcttatcagaaggtaagaacacagaagcctttgggaactgtgctgagaagccgggcccagctgtgatggtgcacacctttaacccagcatgggcgggcagagctctgagtttcgagaccagtgtggtctacatagcgagttccaggacaaatggaaaagttgggccagcttattctaataatgtaagaatgttgtatcccgccatcatgcctttattttaattatttttttgtctgtcttattcaggccgactttaaaatttctgaggagtgcatcgcacagtggaagcaaaccaacttcatgaccaagctgggattcgtctcctgtaaatcactaaaagggggtaacatcagctagccagctctgtgccctcccaccatcccgtctgccggctcgacttgttgcatctctcacccgctcccaccaggtctgaactgctgacaaggtgcaggacttggaaagggacagctcaccttcctactgtgtgggatcacccagcctggctgaaaggaaacggagtgcctgggctaaggagatgctgcccagcggcagactggccctaccttcttcccttggcagctgacttgagaaatctggtttcaatagaacccacagaaaaagtttattccatggtccctgtaattggaaaaacactggttcccaagtttccatggggttttccctgcagctgtactagctgagatcgagtgcctggtctgagctaattacagcttctccccgtcaggaaattgtgggatttgaaaagaagggaaagagagcctagaggtctcccaagctctccagggctggcagcattctccaggcttccaaacctgaggcttggcaccagaggcaggacttgccctggctctcttggggttcccttgatctggctagattggacactccctaaacaagccagctgtgttagcagcaggatggagatggactgaaactgtggagctttcttcagaatgtgagatactccataaagcatctcaagcaaatccctaaccgccactgtcaagttcaaataaagtgtctgaaaaggctttctgcacggagtctcgtgagctgcatcatctcaggagacagtgtgagtgcagggcagctgctacgcttacctaacctgggatcactgactttagccacacattgggatgagacaggcagggacaagtaacggacatcccgagtgtccccttggcttgtgtcagtaggcaggacaccatctcacgtgggccagagcactggcctgcctaccacagccaggtccttctgtggttcattagcattaggttcacgctagcatgaggtgtgcattcctcaaaccttgttaccacgtattaccagtatcacctgctgccgatgtctggaaaacagcagtcacagccaagtttcaatcatttaattaataccttttaatgaaacacagctttgtcatgtgtctcactcaagcttcagaggaggaggcatagggaaaggattgtttatagagacatatcaaagactcaaagtaaggaaatatagatatatatttctctcttctaatatttttatgcaaattaaaaatcagaggctttt

SEQ ID NO: 29252 - DNA, 1645 bp, Mus musculus
gccagtccagtccactcctttccttagttctcggagatgggcaagtctctcatgcccacaggctccccaggctgctggcaggagtggggctgtggaattccaaagcacaaaaggtgcagtcgaggctagccttcctgtgcctcaactcaccaccaaccactctcctgccttccagttctgtcaggtgctccttctaggggactcatggtgaggagagagaagccagaggaggcctgtgggcactacactaagaaaccaaaaaccagactagggagccatctgggatgttggcatgttgggtacctgtcctgtgacacttgattgtgcttgggtggatgggcacagcctcagagccaggagctcatgggatgtgtccatttcggcttggcaggaaatcctgccaaggtgtggggagggtctggcagggacttcctgggcagtgggcccaggcctattcctcagaatctttctctgacctgtctccactctccggtgcatgtcctttctgcagctgcctttctgccaggtggagggagctgagggtttgtggccaggatggggagccaaaggcttatgttactaccccaggctcttctctagaagaggggataagctgtgatctttccagcaggccggtggctatccccagagagcagcctctgctttctcttcctagaatctcatgacttgtaccacctcgaggtgagccggagttcctgtaggctccatggctgtgcctccttcagggccaccctttgagtcttttcaacgggggctccagcctggcaagagagcctgccagtagcttctccactaccaagacgggagcagcacgctaccccattactgaccttgctgtcaagagctggggagatggggtggagtccaggccccctaagccctcctgttcgggctgcttgtgttctctgtctttccctggtccgtgtgtgatggggagctgctgctgggagggaggacaatcaaagtaagcactgttctgccccacgatgcaggatgcagggtcgccagggtcgctggagctcttgccctggcttgggttcttctctgtgtttccccaccgggtgggccacagtacaaagaaggaaggagagtctacaagagacatctctgtcctctggggtaaatgagcttgaccttgtgcaaatggagagaccaaaagcctctgatttttaatttgcataaaaatattagaagagagaaatatatatctatatttccttactttgagtctttgatatgtctctataaacaatcctttccctatgcctcctcctctgaagcttgagtgagacacatgacaaagctgtgtttcattaaaaggtattaattaaatgattgaaacttggctgtgactgctgttttccagacatcggcagcaggtgatactggtaatacgtggtaacaaggtttgaggaatgcacacctcatgctagcgtgaacctaatgctaatgaaccacagaaggacctggctgtggtaggcaggccagtgctctggcccacgtgagatggtgtcctgcctactgacacaagccaaggggacactcgggatgtccgttacttgtccctgcctgtctcatcccaatgtgtggctaaagtcagtgatcccaggttaggtaagcgtag

SEQ ID NO: 29253 - DNA, 1178 bp, Mus musculus
aggaacaggacctgtcgatggctgacttcccccctcctgaggaggtcttcttcaatgcaggccctgagcttggccctctggagtcctgcagctctgaggctgccgtccccccagctgctagcttgtcccagactcctccgccagctccacctcctagttctggatcagaacctctggccaggctcccacagaaggactcagtgggcaagcacagcggggctcccagggaggattcgggcacgcctctggtcacaccctcgctcctgcagatggtccggcttcgctctgtgggtgcttccacagggattccgaacccttctccgggttcatcggcccctcagaagcctctgcgaagagccctgtctgggcgcgccagcccagtgactgctccctcctctgggctccatgctgccgtccgactcaaggcctctagcctggctgccagtgagagtcctgcgagtgctctgcccactggaatacccgaggcagagccacggtcgccacagtctcctgcctccaaggccagcttcatcttctccaagggcaccaaaaaactgcagctggagaggcccgtgtcccccgaggcccaggctgacctccagcggaatctggtggctgaacttcggagcatttcagagcatcggccacctccccaggcccagaagaagccttccaaggctcccccaccagtggcccgcaaaccctcagtgggagtccctcctccgtcccccagtcttcccaggacggagtctcttactgctccatccaccaatgggctccctcacgctgaggacaggactaacggggagctggcggagaatggaggtgtgcagctggctgctacagagaagatgggctcccctggttcaggtactgtaggcactggtgcaaaatccgttctcagagggcccaccataggtgggcatgctcttggatctacaaaaactgatagcagtctgagcctggagggatagtcgggtcatgtgctctggcagccgcccggaataaatttcagttttgtcacattatctcctatctcacttaggtttaaaatggggcggagacacccacgataccggctgtctataagtgtctagcctagtgtcagtgaagggacgggatataggaaggttgggtgaggagcgttttgggggttttgtcagaccccagctggaagg

SEQ ID NO: 29254 - DNA, 1155 bp, Mus musculus
ccatgactcatttcccaaatctgggaagtcaggaaggcgacggagggagcgaaggagcacggtgctggggctgcctcagcacgtgcagaaggagctcggtgagccttggtcggtgagcagtggtggtggatgcccgggagcctggccaagcccctccgctgaccccatgtctgtttcaggcctgcggaacaaccgtgaggcaccgggcactccacagcctcctggttcacgggacgctgtccgcatccccacggtggatggtcgccccggtctggccttagggacaggggtccgagtgtccctgcaggctctggaagcagaaacagaggccggcacagatgcagaggctgtcatccagcgccacatcgaccgtgtttaccacgatgacacgcttgttggccgatccacgggagcccggccaccgccactgacgaggccaatgtctctcgcagtgcctggactgacaggaggagcaggatctccagagccactgagcccagccatgtcaatctcaccccaggccacctacttgtcgaagctgatcccgcacgccgtgctgccgcccaccgtggatgtggtggccctgggccgcagcagcctgcgcactctgagccgttgcagcctgctctctgccagcccagcttcggttcgctccctgggccgcttctcctcggcttccagtccacggccccgcagccgcaacgcttcctcgtccagtgacaactggagccactctcagtcctccgagaccattgtgtctgatggttccactctttcctctaaggggggctctgagggccagccagaaggctctgtagctagcaataatgtggcgccccctcctccaggcggtagtgggcggggctcccccagcgggggtagcactgcggagacctcagacacggccagcatccgaagcagtgggcagctgtctggcaggagtgtgtccctgcgtaagatgaaacggcctcccccgcctccccgccggacctactccctccatcagcgcggctccgcagtgcctgatgggcccttagggttgccgcccaaacctgagcgaaagcagcagccacagctgcctcggccgcccactgcgggtggctcttcaggggtgggggcagtatcttgtccacccagctcagcaggcacctgggg

SEQ ID NO: 29255 - DNA, 1101 bp, Mus musculus
caggcccaggaggggctccgctccctccagcaccaaggtaagtcctgccctgttagagtgctgttcccagctcctgggtcaggggcttggccaacagacccttctggtgtcttccagaaagacagaagctgagcaagggcggctgggaccatggagacacccagagcatccaggtgagccctgtcccagctccgccctgctcttcccttctgacttagcctctggcatgcatggctttgggcctttctggactagtttcttctgtatgttgaagaggtagatgaaatgacttctgacagctagtccaggcttgctccatctggtacctgcacagtgctggctgatgctgggggaatccagcgggagcccagagtagctcatccaagctgctcttatccccccaacagtcctcccagacggggccggatgaagataccatctccatctacagccagaagtcatacatgacggagagctccaccgcggaggatgcgctctccgtccgctcggagatgattcagcgcagaggtgtgttgtcatctgctgggctttctaggtagcagggagaggtgacaggcaccatcacatcgctttatgtcctggtatctgtggcttccccttttcctcctaatcccaggctatgtgattcagtgaatttaccagacagtaccctttatcttcttggaggttcatggtggacactgacccaaagcaagatcgtgaagggtttgggaaccctgacttgtggtaacttagctgcagcgtgaccaggagtctaaaccctttacttcttcaagtgtctactgatgttctatagaagctaaagtgattgactttcagtatagcttagctggtatcatgcttgctttcgcaagcaggaaagcctgtgtccagtcccttgcactgtatgcaacagtgcggtggtacacacctggaatcctagcgcttgggaaatagaggtaggaagatcagaaattcaaagtcttcctcagctccatagtgggttagaggctgacctggattgtatgatatccctatttcaaaacaaaagccaaaggattggctagggacagcctcagagggcctagggaaggcatgtct

SEQ ID NO: 29256 - DNA, 2222 bp, Mus musculus
ttattttagcaattagcaataatccatctggttaaagggcttgggaatgatgatcatccatattcatgtaaaagtgcccggtacaggaggctgtggcctctcctgtttttattgacacaccaattgaccgtaccaatttgtgattgatactatttgcatgttgttgctgtttttattcaacagtagttattaagtagttagaaatgtatggccgtccttgaaatgttatcaggcgccttggcataatattttataaaaacttgtcttcatgctaaataccttcttctttctttctttcttatttctttatggcaggcggagaacatttacaatgatgaagatcctgaaggaagtgtggatccagagggacaagggtcctagacgtgtctgcacctgtgatcctagactctccttgttttcctctgaaccccgagatggatttaacattggtttgaggcacagactttgttcagctacccagctacaataggtgccaccaacaatgctacaagcccaaaccaccggtgttttctaaatcttaactgggggtttaagtcagcaaagcctcgttggtggctccaattgtggctgggtagctgaacaaagtctggtttttgttgtgtgtggtttttccttccttcctttctttttctttctttccttttttctttctttctttttttaaacttgggaccaccaagttgtaaagatgtatgtttttacctggcagttgttccactggtgaactgtcaagttgagaaagagtggattgctagtttgtgtttgtttttaagattaaattaatccttgataaaagttgcttttttaggggttagtctttgaccactatagtttgatgccatctccattttggttgacctgtctcaccatcaggcctgttactctccatgactaactgtgtaagtgcttataatggaataaattgcttttctatatagccccatgctggtgggttttatttagtatccatcagacaacagtctatggcttctggaagagtttgttcgatgacagttgttttctgtagttttgactatcaagattgtaataaacataatagaccaataaccatagataaaagagagctttactccagtcagggaaattgaagacattactgaatagagtacacaaactagccttggtaaaattacatattcttgaagtcttctcccgagagctacataggtttccaagaatctcaaaggcagtgtgatagacagcttaaggcagagtttaaatttaaaacacacttgaactgtttacagagagcttgtatctgatgagtgtttttcattggaacccctacttttaaagtatagacttaagagtcagtgcctttattaccacttggtgataactggcgaaaggggaaaaaaaaaaaaaaaaaacaagcaaacctgcttttgcttggactgactagatgactctcacctcagaaccatttatggctttgggaaagtttgggtaatgaagtgtctggtccagatctgaagtgatgcctagaacttgtgattacgctggcatgtagtacaaattatcaagctggatatgggatgtgcacttttaatcctagagcttgtaggtttccgtgagttaggtccaggacaggaggggtggggtgtgtcttgggtcatggctgacagtgcacacacacctggagtctcagcagttgggaggtagaggcaagaccagaagttcaaggtcatcctgacccacagaagttagagaccagcctagacgacttgagacctggtctcaaaaaaaagcatgccattcctttaatcccagcagagttcagggccaacgttgtctaaagagtgagttctaggccacttggggctatatataagtggggtctggtggtggtggtggtagtggtttgtttttttggtgttttttaatttgacactattttaagagtaaaatacgagtgtagacttgaaggggaagatggctttgtgagcagagtcttaaaatctaatacctgtagcacaaagttgtggatccatatagcagaaattggctgccctttgaccccaacattttccctcagacgttcttggtttgggtcagcacaaagcactccataacattcttcacgatagttcagggtatggtgatgcatccatcactcagggttctgctggaagataaaaggctctttttcccttccatagtacactgaaatcagtaccagc

SEQ ID NO: 29257 - DNA, 1877 bp, Mus musculus
acctctggaagagcagtcagtgctcttaaccgctgagccatcactttagccttaaagtaacacttgaatagtggtgttagtgacaggacattttccttttttttttttttttcagacatggtttctctgtgttgtcctggaacttttctctgtggaccaggctggcctctaactcagatccacctgcctctgcctcctaagtgtcaggatttaaagtgtgcattaccacacctgacttgactcatgcagtcataatttcatttagtaatgtagtactcattactaatctgttcttacaaattatgaacgtgtttttttttttttttttcctcgagacagggtttctctgtatagtcctggctgtcctggaactcactttgtagaccaggctggcctcgaactcagaaatccgcctgcctctgcctcccgagtgctgggattaaaggtgtgcgccaccacaatgaacgttctttagttctgtaaatgcctaggttcgggcttttaaatatacgacttggttgcttaagtactttgtgcttttatatatatatacacacagaatttggaggttttggttctgtcagtgggaaaattgaaatagaaatcaagatcaaccatgaaggagaagtgaacagggcccggtacatgcctcagaacccctgcatcattgcaacaaagactccatccagtgatgttcttgtttttgactacacaaagcacccttctaaaccaggtaccttcctcttttttttaatcaatttatttatattgacatgtgcgggtgttatacttttcaagtgaaataatgcttttgtgtagaagaaaatcgtgattgctcagctttagcgttatatatctggtaaagggtctgtggtttgtataatagatgtttgtgacattttgcttaataaacccagaaagacagtagattgtctatttttgatatatgttattttgcagacccttctggagaatgcaaccccgatttgcgtctccgtggacatcagaaggaaggttatgggctttcttggaatccaaatctcagtgggcacttacttagtgcttcagatgaccatgtatgtatccttgcagttctggagcaaatctgggattgttaccaattggtttcttttttgggatatgtggggaagtgagaatcttttatataatggttaattttacatttaagaccatctgcctgtgggacatcagtgcagttccaaaagaaggaaaggtggtggatgcaaagaccatcttcacggggcatacagcagtagtggaggacgtgtcctggcatctgctccacgagtctctatttggctcagttgctgatgaccagaagcttatgatgtgagtgcagcccattgtttattcttaatacttgtattttcatagttttgtgttagtcacagtgtcaaatttcttctgttttttctttttaaattaagttgggacactcgttcaaacaatacttccaagccaagccactcggttgatgctcacacagctgaagtgaattgcttatctttcaatccttatagtgagttcattcttgccacaggatcggctgacaaggtaggtttgcctcctttggattttttttttttttaagatttatttattatatatgagtacagtgcagctgtcttcagacaccccatgtactgactagttttgtgtcaacttgacacagctggagttatcacagagacaggagcttcagttgagaaaatgcctccatgagatccagctgtggggtattttctcaattagtgatcaagggggaaaggccccttgtgggtgggaccctctctgggctggcagtcttgggttttataagagagcaggctgagcaagccagtaaagaacatccctcc

SEQ ID NO: 29258 - DNA, 1110 bp, Mus musculus
ttttgttctaaactgggacaggggtggggtatatcatgtatcagaatcctgggagagctgacctgggaaactaaagagaagaatctcaaagaacaggctgagggctcggcctgaggtccagacataaggaagtagagagggagaagacgagccttggccagcgtggcgagcttgtgttgtttgatctgacacattttatagctaaaacacaaacccttgcccagccaggtcagatggcttccctgaccagctgggccccgagcctctttagcaccgactccagtcccgtgctctccctgcagcattccctgcggctcacgtctccagcacatgctgccgcactgacttgataaccaccagtctcttgtttcataattacagtttgacttcctgccagctcctgctggagatatcctaattccattttcattttccatttaactctaattttagggaacagaagtcaaggcaataacgtactcagcaatgcaagtctataatgaagagaagccagaagtgtttgtgatcatcgacatttaaaataccaaagagggaaaagactcgtgaagagctgatttgttttcttccgtttgagaggatgtgatgactcattttctatagtatctatgctaaatggaaatacggaactgtacatttaaagtgtggctttcagaaatggaaaaccagtgtgtagcagtggtctctagataatgaattcctcggtttttgaggagcagtcttgtacttggtcatttgagcaggagcagcaggtgccttacattgtttgtttgttttttgagttatgccatttttctttcttttttttcaattttttatttggtattttcttcatttacatttcaaatgctatcccgaaagttccctgtgccctccccactgccctgctcccctacccacccactcccacttcttggccctggcgttcccctatactgaggcatataaagtttgcaagaccaaggggcctctcttcccaatgatggccaactaggccatcttcttatacatatgcagctagagacacgaactctgtgggtactggttagttcatattgttgttccacctatagggttgcagatccctttagc

SEQ ID NO: 29259 - DNA, 1140 bp, Mus musculus
ctggagcagaagctgaaagctacgtcctgatttgcagacagacagacagagacagacagactgggcctgatatgggcttttgaaaccttggaacccagccccagacagacagagacagacagactgggcctgatatgggcttttgaaaccttggaacccagccccagtgacaaccttcctccaacaagggcacacttcctaacccttctttttttttttttttttttttttttggttttttggttttttgagacagggtttctctgtatagccctggatgtcctggaactcactttgtagaccaggctggtctcgaactcagaaatccgcctgcctctgcctcccaagtgctgggattaaaggcgtgtgccaccacgcccgacttctatttctttccaaatagtccctcaaatagacagcccatggggccctgcttattcagatcactgcacccctacgtttctgaaagcatgtagaagtagagatcatgacacacccaccccaccccagagtctagcacttgggaggctgcagcagaaggatcccgagtatgaggcccacctgagctctctagattgtgggggggccggggaggggagaggagtgggggaggaggaggaggagaacaaggtcagtgaggagactcatttcaggtacgtggggagcccggggcacttcagaggagcaaggttctctgatggtctgaatcggttccagagctctcgctccaagttcccaggtccttcaccttcattattaatcaatggttgttacagaagaaatttggtcaaggcgtaagatcacttcccttgtaactttgcaagccatctgtacatcgtgatgtctccacctcaggctgtgtgagaaaactcccttagggtaatggttctctggtcagttgggctaagagtctgagtcctggagcctgccctttctcctcttaggcactctgcaccatggtcatagctactgcggtgagcagccttgcctgcagtatggaaatgcagcctcggtgacaccgtctgacacactgctccacagatcacttttgcatcggcactgaggtcataaatctattccactgcaaacagttggcaaatgaacccctgggttctgatgtgcagggtttatttcctgggc

SEQ ID NO: 29260 - DNA, 1245 bp, Mus musculus
cagttttagctgggtggtggtggcatagccctttaatcccaccactccaggaggcagaggaggcagatctctgttagttcaaaaccagcctgatctatacagcaaattccaagacagccagggctacacagagaaaccctgtctcaaacaaaaccagtaggacaacaaccaaaagtagacaatagccttgcagctccggagcccctcacagttcttggcctttgctcagcagggaacaatctctctcctttagggactgactcctccgaaggcatcccatgcagagttgagtgtagttagtggaaatatttcctttggatctgaagccatcaaagcagcaagcctctctctcaggcagcatgcatctgtgttacattccctaaagccaaggattgttgtggggacggcccggtccagtggttacctagctcagtggggacggtgggctctgggcgtgagtgtgtttgtgttctcaaagtctcctcatctttgcagctggaagatgtagagtgggaggactgggaatgagagaagccagagcaagcagctcccccaccctcggcacatcccacctccctcgctcgctagtctcggccggacttggaagacactgagaatgtcccccccaatggcctccgccatccagaacttggtacatattctggtggctccctgctggccctctgctcacaccttgaaagagccttttcaaatacagatccagaagtctgatttgtgccaaccttaggatgacctaaggggaggaccccgtaccccatcaccggagagcctgcatttccctgctattgtagggattcctactgggagacctcgaggggtagctgtctcctgcagagacaagagccgaagcactggtctcattgaagacgacacgtactaccccataagctagtaagccagcaagaaaggccatgccacctgcccttgactacacaggaacagtgaacagcattttcgttcctgacccaatgagaaagaggcactcatctctgacccaatgagaaagagacactcatctctgggaaatgtgcctctctggaatctccatcccaaccatttcctgttcttgggaaggtcctacgggcttcagaatcttaagaccacaccttgactcacctctaacccacgccgggatatccctacaccttcccagggcttttatgtcagatgcacccaagtccttagcccatctgtgccactgcaagagtctgctcttgtatttct

SEQ ID NO: 29261 - DNA, 1274 bp, Mus musculus
taggtcagccccccagggtggccgcacagcacatagactgacagggacgtgggtgggacttgaattctggcctgagggggcgccgaactcagggtatgtgtgtgtgtgtgggtgtgtgtttgtgtccgggcgcgtgagttttggacaaatttctagagtgtaactcagcaccagccgtctgacgagtctggacatgtgagcccttccaagagttcaaggagccagtgtagaaccagggactgggggcctctccactgtgaagtatgagttaggctgaaagtgggctggggatgactgagtgcttcttcatcgacggcctcctcccagtccatctcccggaccgaccgggaacctctctcatttccacactgaaccctacttgcccctggtcgtcccaagtgatgggggaaccagacagcttggcactgcccactgcacgagaggaacccgggcccgaccccgcctccaccccggattgggtgctcatttaaatgtccggccccgccccgagcctcgggcgcgtacatataggcggctcggcgggcggcgggcggcattctggcgcggagcgcagcagcagtgggcgcagctagcgggtcggctgcggagcgggggtgcagtgcgctttgccccccgtacccctccccctcggacgcagccccacccctctgcccgccgggccgtcccagccgaactatcccctgcggcgccagcgcggggcggctccgggcgcccccagcagacccccatcatgggcagccagagctctaaggctccccggggcgacgtgaccgccgaggaggcagcgggcgcttcccccgcgaaggccaacggacaggtgagtgcgctcggagcggcggatcccggcccccagcccgccggcctcgccccctctggggcccagggccggggccgcgcgctttgtccggcccgggacacgcggcgccccctcccccgcccggtccctttgttctcggcgccgcagcccccgcgggcgaacgaggggaggggcgggagggggcgccggccgggctcgtcgccttctttgttcgcgcccggcccgcgggcgctgcccccaggccgccccgaaggccgcgcgggaacaaaggcgctgctaggccgcaccaagggggcgtctagggccgtggggatggtactcggcgcccagggcgccccatctggagccccgatcccggcagcccgcggtggcttttgaagcggtggggagcagagatgcggggagactctggggtgggtgggggctgatcacacaa

SEQ ID NO: 29262 - DNA, 1504 bp, Mus musculus
cccctagccaggaagctgaggccaagggggaggtcgcccccaaggagacccccaagaagaagaagaaattctctttcaagaagcctttcaaattgagtggcctgtccttcaagagaaatcggaaggagggtgggggtgattcctcagcctcctcgccaacagaggaagagcaggagcagggcgagatgagcgcctgcagcgacgagggcactgcccaagaagggaaggccgctgccacccctgagagccaagagccccaggccaagggggcagaggctagtgctgcctccaaggaaggagacacagaagaggaggcagggccccaggctgcagagccatccactccctcgggcccagagagtggccccacacctgccagtgctgagcagaatgagtaggggtggggacaggtgggtgatctctaagctgcaaaaactgtgctgtccttgtgaggtcactgcctggaccttgtgccctggctgccttcctgtgcccagaaaggaaggggcttgttgccccctcccagccacgctcccttttcgccctcctgtggattctcccatcagccatttggtcttactcttaaggccagttgaagatggtcccttacggtttcccaagttaggttagtgatgtgagatgccctgtccctacctctttcccgagccccatccctgcagaaggcaattgctgggtttccaattcttttccaagttcgttttgtttatcctgcttctcaaccccctgagccagaagtgggggcttatactcccaaaccctgagtgtccagcctttcccctgttgaattcttagtctcttgtgctgtgcctagtggcacctgggctggggaggacattgccccatctgggtttttataaatgtcttactcaagttcaaacctccagcttgtgaaatcaaccatgtctctgacttgataagcaagtgttaggcttcaggagggagggaggtctgtaatgtgaaacaacttcttgttgtctttttttttccccctcccattgttgtaaataacttttaatggccaaaccccagatttgtactttttttttttctaactgctaaaaccattcttccacccggatttactgtaacatttggaaaaggaataaatgtcgtccctttagtgatgtttcattgagtggtcttctggggtgtgggtaagaggactgcaccgacctggaggacaaaggcaggtaggtctgcaagtgacgccccacaagagacggggaagaacttaaaccaaccagggccgagggtatagaaatgagctgttttattacaaagagtttcacaaaatgaaaatatctcaaaaaggaagctaggctatcaacctccacctacagaattgggggaagacaggcaatataagtttttttgtttgcccaagatgggtgggaaggtataaacagaaccaatctaaaaatggctgctattacccaagcctgaaaaggggtcctaggagacccagacccctcctaaaaagttt

SEQ ID NO: 29263 - DNA, 1150 bp, Mus musculus
accaaggaggagaagccagaagccaaagggtgaggaaaggggctggtggctctctgtagcactagagcatcatcaccttctgtgtcctacctctgtgagagggaaggaagagcagggacagctgctggtccagcctacagagagaggcctctttaagggtggagtctgtatgtctctgcccagttcccagcagtcacctgggcagccagggtctatggaagtcactatagccatgtttgtgcttcagggccactagcatgagttttctcatgcctgtctgttctctctgcagggtcaaagaagaggtcaagttggcctgagcaaggtctgcagccccatcttctccccaagttcctcacttctcagattttatattttctattcctctgtgtatttatataaaatatattaactataacgtccccagggaccagagcacagggcagtggtgctaggagggctcttcccagagcgaccttgtccatcctgccacccccctccccccatttgcgtggaaagaaaacaaccagaagagaaaaatcctgaactgccaagtgcctgcttaggagctctgctaagatgcccctgttaaactttttaggaggggtctgggtctcctaggaccccttttcaggcttgggtaatagcagccatttttagattggttctgtttataccttcccacccatcttgggcaaacaaaaaaacttatattgcctgtcttcccccaattctgtaggtggaggttgatagcctagcttcctttttgagatattttcattttgtgaaactctttgtaataaaacagctcatttctataccctcggccctggttggtttaagttcttccccgtctcttgtggggcgtcacttgcagacctacctgcctttgtcctccaggtcggtgcagtcctcttacccacaccccagaagaccactcaatgaaacatcactaaagggacgacatttattccttttccaaatgttacagtaaatccgggtggaagaatggttttagcagttagaaaaaaaaaaagtacaaatctggggtttggccattaaaagttatttacaacaatgggagggggaaaaaaaaagacaacaagaagttgtttcacattacagacctccctccctcctgaagcctaac

SEQ ID NO: 29264 - DNA, 1188 bp, Mus musculus
gcctgcctcggcctccctagtgctgggattaaaggcgtgcgccaccacgcccactgccttcaagtcttaagagtgtaagtaagtgtgtaaatacaggatgagcgaggtgctgcatgttgagagttcttttagttcaatcacttggatctataaagtatttggagcctgaactggccctggtagcatgagcccataatcccagcagccagggagccgagacaggagaatgaggttttttgtttttaaaaaagatttatttatgccgggtgtggtggtctccccagaagagagcatcagatctaatcatggatggttgtgagccaccatgtgtttgctgggatttgaactcaggacctttggaagagtagccagtgctcttaacagctgagccatctctccagcccagagaatgagttttaactagcctggactgcatggtgaggccctgtctgaaagaatcttttaaagagcaggtaaaagggcttgccataacctgtgagagttaaaaggacggactcctgaggactgtccctgacctcacatgtgctctacagcactgcctagctcagtcacacacgagcatgatagtgtatttagcccgggtttgaggaactgttcaaactgagtatattttggaccaaggtgaataccatgtgtgtgatgctggtaatctggtttgtctgtattgcagactggcagacattttctgtgaagcgaagggaaggaccaggcagtaatattttgtttagggcatggtttttgttggtttaggttttttttttgttgttgttttttttttttttttttttggtggtggtgaagctgtttgagacagggtttctctgtgtagccttggctgtcctggaactcactttgtagaccaggctggccttgaaatctgcctgcctctgcctcccaagtgctgggattaaagacgtgtgccaccactgcctggcttggtttttgttttttgatatggggtctcactctgtagccctgtgtcacctggaactttctatgtagacaaggctggccttgaactcatgagacactctcaccgtgtgtcccaggctagctctctagccccctgcctcagcctctcaggtgcaaggattacagatgtagattaccatacttggtttattttaggcgtcgttttgccatatagtagattggtctctgcagcaa

SEQ ID NO: 29265 - DNA, 1194 bp, Mus musculus
agaaagaagatagatggatggatggatggatggatggatggatggatggatggatggatggatagatacatagatagatagatagatagatagatagatagatagatagatagatagatagatagatagatagatagatagatagataaaataagtaggaaagaaagagaactggagtcagtttagcatcagccttgcttttgagtttccaaagattaaagtcttgatgtttttttcttccatcaacgttccaggaatgaccaaccctgaagtcattcagaacctggagagaggctaccgcatggtgagacctgacaactgtccggaagagctgtaccacctcatgatgctgtgctggaaggagcgcccagaggaccggcccacgtttgactaccttcggagtgttctggatgacttcttcacagccacagagggccagtaccagccccagccttgataggcctttcggtcccaagatcctcccaaccactgtgccctggctagggcagatggaattcctgtgccatatctgtgtggcctgtgcacacatggactctgactctgtacatgaaacctgtgcgtgtgtcacacataatgcagtttctgtcttgtacacacatctgtagttatgtgggttctacacatgtgtcttatacctgtggagcacgtgagtctaagccttggatacctcctaagatgtctcttcctataccgttccatttcctgaagccatagagaggagaaggtctgcgattgatgcgtgtctctgtctaccactgcctttcagagggtctccaggaaggccctccttgtgggctgccatccaatctcatgtctctgtgtgttctgtcctggtgcctagcacacaccaggagctcaataaaagtctgttgaattaaggttgtacatttttctactgcatactttatttctttatggcaaatagtgtgtgtgggggggggtcagatgatggagactggggttgctgttggatcgtccacactagattctcctgccctgagttgccactatcactacaggacattctacctgtaatctaagtgtatctctccactgaacatggaataagccattatcatgtaaagaatactagatgtccaggtccacaagaaagaaaaaacataattgttgctctcagagtaaactttttataggaaaaaccaggttcaaaag

SEQ ID NO: 29266 - DNA, 1177 bp, Mus musculus
tgagttccgttcctagtacccacatcaggcagttcacagctgcctgtgactctagttccaaggagattcaaggctctcctctcagccttaggcacagattcgtgtatatgcacatgcaggcacacacccatctacagaatattttttaattaaaaagagctggggctatagctcagtgataagagtacttggggttagtcaatcccagaaccaaaaatgagggggaggggatggggtaagagattagattgagggtaaggaaaaaatgggcttgggcttctggggaatggtggcttgggactcgagcaagtggctctaactcctcctcctcctcctcctcctcctcctcctcctcctcctcctcctccagtctggagaggtgttggtgaacgtaaaggaacactctcggcagatcaatgacatccagttgtctagagacatgaccatgtttgtcactgcatctaaggacaacacagctaaggtgagcctcactgccctcctgactcacatccagcctgtctgacctgcccagaaaggtgcccatcacagatcctctccctccctcctctctccagctcttcgactccacgactcttgaacatcagaagactttccgaacagagcgtcctgtcaactcggctgctctctctcccaactatgaccatgtaagaaggccccacccaggcttccagctaaagcttctggaatctggatgtttgcccaacaaacaggctgtaaatgatgggggaaatgatgtcaggtagagagggaactcgtgggattgttacagtgctgactgactgggggcaggaggtccttgacatggctgcttacccctccctgcgggtcttcccactctgtgggtaagatgttacagaagagcagggagagaagcctgtggacaagtcctgaggcgctgagctttcttccctgtaggtggtgctgggaggaggtcaggaagccatggatgtgaccacaacctccaccaggattggcaagtttgaggccaggtaagggaaagaggctctcccacactgaaactacagcaggccgcctttcagagtacacacaggctcctgacccctaaggacaaaggggatgtgacagatgtccagtggagcagatggggtcatgaactcagctgcacatacagctggctaaagagcctgctcgcaca

SEQ ID NO: 29267 - DNA, 1176 bp, Mus musculus
tagcatgtgagtgcctggtgcctgtgaaggccagaagaggatatcaaatctcctggaactgcagatacagattgttgtaagccatcatgtgggtgttgggaatcaaacccaagtcatctggaggagcagccagtgctctttaagctctgagccttctcttcagctctcctagccatttaaaggaagggagctctgtatttaagatcacacagtgagctagtgacaaagcagtggagcccatacatccttactgtcatccggagtcaattgaacaggacccgaaaggttttttttcacactgcaactcaggttggcctttacctcttctgactccagacaaaagcacatgaggatgctattggaggcctggctcttctacagcttatgttaggaaaggaggagaacccaggagctgggcggtcctatcagctcttcactggtaaatgagcagaaggcaaacctggcttggctagagcctgcagagggtttgtagtgcaagctaagctattgattattttgggatgtgaccatcctatcattttactctttccagatcgtcaacgtgtggtactctgtcaatggggagaggctaggcacctacatgggccacactggagctgtgtggtgcgtggatgctgactgtatccttttggccatgggttagccagccttggagatactggctttggcatgttgtggcggtctagagaataacactccctactcccagctacttcatcctgtgggaaactaggacaggttcaagtttgggaattcagaggtcagggcactctgaggtaaaagtgagaaagtctctttgggactgacctgggagatgctctgatggcttccaagaagatatggactaggtggactatgtattcttatttgtatatatgtgcgtggtgaatctgtgtgcacaggagtagggacaaatggaggcatcaggtcttaagttgttcttcaacctttttttttttttttaatcttttttatcatttttcttttccctaaagattaggggttttggttttggtgttttttggtttttgggttttttttttttttttttttttgtttgtttttcaagacagggtttctctttatagccctggctgtcctggactgtcactctgtagaccaggctggtctctgcctcctgagtgctgggattag

SEQ ID NO: 29268 - DNA, 1695 bp, Mus musculus
ctcacgttgccctttgttctaccacagctctcctgcttgcttgtggcccgcagtctcctttccctgagcaatctgggggcaggggctgggatgagaaccaggaccaggggtcaccatcttgtcttcttccttggccccactgaccccaaccccttgacgggttctttatcgcagaagcagtggctggcatggtgctcaccatcacagggatcaccgtgtgcatcacaagctcggtgagcaagacccagggccaaccgtcgcactcctgagtgggccaaccccgaccgtcagctctgctgtgctcggtggatgctgggcccaaggtgtaggcagaatgattggccagctggcctctctcatctctcagatcatgtctatctcaggggccacaataagaaacatactctccatagtgccaaggctacacagaaaccctgcctcaaaaaaacaagcaaagccgggcgtggtggcgcacgcctttaatcccagcacttgggaggcagaggcaggcggatttctgagttccaggccagcctggtctacagagtgagtccaggacagccagggctatacagagaaccctgtctcgaaaaaccaaaaaaaaaaaaaaacccaaaacaaacaaacaagacgaagggcagcactgggaaggttttgtaacctttagtgggttccacggttgagatttagcactggagccaggcatggtggtatactccattaatcactcaggaggcagaggcaggtggatctctgtgagtttgaggtcagcctggtctacaaagcaagttccaggacagccagggctacacagagaaaccctgtcttggaaaaccaaaaagaagaaaagcattaaaaggatttagcactggagactgtacagccaccctcagctgccatctttgtcttcctgctgccacctcaggcagctgttactcagcctccgttacctgctgtagactgtcagcatcctcacacagcgcctccattacatggaaagggctggctgcagtctcaaccaggaatggccagaagcctccacagctccattacagtgctttggctggctgaaggtgggatttggggacagaagttacatcagaatgtcagatggaagaaaaacaagctggccctgggcaaaatgctcaactgtcagccccgcaagtagacagctgtgtgccggacaccacctagctgcagcaaacatctggccagcagcagctttcaataaatctacagcaaacaaagcttagcaaatgttttatttgtgttgagtatgcagtgtctctggcaggatcacatgaggaggtagcctccacagaacctgcctgtgggcctgtgactgaggaggccacacctactgtgagcccaggaggcatggcttctccagaacaggttgctgagggctggggacagaggtggctgggagtggttgtcccccagtttgtatctggagctcccagctcttaagatggaggagcatgggcggaggttggggctacagcttcaggcccaggctggtgttgcgcagacaaggcctcttctgctgtctctgctgccctctggtggatgtgtggagacatacagagctatgtgtgtgcccaatttgcatggactgccagaggtccccaaccaggaaaggcgactactggatatttgaacgcctcacaagggaaacaggaagccaggctttca

SEQ ID NO: 29269 - DNA, 2108 bp, Mus musculus
cctccagtaccccacttggaaccaccctgtcagggtcctttgccatgtgggtgccaaggtatcctgcttgggaagatgagatatttcagagaagggaagaggcttctaatggctttgccacaagcttgcctatgggcttcagcctaggaggcaaccactggttcccatcacttctccatgcagcctttgctggaccgcaggcccacgtgccccttggcgcatggtcgtttcttggctcctgcccctcacctccatctcagaggtgtggtttttgaggactgctcttgtgccatttccttcgaaccctcttggccaaaaagtgagtccttgggatttcacttcttcctgcctaagctggctggtaggtcaagaacagacatcccaggaaccaaaatagctgtgaggagttgtcttcaccgtccctccccaccctcctcagtgttactgtggtctcggggctctgctgaagctctcgtgactgcacacctgccaaggtgttgagtcagtttccacaacagcttttctggagtgaccgtctgggaagctgaggcttctcttccatacactgagactggatggaattttgcttcttgtatttcaactattgcaagtttatctttcataactagcctctaagcccccacacactcaaattaaacattgagctgggtgtgtgatatattcctgtaatcccagagctcagcagagctaggaagcaggaccccttgtcaggaaaccaaaaagtaaacagctggaagaaaacatctcgtgctgatgatcatgtgtttaaatccagaaattacaaattaatgacccctttcccatgtcacaggctctaccatttcaaatacttgctaccctggtatatttattcactcagggtgcccagcagctgtgtgttgaggctttgccatctccagctggaatctgttgtcctgtggaatttctcccaaggtcttatatcttggaaatcatagtattcttccggttccagtgaggcctcagcccacactccaggctgagatctgacctgttaacccatggggctccttaggccacagagatgtaagggtgaggcatcttcctgcctccttgaagacagaaggaccttgtgtggtccactacattggcttgcctcacttcagctacctcttaaagcttgtgcagggtgacagctgctgggtctcagtgtggcaggccagagaaccttggctttccctccatccacttgtaggcacccagggcaatgcagatagtaatctctcccttctaccttctcccctctgaccatatctacagtcactacagctgctctgctttccaaagtcagcccaggagactgggccagcttcagggaggctgcctgtctgtgagagggccagcgccttcctcacttgggcaagtcccctgcacatgacctcattttaggaccaagagctatgttggtttcttagattgttagctttttctctagaggaccacagtgggtatggcttggagtccagggcccttggctatacaaacaatatttaggtccttgtccaggggagaacttcgtgtatgccatgtcagccccactttttgtcgttgttttccatgaggcttttttggaccatggtcggagcttaggcactttctgtaagaatgtttctgtaaagatggttatttaacgcttcctagtccccatcatgttagtcctccagagcgctaacccagaggccagtggaactgcccaggtgtccacagaggggctgcagcctgcagagaactgctccagcccccctccaccttagtagcatgtgtggaccaccaggcatctgactgcccttgaccagcctcgggtaggagggctgcctctgtccccatgactgctttcctttgccacccatacttgtttgaagttgtgctgacagcttttttttttgtaccctttcccgttcccagtttgcgttggaattggcagcagccagggacttgctattgatgaattttacattaaatagtcctgttgccttacctgtatctcagccaatcgaattattggatctttctggatctgcagagtggcagtggccggtcatcgtcccacatcctcctggccacaagtt

SEQ ID NO: 29270 - DNA, 3740 bp, Mus musculus
aaaatttttttcttttattttctttagtggtgacttccttcccaattatctttcttcatccatcccagtcctctgccctgacgtgtgtaactcttgggtacttgagcagatggaatattccagaggtgggaggtgggaggggaggggagaagtcccaaacaaagtgttcttgctctgacccatattaatcttgtatgcttggattatttaattttttcttttgcacatttttcttgtattaaggttgttcttcccaaaaagctggatttagtaacccagccaccagcatcgtctggaaatagaggctaatggggaggcccccatgagacaaagatccctccctccctctaaccctatgcctaagacctctttagtttgggaggatccccctcactctcctggagcaagtataccagtggagtggaagggaggggcacaggcctttagacagggcttctcctgtgtagctactgaccctgtttcctacccacctcctaaatggtgcgacccaacttcatttgtttacttgaaaattcacctcagagttgaatgaacctctgaggtggctgtgttttctcctgagcttgagatggggggctgtggtccttccttctcctgaggagaaagtccttgctctgatgacccctaagttgcagaggaggttggagttagtgtcgtgtatcgggatagtcatgaatccctgcctttggcctttcttcttccttctgccatagctggatcatgtatatttcacttccaaaggagagaatggcaaaaagttctgttgtttttttaatagtctgtattttaagtaggtcagtcttaattggttttaggaggacaaactggatgtgagtgggatactgtgaggaagaccagaaagacgaacaagtttctgctcacagggctgaactcagtccttattttctctgcttgtattctgggccaccacttgggaccaactctcacttctggaacctttatgaagtaaatcagctgggtctgattgttcccagcctgaagggagcaaggcctgatggagtctgctgctctctctgttccttgctcccaagcaaaaagcatcctgccttctctaactcactgttacccacaatgaaccctgttggcatctcccttctaaagatccttgtacctagcttgcatttccctttctccctctttccccctcccacctctctcccccctcctcctctcttccctccctctctctccccctccctctctccctccctccttcttgaataaagacagttcagtacctcagaggctgacctgttttcaggggttacacagtacactaaaaccaagctctgggagctgggtacagtgtcagctgggcagaccacctgtggaggtggcagcacagtgccctgctgtggtgatcccccacacccttagccgctctctagaacagcactgttcctcctgttccagcagatctctctgtgccccacatttgcagatctgaagttgaggttcttgctgctggcctctgcctttccgtctgccgtctctcctttagttttgagttcctgctccagattcctcttcagggcaggcagttaatactgaaaagttcaaccaacattggaccacgctggcgagtgccttccgggaaggcaaggtgctggcccttttgtttttaacctgactgaaactgctcctagttcaaagaaaagtcctctatgaagccatcatcgtccttatctgaagagtagacccctgaacctctcaagtgacagttaggaccctggccctggagccagatcctcagcatgagacacaaatgtcctgctttcctctgcccgttttccattatctctggcttcagagcagatcctgtgccacatggaagaggttggttatctatctagctgctctactctaggtgtccctcacagtcggctcctggccgactgacttcagtttccagccctccccagtgatcatggccctggatgttggttgtagccttttggtattactgtatgagttccagcttgcttggtaccgttgttacctgggtctgtgcacacaagtgcttccgaggagcaggtattggtagcctggtttggaagaccttttggtgtcccctttacccgggaccttgtatctaccacttcccctttctgctgcccctgggagtcatccccagtagcctatgttctgaagctaactgtgggctagagctgcagtgggattttagctgagggagaggaaaagacggtgcttctgcgtggagtttctttctttgaaaccaagccggtacaaagacacacttcccacacagaggaagtgtgtttctgtctgcctgcagagctagcagctcacagttctacacgtcctggaggcctctgcactctttattcagaccccagctcttctcttccaggctcactcattttggtatccatcctcttgggtatttttcaggcttagattctaacttctcaaaggaaaaaaacccaaacttctccaggtccctgcagatccaggacggagacaggatagttagtgacaagcttccctagcaggctggggaagtgtgcaaggctaggtgcactgaactatagattctgagcagtggcagcttcaagccgcacttccctgagaggtggtaagagacaggcttcctggcacattctagaccagttttgtccagtatattttttttttgttttatcttttgtattcttttgttaagccaacaaactgagaatttgcccctgtaaggatccatgtggtagatactagctgctctttggccaaaggccttcatagctgactcaatctcccagtctatcccctagtcccaccccaggatgcacagcaagggaagaagctaaggtcaacgccaacaaatctgagtgaaaacttgttttccttctgagagagcatcttgtctgaagcctgaactatgtgcaggaccaaagctggctgtgagaaaagcagccagaaaccggggcgccctattaccagaggggagtgctcttgtgaccgtgtcttcaagggcttaggcttacctacctgcttgtaggccagcctgacttctgatgctcacactagcacacaaagctgatgatgcccactcaccctgcactcctgtggctctgacgttaaggtttctgtttagagaaaagaactgtgtagcatgtgcagggaactgtgaaggaagactgagaccgcctggaaacctgtcaggggctcacaccacgaactctcagaagttgggcaggggtgctggctttgttagccggcttttttgggaaatgctttttttgacctgttatataaatgaagtgggtatgaggtctcagctacccagcagatggaacatcgcccagggacagcttggggtttccaggtaagaaccctagaaaggtggatttaatcctcacaggttttgttttccaaattcatttgcttttatttttctaagaactgtaaactctattttttcatgttctcagggcccctgggtagacaaacaaagcttgatttcagagcagaaataggccaagaaaccatggcgttgcgtgtgctgagtccagacaaatgatatttatatacacatccaaatttgaagagaaaatgtatttctttaggtttcaaacactgtaatagatacaaagcaaaaataaaaacctgttgcaaagttctaaattgtcttctttggtttggagtgaccctggactgggaagtgcacatgagacctaggc

SEQ ID NO: 29271 - DNA, 1229 bp, Mus musculus
aatgtagggaagcgctctaccaactgaactgtatctctagtcctaaaataaaagatttgactgtgcttaatagattaatatcataattggggaagcagttcgtaagatttttataaaatcaaatttttgaagtaaaaatttgttgattatcctcagcttatttacaaatggataccctattttaaacagagtacatgtgaaagagcaagtcaacaaaagcagaaaaatacagtagttttgtgagctgaagttaaaaaagagtccatagaaggaaattttcttcaagtacccttaatgtatgatttgaatgaatttttaagatctcaagacaacgaagaatgagttagacgtgattctaagactggttggtgtttaagatcttgttatgtatgtcactcccccttatctgaatgtttgttacgttttacctgttttggtttcttagagaatctattctttctgaaggcttcatgtctattccgttctgttactcactttattttacctttgttttttcccccaggtttttcgttggaatatacgttgcacatttatggcgattctgagcgtgagggcagacttctgccaggctcagcacagcctttccgctgacaagtgagcttggggttatacgtgccataattaacattgccttgacgactctggacaccgagactggcctcagaagtagtaggctttttttttttttaaattgcaagcgtattcttttaatgactccagtaaaattaagcatcaagtaaacaaaagtggagaagaacctacacttttaacttgtctcactagtgcctaaatgtagtaaaaaggctgcttaaattttgtatgtagttggatttattttggaagctgaaggtatccatctgcagacattgaggctcaagttgaatttggattcaagtggattcttaatacttctgcctgtgctgaagagagaagcttcctaaggaacaagcaagttgaatagagaaaatagtgatcaataataggcattttagtggtctttttaatgttttctgctgcggaacatttcaagatttattgatttcctcctccccccatttttttcccaccacactcacacacgcacgctcacactttttatttgccataatgaaccgtccagcccctgtggagatctcttatgagaacatgcgttttctgataactcacaaccccaccaatgcgactctcaacaagttcacagaggtaag

SEQ ID NO: 29272 - DNA, 3149 bp, Mus musculus
gctttgtccttgtatgctctagtttccgtttcgttttgttttttaaagcatcctaatacttgtcattctcatctgaagaatctgttaatctaaaaggaaagagtgatctggtgttcaaaactctgctgatttctgttatactacagtaacaggcagagaaagaaacttgggaggcagaggcagaggcaggcagattctgagtttgagctgtttacaccacaaattccagaacaactaaggctacagagagaaacactttcttggaaaaacaaaaggaaaaaaaaaagttgatgtttcagctttgtaaagtaatgtgctatggaaactatgtaggctttcagctagggagagctaactagaagtgttattctagacatagcacacgtcagtaagctctacagctctttgctacatgatagtgtgctgttcttatgttttcagaaaaagaagaggagcattcaattccaaacagctgctttacttggagaagtaccgacctaagatgcggttacgcttcagagataccaatgggcactgctgtgttcagtagaagtagaagcaggctggctggatcgtggcattagagggaactcttggtacctggaaatgtgaatctggattcttacctgtgtcatcagagtagtaatggattcagtactcctcaactcctaatgattgagaagaaggcaaacgataaagaaatccctctattacacgaataaaatgtttaagaaaagaaaaaagaaaggaaaggggattaatttagtgaaagatgattttgctcctagttttgatttctgccaggattgaattatttcaaaatctcctgtgttttttaagctttttcaaaatagatgtctgaggaaaaccagcagaatattaaccagtgtggagccagttgttgggagcacacacttccattatgcttggcacataggtctccttgtggtgggtgggatctgggggaggtagattttcctcatctctcttcctgcctccctcccatctcctgatccacatagatggaatagaaagcagcctttgttgctgtagatgtgcgtgtgtctggcagccttaagcccacctgggcacttttagggaaaaaaaaaaaaaaacaaaaaaaaccaacaaaaaaataaataaaaataaaagcaaagaaaaggcagtggcgcatatattctgtggtccaggctgtttctagtctattgatgatggatgcttatattagtttttttttttaacccccttgtgcccctgatctaccattagggtgtgagaggtagccaggaacctttggttttataaatggtgacgaaatgacatcctaaacagagtctttctcctgtaatttagctgagagaattctttttcccaacagtgaaacaagtgggcctcctagaaactttattgcagagatgactggaggccattggtgtttccaggagagctagcatgtttctacaagtgtaggactggattgtggatctgctatctaacaatgtcatggaaaagtggtatcttaaaattttaggaccgatttcagaaatagtcaaaggagcaacagaacattcattgtattttggtcttgagaaatgcctatagttttccaaattattcttgtacagttttatttgtacagttcagtgtaaccacctatcatcttgttaacactagattcttctgagattcaaaaagaaaaatcactgtcagagctagccttgcctagtgagtctgtgtccacaggctgtaacagggtggaagagcaacagtaggcagcccagggagcagcatgtgctcacggcatcatgtggcagtggtgtggggtctctgctcagtgtgttgatacagaaaagctgtttttccttgtttgcagaagttgaccagacaaagcaaatggaggggcacctctgtgtaccctcttcacctaagtgtttataaccagcagtaccctgctacaagccttgggtgcagccatcactggattttgatcgtcaggccagcaggatggatgacatctcattgatagtacccagatgttggtggctttctgagttgcctgtttactgttgatgcaattgttttgatttttaactaaatgcaaataccttcctgcctcatcccagaaaatgaaaaataatgcttttgacactgtttctagaattttaaagttgaaaaatgatgatataatccagaaattgttacttcggagcatgacaatagatttctttaacaaagactcaagatcaaatttcttacctaaaagtttaggttaactgttgactcctcaagggttttgatcaatatcacccaaaccttttccacttgacatgctagaattttggtgtgtgtgtgtgtgtgtgtgtatttgttcacgagcacaatagctcccatgggggtctgcacatgcaggtgtccaccagcatagcctgcctgagatagtgtcattcctggttctggggagaagggtgtgtgaaggagaataaagcagccctttgtcttaaagaagactaatgttaattgttctcagaactggacgttttttttccccccatcaaaattaaaactctttcttttggatttaatgaagtattgctaactgaagccagtttgacttgtgagagaggttagactgacagaaggtgtgcagcctgatttacaaccaaaccctgaacccttttgaagaacaataaaacatattttacatgctttttgtgaatttcttccccactcctaaacagttcatgtttgctctcctttctctgcttggcattctcaaggtctgatttgtgtcccattattaatggatacgttagagaggtgaagtgagaggtatttagtaagtatgtacttgaccaatctcattctaaggaattcatttttgttataggtttgcataatgtattacaacttagatttaaataaacctttttgggggagtggggtgggttggggaggggagggggctttgcaagacagggtttctctgtgtagctctttctgtcctggaactcactttgtagaccaggctggcctccaactcagagatccatcttgctcagagatccatcttgctcagccttctcctgagtgtgggattaaatacctgtgctaccactgcccagctctttttacacttttttttttttctt

SEQ ID NO: 29273 - DNA, 1122 bp, Mus musculus
cctcatcctcatgtctgtgatgtgtcttcgggtatgtgtttgaaggtcagaggacaattccgtgggctcaagttatcttcttccgccttcacttggtttgtaggttagctttgtaaacttcacacagagtcatatgagaggaggggacctcaactgaggagtggtctccatcacacgggcccgcccgtagacaagtaagtctgtaggacattttcctagtgattgatgtgaaaggggtccagcccccaatgggtggagccacacccagggaggtggtcttgggttgtataagaaagcagactgagacgagttgggttcgtgtgtatgtgtgttgtgtgtgtgtttgtgtagggaggcagacagctccgtcgcagactacggacctctccggggtctcagccgccaaagaccccgtccggtaggaaacactagccgggcatcatgagtggctgtcgagtgttcattgggagactaaatccagcagcgagggtgaaagatgtggaaagattcttcaagggttacggacggatccgagatattgacttgaaaacaggttttggttttgtggaatttgaggacccaagggatgcagatgatgctgtttatgaacttgatgggaaggaactttgcagtgaaagggtgacgattgaacatgctcgggctcgatctcgaggtggaagaggtagaggacgatactccgaccgttttagcagtcgcagacctcgaaatgatagacgaaatgctccacctgtaagaacagaaaatcgacttatagttgagaatttatcctcaagagtcagctggcaggatctcaaagatttcatgagacaagctggggaagtaacctttgcggatgcacatcgacctaaactaaatgaaggggtagttgagtttgcctcttatggtgacttaaagaatgctattgagaaactttctggaaaggaaattaacgggagaaaaatcaaattaattgtaggcagcaaaaggcacaggtcaagaagcaggtcacgatctcggaccaggagttcctctaggtcccgtagccgatcccgttcacgcaggagcaagtcttacagccgatcaaggagcaggagccggagccagagcaagtcccgttctggt

SEQ ID NO: 29274 - DNA, 1151 bp, Mus musculus
cagtatctgtctccccaggcctccacttgctgtcacctcccgggtgatgacagtgactgtgcgtccccccacccagcctccagctgagcccctcattacagtggaactctcgtacatcatcaatgtgagtgagggcccggatggggacccgagctatctgcccacacaggcgtgaggcctatctcagggaggtggtctgtgttggacggtgggtgtggcttgtgtgagagctgctgtggcgggcctgatgatggccgggcatggtatgctgctcacccgagactgcacgcatctctttgttctccagggcaccaccgatccccactgtgccagctgggactactccagagcgtgagttggggcaaccctagaccctctcatcagaaatggtctcccatctagaaggtcaaagggttccttggtgccatcctaggtctgagggggtcaagagcacatcttggggctccttgctgtagctttgggattacagagctgggctctgggttcatgccacctctccctcctccaagagataccaactcgggggactggaacactgagagctgccagaccttggagacccaggcggctcacacccgctgccagtgccagcacctgtccacctttgccgtcctggcccagccacccaaggacctggtgagtgggagagaggcctgggctgctggaggcatccgggtgaccccaaatgcagccctggacagatgtacctgggcctgcacatgggaagggggggcagttgctcgcagtcatgacacttgctccagagcatgtggcagtaggtgagtgtgagctcgtgtgcacatgtgtgcagctggttgtgtctggaagcatgtggatgaatgggtgtaaatacatctgtgcatgtgtgccctcctgcacgtgaggagcatgcctgcttgcgtccgacagggagactgggtgcccgacctttaccctctcccagcaacccgtctcccacagaccctggagctggcaggtgctccctctgtccccctggtgatcggctgtgcagtgtcctgcatggctctgctcaccctgctggccatctatgcagccttctggaggtaagtcggaagctgagcaggatgggaggtggctggctctccagggttaggcaggcagccaatgcc

SEQ ID NO: 29275 - DNA, 1163 bp, Mus musculus
tgttgactgaggccttccgggaaaaggataccgctgtacagggcaacatccggctcagctttgaggactttgtcaccatgacggcttcaaggatgctatgacccagcctccctaaagggagtggagcacaccaggggatgtgggcccctcctttcctcctctcctagcaaagagtgtttcctagcctgagctaggaagggcggagcttgactatcctgggctgtggagtggtcttgccttggagtaggggccctagagtagcaatggagttagtgtctggccagctgtcctggcctctggctttccccctctactccctgatgccagtgctaagtgctcattggctgcctacttgtcatccctcaccgagaccatcgggtcagacgagcccaggttctgcacagtggagtcagactgagctgagagagatttgctgggaccagagcctggggtccctcagctcctcagtccttgtatgttaacattaattttcctgaggctttgcctgcacaagaagcttggacattctgccatctcggccatatctgatgaggctcatgaccaccaaaactcggacccctcactgggctgccacgttccacccagcttctctccccaggaacattgtcacatcctactgccaacattgtaatttgcttgtttgtttgttttttttcccccatttggggccaaaagtccaggaaactgtaagtgtcaataaaagaaagactctgtagtcccatgttttccaccatgacttcttgactgtgtgtccgtgtccatccatccatccttccatccactccctcgctatagaagcatcagctgcttccaagccatacgaaagaagctgtgttagggaccttagtgaccgtcttgtgtgccaagatgaagtcagggccctgacaggttcctctgtgactaggatttgtccaaaaaactgcctgtgtttcttaaagttttagggctgccattctgggctgaaagcagccaccccaagacctctcacagtgtggtccttttattatcttaggcctgagttttatctcccagacaaactccatttatgaagtcataactctccccctacttttattaagcacagacaccagtacctgccagttgcatttctagatcagcatgatacccagtctgcactgtgt

SEQ ID NO: 29276 - DNA, 1202 bp, Mus musculus
ccgagcctctgagcctcttctacaagaagaggacataggaccgttgagatgggtttttgggtaaaggcccttgctgtcaagccttgacaaccccagtttgatacgtgggacccacacggtggaagcagagaagggactcccgcgagttacaacgaacgccccagtctcccaccccttccccataagtacgcctacacgagcatacacaatataagaataaaaccacagcgaattaaaaaacaaggcggcagaaggatcaagcggcgtttctccagcgtggcaccagctcaagggcgagtttcctttcagtatggccgggggatgctctacttgggttgcgggaagcgccccgcagccaggccagggatgggttagatggcaccaacaggaccgcgggcgccgctgacgtaggcgacgggagggctgtgggggatgggccccagccctttgcgggagtgcaagccccggcttcctatttcgggagcgaggggtgtgggccactttcatcatgtgatgcgagggctatttaaagaggctgtccagccgggagctgcggttctcagtgcctgctcgcctcctcactcatcgcaccatggcggacgcctttgtcggtacctggaagctagtggacagcaagaattttgatgactacatgaagtcactcggtgagcgaacgaacggcgcaggatctagggtcaggagggccggcaaggcggtcttggcgctgagctcccagggggagtgcccccatgtgcctcccgcaagctcctagccagtccagacagggaatactgaggtgcggagggtggcctgggctgaagccactccactccaccccaccccaccccggcctcctgggaggggggtgtcgcggtccaagcttggcgagcctcgtagctggaggggaagggtagaggcagctgtggccgcagaggtccgggatgggaggctttctaggaagcagtgtaggtgatccggaggtggaaaggggagggaaagaagggcgggaggctggccgcaggagaaggcaaagaggagcatggtggtccagaaattgaattccgaaagggaatagagcagataggagtgtacagagcctggaggaagactaaagaaaatcagtgaattccatctgggaagaggtgaagatacagccaggcagtcagcaacaagccctacccctccatgttggggtagtgaag

SEQ ID NO: 29277 - DNA, 1406 bp, Mus musculus
tgcctctggagcactggggtttcgggcttgcaccactttgcccgggtttctttttgcaagggcttgtgcagtcctgcctgaccttcaactcttcatgtccttgtccccactttcccaccgctgcaattgcgggcctgcaccacacacagcggtagtcgcctgctgatcacctgctgtggctttcacgttacagagacacacatagatgttgaaactttacatttcccttttaggaaaagaagaaaaagaaacatagagacaggaagtcatctgactgtgatagctctgactctgagagtgacacgggcaagaaggcgaggcattcatcaaaagacagcaaggccaccaagaagaaaaagaagaagaagaagcacaagaagaagcacaaggaatgaggatggaacaggccgcggcagccctgactcctgcaaagactcactagtgagagtgtggcctgcctcctacccagacttgtccccatggtctcagatggcttctccccctgcagcaagcagattggggccccacagggcccctcccaacatgattttcccttgttgctcctgaccctttgcaagcgacccctgcagccattgcattcatgcgctcagtgtcttcatttcagcagaaggttctagtcccaaccggctgccactgcccgagctggagtcctctgcaggagtccatgctggagccccgggtgctgctgtggaggggagcctggccgtgagagagagagcagccccaacctgcctgctgtctgcggtggctgtgggtggactctgcggcctccatcccctcagccagggcctgtactccagtgactgctgaaccagagatttgcagccacggtcattgctctgcttcctgtctgtcacagtgtgagtgactggttccatttcaagcctctgcttaaactcctggcataaatggaaatgtgtttggttttaaactttccaaaaaggctttattcctataatccttcctgggcgacttacagacttaacacattagttcacagaaaacacttactatgttatccaagaccctggaaagaggccaagccgaggcacaaagccaaggccaccagcaggtcacagctttcttgagattactcataaaccttctcttccatagtgatgaccgctttcccttgtatttgtaaccctggggacttgctgggcatgagtgggcgactcttagcagtcacctcccaccacagttgttcacacctggaccttgatgtcctgagcctgtactctagagagagggtgaccacagcacaccatacagcaaatccaggaatgtctgtgcaggatgaatgtgaaatagccacacagtgacagccagctgctctgccatgggcaggccagtgtaagggcttgcatagatgctagaatgacagc

SEQ ID NO: 29278 - DNA, 1193 bp, Mus musculus
accctgagtttagttttcagaatccgtataaagccaggtaaggtggcgtgtgcttgtactctcggctctggagaggtggacaggtagatctggggcccatcagctagacagcctagtctgcttgcaagttcctgactttgaaagatggtacctatcggcctggcgtggtggcgcactcctttaatcccagcactcgagaggcagaggcaggcgaatttctgagttcgaggccagcctggtctacagagtgagttccaggaaagccagggcaacaacggagaaaccctgtctcaaaaacccaaataaacaaaccaacaagaaaaaaaagaaagatggtaccttatggacagcaccgaaagttgtcctgtcttctgttcccgtgcactgattttcttccacacctgtgtgcacgcgcgcacacacacaggctgtagtgtcaggaaaacagatctaattgatgaaccagtgttgtgccatgggtatataatttcgaaaagactttgggtattttccaagtaaggtttttcggctgctgatggcttctcatgtcttcctcacagtgttgtggaacgtctatggagactgtgataactatgcgacgttgaagggacacagtggagcagtgatggagctgcactataacacagatggcaggtgagtgagtggcccgcagctgaagtgacagctgcttcccacagtattgcttagcagcctttacacgtcagccctgagctctgtcgcttgggagacgttctcagaaactggtacgtgttagctggcacagtgttgtaatcctgtaatgtcagactgagaaagctgaggcaggagaagcacagttttgaggcccacaggggcgatgcagtgcatacttaagagcacatcaccattttctcccacccaccagtgctcagggcagcccgttcatgagacataaagcaaatgtaatttgaaatagctctttgggggctggcgagatggctcagtggttaagagcgccaactgctcttccggaggtcccaagttcaaatcccagcaaccacatggtggctcacaaccatccgtaacgagatctgatgccctcttctggagtatctgaagacagctacagtgtacttacatatataataaataaataaatgaataaataaatctttaaaaaaaaaaaaaaaaaaaaaaaagaaatagctctttac

SEQ ID NO: 29279 - DNA, 1197 bp, Mus musculus
gtgctgtggaacagtgcctgcttttaaccgctgcaccctccagccccactattcagatttcttacatcatacatgcattacccaactcctttctgaaaaaaagtaactgccttcatttaggggatgtcggttattttattcatttagaaaaattatatggcagtattaaatgaagttttttgtaataccaatgaccttcacaaaattgctcatcttttttcttgtgacatccaggctatttttgttagtgttaatgtttattttttacatatttgcttaatcgtctattatgtaaatatttttatattttggctttagagttatttttaggaaatgctcaataatatttagagcctgccatgtcccaggcatattacaggcattcttatttataatctttagaatggaagagcacttgcctagtctgcctgagcccctaggttcaatctctagcaccacaaaacatataaaagacagacagacatgtacagaagatgtagatgctgttgaggctgagatgtgattcactggtggtgcacagaaccctggacttgaacctcagctataacaaacagcaaaggacaggcacctaacatattctgtgtctgtctgcagaggaagcccagaagggttctttgcataaatatgctttttcttttcttttctacatgtatgtgtgcatatacacatgtgtatgcaccgcttctatattcatatatgtgacataagatggaaaatcttacacagtgttttccagtttcttgtttacattatataataattttgggcattgtgttcattttgtctcattgtcagttttcctgggtgtccctggttggcctggagctcgccgcagttctgcctgtttcccaggggatgctcctgaatacgccactgtgccagccttgcgcacttttattagtatgaggtttttttaattttgttttaaaacaaaagtgcattatatagttcagagtatctttttttttttttttgatccttctgcctctccccacaagggatgctcttgacttggagtgggggtgaaatggtctcatggccaagttagtctggaactctgtggtgttcaaactgacttcaaagtcctccttcatctgtttcctgagtgctggaatgagacataaatcactaagcctgccatctgattttatgtaggttttttctcatttcttagat

SEQ ID NO: 29280 - DNA, 1205 bp, Mus musculus
cctctgccctgaacctatttcttcctgatcccaccctaattagggggctggtggctctctggactctggaatcagaaatgtggacattttaccccgtgcctgagaagatggaacccgagtttctcagagtcaggttagcttgtacgtcttcttttctttggggagggggccagtttctgtagccccagcccgaaccagagatgtgggttttcaattacacaattaaatgcacaattaggcataattaccagtgctccgagcccgagactgctcataacaggcgtgtaatctactgcagcctctgtttatactacgcagcccgctccctaatgatgctgagatgccttcacactgcaccgttgccatggagatgagcctgccgccaccatgtaaagctgacaaatggtactgtggtcctggacccctggatggtttccacagcctttgcagccaccttggaagtagaagggctagctgggtgggtcaggagggtagggcaacccttcctgtcctccaacactccttcctgtacaagccagcattggatcctctgggagatcctgagtggccctgagccactagggaacttcagatcccctcgtcctccagccataagcagggtgatccagtcttgtggaaatctgttctgacatctctgagtcatggagaggccaaggtatggacactcgtactgtccttggcttttggattatctggctctgtgaacttagacaacccctctctagggcttggtttccccacatatgaagtgaaccacacggtctccatagaagtttaccaggcatctaggacacactgtcagctgtaaatgcactaactgctccagcccatggatctacccatgcatggtggacagctggcatccgaggacgactgcagccacaccaggcggcagcagggcagggatccaagcccaaggcctcgggcttcaccagggccatgtcaagtcgacacagcatctttaccttttcccagttcaggactctaagaatggacagaagcacagagccacgtctgactggtgcccaaagccagaattccacattgtggcttcttttaaaaaacaaaaacgtggatatgagtgttttccctgcatatacctcatgtatgcagtgtctgcagaggccagaagaggatgtcagatccccaggagctggagttacaaacagttgtgagccaccaca

SEQ ID NO: 29281 - DNA, 2024 bp, Mus musculus
gccacactcccagccagccctacccctcagtgacctggtggataacgcagacggcagtctgttgcttgcgcagtggtggtggtgtcggcagtcctaactggcgctgggtgctagagtgagggttatctgcccttctggaaccttctccgaacaccctgtcattcccacttaatagatggagcagctggaggcccagaggcttaagcaccctgtccagggtctcacagcccctgaggggcagagcagacatccagagaccgtgtatctctctccaccaaggtgccacctctggagcatcctgccagctccccagagaacgcagcatttggttggagagtcagttgccttcctggaaaagctcaggcctgttccctcattccttaactgggatgtgaaaaaccggactgactttcttttctttccttatttatttattttggagtgtccataaactccaccttagtgctaagcagaaaacaaaacaaaacaaaactaaagcctagagatgatttgtggtctgcccaagactgccttgtaagttaggggtagcactgaaactgggaactgaagtaactttaggacacttgtctcagccttcctcttaggcccttccagtttgttgtaaggtgagaaagctctgttgagatgaagcatcatgcagcccagcctcaaactcactgtgggtgacgatgaccttgaacttcgatcctccagcctcagcctccagagtgctggggttgctggtacggccaccagtctgttacggggtaagaggagtctgtcagcggtctgtgtgcatgtttgtatacacgccaagctacacaggactgcagactgaagcatttgtggggcagactctggcacggagagatttgtggatcaataaacatccttttttgcttcctccttcttcatttattcatgaactctgaactccctggctcccaagaaaccgcctggaagaaagcaattagaacgtaattagagccactcctatcgccagcggggtggggtggccctgggagttccctgtagccccagctttgcagcctgtgcacactcagcttctgctcccccacagagacagggacatcctcagcagggacaaggaccactctcagaggaacttaagtacttgagtgctgctctggctctggaggagggctctccctccgcattgccatgcatctcctatgaggagtctcccagcggtctaagcgctgagctcttgggctcaccctaccagggatccccagccatacactgctagaaaactaaaaggccccatggctcctgctttccagcaagcccgcttagcacaccagagcggatgaggactgccaggatggcagcatgttataaatcacctggagggagccatttaccagccaaggctccattcactgccaaatgattaatattaataataagccgggtgtgatggtgtaggcctgtaatcccaggtctctggggaccagggcaggaggatggagaggttgaggccagtctaagccatatagtaagaaccttgtctcaaaaagcaacagaggtagcacttgggaggtggaagcaggaagaccacaaggcaaacgccagcctcagcaccatagaaagtgtgagaccatcctgggctgcataagaccccgtctctgaagcaaacaattataaaaaaaaaaagtaataaaagggtcgttggctaatgctttctgagctgtgttttgatgttgttaatcattttgttttgagatagtgtctcactacttatcgatggctggcctggacttgatatatacgaggtggcttcgaactcccagagatctgcctgtctctgcctccccagtgctggaactaaagacattgcacacgatgctcagcttatgagacatttctgagctgagacatttcggcttataggacatttcacctgctcttcaccgacacagtgacccactagcaagaagccaccaggattccacgtgcctactctgtgaggaacaggaggacaaaggcagagctggctggca

SEQ ID NO: 29282 - DNA, 1152 bp, Mus musculus
actctgtagctcaagggggtcttgaactttagattcttctgtctcaggtccagcaagttcttcatttttatgatgttcaactcacctacttttttttttttggctgattgtgatttttggcatcttaacaaaaagagctgtcatctaatccaaggtcgtgtgtcttttgaaatagagtctcactgtataattctggctggctctggaattcactctgtacaccaggctggcctcaaactcacagagctctgcctgcctctgtctcccgagtgctgtgattaaaggtgtgtgctaccataccttgctaggcctatgtttctaagagcttcacacttagcgcctgtgtgtaggttggtccaacctgagttgtcatattgtgtcctggctctccgctgggagggggcagggcaaagtctgtctgaaacagggggtccatggtggtccctggtctcgtctctggagagggggatctgaggtctatgttttccctgggtgccatgcagagaggggagacagagaagaatctggtctgattgggagcggagaactgagggcaggggagaaactggaggagagaagccttcctcgggagtcttaggctaggctctttagaagaccttcccctctgtgatccttaatgaagcagctctctgagacaatcctatttggtggcagatgtaaacaaatacactttattcggggtgaaccagcggttatatgtaggtttatggacctactctgcgtgatcagttctctccttcaccttgaactcagactgtcaggttttcctaatctggtgggaagtgactacctgcggagccatcttgccagccccagttaatggtctttttaaagactaatgtcatttaggctccctgacattcccatatgatttttaagatcagcttatctacttcttttatattttgagacaaggtttccctgtagagctctggctggcctggaactcactttgtgctgcctgtgctcgcgggggttggagatgaggaggtacagagtcaagggcacagactccaggagcaggtgagaatgccggagccagctcatatgaacgctgccacaagcttgtttaataatccacaggggcgccctttatactctccacctgtgtcccattggttccaagcaagc

SEQ ID NO: 29283 - DNA, 2315 bp, Mus musculus
cactcctacgcacagcccgatccccaggtccacgtcctgggcgtggctgttctggccccacccaccccttcccaggagtgggtgttcttcaccttcaaaacccagccttcaggactcaccccttctcttcctcagttgacttcatcggtggctttgactcctatggataccaggcgccgcagaagacgtcgcatttacagctgcagcctctgtacacgtgggtccctggtgggggcggggtgttactggagggacagtcattagtgttggtgggaaaaggggggcacggaaaaggcgtgggaatccgggtctccttgtctgcctactcgcaggcctgcaaatgcacttctaacctgctcttgtttcctgcaggtccggatagcttctgtcccacccgcgtacagttttccctggaccactggagcctgaagcagtgctgtccggaggcgcggatcacgataggcaggcgcgcccctggtggcgcttaggctaactgcagcttgtgcagcctcctggatctgcagcccctggagaaaatgcggactctcaagacttgaacttggacctgaccctagctctagcaggacttcagggttggggcaggacggggcgggggggagggggaatcactgggtttgtattttttttaatctcagccttggtacgtgccggggtcttcctctttcttcagctctactccttacctagtatcttgccctcagtccaaacagcaagacagaccgaactcaccccatctcacctctcattcacctgccctggggaaagatactgtgaactagaagcaggagtcctgggctccagctacggcaccatcactgacatccggtgtgacatcgggccgagtctttgctccctccgggcctcagtttccccacatcaaataattaaaattatcccttagttgatgatgcttctagcactctcgtttggctttcaattccatgggctacgctgcagatacggaaactaaggcccagagatgtgaggtgacttgcttgaagccacacaataaggttttagcagaggcaggttttgaatccggtgtactctagtttgagactccccaatccagtatctggcctctggacttggtttacaagccccaatctagcttgggcattccagaacactcacatatcacagccaccacgcaccagctccacccactcttaaagcaatatatcagttcgttctcttgggagccagacagacagagcctaaagcccgagctcagcctgacccacaggaggcctttgtagactcaacctgttcctctttggcaagcttttaaacctcgtcctccaggaaagtgggacctccactcctctgccaggtccctaagcctgggtccctctcccatgatcccctcccaccgagcaatcccagtaaccctcaattcttccacctacttctccattgtggtctccgaggggaagaagatggtgttcggaagcaagcctggggatatgaaagggcagaatgagagtgggtgactatggtcaggaggaccagaaccccaccattcttgaggacaaagcagagaggagggctcttcttcatcttcttcctccacagatgccctgaggactgtgtcctcagtagtgcttgctgacttatgtacagagagaacaaacatcagtccctccaatctgtgaagcggaaacaataggaaaggcagctaagaagcagaggaacctagcagggagcttgcacagtgggggcagttcacaccacactgtggtgaacacgtcactctccgggcttttctgagttagagcggcaagcccactccacgactccatccagcgtgccacacagaacagccaagctgggaactccactggccatcacagtccctgggtcgtgagcctaatcagaggggaacaagtttcctttaggctaggctacctcttgccactgggccacctcccaccagccacactcacttctccccatcccttcccacagggctctttctactcgagggtttagccacggatgcttcgaagcctttggttttataagctgggttttgcagggggtctgggtttgcttctcaagaccttatgggctgagacctccctggtatccatgcaggttggttgattaaaaaaaaaagtgttttcttcactgtgtatctgtcttgccctcttggttggaaagctctccaaaggaaaaaagcccctgaaaaagggggggggggggcaaaactgggtgttcatacatggagtgtgtttgtttgagacagagtctcactatgtagacctgactgattcaagactcaccatgtagac

SEQ ID NO: 29284 - DNA, 1172 bp, Mus musculus
ataaaatggtgttatggttgaaagtggagggaattaagaaatcagttgctcacttgagatttgtcattcaaaatgagggctgattgtgccttttaggttttaaccatctttctcttctaagaattgagttgataatcattaatttttttattaattttttttattaactttttttgagagacagggtctctcatgtaggtcaatatagatcagactggctttgaatccacaaaggttggccagtagtgggattaaacatttgagctccatgtctgacttccttttttttttttttccccgagacaaggtttctctgtatagcctggctgtcctggaactcactctgtagaccaggctggcctcgaactcagaaatctgtttgcctctgcctcccaagtgctgggattaaaggcctgccccaccacgcctggctttttttttttttttttttttttttttcctatttcaaaaacataagcaagcactaacataagcaagtctaatttttcggttacatgtttcttgaacttgccaggaaggatagtagttattttttgttatgtgtgtgtatgcatgtgtggtgtatttgttttgttctgtgtgtgtgtgtttgtgttcatttgtaggtatgtgcatgcccgagagccagaccttttctaccttttttttttttttatttttgttttttcaagggagggtttctctgtgtaacagcctggctatcctggaactctgtagatcaggctggcctcaaactcacaaagagatcctcttgcctcttcctaaagtgctgggattaaagatttgtgcttaagttttgagaccagattgcttacagagtttagagttgggcgcttggctagattggcctgcactgagtcccaggttcatgtgggttgctttcccaccgggctaggttacagatacatgcctttacacttagctcctatgttagtgctggggatcaaggcttcctggcttcgtggccaatactttacccaatgatccatctgttcagctcctatttcattttatttattttatgtttgtgagtacactagctatcttcagatgcactgtaacagggatcagatcccattaagatggttgtgagacaccatgtgggatttgaactcaggacctctggaagagcagttagtgctcttaaccac

SEQ ID NO: 29285 - DNA, 1105 bp, Mus musculus
gtgaagaaggtttcttgtgttatgtgctatttctttctcccctgtttgatatttgggggcttcctgggactgccttttatagatagatgttgggatactctgtacagtttacagtttgatctcttggagttacccaagactgctggtttaaactagcctccctcatacttgactgcctaaggagacgcagccctgttacagatcagagacttgccactgagcaccattgtgctgatctctgcttattaaagcatgtgaacagtagctagcattcttgtcatgtggtgtatttcatgccttgaaaatgaaggcagtaggtggggtaacacagggatcatttctgaatcttgatggttaaaggtgagtgaacatttaataccttgagttttgttactgtgcttgttgctttcttaaagtaaatatagaaaagacttcatttgtgcataatatgtatgtaatagtcacaatgctgacgtaaagctttcccttctattctgaacactaggtacgctctatggatgaattgaatcatgattttcaagcacttgctctggaagggagagctatgggcgaggtaagtgagctggtgtggttgaaaggggtgtcctagggaagcttggacttgtctttcatcagttgtgtctgaatctagtctctagaaatctgtgcttgcttttccttgttgccatcctcacagtaggaatagaagattggagaactgtgccaaaactctactggtgatttcgtaacctagtccagttacttaaactgcaaggcaccaaatatgaacactaacaataaacatgctaataagttagctgtaatatgagatgtgcaaacatagcttatagtcatcaggtattctcacctttacctcagtgttcagtggctaggtgctttcacagttggagtttagatgtgctgttaatcagagcatctcactgacctgcgtttttacactagttctctttaaagcctccattttgaatgcggctgtttcttaggtttcttacttacagatagagatctgttgggcagagcaaatctagaaacaagaagtttggtttctttttagcatttaaaaattttttctcaatatattgag

SEQ ID NO: 29286 - DNA, 1080 bp, Mus musculus
tagaagtaaaggaggggcttatataggatagtgggaagtcatggattccttgcttccttcctttcttccttccttccttcctccctccctccctccctccctcttttttttttttttttttttttttttaaacaggcttaatactttccctcttaggaatatgctagacagatttgagagtagagaagtaggctgaagaagtatacagtttcaattgggggggaaagtgggtgggtcagaacgggagcacttggtatgataagatgtcttcagttctgtaacatacctgtctgtctgtcttcccccatttggcaaaaaattctgcagtgttccttcctgcctctgtgttgtttgtaaactagactgtaatgtcaggcatgggcactgtcctgtcccagttagcatttagtgtagtctggtgtccacagtgggtatccataattagttgatgatgattagtgaagctgaagctattttttaaacagggcccaagggatgcagacagtgatgaaaacgacaaaggtgaaaagaagaacaagggtacgtttgatggagataagctaggagatttgaaggaggagggagatgtgatggacaagaccaatggtttgccagtgcagaatgggattgatgcagacgtcaaagattttaggtttgtatattttacacttctgattttttggatgtgggctgtgggtttttgtttttattttagtccctcctgtcctgtttcagttttaaaaatctagtatagatgatgccatagaggtgtaaactaactggtaaggtgggatttcccaagagctgtccatgtttatactttgcccaacagaatttgcatttgaatggagctgggcttgcagagtggttccacagaggacattttagtagttctagaacttcagcataggcgctttgggactctctgagctggtcctacatcactatacaccagagccatggacattgagggatgtatgtgtctctctctctctcacattggagggagaattagctgagatattttacgccttctcccatttcctacatgctcagcagctccattctatgtaggtaggc

SEQ ID NO: 29287 - DNA, 1310 bp, Mus musculus
tgttttgctttattttgaaacaaagtcttgtgcggactccagcctgacttggaaacttgttctgagtgctgggatgataggtgtgtgccattatgcctgacccagaaaaccaaccattccagctttgctctgtgtttaaagaggatctgctgttctggtggagtggatttacctgtgtttgtggggaacatttgtttcagttttcatggctgccgcaggcaatactgtttttagttttactctgtgtttattcagtcttgattccatagtaaaggtgtattgtatgttaatagcagatgatgatacacatgcaaacaatggaagaatcattctagaggactacaaccctgtgagccttgtcaaagatctctggttattttgtagaactagctttcaggactgctaatgaactatgtcaaggacttgaactgggggttgctgtagtgtccctcctcgatcaatataaggtttaatgccctttactttctctgtttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctctgcagtttgattattcaggcacgcaggtacctgtggactctgcagcagcaactgtgggactttttgactacaattctcaacaacaggtacagtgtgtgtctttgtcatctttccctttctttccagccctcacattatgggggtggggtgggcaaggctcttaccagcttagaaagcctttagccagttgcttttggtccagcaatggaataaattttaaaagctcaccttctcagaaagttggttgctgcagttgctagaaagagagcacctgttctgtatacactctgcttgcttggctcctttctccccaaccctgggggagtgaatgagtattctctcagatgctaagttacatttggaagatttctattgtatgctgttgctggtttgttttgtgttaaaaaataatgaggggctagagagatggctcagtgggtaagagtgcttgcttcgaaagcaagaaaatacaactccaaatctctagtacccttgtaaaagagcagctgtccatgcttgtgaccctaggatcagagataggcacactctggagcttgttagccagcctgatagcctagcagaaacagtgggcttcagatgcagtgttagaccctgtatcaaaaagcaag

SEQ ID NO: 29288 - DNA, 1162 bp, Mus musculus
tcaaagagaagtgcctccctctacctgcctcctgaatgccggcctactggccagggtacttccttatttgcatagctttaatgtaagccatttttaaaattcactagtgtcttatgtgttgttctgaggaagacttgagactgactagttataggattaaaggttacctcagtgtagctttagtttgtcgaggtatacagaaacattcatttggtagaggattgggttttagttttgatctgagatctcagaaattatttaccctgaaaccagtcaaagtcagtctgtctgtctgtctgtctgtctgtctctctggctgtgctagaactcatgtagactaggctggctcaaacttacaatgattctccctagttttttttatctgctaaggaacagtgaaggttttttgttgtttaaatatagcatttgtttatttaatgtatgggtgtttggcatgtatatagactattgactcttgtctgagactacataaacagcagtaaaacttgaaacaaaaagaaaatagtgagatcttttggtctctgaggctgctcccccccccccctttatcctaggaatgcaaagacttttgttctgtagatttgtcttaccctcacattcagctttgcccatagcttttttttggggggggggagagggaggcatggagtatataacaagaaactgttcttttatgataacttagcatcttttcttgtaacttccaaaaacctgcatacttacgtacgtacctgtgtgtgtgtgtgtgtggagaccatacagagttttatccttttgctgtatgggatctgattataacagtaaactattttttgcaaaaaacccactgaatggtactgttgtgttgtgtggtttagagcttttggatccgaaacattgccttttgtaaactcacgtagtgagggacatagaagaatcaaagcattttgtcatagatacccaaacagtatttgttgtgaatcctcatatgactttgaaatatttgctggatcttccctgtcctccctgtgagtgaatcgtaattagcacagtgctcatctgtgctgtcctgccacaggcacttcctagtgctcacagtgttcctttcccagtgttggtcactggctcctttatgaattcatgacagtggtagcagaactca

SEQ ID NO: 29289 - DNA, 1765 bp, Mus musculus
taggcattgtagtccagcactttgaaggctgaggcaggagggttcaaggccaccgtaagctacacagtgaatcccccatttcatagagcccaccaggactggggagaagcttggtaggtaagagtgtttactgggcaagcaagaagatcgagttcaagtgttcagcactcacctgaaggcaagtagatcccagctttggggaatgggaacaagaggatccaaggagcctgctggcctgtgttgtgtagttaaaatggcaagcctcatgtacagcaagacaacttgtctttaaaaataaggtagaaagccttagagctatgggtctcaacctttgggctcttgtatcagatagcgatgaaataattatggttgggagtcaccacaacatgagaattaaaggttcttaggaagtttgagaaccactgccatagaggaaggcacctgctgtcttctctgtcctccttgtgtatacacacagatacatagacatagacacacacagacacacactgacttggataaatgccactatgactttttactgaggttatattatctttgtgaaattcctctttactctcagtctgttctctcttcccttttgtccccttcatctatagcctggaatgctagccagactagagaggtgtgtagtagggctgcagtttggtcgtttgtttttactgacaggtatgtttccagcaggtttagctcccgctgcgtttgtccccaacccatacatcatcagcgctgctcccccagggacggacccctacacagctggattggctgcagcagcgacactcggtgagacacgtgctgcatgagggatttgctcacctgctagaaaagtcctttgaaacgggcatgccttctttctactctgccaaagccatgtctccaacaatgcctcctggttttagtgccagtcccttgttagtcatatttctctgcttagctattgtcctgttctgcctaggaaaataaggtggtcacttattctgtcccacagtagctttcgtccacagaattgcttgttgatagtgcaggggatttgctcagcttttcttttggttccataggagctcactgtttccttaccttctcgttgcttgtggctttccctttctccagtcctctaaattgcatagcttttgagcacaagtcttaacacttctctcttggatttctcttctccctgctctgaaatgtggcgtggttctgttattctcacttagagctcatcagagcctgaggggacgatggttggtccttgggattagcactacaaagctctagtgtcaggattctaagattggctgagctggcatcctctctcgatgacttgtgtgcagagcttaccaatgcactgctcttttattctttaatagtcacattggctctcacagtacaccacagtcagtcctgtctgatttcaggttccttactgtaccagcttgggcctctgcctccagatagtaatcactctttgtgcctggcatgacctgattttattttggatcatttcttgtgtctctgttactgacaacttttatttgcttgtgaatggattcagttgtcttttccttccctgaacttttgaatgtttttttttcccccaaagtcaggtacctttcttttttaaatctgtgtagcacagttgttgtctcagaggggccataaatgttaagtggcttcatttcaatatgagaacaaaggcagcaaacaacctctgaaactgttggggtgtacacctgtgtaagtt

SEQ ID NO: 29290 - DNA, 1114 bp, Mus musculus
cggtgtgtctaaagacagctacagtgtacttacatataataataaataaatcttaaaaaaaaaaataaacattttattcctggcagtggtggcacacacctttaatgccagcacttaggaggcagagagtttgagttctacagggctttgctcccccccccctttaatatttatttatttagctgtcatttaaaagactgactctagtagagcatgtggtgtgtcctctgtaagtcctgtgagatagcatttctgtttattattcccaggttcttcgtggaggagctagccaacgtcctttgaccccaaatcagaaccagcagggacaacaaacagatccccttgtagcagctgcagcagtgaattctgctcttgcctttggacaaggattggctgcaggtatgccaggtaagattagcattgatgttcctaatagtttgtggggcccaaaaggtatgaattgagggagtgtttttggcttcggactggggactggcagggatgatacatacttgccctcacttagaccagaggtcgatgatgagagctttgttctgagccagtcattggtcgtcacggttatctgaacacttgacggatgtgtatgtacacgtgagaaggtgagctttgcttcattggtctctctttgcctcaggacttaaagtggacagagtgctcatcctgctttcacaatagtctttggctttgttctgaatgcctgtgtatttgagccgcttgactgagaaagaatttctgctgttctcttaagtagccaccatttgtatttgtagggtttctaagtgttgtttggttacccactgagttgtaaatgtgtcaccagtgtctgttggtctttttactgccttgttggtgagcattgaacatagattaatgtcatgttcttcattgaaacaggtacttaattttgtgagactttcttgtccgatgtagccatttataaactgagaagcctcaacttgccttgtgtattttgttacttatctgtgggttgtattaggtctcctgtgcatgtgcacacaattcttactaagaggagatgcttggtagcagtgaataattttgtcagttgaacctaacctagctcttctcactg

SEQ ID NO: 29291 - DNA, 1114 bp, Mus musculus; identical to SEQ ID NO: 29290

SEQ ID NO: 29292 - DNA, 1100 bp, Mus musculus
aaagatgacaggcctgcattagaaagttctgtgtagtggtgggcagtaccccacctacacacctttttttttttccttcctgtattccatttttctgctagaacctttcaggtgttgaaaggcatttaggtcatttccttcactttcccgtagctcatgtggccaccagggctttttaacctgcccccatcccattctatctgcgacactaaaggaagggaaatttgccatatttgtgtgatggcttgaatagctgttaacccaagccatgtcctctttatgacgttagctgcccctagaactgctacattaacagttaggctgtctctgctgacacatttgcagtggtaaggagtctggatcaaagtgttaggaacaggccactgggcttgttcttcaaagaacaggcctgtgcttatctgcattgttttaattccattttagttgcaaactccaacactggcagtggctcccgccgtgactccctgactggcagcagtgacctttataagaggacatcgagcagcttggcccccattggacacagtttttatagcagccttagctattcctcctctcctggacccgtgggcatgcctctccctagtcagggaccaggacattcacagacaccacctccttccctctcttcacatggatcctcttcaagcttaaacctgggtaagaaccattactctaacaccaccttgaacgctagaagtctcttgccactgatgacatttcaagtactttgcataagcaaaggacagtccctttatcctagaagtgtcctggtgttctgtgcctttgatagattcctcaagttgctcaggttgtacctgcagcttcctagcagttggggattgcctagcatctggatacaccttgtgtattcactctgtcctcagtgtgaacattttctcttgggcaaacacagtaaagtcattgcagggaggcagaaggacacagaggcagaagaatagttactagtaaagcctcatagttactagagagctctgaatatactgctaaatttcttttaggttctccccccctccctcatataaaagttagtagcttcacaaagcattttattgaaa

SEQ ID NO: 29293 - DNA, 1162 bp, Mus musculus
gaagtgaggatgtagccagtggttgagtttttacctagcaggaatgcccaagcctcagttctcaccacagtgaagaatgtggggggcgggggggctggtgtagagggagtgtgggaggggtgagatggcgatgcctggacaccaaccctttaaatagctatgacacaatataaataaatagaccatgttagcccttaaatgcttcaagatactgtccaaacactgtagaaatggggaagttcagtgagcttgtaaaagcccatgttaattgtctctttcacagaaggctttcagatgcccagcacctgcaggtagactgctaggaactgggtggttaactgctgcttcccaaattcctaatccaagagcgatttggctagtaaatattgaaaatctgtttcctagatggtcttttcagaaaggaccagagaacttaagtgctaagcaaaacttgacagattggtttaatgtatagataaattctgcttggcccatgcagaatacatttgtgaattgccagattaatcacctgagaaagtttttctctttcagagatttgtatatactttattttttcagtaataaaagagccagtatgtcaaaacttaagcataaatgtataaatacataatgtatggcataatattagctatcattccccctaaccctttgaattatatattggtatatttttggccacagtaacaaagtctagttaatgttagcttcaacagcactgcatttattagtgcatataactggaaattcagaggtgtagggcagtgttgagggttagtttgttccaccattgacgtagttgccaagcacctggcttcctttcagcataccttccgcctttttcagtgacccacaggcaaaaatgcctggcttaacttcagaagctgtgtttgtgctggtcttccatggtcatgtttgttacgagcaccacatctgcagtgcctgctgccacaccgaccttgtgaccatttctttgtcctttctccaagaacaaggtttcttactgtcagaaagaacaatcatttggctgctcttttctttttaaacaaatccactgtgttcagaagcaagcactgtggcggtgagagttagcagtaccctgaagagtgaggaaggttgaggtaaccgagtctgaacatgaggc

SEQ ID NO: 29294 - DNA, 1155 bp, Mus musculus
accactgacccacaccctagcccaggcctgcttttgttaagccttttggtcatgacagcatcttactgtgtatggatttataacctagtcaccaatcagagcagcagtacaaagggcatacgaggctgttactgctgtatcacataagctttgtctcgtagaaaatggtaagaattgcctgttgatgaggaccttaaacctaccatctgccttggaattgttccttcacacaaagttttccaggaatttcctgtacataaaagaggatgtgttgatttccttccctctgcttgcagcaccaggacaatcccaagcagtgctgtatccacacccatgtttggctgggagggaatgttgcttggagtggagaagctcagaaggctctgtgtgagccgggcgtggtggtgcatgcctttaatcccagcagaggcaggcggatttctgagttccaggacagcctggtctacagagtgagttccaggatagccagggctacacagagaaaacctgtctcggaacccccccccccccccaaaaaaaaaaaagaaataaaaagcctcagtgtgctcgctttgtattttctgaatccttactgtaggtgctgtgcctcactttatttattaaggaaataccatgtagtgctccattctttttactggttggttttgttttctcctttttaggtagtactgggaattgaacctaggtcctaacacatgctagcaagtgcttccttcatctttgagctgtatctccagccttaaagcactaattttcctagcaatggtttgctagcaatggttaaaacaaaaacaaaacagtcaaataaaaaaagaaaaaaaacaaaataaatatttctttcttaatttctgtgcgaatgtttccttcagattggtgtatgggccttagaaagccacagtagagagaacaattgcccgatgatagctcagtgacataggaggagagagctggtgaggcttgtggaggtgaaggagcagtgcagtggtgcgtcttcctcctagatgagggccctgatcgtggactcaagtctttttgttctataaccaacaggaggactcacaaacggcagtggaagatacatctctgctgctcccggtgccgaagccaagtaccgcagtgcaagcagtgcctcca

SEQ ID NO: 29295 - DNA, 1542 bp, Mus musculus
tgctgtctttattcactttttggacaccattactgaactgagaaaaccattcctgctgacttttaaattgcgagccatcgtgtgactgctctgaaatttgttttctattgctttgtgtctgtccccgtgtcccttgactctaccagaggtaggagccctttgagatgtgataattgacaggtggttttctcgcaaacacaggctgcatcatggcgccccattccttgtgtttgaggcttggtagtccaggtcttttggaacagattttgtaacttgtctgctcccatgcttcctacgtgatctgttaggagggagctatatagcacacccagctcttggatctttctcacctgggtaaaatctagagtcagcactcttattaaaaatagacgcttacatggttgtcatgatataagtgtgctaaattgtataagctttgcaatcctgctcacctcatgacttttttctatttgaagatgactttggtagtttttaggtttttagaagtctcgtgtagctcgggtcggccttgaacttacttatagataaaactggccttgagctcttgatcccattgccgtcccatcagcacttaaagtacaggttgtaccatccaaccccggcatgttttttttttttttttttaaatttatttattatatgtaagtacattgtaactgttttcagacacaccagaagagggcatcagatctcattacagatggttgtgagccaccatgtggttgctgggatttgaactcaggacctttggaagagcagtcagtgcttttaacggctgagccatctctctagcgcccccccccccccccccccccgggcatatttttcaaaataggttttgatagttatagtgtaggctggcctagaagttgctgtgtagcaactccaatcctgcctcagctcctcagacctggagttagaggtgtcttccattacaccctgctggtgtcatgctgttagtgcctcggcaagtttgatgtcccatctgctttctctcacttgctgtgttgctacttggctatagttgactttgattgtcggatctgtgcagtgcttactgcttgttaggaagtggggctatctggatgattgctgcctgtgattctggtggtgccttctcatctttgtctccaatagaacgagatggtgcgggagctagatggccatgtcctgaagtgtgtgaaagaccagaacggcaaccatgtggttcagaagtgcattgagtgtgtacagccccagtctttgcagtttatcatcgatgcattcaaggggcaggtaagtcacttagggtcatgttgtcagtcagaagcagtcatgtgcagtggtttcaacctgaacatgtgaccaggtctcttccctttaccctgtggggggtctgccattggcagcagaactgctaagatgtattcatatctgaaggattattttttccatggctagttattttcccgatttttaaaatcttttgttatataaaaaattaagatagaatctaatagatcatgattgaatgcatgttta

SEQ ID NO: 29296 - DNA, 1101 bp, Mus musculus
aatggtggttgattcttctttggcatttgcctcttctactaataaatacagtaatgaagaacctttgcactttctattagaggaaaacatttctctactcctcaaataatccttcccaattctaaaataattatagatctacttttttgtagttagtcatttgtgaaaagcccaggtagaaagtaggtccataaatatataaagaaaaatagtctgctgtcatgtcacagtgtgttcttgttttgtaataagagagaattgttactaccgatctatttacaaattgcttgcaggtcccttcccattcagatgcacttcagagctgttatgtcattaccccatcctctgcctcacgagagataaacagtgattagatggagaactaggaatccacagaactgtttttttatgtatttttttctttgtttttgtttttttcctgttttttttgcttctcaaataggatcagtatggaaattatgtaatccaacatgtactggagcatggtcgtcctgaggataaaagcaaaattgtagcagagatccgaggcaatgtacttgtattgagtcagcacaagtttgcaaggtgtgtgctctggggagcaaggattgggcagctctccagctgtagagtcgttccctaagttcttacattcgtgtatgtgtgtgtgtgtgtgtgtgtgtatgtgtgtgtgtgtgtgtgtgtgtgtgtgtgtgtgcgtgtgcgcgcacacgtgtgcaccgcaccaggtctatgtatggaagctagaggacaatctgggggagtgggttctctttttctatcttacaagtaaaaagcaagcaatatgttaagtgctctttctactcctttgcagttgccaagggaatctaagggctgtctccagcatgccgtcctgtggcgtttgtttcctcccttgggtgggcattgcgaggtgttcccactcacctccctcttgacctgaacgggcctttgtcagccctgcccaggcctccgcttctcagcttccgagtggcaggcttgggaaatcatagcctcccatgcctctggtcttctgagcagattcgttatttctcactgctcatagaacacaatactgct

SEQ ID NO: 29297 - DNA, 1585 bp, Mus musculus
cctttgtaaatttcattttattacacataacatgtactaattattttttttaattgactaattgccctgctgtttactggtgtataggaacttgtacataggtaatcagtgtacatgggaggccacatgctttgttcaatgttgtatctatattccacatgtggacactttcagggtggttggtttaacaaaaaaagttaaaaaaaaagacaaaaaaaggtttttaactcatttgccttgtggcaagttttgcaaatagctcttccccacctcctcattttattattaaaaaaaaaaaacctgagaaatttgaattttagttaaatgatctcaaactggcatttaacactgtttataaaatatatatatatatacatatatacatatatgaaatgggaacgtttcagagttgctagagcatcagcctgtgatatggagtttatgacgctctttttttggagatgacctcgtgctgagggaggtggtagctgcagatccaggaggagcggggaccccagaggcccaaggccagtgggcatggccacttgctgcctgtggttgcctgtgtgaacactgggaagcaggatctgactgtttagcatgagagaatacccagctcggccctggtctggcttctatagatacatagtgtatacttgtgtagactttgcatatatacggatttgtagtattttcctgttttgatgtctaatctgtatctataatgtaccctagtagtcggacatacttttgattgtacaattgtacatttgtatacctgtaatgtaaatgtggaggagtttgatcaacacgaacacgtttttggtaagaagagaatcagccagcccgtgcactctgtatatcccaccttttatggtcgtagcagatagtgttgtatattgtaaattgtaatttcaaccagaagtaaatttttttcttttgaaggaataaatgttctttatacagcctagttaatgtttaaaaaggaaaaaaaaatagcttggtttatttgtcagctagtcaagacggtagtgagagcctttctaaatgttacttcagatgcttcagttcacactagtgtcccccccccccctttttttttaatcctaaaaaaggtaatgtttcgcttattttgtgacagtcaaaaaggatgtgcagaagtttcgcctgccccctccctgctcagcgccaccccttgtaaagtgactcgccctccgttttgtacagatgagctgtattttgcattttgtctacttgtaagtgaatgtaacatactgtcaaccctcgtttgaatatagactgtaacactacacggtgtacatttccagagccttgtgtatatttccaatgaactttttgcaagcacacttgtaaccatatgtgtataattaacaaacctgtgtatgcttatgcctgggcaactattttttgtaactcttgtgtagattgtctctaaacaatgtgtgatctttattttgaaaaaaatacagaactttggaatctgaatttgtactgctctcacttctcaaacctgctcaggcaagccctgctctagcctgcctctgcctctgcctctgctccagcc

SEQ ID NO: 29298 - DNA, 1189 bp, Mus musculus
gtctccctgcccatctctgatatctagcaccaacccaggagcctttaaggtcacttgaatgagtcttgccactgtatggagatcaagacctcaaggaggaggggggcagagcagctttctgatagggagaagactagggaagccttcagagcccaggactcttgtccctgtgtctgcatgtgcagtatggacctgtgtccagccccgtggctcctgcctcgtggtttctgccccgtggctcctgccccgaggctcctgctccatggctcctgccccgtggctccttccctgtggctcctgccccgtggctcctgccccgtggcttgttgaataaacataagccactcagtgttcccagctcggcacccattacgtttgaaaggccgtgggatgtcctcatcagggatgccctttttggtcccatctggagcaggtgaccctttgggtccatcaatagtggggaagctgaggttgaggtagggctacaatgggcttcaggggcctgggattgggttgctggctctgtctttagtcgactgtgggccaggcagggtgacagtagatgtagcaactccagcagggccttgtgaccaggcagctgaatgacttctgacccccttgccactcccatattcctatctactgaggagttaaccttcctcccaaaggctctgggaggtgggcacaggcagtcagtgtggtcatgaagctgctaactgagggagcgcgctgagatggacccagcctggggatggatgtgtgaccactgttccaggctcctgctccttcctgagccgcctgacttagctctgccgctagtctccctccaactctgctttaagcctctccctcaggaaactggtgccctcctctaaaatgtcactgttctcaggaggcagaggcagaggcaggcggatttctgagttcaaggccagcctggtcgacaaagtgagttccaggacagccagggctacacagagaaaccttgtcttgaaaaaacaaacaaacaaaaacccccaaaacaaacaaaaaccaaccaaccaaacaaaaatgtcactgtttccttctctcgaccctccctggccatggcctctcctcacatctcctaactccctcatctcgtcccctccaagcccctcatcttaccccttcttgagttgtgcccgtggcctgggaagggctctgcaag

SEQ ID NO: 29299 - DNA, 3128 bp, Mus musculus
gggcctgggatggagcctggccctgcttctttctgctcaggctgctagcgtaacacagactgtcctaaggagcagaggtgctgccatctgccccagactgtgtccttatgaccccttctttggtcccattccctccagcccggggcttcaggaccttgtgtcccatggacaagaggaaggaagccctgggttgctggttgaaacaggggcaggggcagggttaagatggcccacagtgcttgctgatgtcctcttcttgctccagaggccaccatgctggcttctagaaccaataatacatggtacatctagccctccaattcaaaatcacccagatgctgtggcctcgagctgctgtcccaaggcctctctcttgacaggagggtgccctttgtcaccagcctgagctcatgatggggtcaccgccccctccccctgccaaatgcacaggtccccaggctgcacctcttcctgcattgcctcccagggaaagggcttccttcagtgtacagggcagccagtggtaagtgaggccagtctagcatccctcctgagaggggatgccacatagcctccgtcaaccactactagaatcctaaaatgcattcacacaggagacaaaaacatacccagtcctgaccacccagccagcgagacatcacacagatgcaccaccttcacgcagtgctcagccatcctgatgcttctgctacatcgtaggccactgtcattgtcaccagtggcgaccacaccaccttcctcccaatctattctctttacacacattggtcctgcatctggctcctctaaccatccaggtcactgaggaaggcaggaccgagttgtaggcatcagcccatattgggtcccccagagtcactctattccacttggtccccaccatgacacctataccagccacactgatgctgatcccagctgacgtcagtcacaagcccacacagttaatgcaggctctccctcccccactgtggctcatagagaagtttggggctagcctccaccagccaagtttgaagcaagaagggagctagggcctcccaggaccaaggcgctgtgtgggttgtccctggtctccatgtatctcctttctgctctgagccaggagctgtctctgcctcccaggacacgtgtctccaaagtgcctgtgagggtgggctccgcccaggccctctgtgtcccctgccctgccctggcctggtgaggccaacctcaggcctacctaccctgggtcctttctgtggacacaactgaccaggcaacttggcagttctggctatatccagatgaacccatagcccaccaggctcatcccaatgctataggctctgagaatcattgatggggacaagggtgtcacaggcctcaagtctaccatcctgtctctgttatccttagaagtggggctatttcagaggtatttaaaatgtggggggtcaccattctctttgtgaaagggccatgccgaaggagctctcagcaccaaagggacacagcttgggtagtgactggccggcacccctccaccatctctcacatgtcccaggttcagtcaggtgaccacatggtttctttctgtttcattttaaagaatccctgacagcagagttgggcagactgaagaaccacatctgggtaatggacaggatctaggcagttggcacagcttgtctttctggggtgggggtggagggggtgtccccctgtcaggctctgttctgtcttccagacctccatgactcccttgatgggactttagagttttgtaagccagtcggcctggtctttaagtgggggggaaggaatgagaggcgtcctaaacccatgagatgtggaggagggagcttggccaagatcttccctgcagcaggggctgggtagggcgtagaggagagccagtgtcccagaccctcccactcctccctggtaagctgcagtcttggggactagagctttggaaagagaggctcagcagctgggcgaggcaacctccaggtactcagcccaaggggacaccacgaccagggcaggaggccccagcttctgtgttgggctagggttcacttctcacatctcagggtggctctggccctggggctatgggtttggcatcctgataccagcatccttaatgtgtcagcatctgagagaagaggcagtgggtcttaagtatggggtccgggctccaaggccaacgcctaggcttcatggccatggcgtttgacctgaaggttaatggtgtgagcagcccagataaactgggctagcctggtgaggccaggacgatttaagagaactcagttccaagggtgaactgaattcttcctagtgcaatgtgggtgcggggttcccaccctgccccagaaacagtgcggtacatacagagcctgtccaaaggagtccagagacacctcagtgctcctgggaaggtattcaggacaccggcttgcctggagacacaatgcattctgaatcagaggtggtgatgtgtcctggacttctctgggccctggtttccctagagagtaagacatgctggggccagagcactgaagagctaagcttcatctctcttgggggccagactagggactctatgtgtaaggttgattctccttgattgccagaggcatgtgggtgacagccaggactggctgagcagatctgcagcaagagcttaggatgctggggccagaccccctgggcttggcttagctactcatcaggcctcctggctggggctcgagcttcagagagcagagccaacgctgctctcagggcagttgtggctccctgggctgtcctggctttctcctgggatgtgcctcccagccttggtgtctgtaaatagaagcccacactgtacagatctacagagaggcccaaactgggctctggtgtcaccatctgaggggctgatggcctggcttcccccaggtgccctgtgggtgcttgggtatgcctggccccggcgtggtgaatgcatgtaaatacttcgtagacagtgtggctccagagagccccctgagacagtgtcccccccaccttactggttcatcctctctcctgtacagagccctcccagcccctgggccaccaggatcagg

SEQ ID NO: 29300 - DNA, 2336 bp, Mus musculus
gggcatgggcatcccctgtggggaatggaaagtgaaaccaggtcacacaggcatggacatcattttcatggatgtggggggggggaggctccttgtacctcaggttagaccaatgggttcttgatggtgctcagcaatcctttctgtctctcccaggtggctctgccgtcctacgaggaagccttgtctctgccccctaagactccagagggggaccctgcaccacccccatactcagaagtgtgatccccaccaggcctttagcccttgggctgggagaggcagaacttcctcctcctgcttcttcactttggtggttgctgtggcctgcctgctacaggacaatctgcttgtgccccccctcactgtcctctcctctcggggacccctcactcacaactgagtcaccctgggctcagtgaccctttgcggctcaggatactcagcctagcagcccgtctcgtctccatcagcagtgacacttgttcagagcgcagccataggaagttagggtgcgtttggttaacagctaccggcttgatctgtttggccaggcagcagcaggaagagaatctggccaagcaatagttcctggtgtcagtttatactcagctgtcagacgacaggatgggtcatgattgtggtgcccgtttgccacctccagtaccccaaaagtgtacaaacaaaacaattccttcaaatagcttgcttaaatagcgattcagccaactgctgtcattaggaattatgataaaatctagtaagaaactgaggagaaaaagaaatagaaacggagcccctcccaccactcactgcagtgctcaccatggagcccctcccaccactcattgcagtgctcaccatggagcccctcccaccactcactgcagtgctcaccatggagcccctcccaccactcactgcagtgctcaccatggagcccctcccaccactcactgcagtgctcaccatggagcccctcccaccactcactgcagtgctcaccatggagcccctcccaccactcactgcagtgctcaccatggagcccctcccaccactcactgcagtgctcaccatggagcccctcccaccactcactgcagtgctcaccatggagcccctcccaccactcactgcagtgctcatcatggagcccctcccaccactcactgcagtgctcaccatggagcccctcccaccactcactgcagtgctcaccacggagcccagcctctgcttgagtttctccagcacctggaggctgggaagtccaacagtctcgccgctggcctgaacatcctgttcagcgtgggaaaaaaaatgttgcttctgttttaaataatcccttcccatgagccactgctctgatggcaagctgtccttatcttcagtcaagtgttccctagggccacacagtggtgaggtccctgcaagagtccctttagcctggcagatttagggtctggtgatcacacatcccagcggccaggttgcttcagcttgcttgccctgggctacgctcaggggatggcaggtttggagttggccgccctgggggtggctgtctgtcactatggctgcccagttggggcaggctagcctatggggtgtgaagagttggccagagtcatgtgttctatggtggcagcaaggagggtcagttcatatgcctctgctggcttttctatcgctaggggttgctaggggttgctagggatctacaccctgcctgtggtgtagatggggctgcagggctgaaaagttcccactgtacctgtgtcattgcttgtgtatgacttggaagaagggccaataaagcaactgcaagctttgctctgtctcatgtggttcttgaagggtgatatagggacagaggacctgcctctgtcctccagtattcattactccagcacacatgtgcacatcacgtctgccccaccccccagggcctggccagcttgccagtgtcacctcctgaagctatgtgagcatccccacatctcccagttgacaaggggaaagatggcctccagccagggcctgctctggatcctggggatacacaggctggggctgggagacaggtccataccctgtggacatcagccagtgctgcggggagagtctgtgacctcagggttccgagggtgaaatgtcttagtggggcatctcaccaagaggagcgaaggacaggtcgtgctaagtaacagctggtccagaatacagttgtagaatgtacaggaccaccatggtggggaaggggatgggctcagtgttctgtcagctgagaccagtggaggcaggcaggggcccctgcacagcaggactctgct

SEQ ID NO: 29301 - DNA, 1167 bp, Mus musculus
ttcctgttagagtgccagggaagctgggaacagcccagtctgtctacagatgcctccaggaaaaaagccagcagcttttgtcttctatgtagacttctagttatttccccaagttcagagcattctcttcagcctggattcacagctcagtctgtcacctgtgctacatttggaaactacttctgggctctgcctctaaagtgctcagtgggtctatctcggcctagggtggccatttatttacgcttttcaggcctcccggtgactgatgcctagccattgttgaggagcaatgcctacagatagatggccaggcagtagggattgtccctggtctggcctgaccttcccttctgactcagattcagacaactttgcatgtgggctgaggccagtgaccgatcgagattccctttgtagtcctgtgtaaggtttacagtgcccacagccaccaaagaatcaaatgttcctttcccatcttaatgtctgggcatcactgggcctggtgaccagaagatcatgaaactatccaaaatccaaacagtagttcccagacaggtgtgttgtgtactgtgggccagtgctctgggaggtggggggaaagtatgaaatcaggctgcagagtcttacaggattctggacatttcagaggtggccagagccactgttctctgtgcagacttctagattctgtaccacagaggtctggaaatccagatgtccttttctttcctcctccctagaccctcctgcccctcccccatcctacaatgtgttccctcagaatgctgctctctttagtgatagtatggaaataactctcatttattgtatacctaccaagtagcaagcattgaactaagttctctccagtttcttgggatgctgaagcaggagacttgtttgagcccaggagttaaagattaggctggacaacatactaagaccctcaaaaaagaaggggggccaaggggccgcaggaattcagacccatccctgtattcctgtatgtccttgttcgacggaccaaaatatgagtcccaagaagatgggcaggatcaccaggaaagccagaagaggcccagcaaggctggtgagtgacaaagagctctggtccctaagagtccaagactcggttagctctccaccagcttaggccacttacac

SEQ ID NO: 29302 - DNA, 1164 bp, Mus musculus
tcaagttgacacacaactagccagtacacaatctaagtatagcctgcactcttgacaattgggaaaccctcagaagtgggcggggatggtgactagaagattgtgtatgttgagacacaccgtcagacatgcttgtgatgtaacaaataagaggcatgacacaaaatgacatgcccagtgtttacaaatgcagaacagaactccacaaaatgaacctagaccacaaatgtctattcagtgtgtgttactaccactgcggcgttaggtcgccatctttatccagatccatccctcaccttagctgcacttcccacgtctgctccgctctgcactttgactcagccacactaactagatgagcacacagcctgcagccatgggggaaaggacatggtgggtttgccacttgtgtcacagcttcgcttgcctgctgcattttaacctgtgtttttttctttaggattacatgcgtcaggcaggagaagtgacgtatgcagatgctcacaagggacgcaaaaacgaaggagtgattgaatttgtgtcttactctgatatgaaaagagctttggaaaagctggacggaactgaagtcaacggcagaaaaatcagattagttgaagacaagccaggttctaggcggcgccggtcttactccagaagccggagtcactcaaggtactgttgacatagcatgagttgggcactcacagtaccgcactgctcagcatggacggcccactggtgttctcttgttggcttttatagcatgagttcatgtgcttcagtggctcagaactttgaactgaacagcttgtgaaactcatgaacctcttaagtcacatacacaaacagaagcaaagtcctttgctgagacaggactcagtgaccgctcacctttctctggggagctgagtcataaactaagctagaagcacataaggccagggcacctattcttttttttttaaagatttatttattattatatataagtacactgtagctatcttcaggcacaccagaagagggagtcaggtcttgttacggatggttgtgagccaccatgtggttgctgggatttgaactctggaccttcggaagagcagtcgggtgctcttacctgctgagccatctcaccagccccctagggcacctattcttata

SEQ ID NO: 29303 - DNA, 1152 bp, Mus musculus
caaaatcggcttcaaaaacacgctctcggtccaagtctccatccaggtctgcttccaggtcgccctcccggtctagatccaggtcccactcaaggtcctaactggctctgccacgctggaactgccgagaagtgttttgtacatgttggtagccgtagcacaagagtgaagtagaacacccgtcactgctgtacattaactccctaaaggtgtgtctcagttgttcaatctcagtgcttcctcggtcagcctccaggcgccaggccttcccgctctactgaaagcagctcctcagacctccccttactcacagtaggacacccagacgcctgcctttcaggcctggccacggctatagggagctcggcacccagacggctggcttctcaggctggagtgatggcgtaggtaggtgtgctgagctcagccgtctgcccttgaatcgatgccctttgatgtgtgccacgtagtgaaagtgcaagtcttcagtctcccaccacttcggtttcctgtttctggacttaccaacgttgtgaatagcacagtggagagaaacggatccctgcgtagcccctaggaagtaacactgtaggagctccacattctggtattgtgattatattgttttatattaaaaggaaagattttttttaattttatttttccccgtcttgcaaagtatagtgacccctgtttccattaaatttgaataaagactatttttgcttgacaaaatttcaccgcgcttgaatctaaatggcatttcctggtgtgtcatctgtcctgctgttttccctgtggtgagaagcaatatttcccaaaggaatattcacccagcagaatgaaggcaagtccccaagagtctggggttctggggttctcttgagaagctgtggtcaagctgaggagaagtgaggccatttggaagccgtgtcgcctgtgagttcttcatgagcagagggggttctggtgcctgtcggtcttgtcatgatcctcttgtcaccgtaaaatctgcaccggaaaccaggggtatgccactggaataccatgccccagtcattctcgcactaattgtcatagctcaggaggtgcctgagatggtgctgaggggtggcacgtgtggcaaggtggatcctggcctccttagtgcat

SEQ ID NO: 29304 - DNA, 2237 bp, Mus musculus
gtgcgaatggaacatttttagttgtagtctggggaagaaaagttaatgaggttttaaaaatcaggtcttgtcgtgtggggagcttgctcccccaggggagaggcccctttacctcagtggatcctgttaaggagtgcttccagcctcagcctgggcccctcccacctggcatggtaagggggtaagggacgctcagggaagaggtgcattctccgacctctgcctcaggcctgaggacgcccactgggagctggggcatttccatctcctggtggccatccctggtcagggtgtgagtgagctctgctactccccacccagtgcctgaggagcctgtcaggttttgagagcttgattttatggtgggttttggatttagtttcctttttccttttttaaatattggttttaaaaagggagcctgatgcccccaattggtagtgagaatttggggacctccccaacccccgaccccacaaacagggcctctgtaatcctccagctaacttcctacaaacatctgcctggaagattagtagaatcctaattctaggctggaatgagcttcatgaggcttgacagaggctcactgtcagccgtggctgggggctgaaggggagtaagcaagagcaaagtgggaagccacggcagcctccggcctcccctgctgaatgctctatacaaattcagcacctttgactggttttgagtgtgcattttcttttagtgatactgttaccagtggcagtttgctttacagagggggagcccaggtgggagagaaatgggcttgggttccattctcagaagtgaattgcagactggaactgagccagagaaggctgggctgtaggggttggattagcatgggctcaagctacaccagctctgaagaggaggagcaggaggagcctgcccactgggcatcgtgccatccccatcaggacctcagacctggggtacctgaactctgtccctctgctgccgcctctgtctggaaattggaccagaattctgatgtccctccagcctcctccccctcctctgctggctctggcaacagatcctgggatatggtaattgtttggattttctttctttctgcagttgtgtgtgaagaacaggctctgtccaggtagaaagattgaggggcagggggaggggagtcccatctccagggtcagagacttggcaggactttccccaaagtgactcaggcacaccacagtaacagtcccaactgcagttttatttttacttcagaagtagatttccttcaaaccacatgagatctctgccacccacccacaatcaagccctatattcccaaggaggctgactccgggggcccttccccccaggccagcaatgtattccggggatgtattctggggtctgagggccctggcccattctgagaaatggagctgtagctatggcctagccagcacccccagtgctcgctcatgggaaatatcagccctaggctggttgtttttacaaatctctctcagatatattattttcatgacaaaaatgaaggagctttgtaaattttttaaaaattatgaatcgtatcaagtagttgtttacatttgacaaaataggaactatgccggcagagtccaaccgaaaaccccctaggtgagataggcagtaactgggcctgctgtctgcgcctttcgtagtgacagatgtggctgtagtgtttaggtgtttggtcttgcttcttgtatggcatttttcaataaactttaaaaaaaaaaaaaaaagcctgactgtgaggattgatccacttttaaagttctcttctaacaaaagcatgggaaaattaatttaatacctgggaagggaagctgccgccgccgccgagtgcagtgagctacccacactgggctagggtgcagtgggaaggaagtgctgagaactggagggtgcctctgccagctgggggaggctttgcacacaggtcagaccgacctgtctccaggggagcagtccgatcccagggtcagggctttggcagtagttagccctgccgggacagagccacttgactgaaggaagaacagacctgaggtggtggcagttagagttgcggtcactgccccagacagctgcagagggtctcattccacctcatcgcccaccttcccccggtggtcccatttccaccaggactaccaacttagacggagcctgtcccagcctgggacatcccaacctaccactgttgt

SEQ ID NO: 29305 - DNA, 1114 bp, Mus musculus
tagctcactgcactcggcggcggcggcagcttcccttcccaggtattaaattaattttcccatgcttttgttagaagagaactttaaaagtggatcaatcctcacagtcaggcttttttttttttttttaaagtttattgaaaaatgccatacaagaagcaagaccaaacacctaaacactacagccacatctgtcactacgaaaggcgcagacagcaggcccagttactgcctatctcacctagggggttttcggttggactctgccggcatagttcctattttgtcaaatgtaaacaactacttgatacgattcataatttttaaaaaatttacaaagctccttcatttttgtcatgaaaataatatatctgagagagatttgtaaaaacaaccagcctagggctgatatttcccatgagcgagcactgggggtgctggctaggccatagctacagctccatttctcagaatgggccagggccctcagaccccagaatacatccccggaatacattgctggcctggggggaagggcccccggagtcagcctccttgggaatatagggcttgattgtgggtgggtggcagagatctcatgtggtttgaaggaaatctacttctgaagtaaaaataaaactgcagttgggactgttactgtggtgtgcctgagtcactttggggaaagtcctgccaagtctctgaccctggagatgggactcccctccccctgcccctcaatctttctacctggacagagcctgttcttcacacacaactgcagaaagaaagaaaatccaaacaattaccatatcccaggatctgttgccagagccagcagaggagggggaggaggctggagggacatcagaattctggtccaatttccagacagaggcggcagcagagggacagagttcaggtaccccaggtctgaggtcctgatggggatggcacgatgcccagtgggcaggctcctcctgctcctcctcttcagagctggtgtagcttgagcccatgctaatccaacccctacagcccagccttctctggctcagttccagtctgcaattcacttctgagaatggaacccaagcccatttctctcccacct

SEQ ID NO: 29306 - DNA, 1208 bp, Mus musculus
tcagtccccaggacaggaaaaaaaaagatatataaattttgaagtatttttgtataaatttctcagaagacattaacatgtttctggtttgtttgtttttcagtaaactggtattaaaattcttattttacagctgagcaagctattgttaattgaaatgacacagttgattagctggtaaatagaggagccagcttgttttaactttaattcacagcctgtaaattagagcattcattcttccttataggcaagcctctaagtgcccgactttagaagtggtttgaatttgtgaagaaaatgattcgtaacactattgaataaatagctactgtaaccgccagtgtctataagagattgtatggagtccaggtataggtcatgctctttgatacttattgtgaaaatgatttccacagccacagttgtctctgttgacaggttgagccagtaatttagttgatgaatgctgtggtaaatattatttgggggtttctaccccaccttagatcatttagctctcaaataaaagacacaaagcctttatatttataataatccttaaagcaccagagctgggcagatatcaaccctctgtgccatttggtctacttccctgtccatagctttgagatatcgctggtcatgttccacctgagcctctcctactccaactgactggccctcatggccataagctcaagacacctacacctccggtgacttcctcctctcctctctccctctttctttattagccagtcacagataacttagagggcaagatttatgccataaaagctgatagatgtgaggatctccttgtcttgaggcaattataccttgggatacagaatttagcattataatgcagagcaacagaacaaacctcaatagatcatggtaactggttgtgacccatagcataactcattaaacaccacacaaaaaattatgagagtgagtggggacagaatagaatgtgactgagagagtctgagtaaatgagtgtgcttagttgggtgtggctgtgcatatctgtagtcttagcacttaagtttcgcacactggaggatcacatagtgagacgttgagggtgtgtgtgatgccttggatagagatggagaaagaagggaggtgggattttacttaacattgacgctgtttccaaaatgctgtaatgtgttgcatttataaactgatatatc

SEQ ID NO: 29307 - DNA, 1159 bp, Mus musculus
tgagtacactgtagctatcttcagacacaccagaagagggcatcatactccattgcagatggttgtgagccaccatgtggttgctgggaattgaactcaggacctctggaagaacagctgagccatctttccagccctagatattgttttaagctagtctctcaatatgcatatctttcatgacttaaggcactaataatttattcaggatgggtaggtaaattttttgtgctttaatgtaagatcttctgtttaatggattggaattctgttggtgattaaatccaaatatattagctttttgaggtttaggggtttgcctggagcattgttttgcttataatagttcccttttcttcttccttttaataggaacatcatgacaacagagaagagtttagcggctgaagctgagaattctcagcaccagcaacagaaggaagaaggagagggagccacaaactcaggccaacaagaaactcagctggaggaggcctcccaagcggccgcagctgagggcagcgatcagggtgagcagaagctgaaagcatccaatggggacactccaacacatgaagacttgaccaagaacaaggaacggacatcagaaagcagaggcctgtcacgactgctctcctcattcctcaaaaggcccaagtcgcaggtctctgaagaagaaggcagagaagtagaatcagagaaagagaaaggtgaagggggtcagaaggagatagaacttggaaacagccttgatgaagacatcattttaaaggcccccattgcagctcctgaacctgagctcaaaacagacccatctttggatcttcattcattaagcagtatagagacacaggtaaggcatgtgactaggggagatgataatgaagatgcattatatgctgtgtttttcatagaagaatatttggttctgtttcttatgagccagttgacttaggcattgataaagataaatagcatgaagagtttcttctctaaagaaattaatgttatcagttgaaacctgactttaaaaaatacactttataagtcaaggaaatacaagaaaactatcaaatgactttattcaatccgtatgtcatcttgccacaacagtggaacaaatttgagttttattgagagagcaagagagaagtgaggt

SEQ ID NO: 29308 - DNA, 1178 bp, Mus musculus
agagcctttggaactagagttgtgagcagatggtggtgagccactatatatgtatgctaggaattgaacctgggttccgacaagaacaacaggcattcttaaccactgagccatctctccagtgcctcagtttttctttttcggttttttgagacagggtttctttgtgtagccttgactgtcctggaactagctctgtagaccaggttggcctcaagttcacaaagatctacttgcctctgcctccccagtactggggattaaaggcatgtgccaccaccacccagcaagttggtgggttttaaaggagctatatcaaacacagtgtacataggacagatgaaaaagtagttttaaggattgaagtaaagaactctaatgaaagaaggttttgcgggtcagtgaaatatgttagttttaggtatttaatattttgcttttctttgacttagaaaacagtctatatgttgagtaatgtcttaatcagggtttctattcctgcacaaacatcatgacccagaagcaagttggggaagaaaggatttatttagcttacacttccacattgttgttcatcaccaaaggaagtcaggacaggaactcacacagggcagaaacctggaggcaggagctgatgcaggggccacggagggatgttactttactggtttgcttcctctggcttactcagcttgctttcttatagaactcaggactgccagcccagagatggcaccacccacaatgggcctgggccttcttctcccttaatcactaattgagaaaatgccttacagctggatctcatggaggcatttcctcaagagaggctcctttctctgtgataactccagcttgtgtcaagttgacacacaaaaccagccagtatgcgggacagtggtggcacaagcctttaatcccagcacttgggaggaggcagaggcaggtggatttctgagttcgaggccagcctggtctacagagtgagttccaggacagccagggctacacagagaaaccctgcctcggaaaaccaaaaaaaccaaaacaaagaaacaaacaaaaacccagtacaaataatgttagaatatatgttgatagcttaatattttccaggctaattgttttgtaggctccttcactagatttagcatcaaaactagaagataagtttcctt

SEQ ID NO: 29309 - DNA, 1188 bp, Mus musculus
atttgtttctgccaagtttttttttttttaaaggtttatttatgcatatgagcacgctctcttcatgcacaccagaagagagcatcagatcccattacagatagctagctgtgagccaccttgtggtttcggggaattgaactcagaatctctggaagagcagtcagtgctcctgaccgctgagccactctccagccacctctgccaaactttttattataaaatatatcttcaatattggagttctcagtgtttttgttagttggaatatacaaattttttacatttaattaaaaaaaatgtatgtgcatcggtgtttggcctgcatgtatatttgtggaacttgagttatgagcttggcagttatgagctgccatgtgggttctgggaattgaacgctggtcctttggaagaaagccaatgcattcatccacagagccatctctccaggtttaacaggattctcacaggtcacttggtttagtaatttgcctttaagtggaaaaatatccagagaaaagcaggtttacctgtgttttttcatactttatttaggttggacatgagattattgaaaaaaaaaattttttattttttttcaatttaaaatgttagcaccatagtgacttaagctgtttcttcccggtctccagatcacacagcaattgtctcatggctttgggaacagaccaataggagcaggagccgtaacctctggaatcttgagaggttcaagattgccggatgttggaagcattaagaatcttggatttggtctgttagaaaaaattacaaaaactctgttggcttttttttttttttttttttttttttaaatgttagactcaggatggagatgtagcccaattggtacagcactagtctagtgtgcacagaaccctgcacttgatccctaacaccacataaaacagcatggcagcaacacctgtacacccaggactggggcagtgagagtaggaagttggtcttggttctgtagtgagttgggccagcctgggccacgtgagaccctggggagcaggtgatggtgcttcctgtcgggtgacagtagtctaaaagctagttcagggctgacctcaggcagcagcaaaatcctttctcctgctgactagtgtcacggcgagtgtcataactgcattgcagtgcttactttccggtgttgaaatg

SEQ ID NO: 29310 - DNA, 1639 bp, Mus musculus
ctgcatagactgcagcaacggttgcatctccttatcctaagaggacacgatgacctgcaagaaaattaggactttttttcttaatttcattgacttcagagacaattgcaaacttgcagtttatgtattggaatttcacaaaagacataggacttaactggaaaatggaaaaaaaaaaggaaaaaaagaaaaagaaaaaacctaaacaaaaattccctctaggtagtttaggtaaaaaaatgtcccttttattttggctttggttgtgattcagagcataatgctttggtttttttttttgtttttttttttttttttgtctttttactctatttttcggatttttaagtccgtaagtgcatacaattttctcttaatttttaaaccctttcctcccccattttgacatttgcacttggagaacacttgagttgcgcagattttgggtgtccaccccagaaagtgggaatttgatttttcccttccgaactggaagaaaatttttatgaagaatttttgtctaggaaagtttaataacagtgttacccaaggttgtgtctgtaagggtggctcattttctctgaccctttgttactcaaagtaaagtactaggagtcctaagaaatgttctgttcttgtgtattatactgattaagtcaggattaatttgatttcaaagctaagaacagtgataaaaacttgttttcagaaatgcattttggaagagaaaacattgtaaaacatgtagtgaatgtttcttcagtttcttgttcagccaatgaggaaagggcattgcctttctttttcccattaatcacttctcaataaacgtgagagcctgtcgagcatcactccagtaccacttagtattatttgagtctctgtgtttggggagagattttggagtctaaggagttttgagaggtgacctagtgactcactttagacagtttgtgttaatggccctgcatggtgttgcatgcctgtaatccttgcatttaggagacgggagcaggatggatgaggtcagaggttatcctcaggccagttgggctacatgagaccctgtcaacaaaaaggttgtattggaaggacattgctttgtacccaaggactagaaacctgctgtgacgatattcataatgcctgtttctggttctttatatagagaaaacacagcactgctaaaccattcagcagtatttgtgtgtatggtgccaggtactgtgctaattccataggaacctcaccctgtaaaaagaggtggcacccactatcccagtatgtaagtgtctgatccagtatatggctgatttagacagtatgccccagagatgtaggtcccaaaaatgaaattctagtggaactcacagaggaatttgtttctttccctaaggcttaattaaaaggcttttctgctttagagagtctttactcttaagatgtcctaattctagagggttaaatgttcaaaaactctatactaagagattctggaaataaagcttaatactgtggacagtgttacactggaatgcagggccgtgctcacacagccagactgctaagaaaggcagctcagggatgctgggatatcgctcagtcagccggtgtgccctgcgccatcaaggaaaagcag

SEQ ID NO: 29311 - DNA, 1168 bp, Mus musculus
gaaatcacatcttgaaaaaaaaaaataaatgaagttgtggtttgctttggtcaatcctgaggacaggataaactcggtgagagaaagtcccaatgcaacctccagacgatttcctccagacgatttcctccagacgatttcctccagactatttcctccagacgatttcctccaagcagtcgatcacttagaggcgaggcatattccttccacctagaataatttttccctgggaaatcctagtgtagaggcagcggtgtgattcaaaagcccttgcctagcaggtgcaaggccccagataagaattctagtataatctatagtgtgctaataaacaaccaaggttgccagatgtggtgcatcctacctgtaactcctcctgtacagaccagaggtcagaagagcttgaacttgaggtcagtgtgggttctaaagtgaaatcctgtttcaggtaaacacccagagcccagtttgtccaagggaccccaggggactctttcctcttcaaagcctgttctctgtccctctgttcaggactgaggaggacatcagaaagaactcagaatccgcactctttctgccatcttccctcgccgccaccatggtgcgaatgaatgttctggcggatgctctcaggagcatcaacaacgctgagaagagaggcaaacgccaggtcctcatcaggccatgttctaaagtcatcgttcggttcttaaccgtgatggtgaagcacgggtacattggtgaattcgagatcattgatgatcacagagctgggaagattgttgtgaacctcacaggaaggttgaacaagtgtggcgttataagccctagatttgatgttcaactcaaagacctagagaaatggcagaacaacctgctcccttcacggcagtttggcttcattgtgctgacaacctaggctggcatcatgaaccatgaagaggcaagacgaaaacatacaggagggaaaatcctgggattcctttttaaaatgtaaagcataaataaaaagccttcgtggactgtgaaaaaaaaaaaaaaaagaactcagaatccttgatctacactcctcttctgcatcatcttttcagctcctaaaaagccatagtttgattctcatgctctgccacattagtaacttcctgtcccatctttgtttatttat

SEQ ID NO: 29312 - DNA, 1168 bp, Mus musculus; identical to SEQ ID NO: 29311

SEQ ID NO: 29313 - DNA, 3361 bp, Mus musculus
cccagtggctaccctcagccagggctccagtcctgtgactgtccacacactgccttctggccctcagctcttccgctatgccacggtggtttcctctgccaagagcaactcaccagacacagtgaccatccacccttcctcaagtttggcactgctaagctccacctctatgcaggatgggagttccctgggcaacatggccaccatggtgagccccatggagctggtggccatggagtccggcctgacgtcagcaatccaggctgttgaaagcacctctgaggatgggcagaccatcattgaaatcgaccctgccccagactccgaggctgacgacactgagggcaaagcagtcatcttggagacagggctgaggactgaggagaaagtggtagccgaaatggaagaacaccagcatcaggtccacaatgtggagattgtggtcttggaggactgattggggacagggccaagagctgtgttttggtttggaattttaattatgtttatttttatcattgtcccgctcatttccacatagaactttttttaaaaaaaaaacaaaaacaaacaaaaaaaaaccaaactacaaaatctcgttgtaactgcaaatgttgggttcctcctacttcctcattgacaactggacagaacaagctgcctttccagaagttagaaacagggcacccagggtctgaaccatctttccccaaggaaggtaattgcttttaggggaagtgtcaaaatatccaggaatcctttccagaatagtctgtctgtgtatacacgcatggtctcactcttgtaaagacgcattgaccagaccctggaacacagatctgactccagaagatgaccagctctgctgtggatacagaagcacgcttgcctctgtgtcctggatatgatggcctcagatgctggtgtgcaaaactgaaagaacaggaggttggctctgcttagggtggaaagtagtgtgatcagcagctcatagggggagccctttgacagggaggggccgaggaatggtcttccagaggtgcatctgatgccccttgcgctctctgagggttgggtaccattttcaatttcagaagaggacagagattatagaaagacacaaagcaatcaaaagattgtcacagctgtgcttttgggatagctcaccttgcccccagccttgtcaaagccctcaccctcctcgcccaggactatcagtccattcctttgcagactgtgatgtggtataaattgttctaattcttggactgtggctgtcatggaggtggggctccaaggccatcatttttcgtttcttgactccaggaatggcagagtccctcgtgcagaccagctgctatttttggtggagccctgcacgtaagcatgcaagtgtgtgtgtgtgtgtgtgtatgtgtgtgtgtgtgtgtgtgtgtgtgtgtgtgtacatgtttcgggtttggaaccaaaagcagtcatttccctggtgcttccttttcttttccttccgtctgctggaccccatgctcagtagctttttggcagacagcagtgacaggtgcctgcctgccttcattctctttgccattctcctcttctgataccacagatgtttctgtgagataccgaactcataaaatggcttaggcttggcagggacaactggtaacacctttcctgaggtgtggactagatggctcctgagtgagctgcactttctgggaaagggacattgtatttgacattgtaagaagtatgacaggagtgtcagtaacgtccaggcgtggggcttcttcctaaatgctgtttgtacattcggtactactaggtcactctttctgctgtgatcccatgtcgttgattctcttcagcgtttgggggagagtaagcagtttctggtttctttaattatattgtttactatgttagggaaaatatagagactctcgaggtgactttataggtcaaaaaagcatacagcttaggagctggaggatttattattattattaaaagtaaaattttggcttttgtttaaaaaaaaaaaatagagaaggatgcctgtctaaatctgtcttcctgcctgcaggttttgaaaaccctgtaagcaaccaaaagttgcaccttccatctcttagacggccatgtgtcaccagggaagcaagccctcagggatcactctgaagaccctgaagagtgcggcttctgaactctattcagatttgtttcagctttaaaactggacttttcttttcagactctttagttaggctggggacagaactgaattggtaaagtggtcacctagcgttcatgaaaccctgggctcagtctccagccagaagtaaactgggcatggggccacatatctgatcctaacacttgggaaatagagacgggagacttagaaattcaaggtcatacataccaagttcaagaccaacctgggatatatgaaatagtgtctcaaaaaatttttgtttaggacaagcttttggtgaaagaaggaatttattcctgccttccttacactttgttaatacataggaatttttattacatttatttatctgtgtgtgtgtgtgtgtgtgtgtgtgtgtgtgtgtgtgtgatggtgagcttgctacggtatgtatgtgaagatcagagaacaacctgcaggagtctgttctcgccttccaccatgtgggtcctgggaattgaactcaggttgccaggcttggtggtaagcaccctcatccattgagccatcttgcctgctctaaaagtttcggtcttcagaccaaaactgttacttgaacctagaaagccacatcgcatccctgttgtgtcctttaggtcatttctcttttccagagatgggcagaccaattcaggacacgggaggcaccctagagaatagaggcaggctccttcaggtcctgcctttttgctcttcacagctgttgtgtcattaaaggttgtgtgagcagcatgcttccaaagtcagatttccttcttgagacagagcctgtttacttaaaacagattacatgagctttgctgttttcctggtcttccaattgctgtcattgctagctgcagtggtacttggagagatgagatctctcacagacctggtctagattattttaggtggggtgatacacatgcaagcttctgatgtgtgaataggcagttgcaatgaaattactcctcaggctgacttgatggtagctatcttttctctagccattcattaaataaacatttgtaagtactgtctatgtataagtactaaacgccaactgattgcgtcacctaagccccagtaagtaccatgaagatgcaggttttgtgctagacactgatcttgcagaca

SEQ ID NO: 29314 - DNA, 1290 bp, Mus musculus
tatgaacacagagcgcgtgtcagctttttttaatccctccccatcacctagaatctaggtctttgatgataaatttactccgttctttgcttttacagaccgtctcctgtgtgtccctgtcagagacctgaattcggttcctagcacccatatgttagaacataacgtccaagttggaggctacaagtggcactaaattacacattatcagttttgacaggttggggcaccgtgtaaccctagtaacttagcgaaaggctcctcgaacccaacatcccacctctagctgggagcagctgttttgcaccagcgccgcctacctctccctccgcgtcggccagagcattcccagcaagcactgctctgatttgcatattgactcacggactttcctttactgctatacaaaaaacgacacaacagttctctttgtgaagagctttccctcagcccgagaagaatcgatagtttgccttttagcttcgacaatatacagttgaaagttggttagactttattttcacctttaccgtaagatgggtggaccgacaatgccactgtgcttccgaacgcgctcgagcaaaaagggcttctgtcgtgagtggcacacgcagggcaactcgattgctgtgcgtgcggaatcgacatcaagagatttcggaagcataattttttggtaattgggcagctggtgatcgttggtcccggcgcccttgaatttgttaaattacaggaggaagcttttttagttcattttacaaatactttcttgttaggtagataataccttctaaggttattatctggatcttctaagtctttttatcgctagcaagtctaagtttctggactttggaattagaagttaatgtcgtaggcgggcatggtggtccacgcctttaatcccagagtttgggaggcagacgcaggtggttttctgagttcgaggccatcctgctcttcaatgttagttccaggacagccagggttatacaaagaaaccctgtctcgagaaacaaaacaaacaaaaaaagagtagctgagtgctctgagttgtctctccagccccttagctatttattttcatttaaattatttttgttttattcgcttgtgtgcctgagtttgaatttcccgggattaacagttgaagactagggctggtgagatggctcagcggttaagattgccgactgctcttccaaaggtcctgagttcaaattccagcaaccacatggtggctcacaaccatctgtaacgaaatctgattctctcttctggagtgtctga

SEQ ID NO: 29315 - DNA, 1875 bp, Mus musculus
tgggattgggagggtaggggagggtaggtggggggaggcacacacttagtcccagtactcaggaggcagagttgggcacatctctgtgagtttgaagccagccttgtctagatagtgagttctgggccagccagggctacataatgagacctgacaaaaacaaaaacaaacaaacaaaaaaaaacataccagagggtggcataacaaacccaagagcgtcctgagcagagtaaaggtggtgggtttcaagaacagagattcaggacgtagccccctgggtgctgggtgctgtgcctggggtaagagaatgcaaaggaggggggcataagctccctggttctccagtctcccttgaactcttgggctgggaccttgccagactgctattagtcaaggccaaagttcaccaccatgtcccaggcatctcctggtgtggaaacgcagggctgcagaccccaaagatagctgcttctatttctgtcccttgcaggtcgtgtttttgcctggggcatgggcaccaactaccagctgggcaccgggcaggatgaagatgcctggagtcctgtggaaatgactggcaaacagctggagaaccgtgtggtgttaactgtgtccagtgggggccagcacacggtcttactagttaaggaccaggcacagagctgatgaagtctttgtgggcctggcttctggccccagctcagcttctcaggacaggaaaagagccagctacagattccaaccctgaacagatagcatctcctgtcttttcccatcaccacagcagaatcctttttcttctgtttcgtccgtcctctttctagaacatactggtacttgtaggatgtgtggggatgggaggaggacctcagaaggatctttgcttactttattagacctccccccctcccctttgataccctccttcctgtggtcctagctggcactggctcattacctacaaaacccaaaacggtagcttaagactacgtgcaacatcctgccccggggttttgctgcccagactctgaaaagttgggactctgtgaagccctgcttaccacgagcctctttctgttcctaacagtagtttacaaggacacagatggtttgtattgtcatcggatccagttgtcatggacccatgcctggggagatctggacaaaggcttttcaaggctctgagtgatctaagccaaatatttgactctaaacaggtgtccatgggcaaaaacactgacccacttgaaaaaaaccaactgtcctcccaaagcacaaggcatcccagtatcccttgggtgtcacctgtcccttccccatcagcctttctgccatagaggactggatagccatgctgggctcggctgggcagtcaaggcaaggcagggtattgggaaaggggtgggagttgttttataacggtgctgagggaggagtggaggggcggaggctggtcctaaggaaagtaacagtggctgagaaaatagttttgaattttttttaattgtataatattttggaggggagattaaaatcttgtaacactttaataaacttagagttttgtaaatgggctttgtttttatgcgtgtccatggagttgctttgttgtctttaaaggaacacctgcttatgagcctgcctttgttagggttatggctgatacatccaatccaaagtctggagaaggcaagaggtgtttgagatagttgtgcagtagaagccactgcagttgcttcatggttatgagacggggtagcttgttaagtaggctctcagcatagcccactgacaacctggtcttcctgcctcagcctcgtgagtgctgaaatcaaggcctggctttggagtagaatttttaaatcctaaaccaga

SEQ ID NO: 29316 - DNA, 1189 bp, Mus musculus
tccttgtcagcatcacacttattaaagagttagaatatagggcaaacaaaaaaagctaaagtgaccttaaaactagtactttcttctctatgaaggaaaaagtgcttttgtttgttttttctcttcctgccatgtagtttctgtctatggaacaaagactccttcccactccgtccccatctcctcaaaccttgatattgcttgagtaaaggaagagaaaacaacagttctgtcaagtctgtgagttgtctagatacaaggttgccagagctgctaacctttgcgattacatcctgaccaaggctcagttctcacaagcaaggccggtgctccgcccctgctccgcccctgctccgccctgctccaccctgctccgccccgtttctccttctctgtcccaggtttagagagtactttgcatatgcctgtgctgtctggggtgtggtaaccttttttttagacagggtcttatgtagcctcactatgtagccaaggatcccctgcctccacctcccgagtacagggctcacagatgcacccaccatacctgccggccagcaacggcttctctcagctgttctccctcacgtgccaatcctgagctcccgtctgcttgtgtgtgccatcaagggctctgactctgttcatctcatctgtcttctgaagcaggatatgttagggctgcatctaggcagtggttttgtttttatgtatataaaagttgattatgtgtcttctttctgtaagtggaagcttacagtcctaatgtaaaggacttaaagcctcgctgtcgcatgttaagatgcttccctactgtacagaatcctgtaaaatacataattacgttgtatatcagccttcctaccaatcttaattattaaagtattttagaatatcaaaaaaactgaatttgtgttactttttacttttttagtgctgggcattgagctcaggcctcatgcatgttagacagtcaccctaagccatatccctcacctctggtcttttgttttattcaagaagattaaaacaacttaaaagtgacacccaaaatactgctaacgacttcaaataaaaagaagataaatgataatgttaaatgtagccagaagtgaaactatcatgtttgtttgtttctctgaacaaacaaaaatcacagggctgggatatagcccagtagagcacttgc

SEQ ID NO: 29317 - DNA, 1195 bp, Mus musculus
ttctctgtgtagccctggctgtcctggaatttactctgtagaccaggctggcctcgaactcagggatctgcctgtctctgcctccggagtgtgggatcaaaagcatgcaccaccactgccaggtttattcattgattttgagccagcatctctcactgaatcagagctcactgctcagctagactggctggccaataagctacagtgatctactctactccacccccaagcagggcccttgtgtaagtgtggggatctgaactcagtcctcaggctgtatttgtggcaggcatttctctcgtgtgcccttggtaacatggctcttgtatgaagagttgctacccccactgaggctctcttactctccctaagcatgttaaaagctgctggaaagtgatgtgtaaactgtaagttcattagtgaagttggttgtaagtgtgttcccatttctcggctctctttaaatcctgtctctcattgcataggctcaactggaagccagcctaactctgaagccgagcctggtcctgagcatgcacctaagcagcctctgctgccccccaagagacccttgtcctcttcttgtgaagcaaaggaggttccggctggcagtacagcaaggtccgtctcctccacctctggctctaccaccgtgacatctgctgccaccactgctgccacagacatgacaaagactgttaagtcctttgtgggccccacccccgctcctgcccccgcccccaggactctgcctgctgctcctgccagtgctaacactgctgccaccactacagcccctgccaagcaaccccccatcccaccccctaaaccagctcagagaaacagcaaccccatcattggtaagtcttcacggttgtgctcagggtttggtttggttatggacagttattttattgaatgatttgttctgtgaatgagttttctttttctttttcttttttttttttttttgttttgttttgttttgttttttcaagacaggttttctctgtatagccctggctgtcctggaacgcactctgtacaccaggctggcctcgaactcagaaatccgcctgcctctgtctcccgagtgctgggattaaaggcgtgcgccaccacgcccagctgtgaaagacttttctaactcatctcttggaatattttcaatatagaaaaaagttttagagccagg

SEQ ID NO: 29318 - DNA, 1179 bp, Mus musculus
gagacaagaaccgccacgccctggtgcgcaactgtgtggacatcgccacgtctgagaacctcacggacttcctgatggagatgggcttccgcatggaccatgagtttgtcgccaaaggacacctgtttcggaagggcatcatgaaggttgtggtgtacaagattttccgaatcctggtcccagggaacacggacagcaccgaggccctgtccctctcctatcttgtggaattaagtgttgtcgccccggctgggcaggacatggtctctgatgacatgaggaactttgcagagcagctcaaacctctggttcacctggaaaaaatagaccccaaaaggctgatgtgatgaagaaagtttgtcggccttttaggcctgtccccacctgggaggtgagagacttcgaaagtagcccaggtactgctgccagccgggcccacttccttccagaagatgatggcgagacctggttcctttcaactgtttccttcacttggtaatgtctcttttttcttgcaacagggttttaccatggaattcactacataaactagctaccctggaactcaggaccctgtacttcccgcctaagtgcctgcaaggtccttattaaacctgactgttcatcttcttgataggcttttccaatgaaagacccaggataatatggagatttgttcaagtcctccctccactcaaaaagagggaactggaataaattagcttttcagaggaaaggtcaaaaaacaactcataatattttgctttttttttcttttttctcttcttttcttttcttttttgttttttttttttgttttttgtttgtttgtttgtttgtttgtttgttttgtttttcaatacaagacagggtttctctgtgttgctttggctgccctggaactcactttgtagaccaggctggcctcaaactcagaaatccacctgcctctgcctcccgagtactggaattaaaggcgtgcgataacacgcaagcccggctgtttgtttttttttttttgttttttttttgttttttttagagaaacattttttattcctttatttatttgttgttttcttcatatgttttaaattgtgttgttttgccattgatatacaaggtttacaatggtggtgtgagccagcattgtgtggtaataaagactgaaaagactca

SEQ ID NO: 29319 - DNA, 1132 bp, Mus musculus
ctctttcactgccagccccgccacctccgcctcccttctttttcaatgtgactctccttcctcgctccccccagtggctgagttcaaaatttaaatatggtatccaatcggctttatgagatctgatcaaaacatccaggtcgtcgaagctgaaaaaaaaaaaaaaaaaaaaaaaaacgtatcctagagctgtcctatgacagtcaccttccacggtaccactctagactaggaccccaaagcaacagcagccccgaaccttgcgcgtgcgctcttgcacaccggtgccagaaggcgggcgcgttccttgccctctcggcacccttacttttcggggcggtagcggagaagtttcctgtccctcagcttcctaccggaagtgctgaagggagagtttggcggtttctctggctctgcgctggcggcatttgggggtgcggattgcgggtgtgcacgcgtggatttaattccagctttacaaggatctgtagcgcggacggagacgtgttgctagtgtaagtgcacacgtgtcccggctgcccgcgtgggaggaccgggacagtcactctaacttcatatttcccgcctggctcatttgcagaggcgttctcataaaggcagaaccagttctagttacatcgctcgtgtgccctggggcctttccctgagtctgcatggcctccgcatagagtgaagggtggacaaggtccttaggtctccctcggatcttttcttttgttttttctttgagacagtctcactgtgatgccctaattggccgggatttgctatatagaccagtctagcccgaagctgcagccgtccttctaactctgtccccaagtattgagattacagatgttccccccaacacagccggtttttatttctttatgtttggaaacgaggcctctcagtgtagcccagtgtagttaccatttttgaatatgaatgtcggtttctttcgagccaggtagtgggtgggggagacgagggctgtggggttaaacacccttggtcttattttaaacgagacagtaggtttcggaacaagaggttacatagctgcctcgagattacatagaaaaacgtttataaggttcagaacttgatactagatggctattccgta

SEQ ID NO: 29320 - DNA, 1234 bp, Mus musculus
ctttctgtctcatgtctatccaccacatgctggggatgggcatgtctgtggccccaggcagccatcagggcaagccacattttccttttcctcactggactgaacaggaccgtcgcactgactttggggtctgagctctgtacctggagctggaagaagattcggaaaggccaagggccacatccccttttcttcccctgctcctaaaagcagaggaaggctacagagctaaggctgggccccaggcaccacaaaagctgccttcctggactgggaagcccctggctgcctgtgtgggagaggagtaaggacctccagggactagcactccaggaagtttgccttcccgccttccctccttcctcattctccagtttcatcagccccccaacctgcctcccacccatcaatgtgaaagttggactcacagctggtctgtgtgcccagttcccctagagcctgttctgctgggcagcctgttctttggttacctgagtaggggttcagttcttctgtctcctttgccctcatacccttttctcccatgcctggtggtgtggggcctgggagaggggccaaacatatccaaagaacacactgtctctggagagttggagcccgtggtggtctccctgctgtctgaagagtaaggagtggctgttggtgaactctgtatttgggtcttgaggacctcactgtggagccagagtcaatctgtccctctagatggtattgccacacggaggctggcatcctgacctccttatcccttgggttctgccaagaatgcttgccaaaaacaaacaaacaaaaacaaaaaaacctgagcctttcttaggtgacaccaggctccacccagtaagatgcatataccaaggttctctttccctgggccgcatggctccactccttggacctcacattggagactggggggattggcttacatttcttaagatttgacgctttcctctgggctctctggccaaaccatcagcagcagactgatttttctcgcaagaccttgaaggcccctggggacccttattccacagtcagcctttcctggctgccttccaagggacaccacccccatcccagtgtcccatctgtcccctctcccggatttaaatggatgacttggcagaagcagccaccaccgacaagcactttgcagagcaaacaactgtgaattctgatgtcccttccccttccaccagcagcagtagatggg

SEQ ID NO: 29321 - DNA, 2375 bp, Mus musculus
tctgtgtgtgtgttgcctgcatatatgtatgtatgtatatcccatgagtacctggtacctgtggaggctagtaccctggaaccgcagttacatgtgcttgtgagctgctgtgtgggttctagaaatggagcctgagttctctaggagagaaagtttccagagccaattttccctcccaactcaggaaacttcaatctggaacttatccaaggacagcagttgaagcccctagaactgcagttatagatggttgtaggccatcatgtggatgctgggaactgaaccctgactcccacaagctgcaccccccacctcccaccccaccctgtgcacatatacaagtaaatgtgattaaagtaaagtaaagatctccttgagatgaaagattggattaaatccctcagccactgtttctttatagagagaagactaaagaacagctggctgccctgaggaaacaccatgaagatgagattgaccaccattcgaaggagatagagcgtctgcagaagcaaattgaacgccataagaagaagatccaacaactaaagaataatcattgaatgcgcgcagtcggtccctcacagagtggcccgtatcactccccacgtctgtagacacatggctttgaatgattactatttggtctgtgtgctactaacagataataaacgatcaccaggaaacttgcctgatgccttctactgtctagagcagcagttctcaacctttggcttgagaccccgtttgtgggtagaacgaccctttcacgggagccgcctaaggacatctgaaccatcaaatattgacattctgatcggaaaaacagcagggaaattacagttatgaagtagcaaccaaacctttaaggggttgaagcattaggaaggttgagaaccactaagggacagaaacttctcatccattagaatgaattgagggtttctactaaatagagtacgggggagggtgtgaccctgacctcagtctaatcagaatgtgcagagacagcttgaaacgtaaaccccagtccaatgcctaagcctagctgcggtctggaggaaagagtaaacagagtggtttctaaggctaggaccagaaacaatagcactgtcttactagaaggctggctctttcatatgaactagctattgctctaagcgtgagacaactacaattagaaatcattcccaaagccaggcgtggtggcgcacgcctgtattcccagcactcgggaggcagaggcaggcggatttctgagttcgaggccagcctggtctacagagtgagtttcaggacagccaggactatacgaagaaaccctgtctcaggaaaaaaaaagttggtttttttttttttttcactttccaacaaattcttttttaaaaagatacatagagccaggcagtggtggcacacacctttgatcctagcattcagaaagcagaggcaggcagatttctgttagttcctggctagcctggtcagttagttctaggaaaaaacaaaacaaaacaaaacaaaaaacagtctggccttctgagaccaacagttgacctaactccatagtaaagccattgcttagacatgcatgagggcctggtataatcccagcactaggtatggaaaacgttgccaggaataacacagtaaaacttatgaccctcagtgcagagatctcagggcagacctttcttcccccttgcattggaattgaggaagtcttcccggttgtgtgagtattcaatgtctagatgactcagcgttctactgctgtggactctgtgtgtgtgtgtgtgtgtgtgtgtgtgtgtgtgtgtgtgtgtgtgtgtgtgtgttttacacagttattttaggtatggggaaggtttggagtggtgagtgagtatgtttctgccgcagagatccgaggacaacttaggagaggactccattccctaccatgtgggttctgggggtcaaatccagatcattgccaggcttggtggcaaacacctttaaccattgagccatcctaccagcccttttttggtttctttttccttttttcttttctttcttttctttttgttttctgtttgttttgatttttttgtttcgtttggttttgagacagggtttctttgtgtagccctggctgtcctgtagaccaggctggcctcaaactcagaaatccaccagcttctgcctcacaagtgctgggattaaaggagtatgccaccactgcccggcccttttttttatgatatatatgtttgtttattacatgtaagtacacgtcttcagacacttcagaagagagcttcaggtctcattatggatggttgggagccacaagtggttgctgggatttgaactcaggattttcagaagag

SEQ ID NO: 29322 - DNA, 1223 bp, Mus musculus
gagcagccagaaactaatcttgcttccgtttctcctttggtctgcgtcctaagcccataggggttgttgctcatttatggaataagaacttaaacagagacctggatttcaagtctcagtacccaaaaaaaacaaaacaaaaaaaaacaattatcagggggctggtgagatggctcagcgggtaagggcactgactgctcttccaaaggtcctgagttcaaatcccagcaaccacatggtggcttttaaccacccatagtgagatctgatgctctcttctggtgtgtctgaagtcagctacagtgtacttatgtataataaataaatcttaaaaacaaaacaattatcaggatggcaattctcctgcctcagcctttcaagtgttggaattttaagctatgccaccactcctggcttgggacctatgtcctttaccttatgtattattgttttgttggattgtgtttgagttttctttcctttaattctgtgacggtgttgggatatgtgcacaagtacaggtgcccattgggagttagagattaggtgcccttggaattagaaatacacgtagttctaaactcttgaaatgggtgcttgggggctggagagatggctcagcggttaagagcaccaactgctgttccagaggtcctgagttcaattcccagcaaccacctggtgcctcacaaccatctgtaatggaatccaccagcaacagtgtactcatatacgtaaaataaaatttaaaaaaagaaaagaaaagaaacgggtactgggaaccaacctgaggtcctatgctggagagatggctcagggcctaatagcaatgactgctcttccagaggaaccaggttctattgctagtgctctcacagtgtctaacagctgtccatagctccagttctacggcatctcaaactcccttctggcctacatgggcaatacatgcatgtatcctgtgcctttaatcccagtgttctagagacagaggcagaagaagcaggcagagctcttgagtctgagaccagactggtctacatattgagttccatgaaagccatacataaaaagatgcagccaaaacatacatgtaaaatgtaaaaaatgtaaaaaaaaaaaaaaaaaaaaaaaaaagctgatcacggtgttgcacacctttatttaaacatgcctgtatgtgcatgtgcacttttgtgtgtgtgtatgcatgcttgggccaa

SEQ ID NO: 29323 - DNA, 1342 bp, Mus musculus
gtgttgtcttcacccatctcatcctcttccaagatgctttgagaggatgctgggaaacttccctgggtccttagagaagggagaaggctcggctcggctctctctgctcttggactgtcccagagggctcatcaggattggtatgggaggacgttggtggcaggacaggctcggtccctttgctcattaatgaccttaccttgatccttaatgactcttaatgacctttctttcaggaaagtcgggatggtcgagtggacagttggcgaaatttccaggcaaatacaaaggggaagaaggagaagaagaatcggaccttcctgcggccaccgaaagtcaagatggagcagcgggagtgagcagcaggaccagagcctccccgctgctcctcctgcttcacggactcattctctctccacctccaccccaccagagagtagcgattgctttttagtctattttgttgtcaatacaatttaatatcaatcagagtaatcctttgtacattgagaggaggggcttggtttcaccatccccgtcctttccccacggatccaccaggattgaaggagcttcggacccatgccgccttcttttcccacgcctctaacttaatgttttatatttgaattgtgtggctcaagggtcatgtatagtttgtggaatttttccaattaaatgtcttgcttacagtggtgttgccccgactccagatcagcctgggccaccttgggaagccatccttgaggcccttgctccaataggagaggtattgtggattcacacggcagtcacttgttgccctcatgccctgtggtgtttggcacgaggctcccagccacttaaacctgttcactttccaaagaattcatcttccagccagtcccgttgtgtccttgcttgtctgcatttattagtggtaatattcttttacgtataataaatttttatacccaagcctttgatggtctcctcctcgggtgtgactccaaggacaggcaagtgtcttgcagctggacgcacatagctccctacactaatttgttaaaccttagcttgtctacctacaaaatgggaacacagggccggggacatactctgatggaatgcttgctagcatgtgtgaagttctaggttcagtactcacaaagcaaagtacaggaatatcaagtatggcagaggccgaaggctgtgtaggagcccccgggttccatcctaacagcattatcaacaatttggaaacattgatttcactgtaggaaatcaccacagatctaatgcggccaccaacgccatgggtgttgtcaatgtcttatctgttaagtaagaggctgcacactga

SEQ ID NO: 29324 - DNA, 1198 bp, Mus musculus
attttttttttttagaacttactttcaaagatgagagcggtggctgggcatggaggcacaagccctaggctgaaggaggagggtccccagttcgagatcagcctgatctgactttgttttggggagggcgggagtacttttcacgaaggcggcggcaatttagcagcaccagcatcctcggaaagtcatctcgtgcgtaagatccagggagtcaatcacgcaactgggtctgcgaggtgggcgggacctaagccttgccccgccccgagacgattgactggtcctctgggttctgtcggaacggggtgtggattgttaggcggtcccgcatctacttccggtggctagggatgcgcatccgggtcacgctaacgccgcggtttccgccactctgttggttccagagtgggtccgtaatcgtcccatgtcgtgctgggcagtgtctgcagccgtctggtgagtccccgccgccgccagggtgtgagcgcggtggctcgggtgcagcgttcggggtcccggctgaagaggtcctccttggtcgtgctgggtagggggtcccgtcaccgtccccctcgtccctgcctgccggtctgccctcgagcttttcccgggcgtcgctctggcctcgccccttctcgcctaggcgccgggtctctgcctcccccttctctcagcacttcttcccgatccactgtttttccacccggagcgttggggttcggctctgtcccccagccctcctcgcctgtgacccttcccccctccagggactggtagatgacaagagtgttgcgcctgccctttcagagcgagagggcttcctccgagtccagatcctggccgactgctccagcttggaggcgcgaggttagacttgaggtcgcttccccagttagagaacaacaaaggcgtccccaggtcctcgcactgcctcagtttgctgggctctctgggcagcagcgaacaggtggcggactcgctggcgggcttgtgagatctcctgaattgacaggtcttcgtcctgtctgttttgagtcctctgtcccacgagaatggatgtgcacagctgaggcaaaagtgcggatgttcttcactctgcatggatttaaagttagaggactccgggtttctaaacttttaaacgactgtgatgtggtgtggtgttgctgttttctgccaagattcaccaatgtaatat

SEQ ID NO: 29325 - DNA, 1141 bp, Mus musculus
tagacggttaccaagagcctcaaggtgtctggtggaggggtgtaagctgcgctgactatccttgcttcttttccagcacaacatgcccttctggaggatcacaaaccacggagatctggtgtccctgcaccaggctttagagcttgacttcctctgagaactggaatgtggacccttccttccttgtgagcttctctttacctccaacaggagccagaagccagaaccctctgagccccttctctcctgtctgtctctcgggtctcagtgccccctcccccttctcttctgctctttctccctccatgaaatgctggcgagaacacaatcagaaccaacaactgcagttattctgagtgagctgcagcccatgtcccctgtacagcaagaggtggctggatagagctgcagaccggctgccgctaccgtgctttaatttttctgtttcaattgaaaaaggaagaacaagaaaagccgatgcttggggcacagttgtactcttgctgcatgacggactgaccgggagctgctcctgatgtggatggaaactgtccccttgagatcgtcttctggtctcttagctatagaatgtctctcccagtgaatgggtatgttatttttataggtgagggtctggtctctacagcagcctcccccacttttctatgaagaaagccgtgtgtaaagtttccgtgacagtagtaatggaaatatctaaaatacctccgtgactggacaggacagaggctccagtgctctgctccctggggaggctccttgccatctacaaggccctggtcacttactttagactgtggcatctcccatcttgtaagcctcggtctccttggcagtcctccttcatctgtaactaaatggcacaaccctggaaactccttcccatagacaataaatctaagcctttagcttgtacttcagaagttctgtcccaggaggctcagcctccagactggagagaagggctcagatttcttaggactttcacctcgtgctcctgcagagcagtacctgttcccagcagatgcttcctctgtggtcggctcagtcgtcagatgctggcctcacgtcctgtcctcacagctacctgtctctgtgcagctctggccagcccctacccact

SEQ ID NO: 29326 - DNA, 1113 bp, Mus musculus
agggtagacagaggagtgcattggtctctccagggactgctgcctttgtgctgactccctccctccctccctccctccctccctcccacccacccacagaggcttgggaaggaaaatgagcaggcagcatcaagagctgctagtaagagaaagacagcttggtggtaatagcacccgcagcttgtgcagaggtccaaggtttgagcacccacaaggctattcacaacctctagctgcagctccagggggttcgttgccctcttctggcctcttcaggcaccaagcacttatatacgtgtaagaaacactcataaaatagaaattccttttaatattaaaagctgttggaagttagaaggcagtccttactgaaggaacaccttgaagaaattagctggtgaatcttttccctgctggatcctgtgttctggaagattagtcaggacatctcatggtgacagctagttctaggagtgtgtggggtggcaggaatgtcctgggatacaaggtggcttgactttcgaatgtaaaagtgactgtgccttagcatcaccctgtccagtgcccctggggcagccggtgatgtccgcgagagtggatacctgctccacattttaggtgcctacttgggcttttgatttgggggtgttctcttctctgctagtcgggtgacagctagtgtcccaagagacttggcacagcttgtccgtgttcacccaagctcaaccttcacagctccaagtagaatctgactggcaagctgcagcagcaagctcatggcgcttccatagacactgctttgaatgggagtcacacaactgacaggagcaccaggcagagctcggtgctgtcctggaagagtgcaggctagccgccaagtgccaagcttgggcctcattcctcactctccccaggtagctgaggcccttgagtaagcgtgtgctcccggctgctcactggtcaagcagctagaactacccagacacacccattgtagatgccaggttggcgttctgagcttcccaaacatctaaaccacgagggggagaaccccgcttgtgtcccagcctcatctgcgggccgcttgccctccctctaccctgagtcaattct

SEQ ID NO: 29327 - DNA, 1464 bp, Mus musculus
attctggggcctgaatccagggaagggagctgtaagacccctgtgcacatctcatgtgcgagctgactgtagcttcaggatcttacgtcaacttagattggcatctaagtgaagccttgttttattttggaatttgagtccgggatccaaggcagccctggtagctctggtctgcatggataacctcaacccttgggttgtatcgacatttctctacgagagacttccatgaacaaagtgactgaggaattcacagctaagagaagtacacaaacaagtgatgtttgctcatttagctatgttcaaaaggcgctggttttaatgtggggatccccccccctttttttttcctttcaggcaagcagtggattttctgtgcaacgagggccacatttactctactgtggacgacgatcactttaagtctacagatgcagagtgactggagtttcctgggtgcctggaatctgtccagctgggcctgtgttcctctgtcggccccagctctgcgggctttggccagaggcttctaggacagaactttgctgtagaaggtctcactcagctgaagtccttttggaacttagtgctctctgttttgttgcttgttgtttagaggttcagagggagatagacagttgagaaggaagtaaaccaggactggatttcttgtaagaaattccaataagctagtcaggactccaggatgggtggtcggaattgaaagaggaacactgccaagatgtcagggcagggcttcagcttgcttgagagcgactgttctccaaggcttcgtgttgaggacaagcactgctagggccaagggccaaagaagaacctaccaccctctgccagtttgcgctgccctctgggtctgcggggttactttcggaattgcactttccttcccttgtcttgcccgccgtgggaaggaggtttaagtgagcctgaggttctgacctggaggcctcgtgcggctgagagaaagaaatgttattgcgtggtctgtaatataagtgttcatatgtttgataaaacagttcgattgtaatagcttctgaaatgttggttttatttttagcgcttacttactgtgtgagtgtggaagtcagaggacagcttggtggagtctgctttctctttgtacagtgtacagagtcaccttctatcgtgtattccaggggttcaactctggtcatcaggcttattggggggttgtgggtgtgcatagcatgtgccatggccaccgcagattgtgactagaccttgagctggggctacagctcacagtagtaaagcacttgcctgccatccacaaaactgtcgcccctggccgtgctgatttgtgcctttaatgttggtgctgactgtgatcttgagctgtctgcggtgagacttcacaacagctgtccttgaaggagaagaaaaatgctcacagatgtcaaaggtcttgaatggaaacta

SEQ ID NO: 29328 - DNA, 1326 bp, Mus musculus
gactcctgttgtgccatcagcagtggccataaatcccacaccaaaccctgcagtctataaccctgaggctgtgaatgaacccaagaagaagaaatacgcgaaggaggcttggccgggcaagaagcccacaccttccttactgatttgatattttggttatggagagggtggggaggggggtggagggatgacaaggggagctactgaactagggagaaaactttccatgtgtgcagtatcgtctttcagaaagtctcctgaggtcccaaccatgtaatactgagaccaggggtggggctaaagtaccagtaaggactgagtcaggcagcttgaagtgtagagagaggcttcccagtcccttctgagccgactgtcctggcgatgtccctgtgccacctattaggactgttttatgtgaagtcgctcatgggaggcatctggagcaatgagagggtagagcctcattagttaatattcccttccctcgggagacccaagtaacagagcggttgcatggataccaggttggttgacactgttcatttaaaccacagtaaacgagtgtcctcttgtgcctgtggttttgagatctaataggccattctgtgtcatgtctggtggcatgaggccattttgagttcccctcatctgtagccagtgtcacaggacaggctaatgggtttgtacagtattgttggactttacctatgtttcttgtccacactgaaaactcatttagttcgagtgcagcctcctccctgtggcctcactgttggtgtgtgccctgaggcagttcctggtgaacaggaagactatactgcaaggaccaggtgtgtgttaggagaacacctcagttttggtttggaggctcctctcccctgacccccccctcaccccccatgagagttcttcagatctccagaatagacctggctaacaggagacaaggtaggaaccattgtacgagctttgtacagatttgtacatttgtgtaataggccttttctgctttaagtgtagctttttacctgtaacctttattacattgtaaattaaatgtaacttttgtcaattgggtatggtcttgagtcttactgccggaggacacttgtcagacccaggacagttgtcctgagaattggtgccctgcccctgttaattaccacaaataaaatcagcccctaaagaatacaaaaattatcattagcgattctaatccccgtcctgagaccccaaggttagtgtttgaggaggttgccccttctgaggtgtgcgagacattaaggctggtgtgtcctggagtctgattcactgtgcagagacaca

SEQ ID NO: 29329 - DNA, 2595 bp, Mus musculus
aaaaatctcgcaagaagatgtgtatcctcgtgcttgtcctgtcagtgattgttacagtcttggtagttgttatctgggttgcttctaaatgaagtgcttgcctcagagcctcctcctgctgagttgttttcaagggcaagtgcttgagagagtcttgccagaacagactgaccacagaagagagtgtaccagagtgtcctgtgataatttagctagaatctaactactaactagtccttggaattagtgaccatggagacagtatttatcagtttatgcatacattctattcatttgtcaaataacgaattaccttattcctttgtattttcctttctcttgtattttgattgcccttattgcaagtgtttattgacagttccatcgtggatattctttttgacaggtgacactacatcataaatttgtctttttgtatatacgcaaactttacctttttatgagtatctgagataaatttccatctggagccagcctattagagtctgagaaactgtacaatatgccagcaatttttattatttaacattttgattttgtttctgaggggtctgttttctgttttgtaagattttggcactatatataactggggattaagaacattgcacccgtgacttcagacaaaatgagaagaacctggcagagccggcccactgccaggttgtgtgggacagtctgggtctgaggtgaattgcctttattgtctgctggtgtttacagagtccatcctcgaacactaagccatcccactcctgtttagagaggatcggttcattaccatgcttacaatcagtcgggtctctcccacctgtctgcatagaacggaagaattaggcacagcccgattttggatagtaaatgtggatcgtttggcatgattccatctcgttcacctgtggctttcattctggtgaatgataaatgttgctgtcaaaggctaatcctgacccttgtaagtaagggttgcctggctttgatggcaagattttgaaatttagactgaagtggggtttaaaactcagtctgtgaacctattgatatagcaaaacaaaggttcattttgtaaataatactggtttagtgatgttagacttagcctaatttatgaacaagagatcaaactctgtgtagttttagatgaaaacagttttaataaaatgtttctgtcttgtatataaatgttgtctactgccctttttcacaggcctagaacagtcaagagagtgtgtaattggtttaggctctcagataaatgtgaattgaggccagaaatgtcagctcatctttctctgagttagaggatctggctactgtggctgtatttatgtttgtttcttctcttcctcataatgttacttaatcttgttctacactaatgtgaccagcagagaaacaagggcccacatgcataagtttctctgcgcttttgcaccatcccacctacttaataccaataaacatttaaaagcttttgtagttatttttatgagttaacatcctaatgacataggtattaggtactgttctgccatggaaaacacagagctgcaaaaacctggagagcaggtaaggtttggcttgggagtagaaaaggctttgatgccttcctttgaaaagcaggacagagagcagctatggtttgcacacttctaatcctagtacctgagaagacaagacaggcaggttgtgagttcaaggccagactgggatgcatgagagctttgagatcagactctgtttttaagacaaaggtggaaaggaagaaaatctgtctgcacgacacagtggcccacgtggtaacttcagagagaaacccttgttctcagatcatagttggacttggatatgtcatttgtgtcaacaatccaagaaataaaaaacgtgatctgttgtgacaagctattgggacaacaaagtggctgtgattgtataatgacaatgtggtggctgtcacgatggctgtgggaagaggtaggaacttggcctggagttgtagtggtttttgggaagctctaataaacctattcctagaacctgtgttgcacttgattgtctttggaggcactgtggtctgggtcagtggctcttgccttcattttagaaggtttttttttttttttttaagtgctgaagccctggtctccctgctcagagattcaactttttttagtctggtgtatttcctgcataagaattgctccgcatgcatgctgtgtgcagccccagctgagagctttgtttgtaagtcagaaactagactggaatataaaaggactgaggagccctagcccaccagtgacctgccgaggggatttggacaagttgcttagctcataaaccccatgttttctctattgcttgcttccatcctatctatctatctatctatctatcaactatttatctattattataaaatttttaacagatgtctaatctgaacatacaaattgtaaatatgtttctgtattcctatccactttgcatctcctgtttagcttcctgtattgacattgaaaagttctaggagtgctgggtactttttaagaagagaaaaaagggggctggata

SEQ ID NO: 29330 - DNA, 1556 bp, Mus musculus
tgaaaggaactcctggtctgtgccctgttatggctgcatgctgagcggttagggtcccagacctcctcctttcctcctcccactccccgcccccgtggcccccccctctctgttttagtactctgttttccatagtggtcactgctcagtgtcacgtgcagagtgtctgtccaccatcacacctgccatccccgtgagcaagcagtctgtcgtcagctgtacatcactgccgctcccaacctcgaaaactgccacctggagactctgtgcagtgagggaggctttttctcaccaataaaccttttgcttcagggtatactcttgggttttttccaggtatattatgtatgacctttgtacaatgtatagacagagttttatttattttttaaaaaggaaaccttttcttgataaaggaatgatggtagcctagctagttcttgtaaaagtgatgcctctttgaaaaaagaaaaaaaaacaaaaaacaaacccagtcccgtttgctagcttttagtagaagaacgcaaccttttctttctcattgccttagagtcttgatgctgaggtaatgttggaggcgtacgtgtggagctaagtgccttttggaggaccccatggaagagcgtgtgaggagaggcttaaggacggttgctgagtatggccagtctgtctttaagtagggcagaaagatgcttgtccaggttgtactggacacttcctcctctacccacccctcctcctccttctacataattttaaattcccacactgccacttcttttttaaaagtattcctgtttcttgctacatcagctgtcgtaccacgttgttatcacaacctggatctttggttttgttttttaacttgagcagattcaagcgggataagacgtgaactactgagcatttccgagggttggcatgggttgcttgggtgtgggctgcacggtggggaggacctcactgttccttcctttctctccctcatcccgcgtgctccctgttcttaatggaaagtcagaaagcacgcgcttctgggagccgaagggtgtgcccttatccctgtctgactcagtagttgtgggaaggagctgcgcccctccatctttgggaaaggaactagagatggggagtatgtgctgggacacagagcaaaccctgcagtgagtgccagcggtgctggagctagagcggatcctgaaggcagtgacattgggacagtcagggtcactgttcacctgctctgtagtctgggattacgttctccaaagagtcacatgcacacaggtgagcagcggtccgcactcgagtggctcttcccgacaggagattcgaaggactgtgtttttgtaacactggtcgggagtgcaattttcccttctaagcagggaaagctgctgtgctaaatcattttgtaactttccgaatgagagacttcggtaaagataaactcgttcagtatttttcaaatgcatttgcattggctgtggggaaaagatggtaggaaaagaataacagtcatggtttcgtcaatgaaaagtaagactgagaaattg

SEQ ID NO: 29331 - DNA, 1180 bp, Mus musculus
attctttgttgttatttttgttttttgtttttccaagacagggtttctctgtatagccctggctgtcctgaaactcactttgtagaccaggcaggcctcgaactcagaaaatcctgaactcggcctcctgagtgctgggattaaaggcatgtgccaccacctcccggctcttttttttttttttttttttttttaaaggaagttcaataaacaagacagctttaatcttttgccttcgtatcacaagtgatccttctcattatcccacaacagcagacggaccagctggactcttacctagagagctaacgaccaatctagagcttattcatgatatatttgttttaaaatctatgagtagttcatacagattcctactcccacatcaacagcagggaagtgatatgcatatagaggagaaggtccagagagttacatgactcacccaggcctcttgctagcaacagttagtacccagtctgcagctttttactgaattcagactttctgctcctctggtccttttcagactgtctcctttcatttcaggaatgccggattgctcaccctgttgtgaagtgtacctactgtaggaccgagtaccagcaggagaggtacagttctccttgacctcgaaagatgttttttgtttttcttgttcttttgtttatagttgttttgttttgtttttgagatggtagtccaggctagctttctttttttgtttgtttgttttcttttttggtttttgatacagggtttctctgtatagccctggttgtcctggaactcactttgtagaccaggctggcctcgaactcagaaatccccctgcctctgcctctggagtgctaggtttaaaggcagactggctttcattttgagaacagtctttatcttcaacctccctagggctgggattaaaaatgtgaaccaccacatctgcatagagaaatgtaaacagctctgggcgtggtgagtcacttctttaataccagcagttccattggctctgagtgcttaagtgaactgttcttccagaggaccagagttcaatcgaggcactcttaggagattccttgtaagtttacttccaggggaatctgactgctctggtctctgtgggcacctgaagagacaggtacaggacacacgttttaaaaaatagtaaaattaaaaa

SEQ ID NO: 29332 - DNA, 1623 bp, Mus musculus
cagttttgtgtctagtgttatgtggagtggtcatcttgccctgctaccaggtctccctcgccaagatatggggatcttgtcatctctaaccccatagcctatagaagtgggtcagttgcccctgggtgctgaggcccatgaggagttcagtatgtacacatgacagaagaccagaaaggttcaagggcccctaaggatgtgaatgctaggtgaagaactcttgcctctctttccttggcaggttctggtcccggcttctcgcaccctcatgtcagccctggccccgcccggcggcccgaggaggacaaggtcaggatgcgtgtgaagccccagggcctggtggtgacttccagtgccgtgtgcagctctcctgactacctccgagagcccaagtactaccccggcggccccccaaccccccggcccttgcttcccacccggccccctgccagcccacctgacaaggccttttccacccataccttctctgagaacccacgcccaccccctcggcgggaccccagctcccgccgtccaccagtccttgccaagggagacgacctgctacctcctcgggcagcccggcctgtctcccaggcccattgtccctcaccggctccagacaacagctccctccgccactgggacaacgggcgtgtgaacctgcgtccagtagtgcagctgattgacatcatgaaggacttgacaaggctgtcgcaggacctgcagcacagcggtgtgcatctggactgtggagggcttcggctgagccgcccacccgctccgccacccggcgacttgcagtacagcttcttctcttcgcccagcctggccaacagcatccgcagccccgaggagcgtgctaaccctcacaccaagtcagagcggcccagccaccctctctatgaacctgagcccgagcccagggatagtccccagcctggccaaggccatggtcctggagccgcggccacagccactggtctgccccccgagcccgagccagatgggcctgattactctgagctggcagatgccgacatcctcagtgaactggcctccctcacttgccctgaggcccagctcctggaggctcaagcccttgagccgccttcaccacagcctgagccgcagcttctggacccccagccccgcttcctagatccacaggcactagagcctctaggagaaggtttggagctaccacccctgcagccccttgctgatcccctggggctgccgagcctgaccctgcaggccctagataccctacctgattccttggaatcccagctccttgaccctcaggccctggaccccctgcccaagttgctggatgtccccggtcgacgtctagagccccagcaatccttgggccactgccaactggctgagcccttacgcctggacttgtgctcacctcatggtccccctgggcctgagggccaccccaagtacgccttgaggcgcactgataggccaaagatcctgtgtcgcaggcggaaagccggaaggggccggaaggcggactcaggacctgagggtcgcctgcttcctcttcccatgcctacagggctggcagctgccctggccgagcccccaccgctgccaccgccaccacct

SEQ ID NO: 29333 - DNA, 1584 bp, Mus musculus
acgcaaaaggggccgaggggaggtagatgctgtaactgggaaacccaagcgcaagaggcggtcccgaaagaatgggactctgttcccagagcaggtgcccagtggcccaggctttggggaggcaggtgctgagtgggtcggagacaagggtggtggctgggcccctcaccatgggcacccaggagggcaagctggcagaaactgtggtttccaggggaccgaggccagggcttttgcctccactgggctggagagtggggcttcaggccgtggcagctactatgctggtgcgccctcaggccagacggagctcagccaggagcgccagaacctcttcactggctattttcggtccctgcttgattcagatgactcctctgacctcttggactttgccctgtcggcctctcgcccagagtcccggaaggcatcaggaacctatgcagggcctccctccagtgcactgcctgctcagcggggccttgccactttcccaagccggggagccaaggctagcccggtggcagtgggcagcagtggagctggggcagacccctcctttcagcctgtcctgccttcccgtcagacctttccaccagggcgggcaacaagctatgggataaccccagccacttcagactgccgggcagctgagaccttcccaaagctggctcccccaccttcagccgtggcccgctcacctacaacccatccgcccgccaacacctacccacctcagtatggtggctatggggccgggcaaagcgtgtttgcctcggcaaagcccttttcaggccaggactgtgcaaacagcaaggactgcagcttcgcctatggcagcggcaatagcctccctgcctcacccagcagtgcccacagtgctggctacgccccgccacctactgggggtccctgcctaccgcccagcaaggcttccttcttcaacagctctgaggggggccccttctctgggtcagctcccacacccttgcgctgtgacagtcgagccagtaccgtctcacccggtggctacatggtgcccaagggcaccacggcttctgcggcctctgtggcctcctcctcttcctcttcctttcagccctcacctgagaactgtcggcagtttgtgggggcttctcagtggcctttccggcaggggtatggaggcctggactgggcctcagaggcctttagtcagctctacaatcccaattttgactgccatggcagcgaacccaatgtgatcttggacatctcgaactacacgccgcagaaggtaaagcagcagacagccgtgtccgagaccttctccgagtcatcctctgacagcacccagttcagtcagccagtcggtggtggtggcttcaggcgtgccaacagcgaggcctcaagcagtgagggccagtctagcctgtcgagcctggagaagctcatgatggactggaacgaagcttcgtctgctcccggctacaactggaaccagagtgtcctctttcagagtagctcaaagcccggccgtggacgacggaagaaggtggacctgtttgaggcctcccatctgggcttttcaacatccacctcggc

SEQ ID NO: 29334 - DNA, 2031 bp, Mus musculus
gcaccgcaggcagtgggaactgaggtcaagagcaagctccgtcccagggagagctgggaatgtgtgtcctgcctctgctgagtactgtagctgacaggacagttggaaataggtgaaaaggggtgaaaaggagtggaggggaccttcagctcatacaggcatattcttaggtcccctaaatgaaaagcagacccagacagactagctccatactggggcccttaaaccaaataccaactgcagcagaccccaggagtagagatgagatggtggaaagggaccagatacattcaggaatctctaatccttctctcctccctattagctcttggctgtagaagggaggccaagagaaatgtcacaggtcctcccaggttacaccagctggggctggaccggaacaggaggcagtttccaagaccaccagccagccagggtcagcaggcatgcccaggcctggctgttctgggctttgtctctctgagttttgaatccttaagaggtcacttgatcttgcctctggctctgagcaagaggcctcatgtcaggcctcagccggtcttgccctgcttcctccaggcaccaggttttctcctccttctgaggtcaccctccagttctactgtctgctttccctggagccatatttaggctaggccttcttgtttcaggcccccgcttcttggaaataccatctctctatgaacataccttctgctgctgctcctctctctgcaccccacattcctggtaaaagcagacctctaaaactggcaggcagtggctaggagtacgtgtctgtggctacacacaggccgctctgtgcacttggttccagcccttagcaactaggtgatctggtgactcacataacctggtgattcacagcatctctatctcttgtaagaatgaaggggattgacatgtaaagcccttagccctggcctggcccacaagcaagcacctcggcagtggctggtagatgggtggatgaataccttcccacggtctggattctgggtccctaattcaagcagtgtgagtcacacatctccaacccttgtccctgacctttgcttgaccaaagatagccctcctgcatctgttgcctgctgccctatgacaagagccttgtgttctggtatgggcctcaagcatttggaaaccttgaaattcttcttgggcctggagatataggtgattgttggagtgtttgcctattgtgtacacacaaggccctggattccacccccagacctggggatatggatggtagacagggtaatcgcagtgcttttatgttagccactagatcaagtcctcctgggaagaggtaggggtgtagagagaaggtcggccccactcctaggcaccttcagtagttactgggtcagctagatccccgtctatacagtttgcacagtcttctccccaaaatccaagcctctgagaacgttccttataactttatagtatgttatggttttccctggatagctctgtctggttcgtcactgtctgtccatctttggttccacgatgcctgtgctggagaagtagatgcagtctgtgtccagtccacgtgaactagcagcccactctgcactggccagtaaaccatgcccaagacaccatggaccacgaacctaatgcgcttgtttcaaccctacatgaggaccctgtctaggggaggctgggttctccagcaagaaggcggatcctccacaccagcccttgtgagctacatgaggagggagggtagacagcaggaacttccttgaggctggaaatggagcctaacaaatgagagatttcagcagtgagagccctactcagccacctgggtctctggcccacccccaccccagtccattctgcccgtggtggccgccaaagtgcttgctgttcagcatttttagatgcacagtgtctggagcccctaaaatatttattggatgaattgattaaagcacatctgttcttgcagctccatgcttcacaccttttgattgcatccttcctctccagcct

SEQ ID NO: 29335 - DNA, 1123 bp, Mus musculus
agcctggtcctgcggggctacctgcctgggcgggccggcgcagatgccgagcgggctttgcaacaggaagcacgggtcagccttggaaagaaggcggacacccttaggtgggtctgagcaaaagagagacccaggctctgcaatcttgtctttcaacgcgatctcgtcaaaggtcaacacagtggcaccctacccctgcttccagctcctctccaagcctcgtgtgacattggggttggggtacttcgttaccaccacggctagatagaccttctatctttcaggacctgctcctcggccctccagttcagccctaatagggtgaggtgggaactgaagaacactgagccctgagtagtgagcacactagaaagagtcacacctcctgctggatttcagtcccaaagctgccctgactctctacccaaactatattaactgccttgggggtgagagaaggccccgtagagctggggtgccagcagaggctttgcaggtagaggcagtgagaggggagcctgatgggggggggggcagacggttgcctagcaaccccacagctgtctgttgacctagaagaagctgcgctgtcttgacacagctggtgtttacatgtaaccgaggctctggcttagtgcttgcttggagcaaagctgaggcagggccctcgtggcagcctggtcccaaccctgcctgtcgtggatgccgcgtctgcctgccctgtttacacctctcccatctcaaggccacaggagaaagagaagtagaaagcagacctgaggctttgggaagggcaaaggcacacgctcaaacacaaccctaaggccttcatcacagaatagggagagacttaagaaaagcaaaccgcaggcttgaagcgcggctcagcaatgaagagctcttgatgctcttccagtggacaccagaggtacggttcccagcaccacccgcgtggcagctcacaaatgcctgtaatttcagcaccagatttaatgccctattctggccttgatgggcatgtctacatatgacagagagagaaatgcatgtgtagatgcacgtggtataggtatgcacatggtgcacatacgcacaagcaggcaacacacacaatttcaaaata

SEQ ID NO: 29336 - DNA, 1118 bp, Mus musculus
cagagagactgatatacgtctacttggaagcgacataagcctaggtggtgtaaagaaacctttttccctttaccacacagcacactgccatccccccagtccccttgttctcacgtttcctttccctcagtggtattttgctaccataaaagtacttggaagactcatttcacccatggagaggcctgcaagatctggccacatagtaaacctttgtgttgcttcatctgttcagtcatgaaatggctgggctgctgacagcctcgtggggcttccccagagggggaagggaaaaaaaacctggctgccaagaaaggcagcagctgaggcgtctccgacggtgtgactcagtgtttgctcaaatagcctgccgtccattttctaacgccttccatcttccttctctcagtgtcactacaaggaatcaacactcggaaggccttcagaagttctaccacccaagaccagaagctctttgacaggaactctctcccggtgcccgtcttagagacctataacagctgtgacgctcctccccctcttaacaatctcagtccttacaggtaaccgtgcgctcgctctctctctctctctctctctctctctctctctctctctctctgtgtgtgtgattaaaaactgcattgtctaaaatctctaaagataatatctgtatcagagagagaatactgttgaactccctgcccaccccagcagagaccgttagctcattcttgtctggtctctgacggacatgccgcgtctcctatgtactgaaagtttgctgtaccattgatgctgcaaagtttaacttgggaaaagtaagtccatctggattccatccaaggaatttagttattacagaagcaagaggacttgttagcaggcagtcctgcacacggattcccaggggccacattctaaccggctttccactttctcagaaaactctaaattaccagatgtttgggcaagttaatgggaccagcctcatactggctgctggggagggggggatcacagtgtggggagtattggtgtccttccacgtgagtgccggtcccttcattttgaacaccctttggatggtttcttctgtaaggaccagccctggtgta

SEQ ID NO: 29337 - DNA, 2551 bp, Mus musculus
aactgatacacgggtgttattattcaggaaaaaaactgagcagctctggccagcagcaaggtttcttctctactgccccaactattgtgtggcctcttgtgctgaaatctctggcttcagagcctgaaacaaagagaaacaggatctgtctctacccagcacagcaaatggttgtagtaattgccaaagccctcataaacccctccggcttgaggagagtgcaatcatggctctgctgcctgcacttgctgggttcctcccctctgcctcctttcttgaactcagaggtagggactaagcaccaggtgccagcaggccctcctgctgtggccactccagagtgctccgtgtctccatgtgtccgtggcctgccccccccccaaccccccaaatccagtgtctggcaccgggtttggcagtcaactccatgctgtgcatgtttcccaccccgtgccttagaagctgaaggtgctttttcatcagaaccttaacatggctgttgatggtaccctggctgcagcccagcgggggctggagaggcaggggagggcagtggtccttccaaatagaagtcctggggcctggccaggccagggtttgggcctaatggtttttactaaattactcccctcctgctctccgagaaaggggagccagagccgctcactgtggttctgttccgaccttgaaggggcggtattggcctggcttctggaatggacagagtccaccaggaaagactgggggcgggaggagctggggaggggccctgtctgcggaaggtaggattagatcattagctcagtgacctcctagggtttcgatgtgctgtgttctcatcctacagctggtttggtaatgatctgcaagtcccggagagcaacagcacagctccgcctgacgctctcattaaaatccatgcagccaagctctgcgctttgtagcagccggccttgcagagcctcctcagcttggggggctggggacccagtcagctgagaggtcctctaggctctacttaggcatatgtgtacccaaaaaaaaaatttttttttaagcatgcttcttttaaacccagagccctttaaaataataaagaacccagtgcaggtgggtgtgtttgtggaatcccgtaagcgtagaataccaagtttagtgactatttaaactgggctgaggctggtaagactataaagcagtggcccataaggactcttaagcgtgaggccaaggagccacgtcccttcccagtctgcctggcccaggggggctgcccccattcctggagcccaggggcccagcttgcaattgctagtgtcaggagtgacttgtagctttgccttggttgtgaaatgatttcattccaggggagggggcgggggatcccttggaggctcagagcagctggcccaagctgcagctcgtctccagtggaggcttgaatgccctcagaaacgaccctggccaatgtcaccgcagagccgaggcggtgttgtcagggctaatgtgaaatctcttcccgtggcgccgatcctctgactctatagcgccagcttggacagattgaggtctctgtggctttggtgaccctgcttaagcattcccaccgtgtccctgttctgcgctagcactgcctcctgctgcagcccctgacttgacctcagggcctggggagggaagcaccataccagggccaggagctccaactccgacgtgtcagcctctgggggaggggggattaagccttgagcttggctggtgcccattggacctgggaccaggtgttacccagagaggtgcctctgctgtgcttcctgcctccatcactttcctagggcctccgtgagggctgagaacagctctgctctgctcctgtattattaacttgcttcagttaactgacttgagaaactaaccaatttttaccttctgcctagaatgatgtacacataggagagaaagctatcatgttcccgaagtgccttgttttctctgatagaaatatatttataaggacctattccaataggctcttggtgtttcccatatcaagatttctgctagctaatgcatagagggaatactgtctaaaaatagaccctttcttcccaaaggttgggaggtgggacctgagcagtggagtgaagccacaccccacaattttttatttatttttttatttttagatagggtttcaggtagatctgcaggccttgaccttactatatagttgaagatggccttgacctcctgacccctgcctcagccatgcctggctaggacagccaaattgttgttgtttcaagtctggtttcatttgcttccctgccgggtttattgtgtgtaccccatttgtactcccaataacctgaagattccatgtaactcttatgtacgcgcatgaatactttaaatgccaaccttttcaatcatttgataaagtctttgtagtcactcagtcacctttggtgtctgtgtgtgtgtgtgtgtgtgtgtgtgtgtgtgtgtgtttcgtgggagaaggtaagcaactctgcaggccacaggtggg

SEQ ID NO: 29338 - DNA, 1208 bp, Mus musculus
caggaggccctaggaacctaaattctgtcagcgttggggaaggaggagttctgggccataaccctgctcacttgaccctgtgttcttctcccctgtcagtgttggagcctttgtgaagacctggctgccctttgtccttctcctcggcattatcctgaccgtcagtctcgtcttcaatctgcggtgatagctttcagatggtctaagcctcaaggaggctcctgacactcaccccttttggtcccaattcttttattccccacccctcaggcagtgttgcctcctgggttgaagtagggtcaggacttgggacagaagtgccgatactgagcacctgatgaggtcacttagagcctccttgtcctttctccctgggcctgagacctcacccttgtggcattcccagtgccatcctgggaaggccttccttcccttagagcatttcctgccaccatcactgggctactcttcccatgcccagggcacagtgaggacaagaacccacgggcaaagcagtgttcagagctggatttgaagctgtttgctggctggtggttgtgtcccaaagtagggcatgtgttatgagaagtgctgcacgccaagagacttggaaccttctctgctggcctcgaatggaccgggagggctggctatgttctttctgccacaccagcacagtgtgtgcctcatcaccgctaatgtgggccctggctagcaagggctgagggcacttacgtgcagagtgggtcctctgtaaattaggtaacgtgaatcccacttgtttccagcccaggaggcctcgtgctggggatagaaccctttaggtccaaaatgtgaataacttgtcagagcagctggtacccctgatcggctgggtctgcttccggttgctacaatgggccctatgcagcctccccctggtctgcaggctcctttataaggggctccctggcaggaaataaagttttaagtctaagtggtgtctgtcattttcttctgtgtgccctgattccttaagctcatatatccctggggactcggagcaaagagatctggctgctgacaccatgcctgagtctttccagctggagcttatgggtacatcaacagtacttgtaaattctgccactgcacgggctgtgggaagtccctgccactcctggtctatgttccaaactcccttccagaaggactctcatcttccctac

SEQ ID NO: 29339 - DNA, 2831 bp, Mus musculus
ggggtgcgtagactttggagttgattgctttgcaatcttgggcacagagcacttaggccagtgtggcctcctctgctctcaatgccaatgggcaggtaagccttccagagacagctagcagactgaagtccacatggtgggtctcaataaatccaggaccggtttgctgtaacttttataaagaggacccctttccctgggggagaaagtgtaaagggatgttagaggtgggggacagcccagcccaggtgaggcaccccctggcttgtattcctgcagccacgcttctccccatgtgcctaaccttagataccccagtgtgctcttcttacatggcctcatatattatatcccagtgtgtgcctccctccttagcccctatgcatatgccacagcacttgtgcctccctcatgcctgtccctccaccctggtccctccaccctgagctcactagacctgccttttcttgacagagtgaagacctcacaggccgagttgtggaagatatggagggtgcatctcaggccaaccagcggcgcatgaatgccaaccccctggaggcgatgctgctggacatgggctatcggatcacaggcctgagcagcgggggcgccggggcctctgatgacgaggacagcgcagagggccaggtgcagtgccggcccagctagaccctcctggccccagtacccagccctgtgcaggagatcagagggctgggctctgttttggtttgtctttcccacccccatttttcattctccccccccccctgttttgtttgttagtttgactttgtgggtggggattgctgcaacttgctggctttctgactctcgggctgattgtcccttgactgtccccagccccagcagaaaagtaggaggggaagcccctccgtatgcccttacctcctgcttcggtgtctctggaaggctctggcccttctcaaaatccttcagcctccagtggagaggcaagagctgaagctgtctttacggactgcccagcccctccgcgggcaacagaaagggagtggaactccctgctggccgaggcttgcctggcctgttgttgccactctcctgactcccgggctagctcccctgtggtctttccggaaggtccctccacagccaccagtgttcgggtggaagcataggaaacaggatcccgcagtggcaaggtcaggccacctgcctgggggcagtggagcttcctcccccgctcctggcctgtcctaggctgtctcgctgtctctgagggccttgcctttcctacagtgtgacggggtggggtccctccctccccacccacctgcccattcgagtccttacgcgccatggccgctctcctggggcgcttctcggcctcactgtgacctttctgccagagctccccgccaggcctaccctgctgaggtggctcttcctaaggaccctttgcaccctctccgccctccttcccacccacatgctgagccgccacaaagaccaaagaagtgatggcttttctctgtcccctgctgctctggggggaggggttgggaaagtccttagctcagccatcccccctcagcagccccgagctttacactggacacagcggccactccaccaccaagcctccctctccctctggccccttggttcctgctctggagccgggagttggttcatgccagcctcccccagccctgtgtgcttcctctgggcggcagccctccagctgcagcctctggggagaagcagcctcccttccctccctccctccatccctccctctctctcctgtcctctctccctccctcacccctgtctctgccaggtgcctcctctcagtctagcttctgagcagccctggagactggagggccatgttaaaagctttttcacagttttaaggagacgaggggggtgaggctagtggtggggggtctggcaccatctcattgctttaatctcagcgacacaggtggcagcttctcccccttcctgcccaccccaggtcctcttcccaccctctctcctagcttggtaatgaagtgtatttattggtgaaggaaacagctgctctgctgcttctcctgctgctgggacttgctcccctgtctcttcctcatgacctttctcaagccagggaggggtagcgagagtgttgagctgggccctggggcacaagaactagccagggtccctttgctttcctgtgttcaagccacctgccatcccccctgtccatcctcctgtctcccgcccgcctgcctagcctggaccctgcagtgtggagagacacataagccttactgtcctctggggcaggagccgagccttttgttgctctgctcccaggagagtgagggtgacacaattgattaaaaccattttgttctagctgtgactggtggcatttgttggggccctccccaccatggctctgtgacatggagcaaccacacctctgctgagcagagtgagacctgccttgcatgggtcgttcaacccagcaggcctggtacaaagcccacggccggccgatagctgtgattggacatcatcagcttttactctcgggctttctccccttggaaatgaaggatttcaaatcttggtagttttcagattctttaaactggaacccaaggcaggtgcacatcccgtcctatgatccacggtgtgcacggttcttatgtattacaagaagcgaatgttttgcacagtcgtgttcacccttccctgcaggtacctttctactgtactacagacaaaagtatgtctgtagcctactacctgggggttagttttagttttagttttgctttgggctttgt

SEQ ID NO: 29340 - DNA, 1192 bp, Mus musculus
agccctccgctgggcctcctctgagtgctttaccataagcttatatggtgctgagggcagaacctagggcttcatggatgccagcactttactgcctacagttgacagtcttttcatccctgtgcacagaggttaggtcttgatcccagagagcaaacccagccgtggctgttaggccttagaattacatgtgggtctggagaggaaagagcccctaatgcgtggggtcattgaagaaagttgtttttatttgcttttttaaggcagggtttcactctgtagaccaggctgctctcaaactcatagacatccacctgcctctgcctcctgaatgctaggattaaaggcatgtgccaccatgtctggcctgaacagcctctggagaagtgtcagagggagggggtctctggggggtgtcaggcagggagtttgaaccacgaagaggtgagaacctggttcccattgaccatcaacctggatggagatttgggaagtctgatgccaggggctttagccctcagatttaaccatagtttaatctggaaaaaaagtttcctggtataatacaatccctggtgtacatggacattgtaattacattgaaactcgacttggggtacatgccatttcttccaagaggatgggttggttctcggctacctacactagcttaagggcctaagcagtgctctgacctggtcttagtcatacaaatagcatagggcttttttaggctattagccacctctggtcctggttgcggggccttggggaggccctggctgtgagggtcatttagactactagccacctcttgtcctgattgtagtagcttaacatgacctggcccaacagataacacaagatgaaagaacaggttttacatctttgcttggaaggacaatcctgcatgcttatcattcgttgtttctttggagatctgtgggtgcagagccttggtgccccactcccagaagcagggtttttgcactgaggtgacctgtcgctgggcacattggatctgaagtgacctgtgaggaaagggcttgtcagccctgccgttgtatatttatttatatctgtgggcccacgagtgtgcggctgtctccttaagagcagtgactctacctgaaaccagagccacctcagggagctctgagcctcatcaccctgagttctgcctcactccctc

SEQ ID NO: 29341 - DNA, 1211 bp, Mus musculus
atatttttaaattaaaaaaatttattaaggctggtgagatggctcagtaggtagagcaagcctagtcacctgggttggagtcctgagacccgaataaaggcaggaggagaaaagggacgaccaatcccacagagaagtctctgtctccatagagacaataggagtagtaataatacttcaaaactctttgctggtttattatgaaggatttttcaaaggacacaatatgaatactcccttgttgagtctttgtctgtagtgctgatgtggctgtggcagagtctagctgaggcctcagtgctaaaatgacttgacggttcagatggtttgccacaggtctgtggaggaatcgtgactccttcaagtgcttgctcggtgctccccatagttgtatgtcacagtgttccccatctttccccattcaggggttcttcagtgcagcggagcagggccaaccccccatgctagaagtcgccgagtgggctggtgggctgccttttgaaggcacctggtccatttctcgaggcttgatggatgttttgtttccctcctaggtaattaaatgcttgtcttgtggacctgggcttggctggaatgtgcaagggtcttgaggatccttgcgtagcttccctgtgttgaactattaagagaagatggcaaaagtcaacataactagagacctcattcgtaggcaagtcaaggtaaggggccttccttcctcccgccactccattgcttttctcctgttaggaatcatcatggaagtgtccctgttttcctatggtcttgggtgacccctgcggaagggttgttccccccacagagggatcatgaccacagagtgagaacagcagccctacaagattcacttaaagatgaaaaaaggccaaaaacttgtaacagcctgccagctgtagagttggtgacttacctcgtcttagagcttgctggtagcatactgggaatgagttcaaggtcatctgcccctccgacttcatggaggctcccgtctctactagtgcctccatcgctaagattactgtaggctggtgagccatcggtgtagagaaggagtcaatgcgaggggagcacacaggagcataggtgatagcctcttcacggcctcagctggagagtccagcatgggagccgcagaggctgagagtttaaagcaaggcatgtgtgcctccggtaagaacctcacgctagac

SEQ ID NO: 29342 - DNA, 1186 bp, Mus musculus
tagactagaaaccaggttgcccagagaggaggggaagggaagttcccagctcctaggtggcaggctagctgttaatggaaagtgacactcatgcatggtgtcggcatctgagtgccactgtgggcacagccttctttgctctgcaagggcatctgcgctgggctgggtggggtgtatctgggaggatctgcgtctgtctggtctgccctctgtgtgtgagtaaaagtgagataccataacttccacagggagctgctgagagctcttaattgaattaggctttttctgagaagattcctcaagccataaactgcactgtgactgaattaatgagaccagtggccataaccacataaaacagcatcttgttagtttatagtcatacctgaacaggcttagttatggcttctctttgtgcatgtggactgggtgtggactgggacccgactcttccttctgtgccagatttatttttacataaataaataaaataagaccagcatagtaaaattcagcaacagtctaggagggagttaaagtaaacaatgaaagtctcctagctctctggccactggcattcagttccccagatgttcctgatgtcggctgtactatgcatcttttctggaaactctccatgctgtgtggacttacgtgcgatggagggcagatttagttttcatgaagtcattttgtggctctaggctgtgaactgggacttgagccctagaaccagctttgtctctttcctacctaagtcatttgctctcttgggcctttagttctctttcattttaatgtgaaaagctctgttgggcccctgctccgctgaggccttgggggactcaaacacttggagggtaaagtctacaaggtccatcctctgggggtgggtcagggctcccgtagttctcaggctgaagagcacagagttctcatgtatgggctctgcgattaaaccatcggttcctagaactaagacagtgtataagggaggaggcacagcagggcactgtgtggtgttggttgatgctcgaacctaaggggagatgaaaaaaagtggtctggagaggtggtgcaggtctgagaggagatggtctggagaagtggtgcagggcacacactctcaaactatgggttgagcaactggatatggtcatgaaacttgatacatttggtaacagta

SEQ ID NO: 29343 - DNA, 1146 bp, Mus musculus
ttaagtccacacccacagtgacacacctactccaaccaggtcacacctactccaacaaggccacatctccaaatggtgccactccctggcccaagaatctacaacccagcacactagggggctctctgacccaggcagcttttcagcacaagaagtgacttttgtagtaggaacacgtacaaggttgctttgagatttcttcctaccctaagacccatgtttttccctaatatgtttttagtgtctctgggagcttggcgtcatgggcacgtagtgctatcctagcgttgcctaggtcagtacctgaacagaggaggggctttgccataggaagaaatgtccttccttccacaggtctaggggtaatgatggcaaagatctggccaggcaggtcctgaagctcacgagatgtgtcccttccctttgtgtccagccagcaggcgtgtgctaagctcctcaggtagcctcagccctgggcatatactatagggttcgccagctcagaacttgcttggcagggagaggagagagcatcggtcttgagcaaaggcctcgctaccttttgaccaagttggctttggggactgagtacccagcatgcatttgggtgctcaggtcttcacccaccttcctactccaaaagcaaaccaaagagctcatagggaatgtggggttctgaccaaaggctaggtatcctcagaagcctgggtctggagccttagcatgggccacaacagaggatggccaacactacgtggggttgacagatgtcacagtggatgtggagggaggcaaggagaactaaactttcagaactatggagtttgctgggagctgggcttcagacctaggctccctcctggtcctgctgttgatttgctctgactttgggcaaatcccttcacctttcacttgcccaaagtgactgatggcctttgacttcttgggatcttctggagcagccgcctggtgtgcctcagttgcgtacagctgcctgctgcttgcgtgtctagggctggaggtcgctgaatgtgctctgcaggtgtgcaggcccgggcctgttgtccccaaattctcctggcactgacgctccttgattctcctgtctctctcacatccccgctttaacaccacccagtgtcagcc

SEQ ID NO: 29344 - DNA, 1635 bp, Mus musculus
tcccagagaatacaacgctgcctcagtgacccaggcccccaccctgagcctggggagggagagcctttcatccccaaaggacagtagagccaggctagtgggtgtcccacagactctcccacgagagtgggggctgggcgctcctcttgtctcctgacctggattggctctgcccccttcctccgcatggcagctgggcccacagcccccactgcagcacggcttgcccctgcctcctgggaagggtcctctcctacagaactgccttcccaatccatccatttggcggacggctgggctgctgaggcaggccccgccccatctctagatccaggctctcccatagtggaaccagggctcctcaaggccctccttccctccagcccctcctcatccagaccaactctccatccttgatcatcatttctaaccaaagagccactggctccactgtggtcccagcaggaaaggagggagctgagccttccgtggccgtgactgggcccctgtatcagaggacagcaggcctgtggctgggaaacagacccgtgacccatagcagagctgcccacggcagcgccacggttctcccgctagcctcggtgctctggccaccacccgagctgtccttactcagagctgcgggctgagggcgtctctgagcttctctgctgggcgctggggcacattcgacagtgacatgattggggtgatgaggaccactgggccttagtggggcttacacgggagggactgtccgaggcgctggaaagtgtcctctacttacacttggcttatttgcacctcactgtaagtatgattctgtttgcacagaggcactcttgttttcagaccctttgagtcccccatgccagtcagagctctgccctttccccctcgtccttcctcgtgtctaacaccgtcccttaaatggaacctctgctgctgggggcccttgcccacagcaccgattctgatgtggcccaacctgtcatgactcaagctcaccagcagggggcctcctggtacctcctttgctcttgggcctgcttttacttctgttggccagttctaccaccaccccttatctggaccactctctttcctgcattctgtagagtagaaagtactggaccccctagaggcctttgctcacaggcacacactccctaccgccaccatggctggggccaagcccatgggtatctgcccaacccctgggcactccctccccaggatcgtgcaataatagtcagagggtccctcccaggggatggggccatgggtgcatggcccagctgtctcctctccatgcaagtgctgttttgggcaggagttgccaggcagggtgacatcgacaaccatgtacaaagccaccgcagctgctgccgctctgccgcctgtacaaaggaaactgaacctttttcatattctaataaatcaatgtgagtttttgataagagtccagggctgcttcctgggcctgggggacttcaggaaggagggcgtcagaggaactcaactcaaagactgaaacagaaacattgttaccaccagctgctgtgtggtccagtgtgcagatgctggagttacactgtgatatgtctctccatgtgctggggccgcagcttggtg

SEQ ID NO: 29345 - DNA, 2319 bp, Mus musculus
tgagccatctcaccagcccctgggaaggtcttaacctcctgaatggagagcagctttcctttgcccagtttttctagggctgcatctttcctgggaggacacacagacaacactacctggcccttagcctggagctttgataggttttaatatgctatccttatgttttggaagcctgattgaccggcgaggattcgtgcagtctgataccgcgttgccctcgcccatcagaagtgatgacccggcctgtggagccaagccagacgccagcatggtaggaggccacccctgaatgtgcttgccacctgccgtcctccacacctgcggggaccctccccatgccatctgagggaagcagagccgccagagctgccagtcttttcctatttatttcccaccctgcgtggttttctttgaactgtcccatagctgtgccctctgctccccaaacctaggttcccacagtttaggccttaggccccctagctggtcagtggcaggagaggagagtcacagcctctggaggccactaaggagaccatgccaagtcactgcctgtgggagggagacccagcctgagtgagggcatgaactgaatggtggcctcctagctggaggcgtgcttggaccttggtgagccagggcctgctgagtagctggctctgaaccacaggcgacaagtggggaccctctctgggactgctgtggtttggggctcctacattccatctgtgataaccactgggatggttttttgggaggggttatatggagctagccagtagagctggggtccagtagagagagcaagcaggggtgggaagcagcctgtgtcaggggaagccaaacaagccatccaggcccgcagaacctcagctcctgtagagtcctgggcagcacagtagggatggggacgtggctttccccctgcccacagagactctctaaaggatcctttcctgtgccccccagcccctcttccaggtcagggctagaggtgggtgggttagctcatgctggtaatacttgaaacgggtttattaatgctgggtattttgcacaattttatagtcttcttttttacatagccttttaaaaataggagttaatgtgttactatccgtgtagtgccaagtcaagggttttcagaaggttaggtagtttaatacatttattacagcagatgtagccgtgaggggttgtgtgtatgcgcacatgtgtgtccatgcatgcggtgtacagatacagctgactcccatgtcctcccctggactgttccctttccccattgccctgggttcagaagcagcctgaggtatgggggactgggtgggaggctgtgttagtcacaggagagagaccacccgctccggccctttagacgccaccacccagcccccaggttaggctcccagctgtgacctgccccgacaggctgaggttaggtgtggtgggtggggtggtggctcagggagcggctgccagtctgcaagccacaccccctcccaggtgttctgctttgagtgtaggcctcagtgctagggacgaggacaccgagtttctgctaatcaggaccggaggcaggggcagagtggacccggaggcccgtgtgggttgtccagaaccttatagtgcagcctcctgctgctgggagctgtagtttctaatcaaaatagtctcgttctcctcggcccttcaggtgggctgaagtccttggatcataacatagaaagtcactactgagtcctctccttgttccagagcccagtgggtcccagacaaagctgggaagtggtgggtgccaggggccactgggagatggcttcagagccccaggccaccccgagtggccctgggaggtagataggaaggggctggagggctccctgacccgcctttcgttcgagccagtatctttgttcccgtttgtaataaagcttctgttttaagagctgatttgctttgctttagtttttgtttgcttttattttgccgaaaccctggcttgcagcttagccttcttcggttctttcagacagtctcgggtcttttcctgggagttagagagcaggcaggcaggcgggcagcccagtgattggtgggaactctgaggagtcgagggggctgtggctacaccacctgtctgccttcatcttgtctcccttttgtgcctccaggacttggtgcctcctgagttctttcctgctaactttccaccctgatccccagtggttgattgctcagcatgtttgagacagtaggtcccagtgggagctccttgttcctagtcccccactcaacctcctaggcagccaggac

SEQ ID NO: 29346 - DNA, 1136 bp, Mus musculus
gggtggaggaaggctaaccagtgagctcggccctagcgtagggccgtgctcacccccacccccaccccctgagctgtgtccctttcttcttcctagtttctcaaggaagcaacttcctctccgctctgaaaaagacaccagcaagatatcctttgcgggctggtcaccctgggtggggaattgaggcctcttcatgggacaggtctccagagtgggtagggctctatctattctctagaatgcactctacccgctagtttgtcaagacccaggctggagctgaccctaaagggatcgtcacggagaggggcagagcaagcaggctcaggaaaatgcctgtctacagaggcttggcagagagtggattttgtaattaaatttttgtttaccctgcagcggggaacatgcatgtgccatgtcacacgaatagggatggggacaacttgaagttcaaactcagcttgtcaggcttggtgacaggctcctttatccattgagtcacgtcaccagctgcgagttccttaggatgccaggcttcctgctccatgccaggatcctgtggttggaattccctctgccatccctagcccagagcccgccttgttccccaggcgctccctcccccttctgctgagaaatgactggatcacagaaaggtccccaaacctgtcactttccagggacatagctccagggaagggtgagctcaggggtcaggggttccaccctctcttgcacgcgtccttgacagggcccactgtgctggagttggtcatctgcttcttctcaatctggtccatcctgggcctctcagggttccacacgtacctcgtggcctccaacctgacaactaacgaagatgtgagtaaagttggacaggcccggggagcctggggtggccaagtgctgcccgctgggggggtccaaggtggaagcctaatgtcagacccaatgtcacacagacctgggggtcctgctgtgacagaattaggatgcatattgcccatggcatgaccaagagatgtggcctagggtcataatgctggaggggtccaatccaagattaatggcagaaatcacgaccaagccttcacatccaccactccactccgcaccctcatgatggcttataacgc

SEQ ID NO: 29347 - DNA, 1101 bp, Mus musculus
ttttcctgcttggattaaaggcatgcttcaccacagcccagctgtttctttcctcctcctcctcctcctcctcctctccctcctcctcctcctcctctctctctctgtctctctctctgtctctctctctgtctctctctctctctcttgtttgtttgtttttccataccagacctcacctgacagtggttcacatttttaaaaattaattaattaactaatttttttttgagacagggtttctgtatagctctggctggcctcgaactcagaaatctgcctgcctctgcctcccaagtgattaaaggcatgcgtcaccactgcccagctaaagatttatttattattatatgtaagtacactgtagctgtcttcagacacaccagaagagggcgacagatctcattaaggatggttgtgagtagcgcacgcctttgatcccagcactcaggaggcagaggcaggtggatttctgagtttgaggctacagagtgagttccaggacagccagggctacacagagaaaccctgtctcaaaaaaccaaaaaaaaaaaaaaaaaaaggatggctgtgagccactgtgtggttgctgggatttgaactcaggacctctggaagagcagccatgctcttaaccactgagccatctctccagcccggttcacacttttaatcccagcaaaggcaagcagatctctgtgagttcaaggccctgtctcaaaacaataatgaaaaaaaaaatgccttctagttatgtgtaaaagacctgtatgaaacagaaaaagatttcatgtgtgcctcggacaccactgtctagacatggcattatgtatatgcagatattccaaaatctgaaaaatgcccaaatttaaaacatttctaggccatagtatttcaggtaagggataccagcctcccctgagctcttgcaaaataaacgctagacattgtgttaaacccacttggtaacttcttagctaatcctcccaaccacactattttattttattttattttattttattttattttattttattttattttattttattgttttttcatgacagctgtcttggaactcactctgtagatgaggct

SEQ ID NO: 29348 - DNA, 1181 bp, Mus musculus
tgtatttgggaagtagaggcagaaaaatcaagagttcaaggccagcctgagctacttagagggtttcaggtcagtttgggctctctggtaaattctggaggcaggaagggatgaaggaagaggggcctgcctgccagggtagagtgacggagaatatctgtagatctcaactgccattggaaaaagtccgggattgactagtaatgtctgccctgggcacttattgggagcggctgcactcacctccagcgggcactttagggagaggctcttttcttttcttttttttttttttaaatgtttatttatttattatatgtaagtaagtacactgtagctgtcttcagacactccagaagagggcgtcagatctcgttacggatggttgtgagccaccatgtggttgctgggatttgaactcaggaccttcggaagagcagtcggcgctcttaaccgctgagccatctcatcagcccccgagaggctcttttctagaaggtactctgtggggcagtagcggggagcctggagtaacctgaactctcttctttcctagctgtccctacctggcccgcacactgaccctggccattcctatcatcgctgccatcctcttcttcttcgtcatgagctgtctcctgcagaccagtttcacggaccctggcatcctgccccgggccaccatctgtgaggccgctgccctggagaagcagatcggtgaggctcttactcctagtcctgcccgcagcgtcccgcagcctggctttctcctgtgccgctctgctaggaattacggatgtagcagtgagcgaagcaggctgtgactgacactgtgacagggggagacagacagtgagcaagcaggcaaatatgtaagcaagaaatactggcagccagcactgagctgagtgcttctggggtgcctagcatgctttaagccgcctgtatgcctgactacttaatctccataagccagcgaggtcaatactggtactctcttcctattcattcatgaaatgagacacagagaggttaagtacatggttcaagatcacacagctgaggccgggcagtggtggtacacgacttttatcccagctccgagggggcaggaggcaagtggatctctgtgagttggaggccagcctagtctacagagcaggttgcaggacagtcagcgc

SEQ ID NO: 29349 - DNA, 1141 bp, Mus musculus
atctgcctctgcctcttgagtactaggcccaccactgagtgtgagccacccctgcctggcctggtggataaatttaaatgtttgatcaaagcacaggccaacagcctgccccactcaggatggtggagtcagtgcagtgtagtgacagaaggaagaggggacagacagcctgctctaagtgagaggtttctgaaggtggttgttttctttttttttttttttaaagatgtattatattatatatgagtacactagctgtcttcagacacaccagaagagggcatcagatcccattgcagatggttgtgagccaccatgtggctgctgggaattgaactcaggacctctggaagagcagccagtgctcttaaccactgagccatctctccagctccctgaagttttctttatgatactggtgtgtgtgtgtctgtgtctatcctacagactgtgaaaatctaaatactccttttgcaatgaattacctttttctggaggaggggtagtcaggggagctaagacaaggtccctctgtgtaactctgactgtcctagaacttgcttgctatgtagatctggctggttttgaactcagagatcctcctacctctgccgaactagtttctataaattatagagggttgaggctagaactccgtagtaaagcacacgaggccctaatttcagtaataaacaccacttggatcagagcacagggtctgaatcttggctcccattcctcactttccagctgtatgatctaaagccaccttcagagcttttgccttctctgaaattaaggaggagacttcttccctggggtgtgatttaggccttaaatcttgaggctaccttaaacaaaagataaatggaggctcacaagtggtctaatgggaaagtcctcctttgatcaattggaaacagcctcccccccacctctgggaacaactcggaatagaagctgtcgtggagagtaatgacacctggtggaaaagggtaacccagggtgactggttttccattctcaaagatcacacttgcatgagtcagaggcacctaccccacagccttgatgggggaaccttgtagctaagtcagtccaaggttgtctactgtagcatctgccctgcttcctggctccc

SEQ ID NO: 29350 - DNA, 1154 bp, Mus musculus
ttagtcaacagctgttagagcagacagatgtgatcaggtacaactgtaatcccatgctgggcacacagtggtggtgcacatagtgaaaccatctcaccgcctggcttaaaatgggttttagagagtgaaaaacaaaccaacttcccatataggacgcttgcaggagtggagggatggctaaattaatgaagtgcttatagcacaaacagactttgcattctcaacttaacacccacatacaaagccaggtatggtagaagaccactgatgtgctgggcagccaatttagcaatatgtccaggttcagtgaaaaacttgcctcaaaagatgggttcagccgggcgtggtgtcgcacgcctttaatcccagcacttgggaggcagaggcaggtggatttctgagttccaggacagcctggtctacaaagtgagttccaggacagccagggctgcacagagaaaccctgtctcgaaaaaccaaaaaaaaaaaaaaaaagatgggttcaataccatcctcgtacacatagtttgaggtcactacactacataaaattctgtctccacaacaaaaactggggaaggagtgggcatgacaaaggcaaaggtctgaaggctaccagaaagaggccttagtcaggggaaatggagggatgaaagcggctcttgtttgcttttcaccagggacaagggactgagatgcaaagttacaagccaaagcagaccaggcgtcctggttctcccagcatccctcagtccttacctggcataccttgccttccccagaggctcctccctatatacaaatccagaccttatggtgtgtctgtctgtctgtctgtcctctcttcctccacatttctctgcacacaccctttctctcttcctcactccctccccagcccctcttttcccatggcagctttcctggccttggtccttggggccagtggactcacctgagtgcagctgcccaataaacctgcctttagtataatctgatctggcttaaattggctcatttcaccttgggtggagaaataagctctcagttctcttggggagctctccctggtacactgactgcccatattggccttttatggtgtcttgagcacaggcagtagatatcttgtccagggtttgggggtggtggtg

SEQ ID NO: 29351 - DNA, 1468 bp, Mus musculus
tcactctgtatgagtcacggctgttggacatctccgtgtcaccactgatgaactcattggtttcacaagtcatttgtgatgtactgtttttgattggccagtcatgacagccgtgggacacctcccctccccgtgtgtgtgtgagtgtgtggagaacttagaaactgactgttgccctttatttatgcaaaaccacctcagaatccagtttaccctgtgctgtccagcttctcccttgggaaagcctctcctgttctctctcctccccaccctcactccctcacacctttctgttccccatcctcacctgcttccctcaggaccccaccctatttgaaaagacaaagctctgcctacatagaagacttttttattttaaccaaagttactgttgtttacagtgagtttggggaaaaaaatggctttcccagtccttgcatcaacgggatgccacatttcataactgtttttaatggttaaaaaaaaaaaaaaaaaaaggaaaaaaaatacaaaaaaaccctgaaggacaaaggtgactgctgagctgtgtggtttgtcgctgtccattcacaatctcgcaggagccgagaagttcgcagttgtgagcagaccctgttcactggagaggcctgtgcagtagagtgtagatcctttcatgtactgtactgtacacctgatactgtaaacatactgtaataataatgtctcacatggaaacgagagaagacgctgggtcagcagcaagctgtagtttttaaaaatgtttttagttaaatgttgaggagaaaaaaaatggctttccccccaaagtatcctgtgtgaacctacaacgccctgacctctttctctcctccttgattgtatgaatagccctgagatcacctcttagacctggttttaacctttagctgcagcggctgcgctgccacgtgtgtatatatatgatgttgtacattgcacatacccttgaatctccacagtttggtccccttcccagctacccctttatagtatggcgagttaacaagttggtgacctgcacaaagcgagacacagctatttaatctcttgccagacattgcccctcttggtgcagtgctctacaggtctctgtaaaaagcccttgctgtctcagcagccaatcaacttacagtttatttttttctgggtttttgttttgttttgtttcatttctaatcgaggtgtgaaaaagttctaggttcagttgaagttcctgatgaagaaacacaattgagattttttcagtgataaaatctgcatatttgtatttcaacaatgtagctaaaaacttgatgtaaattcctccttttttttccttttttggcttaatgaatatcatttattcagtatgaaatctttatactatatgttccacgtgttaagaataaatgtacattaaatcttggtaagactttgtgaagctttttttattttcaaattatttaaa

SEQ ID NO: 29352 - DNA, 1623 bp, Mus musculus
tgggtcaaagaaaaattcttgcccttctttacgaaggaaatggttagagaactgtaaagagcggtgtggtggggaagcctttagcatgggacagctctgcctgggagagaaaggagggggaggagaggggggaggggagagagagaataaatatgaattggataagatcttgggaactcctgtcaagaattcttcccttcctttttttctctctttcagctcccaggcttgctagagctccttgtggaatatttccgtagatgcctaattgaaatctttggcattttaaaggagtatgaggtaggggacccaggacagagaacattactagaccctgggagattcaccaaggtgtatagtccagcccatacagaggaagaagaggaagaacaccttgatcctaaactggaggaggaagaggaagaaggggttggaaatgatgaggagatggcctttttgggcaaggacaagccatcttcagagaataatgaggagaagctagtcagtaagtttgacaagcttccggtaaagatcgtgcagaggaatgacccatttgtggtggactgctcagataagcttgggcgcgtgcaggagtttgacagtggcctgctacactggcggattggtggtggggataccactgagcatatccagacccactttgagagcaagatagagctgctgccttcccggccttatgtgccctgcccaacgccccctcggaaacacctcacaacagtagagggcacaccagggacaacggagcaggagggccccccgcccgatggccttccagagaaaaggatcacagccaccatggatgacatgttgtctacccggtctagcacattgactgatgagggggcaaagagtgcagaggccaccaaggaaagcagcaagtttccatttggcattagcccagcacagagccaccggaacatcaaaattttagaggatgaaccccatagtaaggatgagaccccactgtgtacccttctggactggcaggattcccttgctaagcgctgtgtctgtgtctccaataccatccggagcctgtcgtttgtgccaggcaacgactttgagatgtccaaacacccagggctgctgcttatcctgggcaagctgatcctgctgcaccacaagcacccagagcggaagcaggcaccactaacttatgagaaggaggaggaacaggaccaaggggtgagctgtgacaaagtggagtggtggtgggactgcttggagatgctccgagaaaacacgctggtcaccctcgccaacatctcggggcaattggacctatccccatatcctgagagcatctgcctgcctgtcctggacggactcctacactgggcagtttgcccttcagctgaagcccaggaccccttctcaaccctaggccccaatgccgtcctctccccccagagattggtcttggaaaccctcagcaaactcagcatccaggacaacaatgtggacctgatcctggccactcccccttttagccgcctggagaagttgtatagtaccatggtgcgcttcctcagtgaccgaaagaacccagtgtgccgggagatggccgtggtactgctggcaaatctggcccagggggacagc

SEQ ID NO: 29353 - DNA, 1144 bp, Mus musculus
gaaccaatttccattccagtttggccgagaccgagtctctgcacctcctggttccagtgcccagcagaacatgccaccacaaatgatgggtggccccatacaggcatcagctgaggttgctcagcagggcaccatgtggcaggggcgaaatgacatgacctacaattatgccaacaggcagaacacaggctctgccacccagggccctgcgtatcatggtgtgaaccgaacagatgaaatgctccacacagatcagagggccaaccatgaaggcccatggccttcccatggcacacgccagcctccgtatggtccttcagcccctgttccccccatgacaaggccccctccatctaactaccagcccccaccaagcatgccgaatcacattcctcaggtatccagccccgctcccctcccccggcccatggagaaccgtacttctcctagcaagtctccattcctgcactctgggatgaaaatgcaaaaggcgggtccaccggtgcctgcttcgcacatagcgcctacccctgtgcagccgcctatgattcggcgggatatcaccttcccacctggctctgtagaggccactcagcctgtgttgaagcagagaaggcggctcacaatgaaagacattggtaaggatacctccctgattgggtggctcaatctacccctttccatctttcacatggttccctccatcccaatattctggatgtggttaaatctggcacagtatttactaaaagaaagccaaagaatttggaggatggaagaaataagctgatttcaggtttttcttcaaggctctgtctgccatatgctggtgccctagacagcttagaagcaatgaagtcagactagcctgactaatggaccagccttgggggtgcctctagccagctggggcttggtggatggacaacacagaggtttatttcaggaaccccggaggcatggcgggtaatgatgtccctcaagtccgggctcctggcagagagcacgtgggcgttagacaccattaacattctactgtatgatgacaacagcattatgaccttcaacctcagccaggtgagtacaggtgtctgggcaaggtgagggggtactgttgatgtagataacactatggcacagcagg

SEQ ID NO: 29354 - DNA, 1144 bp, Mus musculus
atttttgctaaagtagcagaattgaaataggtttcaatttgtttgtttgcctaggtggaaggtagctgactgactggtttatgggtattttgttttgtttttgagatagggtcttggaaatcacctacatagaccagactaccccctggtctcataaataatatacttgaattgattataaagaataaacttgacttggttctgtctctcaaatatttgggtgccagctcagcctgactccgtgtatgtttgtgtgtgtgttttgtcttgtgacacatttcttactgtgtggtcccggctcgccttaaactcaatcttactgctcagcctcttaagtgctagtttgcaaatgtgtacctccttgctcagcagtatggtaaagtccagaaggcccatgaattgaactcaaaagtgtattcagtatttcagtgtgttccttcatggcgtttgctgtatgtgaccaattgtaaatatgattattttgcttcctttcactaatatccttgcgtgtgtgtttcaggatctgtctggttcaatcgatgatctccccatggggacagaaggagctctgagtcctggcgtgagcacatcagggatttccagcagccaaggagagcagagcaatccagctcagtctcccttttctcctcacacctcccctcacctgcctggcatccgaggcccgtccccgtcccctgttggctctcctgccagtgtcgcgcagtctcgctcaggaccactctcgcctgctgcagtgccaggtaccctcagtactggtttttgggaagaggaaaagctggctgggctttgactcgtgcctgcatggtttttcccttagcatttgaagaagggaggtgggaagcccttagatgaatactggtgtagatatagcataagaagtgttgagcaatttccaggtccaaattcactccttatttaagattctcaggctgagccatggttttttgtttttttttttttgtttgtttgtttgtttttcttttgtctggagcaggcaaccagatgccacctcggccacccagtggccagtcagacagcatcatgcacccttccatgaaccaatcaagcattgcccaagatcgaggtgagagcttgggtttcgacagaggactagcaggagcac

SEQ ID NO: 29355 - DNA, 1230 bp, Mus musculus
ctcccccatgtagaggagatgggccatgtgctgcccccactgccttcctgcatttgggtggccttatggctttgttgcttctatattcccaagtctgcagtgttagatattagttttctttttcccttggcattggccgattcatgattttctgtggctcgtcaccagcagccaagatttttaaatgctttttactcttaaacttgttagttttcaccttgcttgtttaatctctgttggaaggacccccttgcccacccccaagatacatcaccagtatgatggcgggatggggtggcagtgtgaagggttggtgtgatagtcatttaaatggttatttttaaaaaaccatttgctgggtgccttgttttgttttgcctcctgtttttctttccttgcttacagcctgcttactgcgcctgcctgttacctttcaactgactgaagactggtgtactttgactttaaaaacagaatgaatttggctatgtggtagaggactagtgactgtgttgttttagtccagagccttgaaactccttatcatccagttcagataacttgtgtttttggtttccaagttcaacctgtttaggaatctaggctgtcaaaactaaacacccccccgcccccaacacaacaaaacaaaacaaaaaaaaaaacagaacaaacctatttcataatggacttagggaacaatttctccaaaacattactcagggacaggcatctttactgagaccttgaccttgaagtagcatcctagtgaaggtgtatatttgtgacagctccccacctgcactgtggcactggtttgtgccgagcaagcattatgtttgaatcttgtatgaatttcctcatttactcttcaaaatacggagagaggagtattccgttcttcctcttggcttccagtcatgaatgtagaattataaaacatcctttagggtagttgttagtttaaggtcaagttgggagtgaataaagttttgttagagctataggtattttattcatgtaaggtctaaggaattaaatctaggctttcttgatgccaggcaagaactctttttttttttgtttgtttttttcaagacagggtttctttgtgtagccctggctatcttggaactcactctgtagaccaggctggcctcaaactcagaaatccgcctgcctttgcctcccgagtgctgggattaaaggcgtgcgccaccacacccggccagg

SEQ ID NO: 29356 - DNA, 1220 bp, Mus musculus
tccattttatattaatatttctcgattcgatccttcagtgataactttcttttttctttctttctttaaagatctagtatgctatagctgtcttcagatgcactagcagagggcgtcagatctcattacagatggttgtgagccaccatgtggttgctgggatttgaactcaggacctttgagtcagtgctcttactcgctgagctatctcaccagccggataacttcctttttatggagaaggaagaacctgatttggtagccttgtaaaataaccagaataatcttgtcactgtcttttttgtttgttttttcaagacagggtttctctgtatagccctggctgtcctggagctcactttgtagagcaggctggcctctgcctcccgagtgctgggattaaaggcgtgcgccaccacacccggctgtcactgtcttttaagggacactgtcactgtcttttccagggagctggctgtggtgccccacatctataattccagatttggaaggcagaggcaggtggatctctgcctttaaggccagccagggctacacagtgaggccctcttttactactaccaccactcacgcccctgcccccaaaataaggaactaaatccactgactgtcagctacaacacaaaaaggtgtttctgttggtttttagtttagttttgttttaaaggcagtgttctgtgagagactatttgatttagtttatataatggcaggaactatgaatgtaattatgtccgtgatagtcatttttaggttcagctctgttaaagaggctatcagcttttaaagcaaaagtaagaaaaaagagacttgggatgccattgactttgattgcccaggattgttaaggtctttcccattacaaagggtaaagttattagatcttcaggcttgttgctgtgagcatcatttccagattataagatctggagattccagtgggggtgaggactgactaggtactagaaaaggatttagatttaaaaggtagtagacaaactgggaggcagaggcaggtggatttctgagttcaaggccagcctggtctacaaagtgagttccaggacagccagggctacacagagaaaccctgtctcgaaaaaccaaaaagggaaaaaaaggcagaagccaggtgtgaaggtaaggtgtatatgcctgtaatctcagaagttgggggttgggatttggaaggcttgaga

SEQ ID NO: 29357 - DNA, 1522 bp, Mus musculus
gacctgcagctcgtgaaggtcggcatgaacacctggggctgccaagtgtctggggtcgttgtgtgggattggtctcagaccggtgggttatggccaggacttgaagttctaggtctgcctagaaccaggggttgtggcaaaagacaaagccctgcccctaaggggtgagtcccagacttagcatgatgcattcttgtgccccagggagaaaccctgctcataagcaataagtacccaggctagaagcacggggctgggtggactggggaagcttgggaggggtgggccagaccctggggtacctgtgttttgatgcccaccaccaaccctccttcgtggtctgattctcctacctcttctcttagggagccatggcggctacatactctgctctcaatagctccaaacccacccctcagctcaagccaattgagtcgtctatcctggcccagcggcgggtgaggaagctgccatccaccaccctgtgagccgcagacgaactcctcagaggcagagtccttcccagagacagcaagcctgggtcacaggaccaagtggaatggagttctaaaggaagtaaccagcccagatcacccgtgagggtgtgacgtgccttcctccccgggacgggctcttctgggctcaggctccaccgtgtgaaagccactcactgtacaaactattttttaaggaaaaaaaaatggcgtcatctcccatgaattttttacaagatccatttgccttcttggccatcgcagtcccagcagtcccaggaggaacgacgagtcacatgtgtggccgagactcccttggtagctttggggccctctccgctgttggccgtggggccatctgcacatgacttcgagcaggtccagcgtcgcctctcagagctgtctcctggctcctcagcagaacttggtccccagccatctctttttccgttctgttctggggttctagaaccactttctgctagagcaagggaccccaccctgtcagctcttggctccaggcaccagcatccacaacgcccatcctcggtgggtccctgcggtgggatcggacaaccccatggagaggaagcagaaagcacttttggggaaacctgctgtctgccgctagacagagttcacaggagaccagggaggcggtccccgggcgatgagggctttttcatttcctcctcagctggtaactcagggttcatctgtccaaggcctttctaataaacttacaatccagttaaagcgcccgctcttccttctgctctttatcctccttgaagacttcaacggtgacaggaaacaggctagggacaggttagcccacttgcttgaagcacacgtcattgagaacccctctggttctgtgcatatatgtgctcctatgagaggattctctcacagtatggatgaacactaacgacattagcaaccagcaatggtcgctggcccttagtgataaatatgcaacccaagaccttaaacaccccagacaggtggtctgccaccgtcctccc

SEQ ID NO: 29358 - DNA, 1207 bp, Mus musculus
ccccaaccagacattcattaagtcctgtcattgaaacgcatggtgtgaggtagaggcagaaggatcagaagttcaaggccagtgttggctacaccctgactttgaatcaagcctggccaacttgagagcttgtctcaaatgatcctccccagcagcaaagcaaaaggaaaaggaaactgggaaagcccatgaagaaagcctgcgtaggcccagaatcacattttagtattgaaattagggataaacagggacttgatagtgtgcgctgaaggggtgcagagtcaaaggctggggacctcggaaaataagtcaccctggggcacacggtgctccatggctacagagggcctggtggtaggtgaggctagacaactgggcgagacacaaggactatgcctggatgtctccaggagaccaaaagctgcctgaggacccagaatattctagggaagaaagaaccagctgactgtcccaagggtgagagcatcctgagagtgcttgaaaggccgagtgagaaacctcacccagaggcgggcttttcgggtgggttttagtgacttcttttctcctctggccagtgcgtgaccgtgttcggaccaagatggagagagacatcctcgctgacgtgaaccacccgttcgtggtgaagctacattatggtgaggccaccgaccccgcccaagtgccacttgtcccctcagtgtccacccttgcctgctgccttcctccatcccttgtcccacctctcaggcctggctgacacaagctggcactgatccagctgattccacggtggctttctcctctcttagccttccagaccgagggcaagctctatcttattctggacttcctgcgtggtggagacctgttcacacggctctcaaaggaggtaagctagcatcccactgctgggatatggcagagtcccgtcctgaggccgatgaagagcaatgtggtgcaggcctgtaacttcccggctctgttgaacaatcaagaaacgtcacctgcctcggagagtttctctcaggatgtgctgaggatgactgggcctaaatgtggccctgctgtaacttctggttgctaagggatccctcaaatacctgagagagagtggcgaggggggtgggggtgctggccaaggggaagaaggccaaactcacccaggacgctacaaaaagatacaaaggacccagtagaaagggat

SEQ ID NO: 29359 - DNA, 1213 bp, Mus musculus
ctcaggacagagactgctgctttcagctttcctacctcaaaggtgagggagctttcactcctgggctccaaggtgtggtccaggaagggccaggagcaggctcaggacccaggagttctggctgtgacccccacacaccacagcacttcctgggtttgttatgtcctctcagtttgtgcctacggaatgattggtgagttctgtgtgtcgtgctgagctccttggtgggagcgggtgccacaggggcttggtagcatttggctctatgaattggagtggtaggaccgggaacctggtggcttttctagcctgaccgtgcccagtgcctctcagatggcttcttgagactcccagctcccagaacaaggtgtagccatttatcccagctgtctctgcttccccgggcggcttccctctagcctgccagtcctttaccccttcctagtttttatttaaaaaaaaaaaattagtactttttttgtttttgttttttttggttttttgagacagggtttctctgtgtagccctggctgtcctggaactcactctgtagaccaggttggcctcaaactcagaaatccacctgcctctgcctctcgagtgttgggattaaagtcgtgcgccaccaccgcctggcctgttgttcttttttttaattaattttttttagacagggtcttggcgtgtaactctggctggcctcaaactcagagatccatttgccttgcgtggcttcccaagtgctagagttaaaggtgtataccaccatgtccagcccaaaaccagtactatactttgatttaataattttgtgtatgcttttgtgtgtatgtgtgctcgcgtgcatgtccctaggcatgtgtggaggtcagaggacaacttgctgaggtcggttctttccttctgtcaggcacatgccagggatcaaaggcagtttgtcaggcttaccagtcactgcctttatccactgagctatctcacctgtccaccttgctgttatacattgccaaaagctcctatgcgaccttcgttgggtaccttgtcctctctgagccctgcctttctcatctctgtagtaggaagaaccacgcctaagtcacacacacagattgagagagagagagagagagagagagagagagagagagagagagagagagcgagagcgctgttaggtcacagagataatgccattgagaggctttgaaagcc

SEQ ID NO: 29360 - DNA, 1226 bp, Mus musculus
atgacaccgggtcttcctacttcagattatgctgaagagtggggaaagtccttagatcttgtgaagactgtctctgtagaagagactctgcctccgtcttcctctctccctccttcctttcctgtagaaaaaggctgagcccttgggcagtatggcttctgccacctagcctttcccagaagcaactcctgtcttttttgagggctttgtggtccaaccctgagcatgcaggaggccacttctgtgctgtcctgtcaccctgggatcaaggtcaagttttgaaccagcaactttaaaactttccctgctctcctgctgcgaaggaggcaggtgaaactctgccttccttcactggagctgttttggggtacaggaggctggggtacaggagacctcacttgatcccagaacctagatgctttttctcctggcttgaacccctttacctatgcttggtacctcaggtcagtcactgtgagccctgtctctcaggaccacgggcagagagaggatccacagtgagatccccaagtctccaggcactcagggcatgctgcccctttaaagggatgggctacactggctattggagggtgggcgcggctggattaggtaaccaacctgaaggcgcaatttggagtaaattgttctgggatccttgccacgggggttttacaggccctacacaggcgctcagaggctgtctggctgactcaccctcctaggtgaggagcactgctctctgcagcccctggtgctccccccacactccccaggactggggcacaaggccccagggaaggctcagaggtgtactccttggcttgggcacgcccctgccacctgggcctccagaggaagggaggcctgacctcggtatggctagggagggactcagcctagggactcacagctttaccctagcgcggagagtagagttctaggagtgctggcctcctccagggcagcacttcctgcttccctttgggaaatcctgaggccagaggcagcctcatgggggccaggttaaaccggaaacatcttagtttgaatactgttgcacctgaattcaggcgaggggagactgtcacatttcctgggatgggggagaggagttttttcattgagtttcacttcagaaatgttgtgtggccctaagtccatcttcaagctgtctgggcctctccttccagcaccacagatgagtttctagctctacttcctgg

SEQ ID NO: 29361 - DNA, 1059 bp, Mus musculus
atgaggtcattgtttattaggaaagtcattagcaaccaaacgtaaatagattgtatccttaccaggataagtttttgctttgaggcagggttttaactctgtcctcctgcaggcatggacctcacagagacacatttgcctctgcctcccatgtttcactacacccaactaaaacaaagactcttatgtgtggtgtagaaactgaacccagaactttttttttaattggctattttatttatttacatggcaaatgtccccttcctggttttccctctgcaaccccccccccatcccatcccctctcccctgcctctaggagtgtgctcctccactcactcacccactcctgcctcactgctctagcatcctctcaagctggaccatcaagccttcacaggaccaagggcctccccttccactgatgcccgacaaggccatcctctgctacatatgcagttggagccatgggtccttccatgtatactctttgcttggtggtttagtccctgggagctctgaggggtccgattagttgatagtgttcttcctatggggttacaacccccttcagctccttcagtccttgtcctagctcttccattggggtccctaggctcaggccactggttggctgtatctgcatatgtattggtcaggtgctggtagaacctcacaggggacagccataccaggctcttcttagcaagcacttcttggcatcagcaatagtgtcgggtttggtgtctgtacatgggatggatccctaggtgaggcagtttttggatggccttcagtctctgctccactttttgtccctgtatttcctttagacagagttaaaatttttgatttggttgggtggccccattcctgaactgggggccatgcctatctactggaggtggtctctacaggttctatctcccctttgttgggtatttaagctaatatccccattgagtcctgggagcctctcgattccctggcatctgggacattctagtggctacccccagttccccacttcccactactacatatttttattcaacttcc

SEQ ID NO: 29362 - DNA, 1139 bp, Mus musculus
aaaaaccctgaaatcctgcctctgcatattggtatatttgaagagtcagacaatgtccataaataacagtatttagatgtccttccctaagagctgggactgagcggtggtagtgtggcaagccttttatcccagcactctggaagcagaagcaggcagagacagtctgaggacagctgagtctcctgagggaattctaggtcagccatggctgtgcaaagaaatggtgtctggggataggtggggcgcagggagggagctgagactggttacagcaggtcctgagttggtaagagttcactattaagaatttttgtctacatgtctgtgcaccacatgtgcgcctggtacacagacagtcagaactagagttaaaaataccaggggttagccggtcatgtgtgagctagcaacttctgtaagtcactaagtcaccactgagccatgcatcaatgccccagaagggtctgtttttggtgctgaaatggttttgatgtggccaaatttggtcttggacctgcatagtttaggatgaacttgaactttggccttgactaagcctcccaagtgtagtggggctacagtataatagtataaaagtacagcaggtggcacatggctgtgtctgctttagtagatccaacaaagcagatgctaaaccggccaatctatgggaatagagatcaaagttgaagctcaacacacttatcccattatttggcaacagtgacctgcaactgggaaaactacctgccatgacacatggcggcaatgtctacttggtaactggcccagagactgccacagctcatggaagaactgcatgcagtccatggttaaacgatatttacaatctgaagaatggtactgaacccaattatagcttcaagttttgctcaagcaccaacctgctaaccataaccacaggctcccctctctggaactgtccccaaagtcagagtgaatgtccccaaggtacaggtccaacattcttttcttaagattcaatatatgagtacactgttcccaccgtctcagacagaaaacccatcccaaagctttaagaagttaactgttagcttgaccttgatacaagaacactgccccaagaaaggccaacagcactctagtcggtctag

SEQ ID NO: 29363 - DNA, 1185 bp, Mus musculus
atctcttcttcagaatacaggtctccatctgtgcaggcaaatcctgtgagagatttccactgcatccagactcaggcttactgttgcctttttgctctgctattccagcttaggtcatccctgaaagatcacatccagttagtactgtttgtctaaagatctcttgttttcagccaggcagtggtggtgcacacctttaatcccagcacttaggaggaggcagaggcaggtggatagctcttgagttcaagggcagcctggtatactgaaaaaattccaggacacctaggactacaccaagaaacccagtctcaaaaaaaaaaaaaaaaaaaaaaaggaagaaagaagaaggagaggttgagggagactcagcttggaaacatctcatgtatcaaggtccagaaaattttaatgaataaatgttacaattgaggactgggatgctggtacttggtaagggctggtacatacacatgacagcctgtgtttggaccctggtacccacataaaaagcctgctgtgatgggggggcacacttagaatctcaatgcttggagagcaaagacagaaggatccctagagctctggctggccagctttgcctgatctgtaagccccagtctcagagagcgagcctatcttctgaggagcagcacccaagggtgacctctgacctctacaagcactcagagacatagacaagtgaactggcagctagctactgcaaatgctttgacttaatgtttggggatcctgatggaaatttagtgtatagctaatgttttctgctgctcagatcacacttaaaagtttgcactgagcacagttaggaaatgacagtggtggtgggctagattccttacagagtgtgcacaaagccctgatttggtccctggcactttgcaaggaggacaaaaagggaggcagaaagaagatggagaaaaggaaggagttagaaatgggaaagaaagataaagacaaaatatactggtgaagtagagaatttaccaaatgggtcactcagcagatacagggatcccatgtctctaacatgagacttagcatctggatgtggtggcacacacctttaatgccagcacttgggaggcagaggcagttgatctgtaagttcaaggacagcctgttctacaagaaggctcggggaaagtcattgcagccttagga

SEQ ID NO: 29364 - DNA, 3514 bp, Mus musculus
aattttgtcccctaccaggtgctacaactgcggtgggctagaccatcatgccaaggaatgcaagctgccaccccagcccaagaagtgccacttttgccaaagcatcaaccatatggtggcctcgtgtccactgaaggcccagcagggccccagttctcagggaaagcctgcctacttccgggaggaagaggaagagatccacagccctgccctgctcccagaagcccagaattgaggcccaggagtcagggttattctttggctaatggggagtttaaggaaagaggcatcaatctgcagagtggagaaagtgggggtaagggtgggttgcgtgggtagcttgcactgccgtgtctcaggccggggttcccagtgtcaccctgtctttccttggagggaaggaaaggatgagacaaaggaactcctaccacactctatctgaaagcaagtgaaggcttttgtggggaggaaccaccctagaacccgaggctttgccaagtggctgggctagggaagttcttttgtagaaggctgtgtgatatttcccttgccagacgggaagcgaaacaagtgtcaaaccaagattactgaacctacccctccagctactatgttctggggaagggactcccaggagcagggcgaggttattttcacaccgtgcttattcataaccctgtcctttggtgctgtgctgggaatggtctctagcaacgggttgtgatgacaggcaaagagggtggttggggagacaactgctgacctgctgcccacacctcactcccagccctttctgggccaatgggattttaatttatttgctcccttaggtaactgcaccttgggtcccactttctccaggatgccaactgcactatctacgtgcgaatgacgtatcttgtgcgttttttttttttttaatttttaaaattttttttcatcttcttaatataaataatgggtttgtatttttgtatattttaatcttaaggccctcattcctgcactgtgttctcaggtacatgagcaatctcagggataataagtccgtagcagctccaggtctgctcagcaggaatactttgttttgttttgttttgatcaccatggagaccaaccatttggagtgcacagcctgttgaactacctcatttttgccgattacagctggcttttctgccatagcgtccttgaaaaatgtgtctcacgggtttcgattgagctgccccaagacttgatctggatttggcaaaacataggacatcactctaaacaggaaagggtggtacagagacattaaaaggctgggccaggtgaaaggcacaagaggaactttccataccagatccatccttttgccagattagtggaagcctgccatgcacagcagggtgtgagagagagagtgtgtatgtatgtgtgtgtggattttttttaatgcaaatttatgaagacgaggtgggttttgtttatttgattgctttttgtgctggggatggaatcttgggcttcatttgtgctaggaagtacactgccactgagttatcccagtaagaatgcaacttaagaccagtacccttattcccacactgtgctgtccaggcatgggaacatgaggcagggactcaactccttagcctttcacaatcttggctttctgagagactcatgagtatgggcctcagtggcaagtgtcctgccctgctgtagcgtgatggttgatagctaaaggaaagagggggtggggagtttcgtttacatgctttgagatcgccacaaacctacctcactgtgttgaaacgggacaaatgcaatagaacacattgggtggtgtgtgtgtgtgtctgatcttggtttcttgtctccctctccccccaaatgctgccctcacccctagttaattgtattcgtctggcctttgtaggacttttactgtctctgagttggtgattgctaggtggcctagttgtgtaaatataaatgtgttggtcttcatgttcttttggggttttattgtttacaaaacttttgttgtattgagagaaaaatagccaaagcatctttgacagaaagctctgcaccagacaacaccatctgaaacttaaatgtgcggtcctcttctcaaagtgaacctctgggaccatggcttatccttacctgttcctcctgtgtctcccattctggaccacagtgaccttcagacagcccctcttctccctcgtaagaaaacttaggctcatttacttctttgagcatctctgtaactcttgaaggacccatgtgaaaattctgaagaagccaggaacctcattctttccttgtccctaactcagtgaagagttttggttggtggttttgagacagggcctcactctgtagctggagatagagagcctcgggttcctggctctcctcctgccttctgcacagagtcccctgtgcagggattgcaggtgccgcttctccctggcaagaccatttatttcatggtgtgattcgcctttggatggatcaaaccaatgtaatctgtcacccttaggtcgagagaagcaattgtggggccttccatgtagaaagttggaatctggacaccagaaaagggactatgaatgtacagtgagtcactcaggaacttaatgccggtgcaagaaacttatgtcaaagaggccacaagattgttactaggagacggacgaatgtatctccatgtttactgctagaaaccaaagctttgtgagaaatcttgaatttatggggagggtgggaaagggtgtacttgtctgtcctttccccatctctttcctgaactgcaggagactaaggccccccaccccccggggcttggatgacccccacccctgcctggggtgttttatttcctagttgatttttactgtacccgggcccttgtattcctatcgtataatcatcctgtgacacatgctgacttttccttcccttctcttccctgggaaaataaagacttattggtactccagagttggtactggtctctctgatgcttaggacgctttcctggcgcataatccccacctcggagcggattgggaagtcacaggaccattatggttttcccactttgttagggacgaatcttgaaagttcagcccttgtagcacctcattactctggatttttgtttctagttaaggcctcttgtcccttccttggaagctgccacattcacaggggattagaggcctggcatgcagaagaatggggctgcctatgcctctgctgggatgaaaggctggggccagggcttagggcaggagaccctaataatactttgtcctttactcctcaaagccctttacaaatcctaattaaccctttgcaacacccccaaaaggaaagtcccatacagaaccggagaaattgaggcccaagcagagtctcccactataaaccaatattttgtgatacagtttgctaactttctagtgagtgcttacaggacgattttttttccaaagggaggggttgggggggg

SEQ ID NO: 29365 - DNA, 1209 bp, Mus musculus
atagaagctgttgctcacacccgaaggaattcctcccacaaatccttcagcttgcctgccaaccctgtcaatcctccgcccctagatcaagtcccagcagagtgaggtgacccgcatcctagatgggaagaggatccaataccagctagtggacatctcccaggacaacgcccttcgagatgagatgcgaaccttggctggcaaccccaaagctaccccacctcagattgtcaacgggaaccactactgtggggtatggggtttgggttctgggaggtgttggaggactgcagccagggtcagacctgggcaaacaactggggtgccctgcacctcgactcaggtgactgcctcccttcctcaggactatgaactcttcgtggaggccgtggagcaggacacactgcaggagttcctgaagctggcctgagtcaggatggccaccgatcctatccagctagctcttcaccaggccttgtaaccaactccttgtcgtcctaatctgcaaacccagacccagaccctttccgcagccgcctcctcttcctccagaggcaacattccttattcaccaactagtctcaaaagattgtcttaagccctgacgatggctgtccccagccacaccttggggcatcctctctgcctggccctgtctgatgagcatttctgttgcttccatcagccagagctctgccaaaggccccgcatccccatcctaggagtgccctagagacaattaaatgtccattcctctggtgctgactgcttgtggtgtccgggtccctgcctggcagaggcagatagttctggtggtgtttggactgtcccagggctgccgctgcgtgtgcgtgtgcatgtgtgtatgtgtgtggaacacatggctggctggcagcacatgaccatgatggctgagtcaccctgtttcccatgtaggttctgctgtctgcctgcctgcctgcctgagggtggctgcccccgggctgcctcccgtgttggagctgactgattcagtgtaggggggtgatgggggcgtgtacagctgcagcagtattagattgggtccatgggggtagttgtggcactggttttgtgcacactctggagaaagtatccatgtgagcttgtggatctacatgcatctggttgtcttcagaggcctcgcccccattgaggctcccctgacccagctgagacagagaatgtcag

SEQ ID NO: 29366 - DNA, 1154 bp, Mus musculus
acaagttgttcccagctctaacctggcatgagaagcaaacaggctgctggcctcccctccatcctccaggacggatccatgttcattcctatccataccttggtcctactgatgctcttttaagagaggcctaaagggtaaagtaggagtagcaaccttttaagaattctcaggccccttgtatcagtcttctgagaactcagctggctttctgggttttctcaggtacctgtttcctcagggctgttgttcccacagaggcctcagggttatccacctctcagcagagcccctactatgatcactgacttggggaccatggcagggctcctcggcctgcctgctgggccatcttttacaggaaactcttcctagctacccattgtctgtccctagaaccttgggcatgtgggcatgtgcttgggtccgctatgtcgtctaggagtacagactcctctgtggttgcctcgtggttcccgggttggacatgagtttcccccgtaagagcacagggtggctgtggctgctcagtccttcctaaggctgggcgctgtcgctgtcctctgaactgtgcctctcatttggggttaggagggttcccttttcctgctctaaccttgacagttcggagcacctaagataaaaaaaaagtgttgagtgttttctggtgttttgtgtttctctaaggcctttgagccttagctttctggtttttcttgcctcccaatttagggatcgtctcagttgtatctggttatttggccagccctcaacctcctctagtttggatccaagggccctgtatgtatgaggagtaaagtagttgtgggggtgcagacaggacttctgctaagccttggggctgttaacagcaccatggacctccagggcctgaggggccgctttgccagtgttttaacaagtttatgttttcttatggagtggcttacctttcagagtaatcacacccagctgaccatcccctcagcctccgggctgctgcctccttaaaacagagcttcctggttggtttccaccctgttatcgggagcccagcctccatgctcacgggtatttttcttcgtaaagtttataaagttatttatatgactctttgttaagtcgactggtttgtattgcctattttgattaca

SEQ ID NO: 29367 - DNA, 1110 bp, Mus musculus
gtgcgcgcgtgcgcgcgctcaagtgtgcaggtgtaggtgccatggaggtcagatagcaactctcaagggttgttttcctcccaccttgtgggatctgggcatcaaactcatgttgccaaggttgtgcctaagtgcttctacccctgagcctttctgttggccagcttgcttctcacagtaggcctcatgataagcatctgcatgacttccagatgccttcagtagttattgaatatttgccatatgccctgcactatcttataggtaaattataattttaatattaatgcaagatagcaattcctaacaaagtttcctgccttttttgttgtctccagtagcatgtttttcagatttacagcaacacaagcacatacacaaaaggggggttttgttggtttggttttagttttgttggcttgccagggtgatgaggtcctgaggtcctggctgaccaggaattcactgtatagaccagtctgatcttacacttgaggcaatcactctatgccaccccacctagttatacagatgctgctggtgactttaagcttaagactgtataccccaggcaggtctgaaacttcatttgtagccaaagatgaccttgaaatcctgatcctcctgtcttcaccttccaagtgctgggttataagtgtgaggcaccacacctaggtacgaaactatagtataagtaactcaaatacgtcagataaactgggcttggtggtacaattttaatcccagcactctggagcagaggcagatgaatctctgagttcaaggccagcctggtctacagagcacattccaggccagccaaggatacacagagaaaccttgcctataaaactatatataagggctggtgagatggctcagcgggtaagagcacagactgctcttctgaaggtcctgagttcaaatcccagcaaccacatggtggctcacaaccacctgtaatgagatctgtcctcttctggcaagtctgaagacagctacagtgtacttatgtattataataaataaatctttaaaaaaaaacaacaactatatataaataaataatttgcgtgtatatagagcaggtatattttttcaaattgaata

SEQ ID NO: 29368 - DNA, 1231 bp, Mus musculus
tcctgcagctttggatcagcaggactggccctttcatgtatttcaaccatttgcagatgatacagatttggggatgggccaactcagtgccctggatctgggcctggctggtaagctgagctggtcagccccctgctctcccttatcagcaccaccagggtgagttctacagcactgctctggctaggccacccagtgccaccatcagtaggaggcagggacagctctccctctcatgacctgggccagttttccccaactgctacagatggtgaggggtaatggggagagggcatcacccccacccccataccacctcaccacagatgaatcatggagccatctctctctctctctctctctctctctctctctctctctctctctcgtgtgtgtgtgtgtgtgtgtgtgtgtgtgtgtgtgtgtccgtctttgaagatggctcatctgctgcttctcagtcggcccagtactactgtgctgcccaggtgaggcacagggcccactgtcctgagtgctgctactgttgatgtacagaactagctctctggctctcgtgacctctgcccagctgcctctgtggactgaggaggcaaggggacagagagcatcccctcctcccacccagcctgcctcatagcagaggggtgcctgggccagctctcttgcacttttggggctggctcacctgtgtcccctacaccagggctatctttatttactgtgctgcccagataaggtgcagggcttgctctcctgagtactgaagctgtcaaggggcagggccagctcaccagctctcatcactccagagccagttctcctgactgctgcaggaggtaaggtgggtggtaagggcatcaaccacaccacctcacactagactagtggtgggactggctcatctgcttcccccatcagggccagcactactgtgctgcttaagcaagataaaggacccgctctcctgagtgtggcaggcagcaaggggcagagccagcttactcactctaatgaccctgagatcagctccttactgccaccggaagtaaggggcaaggaggggaaggcatcacccctgcatctattgtcacctcatggcagatgtggggcagggccagctcttgctcaccttcagggtcagcctgatgtgctgtttaggcaaggtacagggcctgtcctcctgagttcatgatcctcttacatatgactgacagaagtgtggtggcag

SEQ ID NO: 29369 - DNA, 2543 bp, Mus musculus
gtctgtccacatagccattggtgagtagaggtaaaggaagaagcgcaaggcctggggctgtccaggagggtttgccaagctctgaccacatgctgagcgtttaaatgctctttgatcctccccactgcatttatagggagagagaactaaggccctgcttggggtggtcaggtccttgtacttgctgttgggtgggggagacagattccagctctcaggcttgctggatgcgggacaccccctagtgtctcttgtcccctagtctgtgccccaggggtagacatgagcccaagcatcccgtgtttctctcgtcccagcccagaatgctgatgcccaggctgtgctgaaggtggctagggaccgcctccaggggaagttcaatttccacaccatgaccatccagattgagaagtactctgaggacatgaagaactgccaggcgtgccagggccccttggaatgactccccagccagacaccgtctcctcggaaacacggtcaggacctgtgggtagaactgtccggtgtgcagccgggattccagcaaggcacagcctggaccactccacggtggggctctccttagcctctctgagctcacaggatggggacacggcagatgaggccccacttctcttccaggatggtgtttgggcagggtcctgaactgatgtcatcctaacaccaccgctggagagacactgaggcacagaaagggatttgggggtgtcctgtatgatccagggtctctgtgtctgaaccaaaaattgaacaagatccatgtaacacgtgaccgggttgtccgggggggggggggggttcccttggcagggtcggtctcattgataaaagaacctggagctggactcaggaggaagatctgaggctattttattagaatttgggagaaggaaaacaaacaaaacaaaaacccacagtccaggcaagccatgaatctcggcagctactgaaggaaagtgagcgagaagagagaaagaaaatcagggcttttgaattacggtcagcgatggagttctgtaaacagctgaatgactataatgggggagggggggttaaaggaacagtgagaaagccacgcatgcgcacacacacaatttcaagatgagagaaaaaggggggaaggagaaatcgggcttctgagttagagtttgggaagacaagctaacttagcagttcaggtctataaacaagtgtctgtaaagtgggaccccagagagccttcagtgtcctaatcaaggagataattgttccttagcatgtctctgggtgactgacaggcccaactgaatgaactctaaaaaaactgcagagaggtcaaaccataacttggtggagttttttctctccatcttcaggtagtcaggtctgagccactttcgagggaggcgtgggggctatgggaggtaatgtcctactctttgggacacatcttcatcaggggtcatcagggatagaacctagtttctatccttttgcccaggaggaatttgcttctgagggagatgggtctcaaggacccctccctggtttgctttacacagttgggagcagagcccttgcctctgctatataacatggcttaccaaggccatggggacagcatttatacactccctctgagatgtgggaccaaagggcacccaaggcttctctctgccttgctcactttggctgtgggccccatgtgacttcctagaagaggaggagaaagaggcctctttatagggaaaaacctgtctggtttcttccttcctggtaccccagcccaggaagccaagtcagtgtatctatggccttgaccaaagtggcagtgatagattccagttagatcttgctctcacagcctcagggccaggccacttcccttgacctatctcacgagataatagatgctgctgtttcgagggtgaccatgacctagttagggtgaagatgtgtccagaggctgacaggaggggtgtcccgggagtctgtgtgaagaatcctttgagctggtttgaggttacagatgcaagaggtaagagctgtctccagtcttatagagttcataggaagtcccttcttaggaagttccaggccaatgtttatatctgtcattgcaggccaactgaaggttgtcacttctcagtgcctgtgactcatacagagaccaggaacatcatgacatctcccccacaggagtgtgcagacagccgagcctgctaagcactgggtagttgtgtattagtttctttgatcagtgtcctggaaaaggctcttgtgaagggccagacgggcttcctaaagttcctgcaatggctctgtcctggcacagtaaggagaaaggctagggttggcctccaccaccagcaccaccaccccaatttaaaaaaaataaatggcatttgttttatgtgtatgagtgttttgccttgcagatatatatgtgccatgtatatacttggtaccattggatacaggaagatggcatcagatcccttagaaggcaaaaatggttgtgagccaccttgtgggtgctggga

SEQ ID NO: 29370 - DNA, 1103 bp, Mus musculus
gctgtggtccctaaatccagtatgcattctgatccactctatagatcacccccaccttttttttttagtactgggaagcaaacccaggggatcatacaagctaggccagagctctgcactgaactgcatgccattagccgtccgctccaccgatgctcgccccagcagctatatcagacactcttggcgcccagggagcatggctctcctgcagcatgcccgctggtcttgttctccgtaccccctcccaagatcgtagcccaggagttccccgtggccttggcttttcacagatcttcccagggttcttcagtgctgcccctttgggtctttttttttcccctggtgattctggagatgggaggaccacatatgcacacccctgtctgtactcagactgcctgtgagattccttatgggcagccagagagtctacagtctgtgtctctgccaggatcttgtcgcttgcctgttagctggaacggcccctttaaggcaaaggagtctggataccctttgatcatcttgtcccatggtctaggagggttcaggtaagagctttgtccctggacctatcctatcccttgcactgtgacagtgtcttaacgtagtctcaaagggccaaataacagacgttgatctgcctgctgtctttctccctatgcccctcgccagggcactgggccctccttccctagaataaggcttcataaggcttctcacgtgtgactagcttttgcctgacatttttttcatgactgcccactaagtgtataaaataggaatacgggtcaaatgtccattggtgagaagtcacagcgagatagattttaggacaatgatttggaatgcatatcatcttactactcattaaaaccaaaggaaatttgcatactagccagctgggtgtgttatttttgtatggaggattcactttaagctgcacatttgataacgtaaggcgtggagtatttttccacaatagattaatttttggtttttgcaatcatcaatgcagagagttctgcttcgcatagacacatcacacaaaacggcaggagtatgtttagggccaattcagaaactggaaattctgtcttaaa

SEQ ID NO: 29371 - DNA, 1156 bp, Mus musculus
tacctgcagggctcacagcagaatggtcgggtgagtgaagcagtggatggtggccagaattaaacaggtcttctgaccctacagctcagcatccctgtgcttccccaggactagcaccggcagtgctcacacacacacacacacacacacacacacacacacacacacacactaacggttctctccatccctgccctgccgcacagatacctctatcttctgttctctgaagataacgtgctgtcactggaagactgggtgttcaacaccgaggctcatccgctgcccgtcaaccgctcggacagctttagcatagctggccaccctcactgaccactgtcgccacgcctgtgtctcagggacgcctctactttcttgggatccgggaccgttctcagaggcactggggacggaaggcccgctgtgggcagaccctggacggatgtgtcggacaggcgacttcttttcctctgtgaggagacaggagctggtgatgtaccagcgtgggcccctgggctatggtccctggcgcctacacgttcctttctatgggggaatttctgtgtccccacacttgctgtccctgggccaaaggactggaagtttgcgttcccatcttgtgtatttggttcggtttcctttttggtttagggagttcggttttgcttgaccttccttgttttttttctttctccccacttgagttttatgacaattataattttcagaatcatgtaccttctaaagtggcgccacctaactcaaggagacctttagtgtttgtacacacacacacacacacacacacacacacacacacacaccacacacaccacacacactcttgacccgtctgcttttaatgcctatcacccgacattgattctgtcccacttcttgtcatctaccctgtcatcggaggagacagtcccctttgctttggtcccaaatgttacaaatcactaataatgctattttcattactgtaatggagaaatatgtgaagtagaataaaggatttcattgaataagaaatcagattggactcattggccaccagaggctcctgggagaaaaatcctccaacagtgtcacccgaagccgtcaccagctggcagaggagctgaggtgtgatatactaaaggcagtgggtgca

SEQ ID NO: 29372 - DNA, 1100 bp, Mus musculus
ctcattcaccagtcaacgggcctttggtttatttccactttctggctgtttaaaatagggttgccatgagcgcttgtgcccacgttcctatgtggatgtctgtgttccagatttcactctgttgctatgatagtctcagcaacttgggaaggaaagagtttctttggctcacgcttccaagttccaggctgtcagtggcagaactcagggcaggtattgaagcagaagccacagaagactgctgctcactggcccaccccttgatgtcatgctcagctccctttatcatacagcccaccagcctaggggtggtgctgcccacaggggactgggctctctcgcctcagtgaaggtcattctcacagatgtggctgtgaccccatctgatctggacagtccatcagttgagactcccttggtctttagccgtgtcaacctgataactgacgctaactaggacattatgttttgattctagctgtgtgccaggggtcctccagaggatccctagattcaatggttcagtcggaggtcttgctgtcaggcccagtacatggtcttgatcacagctaatgtttatgaaagcagcggacacacagccaagttaacccaggagccgatgcggggcagcagtctgcagggtaccaggtgcagctttcaagtgtgacctcccagggaagccacacaggatgtacctgcagcatgagattgtgactgtgtaaggggctcttaccatgtgtgctcctagagactggtcacgtcagcactctctgcctaacatgtcctgaagtcccaggccacaggcagaaaagcagatgcctccgtgtaagtgtgtttgtattgtcttagtttggtggatctccttatcagtcagccaggcatggaatgctcaagaaattcatctgcccagaggctggcaagcaggcctttctgaagatggacctcctgggcctcctaagctgatgcattttttttttcacagccattttacccatgatcatcttacccagaaggactgggttaaatgctaactcccctgtcgtggtttttattggcagcataaccaggaatcacctaggaacagagtgtttcagtggtag

SEQ ID NO: 29373 - DNA, 1177 bp, Mus musculus
tctccggctccgggatgaatgagtccgggacccagtcgctttatgacatttgtaaggctgagccgtgctgtttgctgttgctgcagagccccctcctagtgcgagcagatagccttctctgtcggtttggcaagcttttctagccgagatctgcaagctatgctggagtccgtgctgatgggggtctggggtgcacaaggggatttcttaggctgcagatgcagaaacaagcttatcctttttagtgttcactaggggcgcagtccagctgttactgtagaaccattcacagccaccccacccccatttgctgaggggcgctgggttttctttcatagtgtttaaccccagttgaatttctcgtgttcattgttgtctgtttgatcatacgaggatgtgtgagctacgagtcacacagagtgctatgcagtcggtcctcagggagtgttatctgagtggatgaggtggaagcagggacaggaagaggcaaagattgcagtcaggctgggtccaaaccttcttctactattggctgtgtgtctttggttcctgtcccttgtctgtgatggctatgtgtctcaggttcctgtctgtcccttgtctgtgatggctatgtgtcttaggtttctgtcccctgtctgtgaatgctgtgactctcaggttcttgtttgtcccttgtttgtgatggctgtgtgtcctgggttcttgtctcctgtctgtgagctaggttttatacctgcttcctggagtggccatgggctaggaggttgtcgtgtccgctctcgaccagcaagaacgacacgaccaccagttcttctaacagcaaacttcagtcttcatctctctcgcttcatctttttcctcatctttctcccccgaacccagggcctctcactcttatatactctcagtccccatccactcacagcaggccacatcacctcaccaggcatgcagcttcagccaatcagggcggcaggggcgtgtcaccaccaaatatggacttgtttaaactgccagcatcatggtgcacctgtgcagctctcacgatggtcgaggcttattttcaggtgtatgaggaagtcaggtgcaagtcataagacttagctgcagtccctggcgccttcttgggactgctgccacacccgctcctcacaggaggtgtgtgacctcactt

SEQ ID NO: 29374 - DNA, 1197 bp, Mus musculus
tctattgtcccgcttcatctctgggatatctgagggacaggaaagatcagcaaggtgaccgacctcaggcttacattcaggaagaggtaagtctggaaattgaaccccggggtatctcaatccaaagcttatttctgcctctgcaccagtagtggggagtttagaacgtcgtgggagctgattccacagttagcactggcaggtgcccactgcgcagatccattggctgaagctatgctgcgcctacccagctggctgcccaccttgggctgctgccctggacatgcccaccatgggactctgcagggccatgtgcccattgcaccaggccctgtcttttccttttccctgccagcttgaggatggttttatcagaggagggacagtgggtgccagtgcaagaggactggaagggaacatttgcagtgtcacatagtgagtttgagttgacctaatggctgccaagtcatatctgcctttgtggggatcgtagaggttaattaccacaggcctcaaactcaggtcccatgtgttcagtgtcctgaggtggccctccccctgcaggtcactaagaacacccagagaacatgacattgctcacggggagctcctggggccccctaatgccagcataacactgctgggcagcttggagcttccggcccagacagaagtgggctgggacacgaggccatgctgctaggcaaccatcagcgcatttctgctgatcaccagcttggccctgtctgtggatgacaagaggcctctgctcttgacccttaataatagtccaggggcgggggcatggttccccagaagtcactggtcctgcatgcttgcctacgccagtgggaaacagggttgaggggtattgcacgggatgcctggtgggtctgctaagtgcggaatggtccaggtggacctcacgagaagaagtagaaagttgaagatgctcttgatggctcggtagctctgcttttgggggccctgtgtgagccactccatgaccaggtgcccaggcacttcctgactccgtatggtaatgactgaatcaaggcagaagtagaaggcttctgggagccttctgaagaggtcaggagccgcaggtcacaggcagcacaggaatttgcaggtcatcaaggccctggttccacacttcccagcaggcacaagttgtagtgtgctgggtcttcctta

SEQ ID NO: 29375 - DNA, 1087 bp, Mus musculus
agggcctggcctcctggagccagtgccccctcctgctgtgggcgtcaggacaatgaccaaagccgttgatgttccttttctctgggcatcctcactcctgaagcagtaagagcctgccgttctttgtgtactggatgggacgtggctttcaggaaagttggggctcctcaagctctgcttcctcggggccgagtaactgaggctctcagagaggcagcccctgaccaaagacacatttaactctgcactttaactctcccgtagtggccatggttcgaggtccatgatggtgctttgggagtagagcttgcctcctgccctccctccacaagggggccccagtccctgacgtggcccatacagtgctaggacctagtgtaccagctgcccatgactcccagagtcactgcaaccatggtgatcacctctgtggctcctgggagtgccccccacccccaccgccaacagacaaagctgggcctgcttttctgttttgtctgtttgtccttgtgtgtgctccattttctgcttccccacaattcctgggatgataccaaagcctagcactaggctgtggcaggcgattcttgcatccattttacagataaagaaactgaggcgacacacgtgttgaggggtggagttgagaacagaacccagatctgataccaaagctgccgtctgtgctgccacctcccagcccacgcctctttctctgtggctttgttgtcctcccaggaaccaaaactccccagctattttctgaccaaaatgtgtttcataacaaaccatctggtgccttttcacacagcgctggcgcaggccgccatgccctgctagctgctatgccgctgacttctgggcagatgtgttttgaagtctgttaattccatgggtgaaacggtatctcactctagaaacatcttgctgtccttttctgacctgcagccgtagtggtccctcgaccctagctggtggtcggggcggtccagtggtgagcttctcttaatctcttttctcccttcgctggtcccgtgggctctggcatcctgaatctcagccaaactaacaacatctttccatcgct

SEQ ID NO: 29376 - DNA, 1828 bp, Mus musculus
caaccaggaggcttcgaaaagcagcgtctctggcagtcaagataaaaaagttgatattgtgttttgtgggactgtatatgttgtcatttttaaaggggggaaataacatccaagtctgattagaaccgcccatcagttgttcttggaagtttttagaagacctcacggactttgcagtttatttttcttggccaacacattaaaaccattcttggatttcaagtagccaattttgcctttttatgtatttttacatagtttcctcttcaagaaaaaaaaagcagagtttttttgcttttcaactctattttgttcttaaataagcaagaaaattgcacgttgtattcactgacgacaacaaaagcttagtttctagcatgagaggctaaacagccccacacagctctgattccatagctgcattaaagatgattatttatattacagagaaaagagggatcggccctccaaggaccagacagattgagagagagtcacttaagctgagagagacttaagggtgagactggcgtgcaggcgtgtgacggtgtgtttggagtattgccattcccatcgctgttagctctagagcacatccagagcatacgtttacagaggaaacttgatcatttccaaccatcttcccctaccccaccctctcgcccctggcacctgtcttctatttgtcgagttcactgttgatcctgttgtaggtggttgggctgctggtcaccatgccaccacttgggttttttccatgggaagcagcctgctgggtgtgcaaggccgagtgatggctgatcaatcaaagccgtggtctaggaccagctcccacgtgccatttactgctttcttcaccctcctcatctggagtttgatggtttacagatgtctgacagttcctcagctcttgtgccaaggaggagtggttgttgttgttttgttttgaagacttaaactctgcacaaagatcctggttcagctgtgtactataggttggtaggaagtgtcgtgtcagcacagacctgggagagggtgttaagaatcagggagcgggagggcaggggagagagaggacgggcaaagcagagatctggtttgaaagctggggaaattgagaagccagatcgatttgactttgcttccatgctgtgtgttctgaaaggacatggctctaaaatttcctgttgattggcatgtgtatctcatttaaagcaaaattaggtagaacaaaccagtcagtaagattagaagtattacagagaatcatccttttaatcacagatcttattttggagtaaaacaaacttctagctttagccaggtgtgcatgttgtcgccatttgcattttgagtcatcttgtgtaaatgtcaccatgaaagtgttactcagaattgtcatagtttttttccccccatctttgtgctaaaacatggaaaattgtcactgtgttgatgaggtttcccccattctgctgcctttgggacactgttttcgttaaacttggtcttggctgcattcttttttttccctcgtggggttcaaaagaataaacattttcttactgataaaactagtttcctgcctttttaacatccctggtggacacagcgaggtagattcttcctctggggctgcagtggcggccagtttgttttcagctcatctcagccccaggtcggatggctgcactcatggcaccgggcagggaccaggcacagggttagagcagtgcacatccaggagctccggctgtttggcgtccatcctcatccacctccccacacccattctctggcatcgaagccagagcatcttctctcctgc

SEQ ID NO: 29377 - DNA, 1182 bp, Mus musculus
tctagacttgctccttggagctgatgtaatatatattgtacttaccaccgcttccaagtttctactgtgatcagtgtagtgaatttctagccgagtttttaaaaagctaaatattccagtatgggtttttgtttgtttgttggtttgtttttggtactgtagcagccaagggattgccggacatggattcctcgatccttatacaccacaacggaggcatcccagccaacaaaaaactgtccacaacgttgccagagatagaatatcgagaaaaagggaaagagaaggacaaggatgccaagaaacacaaccttggaataaataacaacaacattctacaacctgtagactctaagatacaagagattgagtatatggaaaaccatatcaatagtaaaagattaaacaatgatcttgtgggaagtacagaaaatctcttaaaagaggactcatgcactgcttcctcaaaaaattacaaaaatgccagtggagttgtgaactcctcgcctcgaagtcacagcgctacaaatggaagcattccttcctcgtctagtaaaaacgagaagaagcagaagtgcaccagcaagggcccgagtgcacacaaggacttaatggagaactgtattcctaacaaccagctgagcaaaccagacgcgctggtaaggtaagtgtgtgtacactcccttcctcttgaggtgactccaaaaggaacacttcggtggcctgcaggagttgttcctgatcaacgctgagactggcagcaggcaggtggtttgctttacacgggtttgtaggcacctgtgtaggcatagcaaagacttgatttaacctttcctgtattctaaattagaggggacagatgtacatgctgcctgattggtggtcctaaaagacgctgtgtgttcatcctgcctctttatgtttgcctatcgaaggttctttttgacaaaaagacaacaagaagagtttgtgccttgttgatgcaaatttctctatgatcaaactgacagatggggagaagagtaagaaatttgtccttttaccctgagcttgttttattggttagtttctttctgtaattagaatttaaattactgccgggcagtgatggtgcatgcctttaatcacagcacttgggggacagaggcaggaggatttctgaatttgaggccatcctggtct

SEQ ID NO: 29378 - DNA, 1209 bp, Mus musculus
caaacaaattcagaaactgacagcagggcatagagctttgtgcttagaccctcagcactgtacggtagaggcagacggattgctgtaagttcaagggtaacctggtttagatcgtaggtgccttgccagcccaggctactcattaagacccctatctcataaaaacaaaaagagctgaattcattcaaggagaatgagcttgtggcttggacctccttggtgtttggagtgtgacaggtgatcggatgccagcaggtcgaggagggacactatgtcttacttgtctgtctgggtcttgcacgccaggacagcccataaggagcgtggatggggcggagtcgcagctcagtgctagcgtgcctacccccaggccttgagttccgccccccactgacctgcaggtctggggacggtgacagggaatagcagtggaacattatgaacgattcgtgtctctaggacagttggcgtgtgtggctctcgggtgctttctctgcaagtcacaggcttcccatcgttctagaagtttcccaagccaggcagtcatgtttgcttctcgttctgtctgcagagggctggttttcaagtttggccgtacggaggacttgtggcagtgaagacgtcgcttctgcaacacagccgccgtgcatgggcttctttttgcaccctgctcacccacccagtcttttgtaatactgttttctaaacttatttctgagtataatctcagcttgaaattgtataatgctagaatcatgagagctcctatgtgtactgcagcagcccagtgtggcgtgagccccatcagcttttaccacaggaaaggaaaccgctgacgtgagtcgcttctgccagcttctatcatggtctaaagagttggtgatgcaggccaggcgtggtggcacatacctttaatcccagcactcgggaggcggaggcaggcggatttctgagttcgaggccagcctggtctacaaagtgagttccaggacagccagggctgcagagaaaccctgtctcgaaaaaccaaaaaaaaaaaaacaaaaaaacaaaagagttgttgatggagaaatggtggagtctttggggtgaggattcgctctggggtccaaagtgtttattaacgcggcctcttctatgtccggtgttgaataatgtgtaaacattttcttgttattaaaaactatttagtggtcagagttctttctc

SEQ ID NO: 29379 - DNA, 1129 bp, Mus musculus
ggactactttcgtgtcgacacttggacacttggtttgctctttacactacagtaaaaacagtacattgttggtaatactttctctccctctagtctctagagactggagtgttgtcagtagttttcatgtacaccattatgttcccaagtctgtgctcagcatacagtatagtttatctgctttatttctgtcttatagaaatcatgaatgtggtctccagacagtgatgaagaaaatctgttggtaattgatgatgggttcaagtgtcagagtttatgtttacagactaaagcttagccattgttgaagggagttggtgtgcatgctagagttttgggctagggactgtttgtgtaaggcagtgacagctcagcagcctagaggcactgtcatggtgggcatctgtgatctagacgtccttcacatgatatatgcaatatattccagatgttttgagagattacagaagaagaggcctgcttcccttgcagataagtttattacgattctccagaactacagagggtgtgcattggcacactgcagtatataagttaaacctggatcttaaggttaataatttgggctgggatgtaactcagttgtagagaactttgtcagggtgcatagtacctggggttagctcccagcactgtgtagactgggtttagtaccccgctcctatgatcccagcacttgggaggctgtccttggacagctaggggatagatacaagagacttggtctcagaaactgctttatagaaacataaggtaaaaaataactataatgaaggtggtttgtctgtccattgctgagacctcaggggctgcctggtctttgctcaggcaaagaggggctccttgatgagtggattgcaaaagcctcacttctttagatgaagcattttttattgtacttactcaaaatgaggtatatctacaacaggagtcgggtattcgtggggaactgcgcctcccaagtcattctggctaattggaaaacaggctttttttgttgattagctctttaactgtgacaatagatggaatttggtttgtgtatctacagctacatttgtgtacgttgggctttttttttttaaatacaatattttaaaagttaagg

SEQ ID NO: 29380 - DNA, 1163 bp, Mus musculus
ggcctggggaagggggttcggaacctcataattcccttccttcccctagaattgaaaagcgagacaaatacagccgaagacgcccgtacaatgatgatgccgacatcgactacatcaatgagaggaacgccaagttcaacaagaaagcagagaggttctacgggaagtacacggccgagatcaagcagaacctggagagaggcacagctgtgtgagcttaaacctcgggagcagcgcagaagctgggaacggtcggtcggaggcttctgctggcaaattcaacctccctcgtgggaccagtcgattactgtcccacttcccctgcctccccactgggcttctgaaataaatgtcttttctcacctcctctgccacatgcatatgttcacatttttgtgcttggatagacgatgtatttcttgtagtaattgatgttttgtaaaaatctaatttgtataaatcctaattattatttttctatgtattttaaatgtgcataaccatataacctttgaattattggggcttagatgtacacgggtgcagtcactgctgcttttgagtgttgttaggaggaagacggaagctccagccgggctttgggactggccaggaggggactgagaagcagaggctgttgagacagatgctcctggagttctggcactgtgcccggactggagtcagaggtcatggccgtcagccgtgcacactccctttttaaagaacaataaaatgctttggaatagagtctcgaacagtgtctgtaacttaaacattgtgggtacttacacgagtgtgggagcatatgtgacacatcagtgtaaggctgagtgttgacttttgccaacctttgcagatctgtgctcagcctggggtctgagaacctgaaagaacgggtggtctacagtctcatgcgtagacagccttacttctgcttcaatgtactctatacacaaacgagagaaagcagtgatccagggaaggctgttgctgatcggagagacatggtcagaagagtgcacgcaaatgccagtcagcacatgctaaatatagcagagcagcttttccccacaactttgtcaggacagaccaatttaaaaacagttgcctggcacgcattgcagattgtgtctgggaaagagtgaatgcgagacagaagc

SEQ ID NO: 29381 - DNA, 1242 bp, Mus musculus
gcaccagggttgtctagttaccttacaacttgatacaggttttagcctcttgtcattagctaccagggtccctgaattgagtcacaaccctgagaccatgtgggcaccatagggcagtgggaggtagggggacagtttgcttaaaccaaggactgcaaaagtctttctctccaaggatcacaaaagtgtactcaggagaataacggtgctcatcagctttgaaatttataacaaaataatggttcaaatgctgagtcccgcatttgggaccttaagtaagtcactccctcctcatgtcttacacaaagccaggcacaaagccagggtgacctggtgaactacttcctggtcagagatggtacagagagacagtcagtgatgcttggaaactgttcactccgccatccatctatccttaactgcctgtgtgtgacctgatgccagacttctttctctggcattcataaccttggtgggtcttcacatttcatgccttggatgagggttctcatctcatgataagctaagagccaaggtcaaacccaaagatgagcctcagctgtaaggatgccgtccagggactcagcccggctctacagccttagcttggctctttctgagcctcagttgcatatcagaacccctgcaggctgtgtggactgtgtcctgaggacccaccctgtcctgtggggtgccatttctgacactgtgagcctcaggttgatgggcttgtagctctggtcaccccagaagccaccagggggagtcatctaggaagtcaaatggagaagtccttttgttgccagtctttgtttgcccttaatctctcacaggagcaccttggggtctttcattcaccccacatacttacctctcacctctaagctgtcacctttcaaagagagccttcctgatagccagcacccaggaacaagcaacctcccccactcccattcccctcaaccccagacacaagttcagtgctaaccgcggtcactccactgtgtgtgtgtgtgtgtgtgtgtgtgtgtgtgtgtgtgtgttctgtctgggaactccacaatggcagtgtctgggtctaagacatttctgtgtctggcccgagcctggcacacattggcagattaaaacaatctgctggaagcccagggagctggctcagcaggtcaggggcttgctggacaggtgtgggcgctgcccttgtaaacgccaggttcattgtccccacctgtaaatcccagc

SEQ ID NO: 29382 - DNA, 3086 bp, Mus musculus
aatccgctttcctaacagactgctccgcctcctaaagtagaagtgtattttgcatgaacacacagttactcaagactaggagtaaggctagacagagtaggcctctccagtacacactcctgagcagtattattctaaactcctctacccagcccacctaccctaccctgccctgcccatctgctgccctccagtttggaggcacttcgccacaagcgtgtcacccaagaggcagtttgctgtcactctggagccccgaccatcacgtcccttcactgtgtagatggcagaacttgaggtgctatgttccaccattagaaaagtcgcctgcgacatcagtggaccccatgttgctgtgtgcatggtataggaacatttatgtactgggggagttgtaatattgtgtaaggagtctggaaggattactactgtgtcagacgtgctgtttcagagtagtctgttctggagtgtctgagtgagaaggccacttctgtagagacactggtttctaggtagacatttaattttgactaaaatgtgtcatttgtataaattgtaacatccgatagatactacatagaaaatgaaggactgaggggttaggaaggcattttcaaaatgacaagagaaggttgggtggggtctctgtctatcttgcctgctgtgagggtatcacccaggcccacttatccatctacagcgagtagtatggcggccttccttgtaacaggctttttcttttctctcttcgtggtgcttgggatggaacccagggctttgtttaggcctgacaaggctctgcccctgagctgtgccaagcccacctccctctgtgtacaaagctcctttcttgggtgaccaacatcttcctgtctttgagcaaccaaggccagcatgcgagccacccagaagttaattaaaccaggttcatcgggagtttgctgaaatgttaagcatactctgttctagagagggagtgaagaaggggccatcttaaactcccgtgaggcccaggcctcgtgctcctgccccacctccatgtgcatcagactgggtgagaggtccttcacttgtcttgggataaattgtagttgtcttagtgagtgtgtatttccacagttttgcctcatgtcagtccccacgcggaaggatagccttctgtgttcttcttgcctttgttttgagacaggatgttactctgaaaccctggttggcctggaacctgataggtgaccaagccagcctcaaactcgtggcagccctcttgcatttgcctcctgaattggagctaggattcagcctgcaccaccacggctggcttgttttctcatctctaaaaacaaagtctaagctaaaagttgtttgcagtctaacaaaggggaatgagctttgtaaaaccagaggcccctcccgcccagacaaaatggcctttctcagtagtactccagagcctgctgtgactttgtgtactgtgctacatttttttttagtgatctttttaaaaacatgttcaagaaatgctctttcttaaagtcgtctcactccacagttcgctgctttaaagtggccatgctttcccctacgctgtgctgacacttaaaataaatgccagctttatggaaccattctgactcatggcagctccctttgaaaacttaccaatacttcacctagcacgggggtcagggagagcttgacagtggtccccgtggctcagggagatgccgtggccacagctttcaccccattgctaatcagggtgtgagcaccctttatatgcaaactgggtggtggtctgtctggttccagtgggaggtaccatctcttctcctttgagaaatgcccctgcagtgtctccgtgggtggggtggggttgagctttgacgattccagagaagaggtctctgttcttctgtgaggggccaagcgagggctcctgggtcagagctgtactcacagcagagggtgtgcagacaggccttagtgggtgtgaggtgcccacgattgggtgtttattctctttggcttcctaaattgcctcttggttgctcttgccgtctctggatatccaaggaaagtctgtctaggttttggcaagggtagaattgttttcctttatagagagacacagttttgtcaaggaagtgaaaacggattcgagattggcagatggacagaagctttaaaaaggaagagcccacagcaagcactctgaccctgagccgagatcatggcttacagtcttgaaatgtgaactgtgatgtctccatgcggctgatgcaggccatgggccgacatctacagagtggctcctccctcgctcttgcttagcctccgatctgtataagccctccaccttggagccgggattttgagtggagtctgcctattttccagtggatactaagaaactattaaacagtgggaagcctggctgttttaagtaccgtcgcttcctttttgatatagatacagactttgaatacaatgcagtttcctcagtaacattagctttcgtagcagtttataccataagatgttctgactggtttgtacactaggtgggtcagctagtagaatttaggcatttatacttttcctgagttatactcccagaacctcctcagagttgcatgtagatagcatttatttctgcatatttaaaaaaaaaaaaacccatttaggaaatatctacaaagaagaaatgaaaaatagtaattattttttcatgaagattttggtccacacctcattgagttgtaatggattctccagtttcttgagttggcaataatcaacatttggtttggagagcgagcatgagagagcgtttgttagtgaaactcacagacttctaaaagttcattgctacagttatcaaagtgggggaaactaaaattaccttatcaaggaaaaaatattaagtcacaagccatatacatttagctcccaagccataatgccgaacagctttggagtatcgtacagaaagctcattacaaaatgcttgcgttttcttttctctggaacatcaacaccagtgtattgctggcagctattgtattaaaaaaataaatatattttca

SEQ ID NO: 29383 - DNA, 1519 bp, Mus musculus
cgggccccactgtgtctcaagacttaatatgtgcctgggttgggtttgtttttcaggagactgagagtgaagctgaagatgacaaccttgatgacctagagaggcacctgcgggagaaggccctgcggtccatgcggaaggctcaagtgtccccacagtcctaagcggacatgtttgttatgttgtaaattttatttggtttgtactcaattcaatttcaaaattgctaaaatgtgtttgagctttagactataacatttgttgtaataattgctaggttgaagttcaccatgtttaaaaaaaatggggggcatggatttacattacaaaggcgtccacggtgtattagtgacattcttccattgacatttagagtgaaatattttatgccaaaaaaaaaatctcttttttaaaaaagggggtttgactattgttggcattcttgtggttcctttaaatgcccttacctctcccaagaggttgttttgttttgttttcctcccttttctcttgaattttagcatccacataaattatgcttccaaccttgtataggtttgtaagcttgcccagaagtgagaccactgttgaagtaccacaaaagtttgaatgaacgagtgagtgttcactcttttgtctgtggagtctgctgtgtggcaggatcccagccctagagctgcagggctgccctgtgggacagcgcagcctaagctgatttggatctgggtttctcctccaggtagggttgttttgtttccttcgcccttttcttctctgtgtaaaggcgattccctagacccaggatggacccttcagttatagaaatttgtttatggaacccggtggctcccgtcatgtttctccttactcatccaattggtacccacaactgaagagctcgtgtatttggcgggctggaagggcctggacagtgtcttggtttcactgttttattttattttattttttaactaaagctatataaagcttgtggattaaacagaataaatttctaaatttaagaacattgccactcacatttattcgcctgcaggggaggacggagttcagggaaaatagaaagtgatgtcgcaggctctccccttcttactgaaataactaactgcagagatgtcagcaagggagaggggggtgtgttcttggaacatggaaagctggtgaggagagaggcagtttacagcagggcatggtgtcagtgtgaaggacctcccaggtggcacttggacctgaagcttgtgacaccagaagtctgagcctagtctttggaggcacagataaatttgattgtgacttctaatagatgaaactagaatacaaaatgcccacatctgaatttcaggaaagcctaagggtgttttgttttttgactgagacagggtttctctgtatagccctggccgtcctggaactcactctgtagaccaggctggcctcgaactcagaaatccacttgtctctgtctcccaagtgctgggattaaaggtgtgcgccaccactg

SEQ ID NO: 29384 - DNA, 3687 bp, Mus musculus
gggctatgttagtggcacaggcctgcaatcccagcagtgccaagccagagggtctgtgagctgggggccatcctggtctattccaggtcagccagtgctgcacagagaggtcactgtgtgtaagagctggcaagggggcaaatgtgactaaaataaataaaatggacagttcttttaatcaacagtatggtgatttaggctgccacttgggaaactgagacaggaagattgtttgagagctagcctgggctaatggatgaaactaagttttttgttgtgattttatttttcttagaaaaggctggcaaaatggctcaatgggaaaaggcacctgctgccaaacctgatgggctgaatcccatccctgggcctcacgtgctggaaggagagcactcactctccagagttgtcctctgaccccttcagatgtgcattggtttttaactgaagcagaagtttcatcttgtattcttaggccatgtgtttgcttcctgcagggaacaagtgcggagcaggataatcggttcagcaacaaacagaagaaactcctcaagcagctgaaatttgcagaatgcttagaaaaaaaggtattctgggtgggactcttgcagttgctgcattttaagggttgagagatgaactgttacatttgtgcagaaaaaaaaagtttacaatttgccaccctttagccaccacatatacagtacaaccaaagaatgagcatgttagataaactttagttaaacttttttaaatgtgcataagctaaaggaatcatttagacaacctaactcaagctcttactgcagtgaacttgtacttactggtttgcatgtttcaccaggtggacatgagcaaagtaaatttggaggttataaagccttggataaccaaaagagtaactgagatccttggattcgaagatgatgttgtcattgagtttatattcaaccagctggaagtgaaggtatgacatgcagatggctcttacttctgagtatgtgacatgatttgtgaatctgtggaaactcaggttttctgtggaatacaaatgtagaagggttactgtacaatgtttgttgtgagaagaattcactttgtaaaacagctgttaaggctggaggtctagtgaaggtgcatagttttgaaagctacacaggtgaaaaaatcaaacttactgtttgtaattttgctgttacatgttaagttactttgacagcaattttctaatgataatgtgatttatgatttaaaaggcctgaaccaaaatggaagttattccttgcgtctgaagtatagcaccatcaccttattaggtcacagcagagtgagtgtcccaatgtcgctctgacccaactcccttgatgacgcagtgtgtgtttggaggtgagttgtgtaaagtggccgaacatcaacaacaacaacaacacaaacaagagcaattggtaaagctgtgtactgctctttaaagtagcattttgaggtggacatttatttgaagcatgaggggcgatctgatttgactggatgttgcttttaaaagaactgaagactttagttgtagttacaagtcagttgcttaccagttagaattaaggcacaggattttatttacattgtagttagaagttcaggcagatggattggcagtcctataaaagccagttaacataattgtttctatcttccaatatgaaataatacaagatgatataactgtttacaattatttctgttgtaacatagtttgctattttgtcatggtacccaaaggacagtaaagccgtaccataaaaccttttggtaactgtactgacgtgagtttacttttacattactcctgttcccaagagttcatgcttgaattttgacagaacagttatcattccaaacgataaggtatttcatttttaaaacaatgtggtaattattttgctttgaatgttttttaagacttaattttaagaaaggaccttatgtttaagtatatttatttatttcctttagagaccagaaacatgggaggatgttttttaaatgcttaatttactattttattagagaaatgctttactgacttgaattttagtgaactttaaaacctaaatacctggtagtattcccctgtagtgagcatgagattaaagtgtagagctttttaaacaatcttttctttttttgtggttgtgtactcattattgcttgttcgtcttttgcaatttagataaatgatataacattaaactcaaggtggttgagttgcagtagggagtcggaagcaagccaagggaacatctttctctacaggggacttggcgattccaaacccccaaggttccaagaagacactgaagacacctggaatctgtacttgctttgtgctattgagctgtgcttgttatacggaccttgttgcttgaccaacagaatctagtgtttaaaaacccaaattacttgtagaaatcttgactcttagttttgtggacagttgagcatctgtggcattgttagtaacaggttgtcatgtgcagtagtcaggcttttagcttagtcttcagatgttacagagtgcatgcttaactcgttagttcttgtaactgagcactagatattagatagtttatagaaagttacctgtagtgtaaagagaagtgtttatgtacgttttcaagttttggttggggcaagttttccagccaagcaaaaactgttagtaaatgcaagaatttatagatgttccatgattgtttttagagttgataaatgcataagcccactaacagccatacagtctaaatacttaggaaatccacaaaggctgctctaatgcttttggttcagtgagggagaattggattatctagaaattacattaccaagatgcaactagggaaaactatttttacagtagtagagcatatatatgtacctaagccccttatggtagacttaaatactaatttaaatgaatttcagataggttggctagtttcgaagtaacctgtttttcttcctgtcatgtctttttgcagaacccagattccaaaatgatgcaaatcaacctgactgggtttttgaatgggaagaatgctagagaattcatgggagagctgtggcccctgctgttgagtgcacaagaaaatatcgccggaatcccttctgctttcctagagttgaagaaggaagagataaagcagagacaagtaatgctttttgtattgacttgagatgtcatacacggtcggatggttaccctgagggctttgtctctttgagctactgtagcctctgatccggctaggctagtttgctggatgtgtctgcccactgagttgtggcttaccacatttgaaattagagtggcgtattcccagaggcagtgacaattggacagagtgctttgtttttgtttttctcagttcttaaagtataagtgcatttaccttaaaagggagtctaaataaagtatctaaaaagtgtgtgcaacttctcgcacaggtagtaattataaagtcccaagagagtgactatataaatgataagtgaaatgatataaatggtataagtttacattaatgataaaggataaatgaaagagtgttgtaagagtgaacttgagaacatggaacaccttgcagccagtcacgcctgtgaaatggcagttggagcacccgtgtcagtacctta

SEQ ID NO: 29385 - DNA, 1196 bp, Mus musculus
tgcgacgcacatccggcgaacacgcgggcttcatacgagctgacgctgcaggctcaaccccgccggcaacctcccaaaacccactcctagctcaactttcacaatgacaacaactggcgtatcgggccgcccctaagcaagcattctcttttatgactacccatgcaccccaggactgaggcttcccccccgccccccatctcccttcaactccccacatcctcccactacggatcaaaggaaggatcaactcaagtcgcgcgaacaccgctgatcatgcgccacaaaaaaaaaaaaaaaaaaaagatcggtagggttgggcgacccaaagattctccctcctctttccattggttccagtcgcccagctcgcctcccctcctagcgaaaggctgccgccctggtgcgcttgcgcatgcgcgtcgttctcgtggcgcactgagcaggcgcagccgcaggcccgccggagcggggcgggtgtagcggcgcgcgcagcctcccggcgctgggctcccttctgccggtcccgccctccgtcgcggcggcgcggtgcacgctgggatagggagcgatctccgagcgaggcggcaagatggacgcgggattcttccgcgtaagtccgagcgcggggatccggggagaggcgagaggcttgtttgtaagacccgagggggaggcgctcaaaatcccggacaggacggcccgcggaggaaggccttagagaccccgagggggttcgtgggcagcgtcccccggcctcggcgttgcggccgagaccggtgcgcccctgcgcagtctcctcctccgggatcgtccccccctacgcggcggtggcggtggccggaaaatggcggcgggaatgggctggagccgaacctcaccggccgcctggcgaggccctgtaggccgggcgccgcgccggccgcccgggctcggggcctagcggagcctcaaggaggaagtctttagggggaggccggtgggaagcccggggcggctgcggggtaccggttgtatggtttggggctccgtcctgagaggtgtttgaggaaaggggccttattattttttttttttagtggcagctttggagaaaatgggtgccccccccccaaaccccgacgtacagcgtccaccctctgggtcttaagctttcccggcggcgcagggtcagagttcgtgagcgctcccgccca

SEQ ID NO: 29386 - DNA, 1147 bp, Mus musculus
ggtgtggtggccctggcctgtaatctcagcctgcaggagactgaggcaggaggattgagagaacggggctagcttgggctacatgagttaaaccgtctcagaataaggtttttcctttttcttggtgtgacagtacagagcaactgggaaaatatttacttctagccaagaagtctgttctggactcattctacacaaacttaagtacacacacagagagagtacgatgtatgaaccttgagcaaccacatgacaaatgactgttggtgtttcaaactcccttcaagagtgtgttctccagaaaagccatccctctcagagtgccactgtttccctcagtcttgagtggagcgcagttcatagtcaggattaccgtgtattcagcacagtgacataggctgtcctctcagcgcttgggaggcagaggtaccagggcttggcaagcttaaggccagcctgggccatgtaccgagaccctgtctaaaaacaaggggattcctgggtgtccaggtatcccagggacagataacagcaactgtgcatcttgtccacggctgggaacgtgccgtattccttccctgtggtttctagtcaaggctagaagtgatcccagatacggtcagcatgcagacaccacctactcactcgggttagtgctttctcttggaaacctgcagttcttgaagtgggtcccgagacccttgcaggtcccacatggcctgacctgaccggatgtgcgtttatgacacaggggggtttcttttctatctatgcagataatttgtggttttctgtaccgttccctgttggcacccctcttcctaagtccaattgaggactaagggaccacaggtctcagtcctgtgccgtgctgtgccctctgctgtcagcctctgagtatctattcacgtcatgtgtgtctttgacgtgtgagaacgcattcacagctgttgcacattgatccccacaactgaacctgcagctggattaagtcccgaatccagcatgtctgtaatcccctggtctgtgcactgtagtatgctcgctgcacgtgtggaaactggtcagtgagcctcatccgtgtgtcctgtgatttcagtatcgttgatctgatgggccacagttcattatcagcttcaactgtcct

SEQ ID NO: 29387 - DNA, 1828 bp, Mus musculus
gtcctgcctctcttggcagtcagtgacagtggtgtacaggactctgctcccagctcagcccttcccagcctcggctctgctggaggaatctccctttgccagtgggatgtgtcaccgggaagcttggctgaggactacagagttggagtctgtggggcagctcttcagttactctcttgaccctcctaatgccggcctgctactgcttgaggtttcctgtgctgtgcgtgtaatcaaggacgttagtcgtcttaactttagaagataatgataagactttgtgaagaccgctttaaatagggagagccagtttgcttttgttttcttcaaagacagggtttcactttgtagctcctgggcctcaagtcctctgtgatcctcctgcctcagcttcccaagtgctggaattagaggggtgagcaccacacatttcaaagttttccattcaagtatttcagctgttcagaaagaaaaatcacctgtcctttcccccatggattagggaaagtaatcattcttttgggggtggttgggtttgtttgtttggttggttggttggttggttggttgattttgagataaggtttcacgctgtagctcatgctagcctgtcactcattatgtagcccaagctggccttgaggcccagaccactctctttcctcaggctctgtttgtttggattgtaggcatgggcttgttgtagtctatgcttcctcctttaacaatcatttccacctttgcttgcagttggccctcaggtagaattgcttcttacacttgaagatgtgttgttggggcctccataggtcactcagcatcactggtcccttgcagactttcctgcctttgagtgctgggctacaggtacatcagctgctccactcatcaagtattcagagctggctggcctaggtgaaggggctgggcatagaacagagaggaacatagctgcaactgcaaagaaaagaacgtagagaaatgaagccatgagagccgtgtactttgcgtgacatgttagggctgagtccttttgtggtaggattgatttcatgagcgtgcatgcatgagctcacacacaaacacacgcacacaggtgcattgtctgtcattaaaaccgggtcccatgtagtccaggttgacctcaaacttgctgtgtcccaaggatgaccctgaactgctcctcctgcctctgtctcataagtgctaggactgagggtgtgtgccaccatacctgacaagaacaggagagtgtcccttgccttcaggtcctgtggaatgctgaattctgcgtttgccattgggagccctccgtgcagattcagttgcagattacgattccacccgcattggtttttagatccaagtcatctgtcagataaagtgagtttggttttgaggtgacagctcagtgtggcccaggttggtctcaaacgccaggcctcagtgggtcttcccagttgactggatgcaggcacacagctgctgtaatcctgagactttggaggcgaatgcagtagatcaagagttcatccttggcttacagtgctttgcagtgctgagctcggcagtgtacttcatttgattgtaaggtagaccctagctgccagcaagtgtgttctcacagttggggagtttgtgtgttccccgttatacagtacacgttctctctaattttctatgtgatcataaccctgttttaaaatttgtcttggctttcattttctacccctcaatgaaagaacattctttttttttttaagtcaagaagttcaaatctgcatacttgatgctaccttggccactggcagttgtgttgccaccttat

SEQ ID NO: 29388 - DNA, 1140 bp, Mus musculus
cttctccaccccttaccctgaagccaggcattcagtctgtagcccaggctgatcttgaaatctcagtcctcttgcctccacctctggagtgccgggattgcaggtgtgtactactgtgtccagctcccatcggaactcccctggccacattaaatgccacagggcctctctcccagccacaaaggcactccaacaggggcatcaaccatgggatggaacttcatttgttcccttgtcttcctccccaaaccccgatccgaatctctgttctgcgggttgggttccagattagacattagaacagatgtgattgcacactgctgctttcagaggtggggtcctgactccacgctgtggcctgatggttctcacactctcagcactaaggtttggggttcatcatggacctgagtactgggggtcggggggaggttgcctttccagtggacctagccagcttgagggtattgtgggaatagacgcaggtggccatcagagaaggactgggccctgctcaccctgcaggcttgcagatttcaaatgtgacccaactctaactgacaccgaaaccaccctgtaaatgaagtcactctagaacatagtctctgtagatgcttatattttgttaaatgtcaaaactaacacagcatgtgttattttgcagaagtgtgtatactgtgtgcagataacattgtaaagcggtatttaattaaaaatccaagcagttcttgcagagttcgggtcctgtgttgcactaatacttcagcagctgtctagtagaatggtccatgtcatttctgtcttgtcatccccacgtgactgctggccactctaaatatggctagtgtgcccaagaaactaattttatactttgcatgtgcacacatgtgaatacatgcatgccccatgagtggagttcagaggactttggggttcagttctctcctttccccatgtggggtccaggcatcaaactggggtcattaggcttggcagcaagtgcccttacctgctaagccatctcattagccccaaaatgtgtcaccactaagccacacccctgcatagttcctccctgttactgcgctaacataccatggtcaaagcaatgcatgcaagtccgtttattctggcttatgg

SEQ ID NO: 29389 - DNA, 2098 bp, Mus musculus
gacagcatttctgagctctacaccccggccacactgcccgtcatgcaggaggagcacagctccaggagcacccctggggttccctaccgcgtcctggagcacaccaagaaggaatgaccggcctccctttggggtgtcactgcccggaggtcacccatggttccgttcttcattgcccaaactgcctttcaagtatcctggtttcaaacggagaactctgtgcaagatggccttgcaaggcccctgtctctcgggcagagaagccattcgatgaccttggctttggaaatttcaaatagtagggggagaatcccaggtgggctatgtggccggttatgctagtgggagttgaaaccattttacctccttggacagtcagtgagcgtcaggtaacggtcacaggttccacacatttccttggagtaaaagcaagacagagtgagtctgccccctctttgcaaatccagcaaaaggctggcgacctccaccgttggtcttcctctacccagcacgcatgtctcagctctacctagttcactcaccattctgtaactctgaggacactgctgtcccttttgtcaaccctgtgtggaaaaagctgtcgtttgcaccttcctggcggacatggaccttcccatcgcctgggtccatctgtgaagaccgggcggtgtctactgggtctgctctgaaaactggcttcgttccagtccttagagattattccattgcttcctctctccaaagaagccgagagaacagaggcagagggggacaggagcgggggtgggggtggggtgtgtgtgggggtgggccgctttcagcccactctgtttccggctaattagaaaggttggaagagtcggagcctcctgaagatccacttcagcctcctccccgtcctccccttagtctcccgctagctaagcctcagctgcaatttcacagcctggttcaggcagaacaggcattttcacacacaggtctgcagctttcttcctgtttattccgtgagtggcctccccctcgccctccccccctccccaaccaatgcacacacttgagagtagctggcaaaggcttgcaggctttgacaggcattagaattccagaggagtttgtttaaaatgtaagttccttgcgccaactggagtgacctgggtcagtgggcttgggatgggacccaacggcctgcatcagctcggagatctgagccccagagagcagagagcagaccccctcagaagccttctcacggaccactaattcccaagggaccacgcggcccagaaggtttaaacctccagtttcttaccctctcagggctttataggcaatctatatgggctcttcggacctgtggcagtccctacccagtgaacaccactggagagtggcagtgttaataggtcagtgtttgatatgccgtcctcggcatgtctcttcacgcccaaacagtgctctgacttcagaactctgccatctgctacagagcctacaaccacttctgtatttcttcttgaccatgtctgtattgtggctcgcatgcctgaggttgaaatgggaacagagaaagggctcttcaactcagcccaacagcagtaggccccgggtgcttttctgaggtcctgggggctgttttaccatatatctctcacccacaaagctccaagcattatacatagttctgcccaccaggactgcagggggacggacacaccaggaaccttgggcagggcaggctgtgtggcagagaggcatagcctcacggaggtttgccataaggctaagccctgaactcaatagttgttccgattggaaacgatttccatgcaatcatggtggaaatatagctaagattagagaagtgggtgatcacatgctccccctgaaaggaaatgggctgctctggaaaatcaggggtgggaaccagggttgccaaagagcccagggatgtgataaaagatgaaggtcaaaagacaagcagtcttttgaagcacagtggctcacacccgtcacttggaagacattattctttccttcaggagaatagccgcaaattctaggctaacctggactaccaagtgagaccctgtctcaa

SEQ ID NO: 29390 - DNA, 1194 bp, Mus musculus
atgtttaaaacacagagaggcagagacacatctgaaatgcagagttataagggaggacccgtccagttaggagacatgagctttgttttattttatgtgtgtgtctttctgtgccccgttcccaagggcatcagaaggtgtttcttctggatctggagttacagatggttgtgagccagcatgtgggtgttgggaatcgaacccaggacctctgtaagggcagtgcgtaccctgaaccactgagccatctctccagtttaggtttgggttttagctgaagagcctctctgttcatgtctccgtctgccatgtcttttgtttttgttttaatatttaagatttggcggcatgttttttcggaaggttttggaccttggttgtttctgatctccgtcctggtgggctactcccccatggcgctgacagtggattgctgcccccaaagcacttctagaatggccacctgcccaggcacttgttgacttgctctgcaggaatttgcatggcagattccctgttgtctggttgctttgagtgtgggatgaactgtgaacgtgactgagtaccaggtctggtactcatctctgaatatttcctcggatgagttttagattgttctctatgaataggtaaaaggttttactatcaaactttggtgttcctaatgaagcatatagagactggaacccgttttaaaacttgtttgttttcttgaattagttaacttcttagtttcatttccattccctatgataggggagaaattcctatttccaggttacaacccattctagcagggaaataacagtgtcaagagagggaactgctcatgtggccttcgtaatcagggtcagaaaacgaagaatggttgagggttagtgctcagcttgctttctctgcttctctaggacccagatctaagggatggtgccgcccacagtgggcggctcttcctgcatcaattaacataacgcagtcttcacagacaagcctgcaggccaatcagatctcgacaatccttcattgagactcttcccaggttgtgccgagctgacagtgaaaaagaaccatcacaggggctggaaagatggctcagtggttaagagtacctactgctcttacagaggactcaagttccattcttggtacccaagggatccagctcctctcctgaccttctcaggcaccgcatcc

SEQ ID NO: 29391 - DNA, 1206 bp, Mus musculus
tgaccactggaattcctcatcttacagcctggtcttgagggtcacagaaagctacagaagtggcctgtagcattgctatcaagcttgttgctcagagggtcatgacagctggcctggacgcatagtaaccatgtctccctcctctctcttccagcatcctggttaacatggacaacaacatcatccaacactacagcaaccacgtggccttcctgctggacatgggtgagctggacggcaagatccagatcatcctgaaggagctatgagggcccggcctcaagcgtcccacacccggggcccggctcaagccacgtacaacctcttctgtgtcagctgttacttgaaatgcctttctttgggaaagaggtctcgcaagcaaccaactcggtgatgtccaagccagggagagaccaagaaggttccaggatctaaatgtcccacccaggctcgaactcactccagagcttcctgaaagcacccagcccaccggagagtctgagcaacacagacccaactgcctgctttctcttctaagtcccgctgcagaggcccttacaggggacgggggtcacaccaccttctctgcagggctacacccgctgtctcgatcggttctgacgttcactgtttcctttctaccaacttcagaccagagagttctcacactttggccaaataacttgaaaactcgtgactttcacagcagatgcctttgtgaggcccttggagaggaaactttcttattgacttcctcggcacaagatgtaagtcaccatcatcgagctgacaggaacaaatacccttgccacctactgttgtacacatttcttatttacagttttcattatgtgattatatatatatatatgtaagtatatattatgtacatatatgcaacattttgtatgtccatgttacatttttatcatttcaaaaatatgtatttcatatttcttgaactatttttttagctgttattcgattatgcattttgtatatcatagggtttagtaataaaagcctacccatgcacacttccccggttttcatgcgcttcttccttctgtgagactccagtgagtctcaaagacccagaagagaggctccggttggagaggcccttcctctttctcccttcactgtggcttgtcccaagggcttcatgtcctgtacatgaaggctgacaatgggcatggcatattt

SEQ ID NO: 29392 - DNA, 1183 bp, Mus musculus
tgtctagctgtggagaagagaattacctccccactaatggagcctagcagcattgagaagattgtagagatcgatgctcatataggttgtgccatgagtaggctaattgctgatgctaaaactttaattgataaagccagagtggaggcacagaaccactggttcacctataatgagacaatgacagtcaagagtgtgacccaggctgtgtccaatctggctctgcagtttggagaagaagatgcagatccaggtgctatgtctcgtccctttggagtagcattgttgtttggaggagttgatgagaaaggaccccaactgtttcacatggacccatctgggacctttgtacagtgtgatgctcgagcaattggctctgcttctgagggtgctcagagctccttgcaagaagtttaccataagtctatgactctaaaggaggccatcaagtcctcgctcatcatcctcaagcaagtcatggaggagaagctgaatgcaaccaacatcgagctagccacggtgcagcctggtcagaatttccacatgttcacaaaggaagaactggaggaggtgatcaaggacatttaagaaggagccgtccttgaacttctgtgggacactttcagttctaattgcccttagactttatttccagctcttatgtcatggaaaatatccagtatatgtgtgtgtgtgtttttatgaagtctgtacataacagcaattctcaaataaaaaaattaaaaaaaaaaaaagagttgctgtggtcatggtgcctcctcacagcaataaaacccaaactaagacacacagctatagaaagaaagaaagaaagaaagaaagaaagaaaggaaggattacaaagtaaaccccacaattaataacttatatctgacccgacatgtttcaagcagagattactggcattggtatggcatgacggcatccatggtgccaggtgccaaggcaacaacacacgcaacatagctggacacgcctcagatccaatacacattgcatggcagaactctactgttgccaatgcttttgcaattctcttcattcagtgatgcgactcccccttatggggtcataaccacagtgtaagacgctgaaatttagaaagggggatgcttggtttaaggttcagagatgggaatgtggggtcacagagccctacagg

SEQ ID NO: 29393 - DNA, 1473 bp, Mus musculus
ttcatatccatatttggtagaactgttaacctagaaatgtagcttgctaataagatagaatgatacagaagtgaagtggtagccacattacaacactgactgctcagacacatttaggttcagggtggacctttatgtcttgtcaagatgtctaagcccatgatgattatttatgatgcaatgtggaatagttcttttgttaaatccaccatctggggattgatgccaactgggttaaatagcgttttcagggagagtgcccttttcactgaaacatggagccttcactgctttccccacctcaatccctgctggtttctaagatatggaacattaaagcataagggaaaaccctcccccttaagttgtgagtgagtcagtgatcacagaaaccattgtaaggggaaaagactgttcttagcatagttgctctaaatttaactattgttgatcattgttatttaggggttttgttttgttgtttgttttttctgttagaaacaagtgaactgtttgaaaatacatttttgtttgtttatatgcatagtgtaaaacaaactgaattttgatgctcacagcacttaccatgtgcgtttgtatcaaaatctgcctgttcttcataggggaggcttgctcttcacacctcagtttattcatgtgagacaggctgagaagataacactcctaggtgattttgtggtgccgtggatttttggggaaagttgagttttaagcaaaagccacatcacttagtttttggtaatgtaggacatgactaaaaaataacgaaatgatacccttaaatatttataatttctagtatttcaagattgttttggaggcaataaaatgacttgaaatgtccggtgtcatttcagaatacaaagctagtgtctctaagatcttagattcgttgcttacagatgtgagtgaagatactgtgggggacgatcctcctggaggattaccttatttttttcctttcgattttgtttttagaaatttagtccttgcttgtagacaacaaaagatggttttaagaactgtttgtggaatgtgtttggagggttaattctagaacctttgtatatttaatagtatttctaacttttatttctttactgtttgcagttaatgttcttgttctgctatgcaatcatttatatgcacgtttctttaatttttttagattttcctggatgtatagtttaaacaaagtctatttaaaactgtagcggtagtttgcagttctagcaaagaggaaagttgtggggttaaactttgtattttctttcttatagaagcttctaaaaaggtatttttatatgttctttttaacaaatattgtgtacaacctttaaaacatcaatgtttggatcaaaacaagacccagcttattttctgcttgctgtaaattaagcaaagatgctataataaaaacaaaatgaaggaaataatgattaactggaatta

SEQ ID NO: 29394 - DNA, 1212 bp, Mus musculus
atttatgggttaacacacaacttctgaagaagtcagacagtgcatttagcatatacaaggttgcacagttcagtttcatggtctagggtcatccaaactatcttgggcatttttcaaaagatagcggcgcagcacatgtcccagtggtcatttcttaaatgcagtggataagtacccagagatgtaccaagtctattctaaaaacagacagtgctgactagcaccccacaaagctgctaaagtgatcctggcctcacctatatacaaagcctgtttgaagtagggagttgtgtttgtgacatttaaagtcatgtaaatacatgtaataagcttgtaacatatgtaatgttttcttagcctttattctacaaaaataagactatttttagtgtgaatttgatgaatgtaagaccatgaactgttttttttttaaaaatcttatggcctaattttgaaggtctccaatttttaaaggttgcccttgtgcttaagtgccagagtgaatcaatgtaactgatgtgtgaaatctgttgtattaagtttttataattgaaaagatttaagctacatttcctgtttttttttaaagagatataaagatgtaggacaaaacttcctccccaaccatcttaaacccaaagactcattttggctttatcaaccctaagtcacccctgcctgattatgtgcaacccctcattttcattggcaaagggaaaaagtctcttgtgttattaaacccagtaacaattacttctcaatctttatgagcagaagagctaaattgtgttttctcaattaagttcagagcaagagttcaagtcaaacattgagtatcctaaaggacaagttcacaaaactataatctgactgaaaaataaaattcataaataaacctttcctccctagtacattctttttatgtaagtgatttatgattgtctacttgggatgactgtgatgctactatgctgtttgacacaggtctctctagcttgaacgctgagattgacagtgtgcacagccctgcccagctgaactatgcttcctctgtgctgatggggaatttaaacattttatttatgactattcaaactaccgaaaatccttgtatgtaggcagatatgagttacagaacagcaagtgctttacctggtctcaaaaccaaaagtgtaattagcttttgcttatttgcttaaacaatcccacctg

SEQ ID NO: 29395 - DNA, 1122 bp, Mus musculus
tctaggccagcatgacctacaatagtgagttccaggaagaggcggccatggaagaaagccacgtcaaacaaagtacaggtcctactcaagtgttaagggaactgggtgagagggaggagatccttgctaccatttgctggggcacaggttctgggtaggagccactctgtgcgtgttgagctggctggagaagttctggagaggcctagctcgggcttcctggaacgggaaatggatgggatcaccacgtcgttctccgttctccattgcaggcttaggagacacacaccttccctctgccgtcccctgcttacacgcttacacgcgtcacggtgaaccctccacgcaggcaagctcgccctggatttctgtccgtgcgcacgcacgtctgcactggtcggtgctagcagaggagcctgctcaggctcttcatcctctctgctgagctctggtaccctgtcctccggccccatttgtcagtccagccagaatcctccttccccctggtgtttctttcatggttcagctttctcccacggcctcctcttcctggaactcactattgtaggtcatgctggcctagaacacaaagatcggcctagctccatctcctgatcagattaaagttatgccccacccagtccatccctccggacgtttccctctccctccccctccccctccctctctgtgttgtggaggtcaggggacagctctttggaggtgtttctagaaatgggctcactgcttttcctgtcttggcaatcttttcctgatgccatacattccctgccctccctttcttggagtgagagatgctctttggcctatacagtctctgtgctttattttattttatttatttattttatgaatgtgaatactctatctgcatgtacacctgcatgccagaagagggcatcagatcccattacagatggttgtgagccaccatgtggttgctgggaattgaactcagggccttcagaagagcagccagtgatcttaactgctgagccacctctccagccctcagtctctgtcctttggtctgtggcttcccttgaatagtcttacaaactttacaattagtatgtcacaaataattttaccattcaattt

SEQ ID NO: 29396 - DNA, 2338 bp, Mus musculus
tttgtttttttctttttgtcctctatatttagccttttactttccaggtcctttattaaagttagatgagcctagcaaaagccattcttgtcctgggtcagctcttctgagtagacactggtcaaagggcaccttcagagccagtgtgttgctccaagcccatatacagggccaggagtgagagtgccagaatgcctgtcctccagcgagcctccctgttaaaccctcagagttccttgatgggcgcttttctttcttcagtagtgtttgctaaagaaggctgtttgcaaagtctatagtcctttgtgcatcatcttcaaatcacactcctcttccctgttttcaggcttgctggaggacagacccttaagatatgaatttatgtaggacctcagcagttttataatcctagtttctggttcagtattttacatacacacctgcccttattttgcctttccctgcactgtggggaaacagacatagcagggcttttgtagctctgagtgtgattttggggggttgaaatgccagcactttattctcttgttctctatgaattcctaccaggagtgaatgatttaaagcactgtagtgctgtggaacttgcttttgtttgaaaggaaaggtgctgatgtgcccagaggaacggtattgtgctgtggccagcagagaactctgtgcagcctccgccttctgagtgttggccttgggaagggtggatggtcaccctggtcccagccaaccagttcaggaggaagattccctatttctaggtcgcataagggcaaggttagagctaggaggatagtgccagcttcttccttcctgtcagaaaacgtggaagaggactcaattggctatgagccaggtgaaagacactatgaacttgaggggacagacagcactggcactgtgcctatcctgttttagcaccctcaagacctcaggctagtgaagactcccaaggcagtccaggaaacctgcacagataaagctaggcccaccttactgtgcattgctatgctgggtccctgttgccatgggacacaggtattgctaagtaaaacattgtttctcttggttgcttgtttcaccataccacctctcagcctgacctcaaactctaacatcaggtctcttagctgacgttaaagggacatttgtactaggagccaggcccctgctgtctagaacagcctcctttctaggtgttgaccacctcagatttatgccttagctgtgtttcaagacttccctttgccattttttcctattgcaggttcgattgtgtatgatttaattccctttaggaatttgtaggcctagggaaagaaaggacatgcatttgcccgtcccaatgtcagcatctggtttggcacacaaagatttctgaggcacccagtttacctagagccagattttctagcccttcaagagtgtctgtgtcagggataggactgctgagaacagtgagggcccagtgagcagctgtctccacagtccctcaccccatgcacaatggccacaaagcagacacagtcatgttcaacttttggtcacatttgtgaagactcgtgcaatgttttctgtgctacactacatacaggtcacacatgatggactagccctttacatacagatgacacatacagaatagccctttgcgatccttggcgttccaagggctctcaggggctcactttctctgttttggaggcaggaggagcaggagtgagcaccaccctgctctgcatttgtattttggtcccaaaatgtaaatacaattttctatgttacttttttgtggtaactacaagatgaatattttaattagataagttatacaaaaaggaaaatcccatgtctaaataaaaagcaaaaaaattctacctgctgagcctttcctcattttgtaagggaagagaggccaatcaccagatgcctgcttcactaaccactgatggagctgcaagctcagcccagtgtggaggcggggttcagccgatctccgtaggagagattttaagggagcaaacatcttcagggggacaaagggagctaaggtggacattttctgtgtatggtcaacattcatgcagggaccaaaggaagattgccatctctcagcctcccctgggaaggctttaccactctgttggcgttggcattctggaccttgtctccctcacgtcagacaatacacattcactcaggcatttacttgcttctttatgttttgttttgttttttggagaaagggtttccctggctgtcctggaactcactctgtagaccaagctggtctcgaactcagaaatctgtctctgcctcccaa

SEQ ID NO: 29397 - DNA, 1200 bp, Mus musculus
tggctgggtaaattagagatggaaagctctgttttctgtgttgtggacgatgttgactgacacgctagatgccgtgcaatggaaataagacattacctgcctcttgtgtccccgtcctgcagctagatacactgtcaggtcctttggcatccggagaaatgagaagattgctgttcactgcacagtccgcggagccaaggcagaggaaattctggagaaaggcctgaaggtgaggctggtggggtggaggctgctgcattgtcagagatgggctatatatacacacatacagtgccttggcgtttcagagatgactgttcctggatttctgtccttgggattttctctgctctttggaagtggggatcgtttgatggcatttgtagctggggcatgacttggttaggggagggatacctgtgctcctagctaggactcacagagttttggttttgctctgggcctactgggtgttgatctgagctcatgttgggctacttgaacatgatggatagcatggtcacttctgtgtccattcaggtgcgggagtatgagttgcggaaaaataacttctcggatactggaaactttggttttggaattcaagaacacattgacctgggcatcaaatacgacccaagcattgggatctacggcctggacttctatgtggtatgtggacttctcagtcccaagctgcctgtggggagaggtggctcctctgtcgacgtccacacatgctgtcctgctgttgggatggggagctgggttgaagtctcgtgtcttgtctgcctgtgtgtccccctcagaaaagggccttgtagcaagtgtagaggttccggggtttattccctgccgttgcaaagctctctgggtcatcctgggctgcatttgcccttcgaatttgcttccctgtctccactcatctccttagcctggggcacaggagttctgtgaggaagtcatggaaatgtggggggtgcagactgctcaaatggggattgtcatgtgggaatggccgttatcatagtggaaagcgctttgggggggtatgctgcttttggcgacttaaatttttccacattgcacatgtaagtttttgttttgaggcagggtctttgatttacagcctaagctggccttgaactccctgcatgtatatctgcaccatgtgtgtgcctggtgcctgtggaggccaga

SEQ ID NO: 29398 - DNA, 1149 bp, Mus musculus
acactcacacacacacacacacacacatgcacagcagtgtccacagctgataagaagcagggctgaggtttgcagccacattcttgttccccttgctgtaatcccagcaatgtgatgtgattgtaatatgttggggatggaaccggggacctgtgtatactaggcaggtgttctactgttgatgtggtgtgtgtgtgtgtgtgtgtgtgtgtgtgtgtacatataactatgcacacacattcatgcctgtgcagaggccagagcaggacgtcaggtgtctccctctatcaccctctgagttgttcccttaagatggagtcattagatctgaaattactattatttgtccagactggctggcctgtgacctctcgggatcaacctgtgactctcttccagttctaggggttataggcactcacagccacgctagcttttatgtgggcactggggattcgaactcaggtctgcctacttgcagtgcagtcagtcttaaccactaagctatcttcccagcctttgctttgcttcaatgtcttgtttcgtagtctcaaccgcatggtacttctgcctctgcctgccaagcgccagcatgagaggtctaagccaccatactcggcatgaaagtttgctctagcttttcctgtaggaatttaatagattgagatcttgcgtttggtctttcgtctactttgaactaattttaagaaatggtttaaaggtccagcttcactcctctgcacgtggacacctcactctccggggaacatttgttgaaagggcggccccttggggggtggggtgggagggccaatgctttaaaaaaaaaagatttattttatcttctgttgcttatttgtgtgtgggtatgtgcatatgaacacaagtactcacagaggcccaggaaggcatcggatctctgggatcaggagctaccgattgcaaggtgtaggcgctgtgaacccagctcgggtcctctgcacaaaccacaaactgcccccacttcttcagctcaggagattgctgtttaaagctaggcattatcagggtgtcgtgggctgatgtaatgatgtaaggagagttggggaagctggaaatgtaggaaccagaaaatggtttccgtagcagtcctgtagggtagcaaggtgg

SEQ ID NO: 29399 - DNA, 1485 bp, Mus musculus
cacagatacagagatacatgccaagccacagacagaaacacacacacacatacacacacacacacacacacacacacacacacacacacacacacacacacacacacacacacaccacacacaccacacacgaacaactttgctttggcttggcagcaactgtaagttgcagtaactgaattgtccacgaggtggcgcccaagaacagcaagcagagcccccatgtgcctctggcaggcaccagaaaagatttctaagagctggcactggggctggggctggggctgaggctggggtggcggctgacaaatctgggagcagagggaaggcacagataaaatgcacctaatcccgagcctcactaacaatgccttttctggagtttggcagtccctgatggtatgtatgagtgtgactggataaaacacagttacaaaatccaggcagccaggcagccagctcctagccaggcagccagctcccagccaggctgggaggcacaaagccagggtctagaggtgaaagagctccaatcagctgctgcttgcatgggtcagaggactctggaaaactctcaacacagtgaaatgtatcaggagaactggaaagacagacagccgtttccatctgactcaaccgcttggaagttggatggatgactttagacagctcagttctgctcactgagactcgccgtattgatctgtagggtggaaatgattttgacttcccaaggtcattgtgaggatcagatggtgaaatgaaaagcccgggcattgctctcaatcacaggctgcaaaggtggcatgtgtgatagtactgctcgtgtgcggggataagtgacctggtgctttttgctgggatttcgttaggttcttttagttgttccaactgacccataaaacgattgctactgttagtcctatgtgagacatcagaggctaaagaaccgacccaaggtcacagtggtgcaccaggctttggaatttgtctctgaagcctagatttgtcggagagcacactcactacgagagcacgtgtgcacgtatgcgtgtgcgtgcatgatggcacatacatggaggttagaggaaaactttggggagttgcttttctcttccctctatgtgggttccctgaaccttatgtatgccgggccacacataacagggactcctttccgctgaggaatgggaacgtgagccctcttggtgttttttgctttttgtttgtttttaaagatttattatatatatactgtccctgtcttcacacacaccagaagagtgtgtcagatcctattacagatggttgtgagccaccatgtggtttctgggatttgaactcaggacctctggaagagcagtcaatgcttttaaccactgagccatctctctagcccgagctctcttataaacccaggaaataggaatactgcctttcagaaaggatgagactccctccagttgagctctatctgtactccct

SEQ ID NO: 29400 - DNA, 1107 bp, Mus musculus
gtcagcagctctgaaggcagaaggtgggggctggggctggggctggggctggggctggggctggggctggggctggggctggggctggggctggggcttgggctggggctggggctgaggctggggctgggactggggaagaggaagcagccagtgagacaccattggtttgcttgcttgcttgcttgttgaggcagagtctccagtaggggtgcatcccactgccaagaagcgtccctagcaaagttgcgcaggactaatgtctgtgccccgacctctttcagacaatttcaaggactatggagtcaactgtgacaagctggcctcagaaatagaagaccatatcctcacatagcttatggcaggggatgcctaaactgtctagttggcgggtgtgggcggcagctctgggaaaggctccctgctctgcccttgaaccagagctcctgagcgcagctgacattgctcttgggtccggcccggcccatcaatggtttccctgggctcatctgattgtaggtgaagcactggaagctcagggaggcgctgtcacctgccaaagctcctgcagtaagccctgccctggtctgtctgcatgaacagaggggtagcctgctccacaggctatgtttccctccctccctctgataggcacagctcctgagtgtactctgcgatgcaattaggcaggcactgcgctgggcagctgacacttagtgaactgtcttaatgcccccagccacccctctgaagcttgttggtgttctcatcagggaaactaaggctggggatggcaaggtatcagagctggacgaaaagtcttgatatatggttctatgtatataaaaaaagtatatttaaaaaataaaatctcactatgtagttgtggcttgccagaactctatgtagactaggctagcctcaaacttacagagatcctctgccgcagggtgctggtattaaaggcacatgccagcatgcctgtcgctctatatatttatgttttctatgttctttacctactattttacctcctgattcttttcacatttggggataggcttggcctttcctcttcctcctcatcttcttctttctcctcctctt

SEQ ID NO: 29401 - DNA, 1300 bp, Mus musculus
gcccctttctaagccttgcttcctcatctacttgtgggagaagtaactggtcagccattgccagagtggatccccgggatgaagggctgtgcctaagaaggagggagatgatctgagcagactccttgggagaggtggtgatgtcgcttggttggtaggatgcgtgcctattctagctctcaggaagtgaatgtgagagaatcagaagttcaaggccatccttagttacacagagaattcttggttaccctgggctacgagagaaaccggagctggtggggaggacaggacttcccactggattttgtaatttagttcgtttcgctttctggttttctgaggcaaggccttggtagccttggctgttctccggaactgtagctctgtagaccaggctggcctcgtacttacagagatccatctgcctgcctctgcctcctgaatgctgagatccaagggcgtgtgccactcccaaagccaatggtttgcttttgcacttctcagaacctgaagcccgtggctcttgaccgctgcctttgacagttggtctccaattctggggtccttccaaactagaggtttcctgtatcatttttctcatcttagaagtcttgaatgtggaacacttgacaggttccatatcccatactggttccgggtgtgtgatgacacacttatgccttctaacaatcccagtttattttgttgttgttgttgttgttgatgatgatggtggtgttggtgctttaaagaaggggactgaagcacagaagcaggtgactcacctgaactgcagcgggagactgcgacagaccagcacgcctatcctgagcccctgatacctcagtgcctgctgtgcagtctggcctcttcttggaggccgttcctgtctctgatacttggctgaccccagggctcaaagcagatgcccactgagcagaggccacagagatgtctcctgacccccatagcaggctcctactccccatgctcctccagggatggtaaggtggcccttgacccagacacatatctatcaagaactcaagagcacagacatgaagtaccggaaccgtgtgcgcagccgcatcagcaacctgaaggaccccaggaacccaggcctgaggcggaatgtgctcagtggggccatttccccagagctcattgccaagatgacagcggaggtgaggaggctctgagggcattgggtctgggcgggaggggagggtggggggtgggcctgggcagtgcagtgctggggggggggtcatggggtggggagctgagggagggctgggac

SEQ ID NO: 29402 - DNA, 1154 bp, Mus musculus
ttagcattagaatttttcttcttataaacacacatacaagatgactaaatgaaaaatggaattatctgtatatttcttgttcttagggtagattccttgtttgtttgtttttaagatttatttatttaatgtatatgagcatcctgttgctgacacaccagaagaggtgtgtatccaattacaaatggttatgagccccaccatatggttgctgggaattgaactcatgacctttggaagagcagacagagctcttaaccactgagccgtttcttcagccccatattttttgtttataaggtatcctgaaacacctccaagagggcaatgtagtttaaaagcagctatgtatgctgtttttacgatgaggccagaggttgatattaggtgtcttcctcaattgcttcccactacatattttaaaaataagactgattgatttaatttgtatgtgagagcagtagcatgagttccctggaactggaggtgcaaggtgctgtgagcttgtattgtgggggctgaaaactgaacctgggttctttgcaagagcaccaagttcttgaaactgctgaaccgttggtccaggtcctattttttaaatgttatcttatgtgtgtatatgtggtggtgggagcaagcatacatgaatgatatggtttgcatttcatagtgttcatgtcagggtcggaagataactctatggagttgggtctcactttttacttttatgtggattccagagattgtcaggctggtgctgcaagcattttttacctgctgaatatctagctttccatgtttttgaaacaggtctctcagagggtaaagtgcttgaggcccggagttataatccccagcatcagtgtaaaagctgggcttggtagcatgtttgtaatcagtacaaggttgggagcagagaccaataagtttctgtagtccaggttggccttaaactcacagagctccgtttgccaccttgtgctaggattcaaggcatgcccagcacctgtgttctctttgtgtatgtacattacttgtgtagagttgtgtgcagaggccctaagtacctggagttgcaggcagttggttctaggaattgactttgggttgtctaaccacttagctttcatccttcagcagaaacacccatcatt

SEQ ID NO: 29403 - DNA, 1199 bp, Mus musculus
tttcttctttgcagtgtgacagctatgagattcgccctggtaaacacctgggagtgtgcatttctgtggcaaacaacagactttttgttggatccattccaaagaataaaactaaagagaacattctggaagagttcagtaaagtcacaggtaaaaaaaatgcatttcgaagttggtttgtggggatctgttgcattatttataaatataaatgctctcccaaaaggagatagctataataaacttagagttcaagtttcctatgtatcagttgcttctttctgctttaatagtagttggactaaataaatgtctaagtagtattgatttcatggaatttccttttcactttgtcttaatcgcatcttgttttttgtcagagcctttgctctctagctctcaagtggaagctttttcctccaataactttttaggattcgggagaagacagttctcatttctggttagcctgactacataactttatttaaagattctaattgaatccatgcagttgattgagaagtatattttataccacaggtccacatacttaaatatataactgggatgcatgcttgtattcttagcacttggaggttaggagtttaaaaaaagcttaactcaagaacagtctgggatacatgagattctatttcaaaaagcaaagcagaagactatatgtataatgtgaaagaactgaataagattataccttgcctatacctactttccattcattttcactttttatgtgggtgttgaggcgttgaacttagattctcttgctttcacagcaagcactctttccactgagccatttccctacagcgttcaaaggcctgaagtttgcagcgtagaccaggctggccttgaatttacagagatttagctgtctccacctccagagtgctggaattaaaggagtgtgccaccacgcctggcctgctcattttattttatttattatttttttaagatagtttttgtttgttttgttttgtttttagtaaagcttaagatcttgactcttactttggtacaaacccaaaataggaacaatttttagacattggagttcattgttataaggctgtacttcaatgtccctcacatcaccaaaggattttacctccatagtagctaagagttgacgagtctgcggtgtcaaaggatgaattgtaggcacagttatagga

SEQ ID NO: 29404 - DNA, 1412 bp, Mus musculus
agagaggccgtggttctcgtggagctcggggcaatcgagggggcaatgtaggaggcaagagaaaggcagatgggtacaaccaacctgattccaaacgtcgtcagaccaacaaccaacagaactggggttcccaacccatcgctcagcagccgcttcagcaaggtggtgactattctggtaactatggttacaataatgacaaccaagaattttatcaggatacttatgggcaacagtggaaatagacaagtgagggcttgaaaacgattctgtcaagatccaattggctctagatctacattcttcaaacaaaattggcgtaactgtttcatctttaagtagcagtttgctgccatttgtattcagctgaagaagtcactattgtgtatatactcaaggcttcttatttttcttcttttctaaatgctcttggacattattgggcttgcagagttcccttattctggggctacaatgcttttatcgttccaagcttcatcttagcttcagaacaaactgttaaatcatgattttgcagaacctttggtttggacagttctgttcttttggatttggaatagattacataggagtatgaagtatgctgtaaataaaagtacaagccagtgctttgtcttagtagttttaagaaattaaagcaaacagacttaagtttccttgtattgaagataacctatgactgtatgttttgcattcctagaagcaggttaactgtgtttttaaattgttataaccacacctttttgaaatctgccctacaaaatttgtttggcttaaacgtcaaagccgtgacaatttgttctttgatgtgattgtatttccaatttcttgttcatgtaagatttcaataaaactcaaaaatctattcaaaacatcacctatttcaaattcaattgtgtctaaaacattactttattcgtaatccttgaaggaatactgttttcaaagtagaactgcctatgtgagtgatcaaattcatgaaaaatttctcgtctattccatcatgtattgtggatattagatttgaggattattctaaattcacatattccaaataccatttcattgattggtgttctttcataatctcttctaattttgaaattttatccttaaaagaaaacaaacagactccaatgtttttgaacaggtattggatcatttttattaaagcaaaatggagctggggaagcgcactgcagtttgttttgacccacattctttcaaatcaaggacaatttgtgactgaagaccttatttgctggataaaaaattacacatacagagaaaacttagtattgtgatgtcatttgcactgtgaactaaagtcatttttagtgttcatgatgagcacccctattttactggtttaggactgtgattcccatcgc

SEQ ID NO: 29405 - DNA, 1104 bp, Mus musculus
tcttatgctgtggagagcaatgtagttatgttcattcattgtaacaatttctatttgacttctctaaatgaaaaaaaaaaaaagtccgaatgagaccatttttttgtaaatgttaaaatgaaggctctgctatccccaggttcttggaagccagctcgtacagtacataaagacaatttcctaaagtccttggaagggatgctggggattgatgagatgtttgcagttgttccggtcacagttatcacttaactccacacgctgacatggatagaagccctcagagatgttcagattccctcttgtctctgagttcatttcccaggctaatgctggtcttgtagttgattctcttgtgtcgatctgactgattgatcagcaccaagcttctaggtgatgccaaggtcatgattttttcacatttctggggctcaacaaaagaagaaaaccttagtagaaagctaagtagaaaagctaaaagcttttttgttactggttggttggtttgttctttaagctgcttcctgcctgtcctgtaattctctgaactcagagattagcctgcctctgcctccagagtgctgggacaaaaggtgtatactaccacacgaagtagcagccgccgctgctgctgctgctgctgcttctccttctcctccttctcctcctcctccttctccttctactactactactacttcttctactactactaatttcttcttctttctttcttctctgctgctgctgctactccttttccttctcctctttctcctcctcttcttcttcctcctcctccttccttatcatcattattgaaatggtctcactgtgtagtcttgggtgccctgaactcgtgtgcacatgtggcttcagactgacttgtgagtgctgggattaatggcatttaccaccacacctggcaataacaaatcttacactgatttgcctagatctagttttgagattttaaactatggtaaaggttgaggacttggttgcacaggccctggtttgccacctagcaacagaaaacactggtaaaagactgcaaatgtcattagtgcttggagtcccaaggaaatggtaagaaaatgaagt

SEQ ID NO: 29406 - DNA, 1124 bp, Mus musculus
agttgtgttcttccttggagaagactatttctctggatctcagcattccttagttgcccatagttctttgtgaggattgaggcttcctatgtttctctgttgatttagtgtgtctaatgttgtctttgttcagttcttgtttaaggcagtcatgttggtgagactttatgggtgtgtagcttttgatattgctaggaaacaaaatttcatagcaaattctcttatcctctcgcatttacaatctttttgcttcctcttccacacaaataccttgatagtggcaagtagcagctctccaatagtacttaaaacccattcaatcaaaaagaaatcatacctggtaccagaaatctagatgactacccgggactaatgaagtcatgtgtcttggagggagaacttacaacttccactttactaaaccagcataatctcatttagattttgatggttgtagagattcataaatgtctatatgggagagtgacagtagctattggtaagatacttaaaaattaagttagactcacaaactactgttagtagatcgttacctgtatctgactgtaatggtgtcttgtaggtttaagtaaggaatgctatgttttaaaatctttaatttttttattttttggaatactggtgattaaacctagggctttatacatgctaggcaagtcttttgtaccatggggttgttgtttttgtttggtgtgtgtgtttacatgtatgtacataccaggtacatgatacatatagagatcagaggactttggatgttgatcttccaccttgtttgagacagaatctcttattcactgctatgcacaccaggtggctggcctgcgagcctctgggaattcttcagtctcaaccatctatttccccttaagggtgcatgagggttacagaagcacgtgagacaacatctggctttatgaaggttctggggttccgaactcaggttgtaaggctcgaatgacaagtgcttagatccactgagccatctcctcagatcttcactgttccttctcttctctcctccttccctttctgtgattacacaggtgggtgccaccaggccttgtaggaatacttaattcttgtgctttgtgccacagttg

SEQ ID NO: 29407 - DNA, 1248 bp, Mus musculus
cttaaattagcccacaaaggaatcaaacaaatcagtaacagaagatgactggaaatagacatattttgaaagaaaaatacaactttctaaaatctgtaagataaacttggaacaacgcaaaagagaagatggaaagatttttaagagccagaagactgtgagttggtgtcttctatggatgacagggagctgcacccacaaaatcttaacagtgaggttgccaaaacaatctgaacaactgatgcatcccaacaggggctggagggatgtgtcacaaagcccaacccccagaagaacaactacaggcaactggtagctgctaattccaagtggtcaaccctaaatacacatttactcagtagggagggagggagggagggagggagggagggagggagggagggagggagggagggagtgtgtgtgtgtgtgtgtgtgtgtgtgtgtgtgtgtgtgtgtgtgtaacaataataattaaagaggccatgaatctgaaggagaagggggtagcatataggctagaggaggagagagtgggtgtaaatgatggaaattcagtatttatgtatgatatcctctaaagaattgtaggagcattcgtagatgacctgcttctgggtcggggttttgtgcgtagcagagcagctcccacgcttcgatctattgaaagtcagccctcgacacaagggtttgaaaattttagatttaaaaaaaaaaaaagaattgtaggaggaagtcacactgtggctaagagatatttatggcacttagtgcacacagttgatgaagtttaacaataatctcaaaggtaagaaacaaaccgacaaacaggcaaagtaaaccggatatgatggcagtcccacagccaagcaaagtaaaacaggatgattgcttaaacaaaggaggttagcctcgagaccactcactacgagctaacataaataatgttaaatcattaaacagtaaaaaaagagtggaaatcaagttgaaacaagaaaacaagtgtgtgtgtgtgtttggggatgttaaccaaagacaaagctgtctctagaaagataataaaaacatgacagagatgacactatagatctcagagacattaaagagtaatttatgaacaattctgtagccaaaatttgataatccagatgaaacagaccaattacctgaaagccacaatttatccaaatagtagacactgttgaataggcctattctgttcaccaataactttgtaaaatatatatt

SEQ ID NO: 29408 - DNA, 1680 bp, Mus musculus
gtgataagacttctgacctctcctctgaggcacactgtgggaagagaggacaggtgcctggccatgcaagtcagggaacacaggctgtagagtctagctgctctaaggccatcggagctctctcctcatctcaaaaagcctcctcagaaggactttctaagggtaaaaagactgccaatggcctagcggctgatgccaatttttcaaattctaaagctccaattttatcaaaatatccttatagttcaagaagccaagaaaatatacttcagggcttttcattgccaaataaagaaggagttgatcagcctgtagcagttgtgatggaagacagcagtcagcatgaagccctgaggtgccgtgtcatcaaatccagtggcagagagaagccagactcagatgatgacctggacatagagtcttttgttactgccaagttggtgaacacaactatcactccagagccagagcccaaaccacagccaaactcaagagaaaaggttaagtccagagggggaactagaactgccctatttgaaaatgataaaaatgctgcaatagaaaatgactctgtgaaacctaccaggccttcctccaatgctatagaattcccagatgccaactgtgctggggtgaaaaatcaaaggcccttcagccctagagaggccctgcggtctagagcaattataaaacccgttatcattgataaggatgtgaaaaaaatcatgggtggatctggaactgaggttgtattggagaagcagaaatccacctctaaatctgtgacaagcaaagtgacaagcagcattaccatctacccctctgacagcagtgggcctagagccgtcccgagcgaggccccaagggagaggcatacatccaccagcaacatccaggtggggcccccagagctcacagcaattagcaaccatgtcagctcccctcttgagctctctattcataaacatgacatcaccttgcagctcacagaagctgaaagagtgggagatgggtctccaaagaatagagcagagatggtggtctctaggagtagcattctaatcaagccatcagagtctgtggagaagaatagtcatgtgcccccagccgagacaatcaggtggaaaagccatagtgcctcttcagacagcagacacatcacagtgcggaatgcctggaagagtaagagagacttgaaatgttcagaagaccccccgactggaataggtaggaacatggaagctactaacgcctatacgcagaggccctgcacagacttcttagaacttgagcagcccaggtcacagccatctgaacagggcgctcgaagagtaggaaattcaggggatgctcctgagctctccccgaggaggacccaaagtagcctcaccgcatcagaggtgctcacccgcagggaccggatgggaggtgccatcactgctgcctcctgcaaccactcatcaagcatggtgagtctcactttccttcctttggccttgatctgtttgactgaggacttagggaatccagaaggttgagagatgctgtgtctcaggtagacttgggagaaagcagcacgacttccagaacctctctctcatagctttgtcttctccattttgctctcacacagaggggaggcaaacaaagtggcatttattccctggtttgcctgagatc

SEQ ID NO: 29409 - DNA, 1099 bp, Mus musculus
catcaagtggctttcacacatgccacttgggggtctgctctcatacttctgttctaagctctggactataggcagtcttctgttcagttatgagtctctgtctctctcttttttaaagatttatttatttatataagtacactgtagctgtccttcagacgcaccagaagagggcctcggatcccattacagatggttgtgagccaccatgtggttgctgggaattgaactcaggacctctagaagaatagccaatgctcttaactgctgagccatctctccagccccagttatgagtctcttggtctcctcagttgttctctatttccaaggggcttcatactgactcctgctccccacccccactccccaagaatatctctgcagttactgtgtagtgcggtgtcttatgccaggtgggagaacttcccagggtggaaggtgagggtctcattcctccctgtactctttgcagctcactttttacttgttactcattggcacaggaggaaggggaggacagcacatttgttaccagcaggcgaatacacaacccgctggagcattctgaactgcctggaaagcagggactgccagagcctgagccagtttggactgaggagcggctgcacccagcaaagccttatgctgaggaagactgagccagctaggtgaagtctgctgcttcttctctcctcctgcttctcagctcctccccaatcctggcctgtgaaggacccaaggccagttaaccaggctagacacaaaggccttggctgggagactgtagagagccaggctatggctcaggtaatttttgtcagttgtccagataggatcagagactacaaaccagtcactcaggcccagctttccctgatgcatgagtagtcctctctcctatctctgtccccaaggtagcatggaccattctttgactcccaaatgggaagctacagaaacccactaccatatagaggtagccaaagccctctcctctgctccatggtaagcagtttgtatatcaaagcccagtcccttttgctgtgtttgataccctgatttgtctcctcactatatccagttggctctttgtttg

SEQ ID NO: 29410 - DNA, 2440 bp, Mus musculus
tcctggctttgtcattccttgctctgtgatctttggcaagtcttcttgaagcctcagttttccctatctttaaaatgagttctttgttggttgcgtgcatgtgtacccatgtgtcacctgcagatgcatgctggggattgagcataggacctggtgtgcaaggcaggtgttctgccactgctgcttcccagctcagaatgagttctatagagtggatgacctcttaaggccttaactttgtgttctacacttgtttcacccatcagtgtgagctgactcttggttttggaaggtgatgtccacatgagtctggggaacatctttctgccttcagttgtttctgggtcttttttctcttttcctcatgtgtctgtcatggggatgagtctgtaaggcctgttttcaatgaggtaaagggattggattgggtggtctcaggtttatgtggctcttgcccagtgccacatttcctggctttcaagctaggtgctttttataacgtaagtctgtttgattcctgttcccgtgcctttcctgtgaatttcctggccacagggaagacacaggacatcctcaggaggactgagtagtctcccttcacccttcttagcacacacacactggcacttatctgcccttgtctgcatcagactcagccatcctgccagggtgtggggagatctaccatgttttgtttgtttgcttcccccagcccccaagggacaggaataactagcacttctgttttaatggagttttgctaacctgagggcattgccatgtgtcttgcctccacatcccaacttgatagacaactaagatagtgttttcaagatctgttcctgctgctgcttttaggttactggccagaaactccttaattcaaggctgcaacctctcacttgcagtgccccctgccactctcctgtaccaattggcagccctgagagttaaaaggaaacagacccctgtggtggtccactgaagagtataggaaattaagtctgtggctcttctctgctgataaaaacagaggggcaccaagccctgcctcaaaatatctcgtcaataatttttgtctttgggtgttgagccctggattcttctggtgctgtagctcctggtgccaaagtctggatctttccacattttagcagcaccaacacctgctgctatttgaaatgttctgtggaaaagggacagctgtgggatgccattttgaaaatctgagtgcaatagcatttgattgtaacaattatttcaggatattttgtttctttagtctgcacactttgtagtcctgccataaagtagattttatttttaaataccttcagcattgcaaatgtttataccaagcaaatggaggctagagggttcaagtccccttgggcctcatatggatggctagactgactctgatttcaaggtcgaaagacatatcacttctgaaaacaccaagatgtaacctttgggcccaagccagaagctgcaggaagcctccacatagaagggagactggtattcaaaccattgtctaatcaagccaaatattccccactaaaagacccactttcctgacagtgcttctctaaagtttgggtaggtggctaaattgagccagcaggtcaggagtctatgagagttctgagtacaggaacctggtcctggatatgcttggttggaggatgaagagctggctacatgccaggaactgctatcttccacttgctgctgttaccagctactctggtattgaaacaatcagaaaaggctgcagggtggcaggccaggaagctaagacaactctgaggcagtgagacagttcaaatgagttgaagagatctgtgtgggaccaaggctacaggcaagcttgcacaccagccatccctctcaagtggcaggggccggtgcctagagcaatagtggatttcttgtcctgggctgtgttagttgtttagatttaatgggtcagtaaaggaacagggactcagaggctggcccatggccacctttgttggcatgggtttctattctgacaaagaatgctttgtaagagctgctttttagggattatcttttaaacaccctgaatggggaacagggttctcctctaccacctcaaccagagtcataggaaagaggtcctattttcctgctgcttcacagctcagaacatgtattgaatggaatgtatttttaagagaataaagtctatttttttgtattttaaagattgagagggctagaaaggtagatagcccttaaataaacttacgcatgataggtcctttgctggggcctcagctgttggtctacacctgcccaggcaggtggctctggcttcacctctgccccttggagtctaggtgcagcagcttctacattcctgctccaagcacgggaccagagaggccagaacctgcctctggaaagcagg

SEQ ID NO: 29411 - DNA, 2273 bp, Mus musculus
tttgaggattaggaaaacagctaagcatttaagagtggctgctagtcttccagaagacctgagttcagcccccagtacctatattggatggtttaccacgtcttggaatgatagcttcagggtatctgacattctcttctatctccctaggcatacaaactttttgaagccttatttttaattgtacctaattttctggcagcttgtaaggttgcaaaggtccaagttactagggcgttgtaggtcctgctctttatatagactatggtatatatatattgttacagtatttctcaatatcataaccccaaggcttggtatctgctccgaactagaaagtcaagtacattcctatccctaagaaggctctcccccttgtggttcagaggttaggatgccttgccaatcttagccagcaggtattacatgaaataaaactagaatattgtgcatcaataaactgatcaagagacactttggtaaactgacaaactagtgatggtagcagataggtcttcaaaagtcaacaggaatttagcgatttgaacacaataaagttatgtttgcaacttggtgattcccctacctctatccccactagccaatcccaagactcttctttgctggagaacacacaatccggaactacccagctacagtccatggtgctctgttgagtgggcttcgagaagcaggaaggattgccgaccagtttttgggagccatgtacactttgcctcgtcaggccacaccaggtgtccctgcacagcagtccccaagtatgtgagacagatggttctgaacagagagatccaacggcatgtcatctgccacgtaagcaagctcttctagcaatactagatcctactgagaaactccatgtcatcagctactgggactcctagtttgacagcagaggctggctcctttggctgacagcaacttacccattgatttggaagtacagctccataaagactgctcgagaagcaagtggtgtgagataacctcttagtctatggtgtttgtttgtttttgtttttttttaatatattttgagaataaaactttaaaataattttatatgaaaatttatttttaattgtgtgtgtgtgtgtctatgttggaatgcacatttaaagtgggtgcctgtggaggccaaaggcgctggtgctggtcacaggtggttctaaaccatccaaaccaccatagttgttgggaaccaaactcaggtcctctgcaagaagagtgtggttttatttaaccattgaaccatctctctaacttttggatcttttggattaaagttgtatatacacagtacacaagtgctgctcccttggaaatgcaaaatcctacctctggcaatagctcatctgttctctccctgtctgtgaggagggtccgagggctctcctacacatgcagcaccttttttaaagcttcttttttaaagctttttgtgtatcagtgtttgcctatgtgggtttggtgcccatgagccttcatttgggtgctaggaaccaaacgtgttctctccaagagctgcaactgctcttaaccatggagctctctctccagccccactatagttcttaatggcagtctattaaatgaaaggttacatgggaatgtttctttgcacttctcatgtgctggtgatcatgtgttggcatagagcaccttgtaattgaactgtctcctctatagctgctataatagtacctataccccaaatataatctccccatctctaaatatagtatctgtaaagtcttcactgctatagtggtgtgtgtggggtgtgtgtgtgtgtgtgtgtgcgcgtgcatactcagatcttgtgccttgaactcaagatctttttgcctccatgtactgggattattggtctgcatcactatacctagctctaaatgaagctgagttaaggaacattattctgggtttggttagacgatgaaaatggagtgggggcttttctcctaatctccccgtgtgacagcaatagaaaaatgatgttagagatggaagggtgatttctggcacagtaaatggcagatgcttttaagacaaggtctcactgtgtagacctggctatcctaaaactgttgggattaaaggcatataatttcagagaaattctctttgacaacagacaaggctaaaaagaaaatagagcaaagagttagctgctagttttaactctgtattttgcctaaatttgtgaaatgctataccagcagtaccaattcagagataacagctgtttc

SEQ ID NO: 29412 - DNA, 1192 bp, Mus musculus
taagggatggtgatagataattgcaatgtaagttggttagaattagaagaaaataaatggttagagaaaacaaagaatgtcagatccacagagccagtcagtcctgccaacgacaacttgagttcacagcttaaagttttgtttttttactgttgtttttgtttttatatacacatactcattattagtaaaaactttttcttggtaaacttacatcaaaacattctgaagttaaaaggatcaggccttttaatttaattttgtaattttagttacagggctttctaatcaaaggagcggtataaggagagactgtggggtgggggtgttcagtcaagagttggtgcagctcacaaggacccaagttccttctctaacaccgagtaaaagctgagtgtggtggcaggagtgtggagtctcagtgctaggaggcggagacatgattaatgattgctgctgaggtctgatggctagacaacctagctgaatctgccagctccaggttcagtgagactgctcaaaagataagagtgatcaaagaagatagccactgttgaactctggcatctatatgtgtgcttgctcgattctacccccaacccccccccaatctctttctctatctctcctctgtctctgtctttcttatgtgcatttgcacaaactcacacacaaaaagaaaaggatacagacatgaagagaatctgatctcacataaacttccttataccatgaaaagattattggatttatatttgtgtcagaacttcatatagctttttttttttttttttttttttttggtttttcgagacagggtttctctatatagctctggctgtcctggaactcactctcactctgtagaccaggctggccttaaactcaggaatccccttgcctctgcctcacaagtgctgggattaaaggcgtgcgccaccactgcccggtcttcatatagcttttaaagaactcattaaatagcctggctgtggtggtacacacatttaatcccagcactcaggaggcaggggctgggggatctctgagtttgaggacagagctatgcagagaaaccgtgtctcaaaaaaaaaaaaaaaaaatcctagctttttgtggctatcctcagttgttttgttttggaaaaacagtgtaaaacatgagtcttaattagttttttgtgttttttgct

SEQ ID NO: 29413 - DNA, 1198 bp, Mus musculus
aaccacatgtgcctgggggcttggggctgcccctgccagatgtgccaagctttctggacatatccggcttccccttgggtgcacggtgattattatttaacactcaacattccggcagacagtgcctcccaacattaagcagcagcagtctgtagaggcttatcacccggagagtctccacctgggggtgacggggacagccaacccttccttttcctcagaaggatgtattgtggcattaactcagtgataggagagagagggcttaacccaggcacagatcagcatgtgcaaaggccctgaggctagagacatgctatgggactttatttagtccattgaggaagagaggaagagagggttagttattgatttttactgcaactaaggtgggacctttggaagttcctaaacagagcctcctgagttgcttccttgtctttgggctatctactcctccacacacatccctatttctccacacagcctcacccctacctccacagccccacccctacaaccacccacagcctcacccctacctccacagccccactcctacaaccacccacagccttacccctctctctacagcctcacccctacaaccacccacagcctcacccctacaaccacccacagcctcacccctacctccacagccccacccctacaaccacccacagcctcacccctacctccacagccccacccctacaaccacccacagcctcacccctacctccacagcctcacccctacaaccacccacacagactcactcctaccccccagcctcacccctactcccacctatagccccatccctacccctgaagcccacccctataaccacccatagccttacccttacaaccacctatagtcccatctctactcccatccacagccccacctcccccccccccacacacacacacactacggagatccaccagcagctcctaaaagtagaccggaaggaggatgagggcaaatgccagtcacattgtcaggaggcacagttctgagtcctttctcttctgtctctctttctccacagtgacttactaggtggccttgcttaggtaagttactggccctgcctgggtggtggagtctacaatcataaaacatgctagatacttagacagcagatcctaaaaggctctgtaaatttgatctccccagacctcct

SEQ ID NO: 29414 - DNA, 1138 bp, Mus musculus
ggatatgtatacataaatgcaggttcttaaagaggccagaggagttggttccccctggggcagatgttacagatgtgtctgccatgggtgctgagaactgaaattgggtcttttggaagtgtgtgctcttgactacagctcgccagcccccatcacaattctctccaatcccaggcaagttccgctctgtttacagacaagccacacccaccttcttgtctgatccttataaaccttagacacaggctctgcttctgtttcccaggaaagagaacccaggctcagggaggttccataacttaccagagacctcaaggctcctaatttgtggaactggaactcaaaccctggaattttttttttttgtcttcacggttgctgcccactggaatggggtgtttggggccattagaagacaaacataaggtgaaggaggcacttggggtgaggagaagaatggaagggagaatgaactggaggtgacagaacacagtgggaacagaagtcgcatcccaagccagagaagcgccagggacctgtgccacacaggaagtaatgtctgcacagggtgtgagtggaggcagaagatcggaaggtaccaggaagggccactgggggtaggatggtgatggtattatgaaaccccggatggcataggtacacccacagcctccccatgagtttccagactgtgctgtcccacccaccaggcatgtggccaccaccctgggtggctcctttatgtggctcaggtgtctcagctgacagtggaggctttggggagcaaggctggagcttttgcctgggccccagcaggatttcttcccggttagcagtgcggacagggtcctggtgtgtaggctggttcagcctcacaagggtgtaaatacagcgcgtgctaactgggggccatggtttaagtctggtggtatgcggtgtggtaccaaggcagtggtgatagccctgtagcggcctctggaccacgagcgtcatcaatagcaaggcctgtggctgagccagggtgcttgctaagttagatgttatacacattcaacctctggtgttcccagcttacgatggagcgttaccccttacaagccaaggaacatctctgttgtctgccatcccctggtctgca

SEQ ID NO: 29415 - DNA, 1191 bp, Mus musculus
aggggtttcctcaaaggctttgccctagtttaaccttccccctcaccaactcccaatttcctcaaagcccttgccccatttgacacccctcagaactcccattctccatggtcacaccccgcttttggcccagtgcctgcctggtttccatttcctgccacgaaaggtgccgatggctgtgattgtctgcagaccttgctgagcctgtctgtatgtcctacaggttcacagtggccatgtggccacatccatttgacagatgggggaaagaaaacccagaaactgacagtcctggggacacccagggaatggcaaggtcggggccaactgggtgtgagtggcactgggtcagggggaacttgtcctctccaattgcttctggagcagggttttgcgctctcaggcaggcttggctctggctagggtctctgaggcagctgtccagcctccaactctgtcagcatcctgagataatatagaggagagtgttctggaactcacaaacctgccataaaaatgcaatctctgtcataatggtcggaataatgttgttgtaagttagacaaatcgggtgttaacgctgtgtattgtgggggcgaagggggagtgcctctgccgagatcggagactatgaagttgtcatgagagggcttctgagaaaactggaggatcatgagttctgtgtgcgccatggtcaccctccaagggggcaggagctaatgagtccacttcagagatggggaaaccgaggcatgaggggaaaaaaatgtacctgtccaaggtcagtggcttgctgtaactgaatcctctccacagatcccagaagtctccatttccattgactgtttagccaacgtttagaaggatagtgtgctatagaaaaattcctgattctggcttctctgaaagtcagtctggctacccaggctcacgtcgtcacatggctgattctcaggtacctcctcagattccccgagtactgggtgactagccaccaccttatagcatatattggtattgccctcccgactctgcagaatcgagtggacccttgagtctggcccagactctgtgcggacctaaaaacagaaactaaaggtctcctggggcgtgattgcctattctatgacatgggtcaggatgctgcagtggccaggtactggacaccggtcccggagaacaccaccgaag

SEQ ID NO: 29416 - DNA, 1177 bp, Mus musculus
caggcagatgcagaaaggctggggtggaaggttaagatgttgagggaagtggagagggaggcattgaaggttcttgacttgtttattgagggacctagccagatttgtgtttgggaagatggatgacttcagtgatgggggatgctgagaatatccagacttggtcctgcagaggaaggctggtctggactctgagttccctgaaggcgcagactccctggaccttttgaacgtccagagttatggaacataaaactgctcaaacactatactttccaagaagcctttggatactttgtatcttaccagcttcttttgactttgtaacaaccatattggtttccttgtttcatggtgcctggccctctggaccatgaacctcaggaggcagtgactcaagctgctgccttggccgtagcatcccagtgtgcagagctgcttgctatgatactcaagggcaagtgcgtggtcagctaccgcacagtcgatggatagagtgctcagtgagtgggcctgggacaagcatgggagggaaagaactggggaaaccaagggagccttcctggagagggaaaatctggggatggctcaaacggggctggaaggaagtgttttgagtatgtgggacagaacagtttagccaaaaggccatatggaccctttctgataagggctgggagcttgacctgctccgagccttggtgaatatggggtaaatttgcagttgtttcctgggtgcgattgtttttgctctttctcacttcagaggaggtagcttttgtgtatgccttagtcaaggaaagcaaaacctcactttaaaccccagcatctgagagttcttatcagatggccccttctctcatccacccctccatgcgtctatctgtccatctctctatcctctgtctatctaccttcatcattgccctccctacatccatccaccactcactcgttcactcacccatccatctgtccatccatctccaggggcaggcggtgcgtggggaatagagcctggctgtgggagagaacagggcctgctgacttcgtagaaatacaagtgcaaagagtcttccggaggcacggatctgggttcaaatgggagcacagcaagctgtgtggtgtggagcaagatgctcccactctctggacttcatctcctatggtttgcttg

SEQ ID NO: 29417 - DNA, 1176 bp, Mus musculus
gcttatactgatggacaaagaatgccgtggaaaaataataaaagaatgaggtgtcagggcctccctcagaatagtgagctcacacaaggccattgtggtgtcctgtagccaaggaacaaaagattagacatataaacaaattctacgaagatataatacaaatattgtattataccagaaattaaataataactgtagcagctttggcctgaggatttttcttgagcctaatgacagttggcactctgactactaagagttaataatacacactctggacatggcaatctgcctaggctggcttggagattttctttctgtctagtgcccttgaaactacaagagctgtcagcctgagaacgggctgtcatttaccatatatatttgctttggcaaaatatgcctctagattcttagaagttgggttatggggttgatgagggaaaatgatttgtaaaagataactctgttctaccacagtttatcgatgatgactaaacttaggaccccagacatacaagaggaagttagacatgtgcctggggacaaaaatgatctgatctatatcccttggagcaatgtgaatctatccctgcctactgtgttctgtataaacaaagaaacaacctgactaccagtcagtcacggctgcaagagtctcctgtgcctgattcagttcttcttccatcactccttcccttcttccctcctctctggaaccaggtcgactgctagggcagccatggttacaccacccccccccccccccacacacacacacacacaccggcaagagactgacttgggagggtttggaggtgggcatcctataccactctctagctggcttttccggctgtgtgtcagattcattgtgaattgcagtaactggtgtctgcttgattgcacgcccctgcaggtgattcagagctgctgtgagggcagaacacccaaggagatgatagagaatttgttgcacagagtgactgaagagaagaccctgcctgccaagagtctggtaaaactcctccaggctgtgaggacagcattcccaaacctggacctcctgctggacaatttgcagaaaggagcgggatcagccggcaccacaggtactagctaattgttcactctctggacaggagttgcctgtacagaaaatcacagcttaaagct

SEQ ID NO: 29418 - DNA, 2115 bp, Mus musculus
aagacaaccgagtgaagcaaaattattaggttgggtttcagggttattaatgtctttggggtttgactgttttaaacatgaactccagttctgttgtgatactgaaaatcagattgcccatttcttctttctaccccttttcagaaaggcctaaagaatgtgtttgatgaagcaatattggctgccctggagcctccagaaccgaagaagagccgcaggtgtgtgctgctatgaacgcatctccagagccctttctgcacagctggtgttgtcgtcatactaaaagcaatgtttaaatcaaactaaagattaaaaattaaaatttgtttctgcaataatgacaaacgccctgcacctacccacatgcactcatgtgagacaaggcccattagtatggcccctccttgcccttccagtaatagttaattttgaataattatgtattgtctgaaaagcaatgagtgctagtttttgttttctttgtttaaaaaaaaaaacaaaaatccccacaaacgtttgttgtttttttgtttaaaagcaagcatgcttgtattgactgtaacagactaattcagattgtcaaagctgctccctggttccattttggagagtaatctggggcatcttcgtgtcttctgttttgttttgttttgtttttcctcaacccttctctccttttggggtgtgtatggggttgtttcttagacttgtattttaaaatttgttaaccataggacagcctgtggggaggaggacagagtatttccacattccactccctaggtctagtttagcaaacgtgtccccacctggtgctcttaggaaggagtatagaaacgcctcgattaacaacgtattccttcttgaaagttgccttttctctccacctctgagtgggtccagtctgtgatggaactcatgaaggtgggtggacgctgtctcgcccctctttctaggatgcactctatatgtgactgtgactttcaagggtatttgtttgccatttcctgatttagggaggggaataatttctaacttctttcattgataaatgaaaagtattgcacctttgaaatacaccaaatggattgagttcctaattaaaaaaagttcttttgcccctgtcagtcattttcttacatgcttagcacagattcacaactcactgtgtagtgttcctagattcagctgaagacctggtacctagggttcctaacgggatggtgttaggaaacacatcatggctgatgattgccatctcctttcaggtgatgaggtcacaggcctgcttccttaagaagctatgagcatggggtggggagcatacttttaaccaacatggggaccagtcagggctatccccttttttcttccatgcctatgaggaacctttgaacaactggctgaagctttcgcaagaaaaatggcgagagcctcatgattctttataagtgttaatagagactttatcagattattttgtttgcaggttccagtttttaaaaaatgtttagataatctccttccccagtcctgatcttgtggattcgttagtgccgaaccaatgctttcttgtgtctcaactctttgtatatgaattcttttcagatgtattaaacaaacaaaacccttcacaagtgagcctgaaggttattttcctccgtcttttacttttcaggtatttagaaatgagaatgtgactcttatatgacatcaacatctaacacattttggtataaaattttaaagcgttatttttgttttctgacagtaagcttgaattgtttacctccatatgtttaggtttatgccttctctcctaaaactgacaagtggctctgaaactcaccttgtatgctgagcaggtcagagtagtaagtgcagaaatgtttgtgacgctctcacctcatggaaggccacattagcatgctcctgtagtacagtgggacgtagactgattgccccagcttgcctgcattaacgtatagcttgtatagtaaaatcttaaaaacagtcgttttcgggacatctaaaatgcaggcaggtttgagaaccactgctcctaggtggttctttctctcatattacaaaatttgttttgttagtgtgcttcat

SEQ ID NO: 29419 - DNA, 1195 bp, Mus musculus
ctaaccttcctgcctctgtctcactagtgctgagattataagcttgtgccaaccatgcctgtttttaatgtggtatagggcttgagtccaaggctgtatgtgtgctaggttatcactctgtatactaaatagctatagccttagcccctgacctgtgattttaatgccgcgaggataccaaatctcagttgccaacctctcttaactctttctttagggcaagaggattatgacagactacgaccgctaagttatccacagacagatgtttttctagtatgtttctcagtggtctctccatcctcatttgaaaatgtgaaagaaaaggtaagtcaggttctgccctttgaaacatgcacagaattcctgttgccctgttacagtttcagtggcttgtggattaacaaaacattttaaaaccttgcttttagtgggtgcctgagataactcaccactgtccaaagactcctttcttgcttgttgggacccaaattgatctcagagatgacccctctactattgagaaacttgccaagaacaaacagaagcctattactccagagactgctgaaaagctggcgcgggatctgaaggctgtcaagtatgtggagtgctctgccctcacacaggtaaggagggctctggaacctatgtctctgtagtcagttgttttgagcattaggatacagaggctctttccttttattctttcttttttcccttaaaaatttgtccgtgaatgtatactgtgtgagtgtagttctgcagagtacataaactgacatgactattccaaggtatagttgagaggaaggttttttattgtagatatgaaggaaagacatcaggaagaatccagagatgagagagaaaatagactgaacatggccagcaaactggacttggccatggtggtggtggggtttgaaggaagaagagagaggaggaccaagagagggctgaaatagaagggaatgagaagctggaggtggagtggggtggggtgggatgggggcttctgagctggagaagttgagggtaaggagtgggtggaggtcagcatgcacttggttatgctaataggcaccctaggtagcaatttgtcccttctgccagtgataaggaaatgacttcctgaggagtgagggctttttgtccatctgtcagaatttggccctgacatttcaaccttttg

SEQ ID NO: 29420 - DNA, 1121 bp, Mus musculus
acagagacttggacctcaccagctgggatattccatcatcttttctgccctttcttgtgttaaaaaaataaaaaatcaaagttcttttagtaaatggctgccagaacttttggtctgtgtgtgataaccgtcgtagctggcacacttgggatggagagcaaagggacttgatctcttgattaacgaggtgctcttatctctcactcatgtacgatttccgttagacttgcccggtgccgccgacaataaccctgggtggagagcactgggttggggccagacacgcactcccatctcctctgtgacttagcagctgcgtagctctgacctcgggcaagcctcgggtcctcctctgacgatggaggtgtggctccgggcatggtggtagctgggagctgtacatgatcgttgagatgtaaaacttagcgaaagagtgttaaagattttgaagtccacagtttctctgctcacttgcttagtgacaagtccccaggaggcagatgtagtcaagtggccccttagctggatggctccggagcaggaccctggcatcctggcaagtgctgggaatgaccatgtgccttcagctaggggctgcctgggttgttaccactacttctctgtcccatcgggtgccacccagtcctcaggggagccatacactgttcctgctgtacggtgtctaccccgatgtcttcactgccttttagtatggcatcatactgataacaaaaatgtgaccacttggcactaacccttgactctccactccattcattggccctggttctgcccgttctgcttgtctccttcaccagctgctggcatcattagcctccaagaatcccattcctggttcccagtggggaagggagatggccttctgctgtgtcctgaactcccagcaggggtgcctgctgcctgggcccctcaacagggtagagatgatgctctgttgtgacaggggcagtgggcatcctgcctgctccaatgcttctggacctgggcgctaagcatgttgtttgtttggccaggctttgtgctggcgcggtgcccacgaaggtcagtctgctctggcatgctgctctggagcatggggagctaggcctgagctgagtcct

SEQ ID NO: 29421 - DNA, 1135 bp, Mus musculus
tttccgggctctggtaaattttactcggtccattgagtacagcccccagctggaggatgcaagtgccaaggagttccgagaggtgtcggaggctgtggtagaaaaggtaggtgagagcgtgtacctggcattgggagctccccgggggtggcagagcaatgccggaataagtaggaggcatctgatggtggtgtgtcccccacagctggagcccgaatacaggaagatccccggagaccagattgtcagtgtggtgttcatcaagtgagatggattcctggggatgggaagggcgggggcaaccagaaggggtggcaagaacaggtcagggagggtcctgaggagtggattatttttgatggggattcagaaagcataggtgggggatccattaccagaagtggccctaccttaggcccaggctgcccaggtagaggggtctgggtgtcgcgcaggaacttgacagaggcgtgcagattccaggccttttccttcccagggaactggatggctgggtctttgttgagctggatgttggctccgaagggaatgcggacggatctcagattcaagaggtgctgcatacagtggtctccagtggctccatcggcccctatgtcacctccccctgggggttcaagttccgacgcctgggcacaggtgagcctgtcctccagacccactcaggtcacttctcccctccagttcctcagactctggcccacttcggtgtctctaccttgggccatcctaacctggacaagcacacccctggagatacggagctcattccatcctgagcctgaccatcagtcttttttatagtctctacttgggtagagccagactgcttcctctaactagcacctcggaagctgtctccttgtagacctctgtattttgacaggagattcatctcctttatacgcactttataaacactttatacagtgtccgaagacaccagcatccagtgttgttggactgggcaatttttaaaaagcttatgctgagccagggggtaggggccacacacttatgatctcagcgttcaggagttcgaggccagcctggtctacagggtgagttccacaacagctagggctacacagagaaaccctgtctcgaaaccacc

SEQ ID NO: 29422 - DNA, 1164 bp, Mus musculus
tttcaaatctaaacttatctgtgagcctcctagtggccaatgagaaaagggaaactggtttcattaagcaccacaatctaatgaccgagatgcctcgcatatatgtatgtgcgctttccatggctctccgggacacccccgtctagactcgggggtagattcaactgctggttccaggcagctcctcccgtgggccatcctgcagctcccatctctgtgtccacagaacaatgtagtggggcgcttgtgcaacgagtgctcggacggctcgttccacctgagcaagcaaaacccggacggctgcctcaagtgcttctgcatgggagttagtcgccagtgcagcagctcctcctggagccgcgcccaggtaccggcaagagggcggcagctggatgggacagccgggacagagggcgggggcaacaccgccaccgccaccaccacccctgcccgatctgaacattctccatctccaggtgctcggggcctcggaacagccctctcagttcagcctgagcaacgccgccggcacccacaccaccagcgagggggtctcgtcccctgcacccggggagctgtcgttctcttccttccacaacctcctgtctgaaccctacttctggagtcttcccgccagcttccgaggggacaaggtgcgcaggacagaggaacaacacaggcaggaagggcattgggaggatagagacagcgtggcccgactgaagtctcccgctcaaagcctgtccacccctgttccaggtgacgtcctacggcggagagctgcgcttcactgtgacgcagaggccccggcccagttctgcgcccctgcacagacagcccctggtggtgttgcagggcaacaacattgtgttggagcatcatgcctcgagggatcccagccctggccagcccagcaacttcatagtgcccttccaagaggtgagcccctcccatcccttcttgttcctcactttgggggcctcagcccccagggtgtcaggaatggatctcatgtcacttcccttacagcaagcgtggcagcggcctgatgggcagccggccacacgggagcacctgctgatggccctggcaggcattgatgccctcctcatccaagcatcttacacgcagcaaccggctgagagcaggtagctggggctgagg

SEQ ID NO: 29423 - DNA, 1112 bp, Mus musculus
ggccacagggcagcccactcttggaccctgatatccagattacggtgagctcattagaatccaccgtggtcaggcagaagagtaagtggaagccacggtcccaatacccagctagccaatgtggtctccttgccactgcatggctggctactcccaagttcttagcctggctgctgtccatgggcacagtgggcagacgcatgagcttgggggtgtggacggacgagagtccaagtggttgggagagcctggggttggtgggtacccctgccctaagtacccttcctaaccttgctggtgtctctgcagggcaataacatcatgttggtggcttcccagccagcactacagggcccagagaggaggagctatgagatcatcttccgagaggtgggtagcacttgcctttgactccccaggcacacaggtctacaagttcaggagatgtggcccagagcttccactgacacttgctgtccccctacacaggagttctggcggcggccagatggacagcctgcgacccgagagcatttgctcatggccctggcagatctggatgaacttctggtgcgggccacattctcctctgtgccacgggcagccagtatcagtgccgtgagcctagaagtggcccagccagggccctccagtggaccccgagccctcgaggtggaagagtgtcgctgccccccaggctatgttggcttgtcctgccaggtgggtgtgtggctggctggcctggctgcatccgctccagtgccatggtgtgtgcaaagtggttggtcagtaaccactgctataggccgtaactgctcgctcagttaggtgacttttgttctcacattgttgtggtcactccctaagagccaagccatccctttaaagacttttttttaaggattttatatatatactgcagctatcagatgtaccagaagtgggcattggatcccattagagatggttgtgagcctctatatggttgctgagaattgaactgaaagcctctagaatagtagtcagtgctcttaacctctgagccagctctccagccccaagccatccctttaactgatagaaacaaactctccaagggataggtgacttac

SEQ ID NO: 29424 - DNA, 1122 bp, Mus musculus
atttatttattattataaataagtacactgtcgttgacttaagactcaccagaagagagtgtcagatctcattacaggtggttggttgtgagccaccatgtggttgctaggatttgaactcgggaccttcggtagagcagtcagtgctcttacccgatgagccatcttgccagcctcccagactcatcatttttttttttttttttttttttggtttttggtttttggtttttcgagacagggtttctctgtatagccctggctgtcctggaactcactttgtagaccatgctggcctcgaactcagaaatcggcctgcctctggctccccagtgctgggtttaaaggcttgcgccaccacgcccggctcagactcatctttaagacatgcctataggtctatggtttctggatcagggtgtttggatgagtttgacttcatggctggtgtctgacccccttgtgccctgcagcgatgtcagcacaacacagccggtgagttctgtgagctgtgtgcaactggttactatggagatgccacggctgggacgcctgaggattgccagccctgtgcctgcccgctgaccaacccagagaacatgtgagtactttgctcagatccaaggatgggctcctgctggaggacaggaggcaagctgggaagggggctcctggggcctgacacctgcctgcctgcctgccccaggttctcccgcacctgtgagagccttggagctggagggtaccgctgcaccgcctgtgaacctggctacactgggcagtactgtgagcagtaagtatggagtgggaagagatggggtgaataggagactcccaggcgagagtcctgcagggtgtggctcggaaaagtctctaccatggtcctcactgttccaaacacttcccacgttaatgccgccttgggatgagcaaatgctatgactccgtgtttcaggcatatgtctgttcttccaccagctgggattgggagaaacttcttgaatcacttggggtgttttgttttgttccgttttgttgttaaggcacggagtctcactgtataacccaggctacactgcttccagtgttgacagtacagatgtgtgcgaccacccctggaaa

SEQ ID NO: 29425 - DNA, 1160 bp, Mus musculus
tcccgtgaagatggacggcccttgcccagcagcgctcaacagcggcatcaaggtactcgtgcaccgacctctgtcccatgagtcagccctgttcctgtcctgcttgcgggggtgggggtggggcttgagctggagctagacctagacaagtctctccccaccccaggctctgagctccacttccctagcgtgcagccctccgacgccggcgtctacatctgtacctgccgaaacctgattcacacgagcaacagcagggctgagctactggtcgctggtgagtccccgcatccctggcctagctagaagctgccaggatgctagagaggatagtggctgctggacaaagatattacctgtggagaaacaggggatgatgcattcacacctgctccccaggcagaatccgcaggactctgccatccatccttagggatgaagggagaagataccgccttgggtctgggcgccgtttactgagatgaggaatgctcagcctgtaaagtgtctttatttgggttccccaaagcagagacactgtaggatcccaaaaagggagggcagcagagaaaagaaggtgtcagacaaggaagacatggtcaagtgaatggctgtcgcaagcagattttcccgagttgtttaatgggacgaggaaacttggaactccagagtcaccatgttctacgtggtctgtgtgtcccagcttgtcttgggcattagctgagttttattcaggacaggcactagataggattgtccaccaagctccaaagccaaactgtcacactcaagaggaagggtggaaaaagccagaagagaagccagcgggattggagcaagtagggaaggggtgtctaggatgcaaactggggcaagggcctccgggaaagctgcttgtccaacactctgtggaaagcacggtataggcagggaaaacatgaaggtcggactgacaagaccagctgaatgaagtgggagcgcgagcggacacttggagcatgtggaaactcctccaaggatcgtggctctgagcagggcgcatggcagctgcctttaaggctcatgcttaggaggctgaggcaggtggatctccagatggaggccagcctggaccacgtatgcaagaccctgtgtaggagcggggggaaagtctcagctct

SEQ ID NO: 29426 - DNA, 1099 bp, Mus musculus
acaggaagacctgtctcatagaaggggtcaggaaagcaggcctaagaggaagtgacacagaaccaaaggtgtggcgctcactggagacttcccactcacagaggctcccagcaagcccatcacagtgacagtggaggagcagcggagccagagtgtgcggcccggagctgacgtcactttcatctgtacggccaagagcaaagtgagcagacagggagtggtgggggaagtcttctcctgggctccctgagcccacacgtaaccctcaccctgctgccggcttgcagtccccagcctacaccctggtatggacccgtctgcacaatgggaagctgccgtcccgtgctatggacttcaacggcatcctgaccattcgcaatgtgcagccaagtgacgcgggcacctacgtgtgtactggctccaacatgttcgctatggaccagggcacagccacactgcatgttcagggtatgccttgttgtgatcggagcctggccccagggttccccctatactgtagctctctctaggctctgaagaactggggtacagaaggacaaactgtacctcagtcctcctgaggcatatgtcctaaccgaggtgaccctagtgagagagcagacacggactcttgtgcatggtgatgaaagccaggggtgggagggattgaagggcgagaagtgagaggaagatggtgagggcctgtaaccccagaggttggaggttgaggcagaagtaccatgaagttagagagtctgggcagcattgtgaagcccctttagaaagaggagggagggcaccatggggaggtcttagatcaaggctcatgatgtttccaaagccctcgccgaccctggctcccaccctcaccccaacctctcagccccccaccctcagctactgcacggcagaatggctatgcagggctggaatagaagcggagactggcaaggggctatagctgagagttggagatagtccccaccgtgactgtatcttatccttgctttcttgttagtctcaggtacctccactgcccctgtggcctccatacaccctccacagctcaccgtgcagccgggacaacaggctgagttcc

SEQ ID NO: 29427 - DNA, 1103 bp, Mus musculus
ggcttaaacacctgtcaggtcaggatatgcttagcttgatgggaaaggtaaagttgtgctaggcatactcttgcctgccctgacagagaaagtccttggctccctaaatcttctcatctagaggtcctaagggcgacaaagtcctgaactggagatgggccagcaaagggcactcactgcttcactcagggggctggaggttcaaggctggcctctaaccaccctctctgtgcccagccaccagcatcaccccacccatccgcattgaatcctcgtcctcccacgtggccgaaggacaaaccctggatctgaactgcgtggtgcctgggcaggcacaggtgacgtggcgcaaacgtggaggcagccttcctgcccggcaccaggtaacaccgtcccagggtcagcctgctagagggaatggatggggacactttaagccctgcctaaaccccaatcctgcccgtttgcagacccatggttccctgctgagactacaccaggtgtcccctgccgactcaggcgagtatgtgtgccatgtcgtcctgggctctgagcacacagaaacctctgtcctggtcaccatcgaacctgccgagtctatccctggtgagtggctcccagtgatacagatagttgcaagaggcagaagacttctggggtgtgacatccctaactgtgactcctactgctagctggggacagtcggccacctgggctctgcctccagggctctacctaagcagattgctttgtctgaatgacccaggtcttccatcaaggtcttctcggccatgtctcctgacttccttctccctggtagccttactacctgcctgtctgtctgtttgtctgtctgtctgtctgtctgcctgtctgtctgtcttcctgcttccttccacgaagaaaacttgggctcttcttgggctccggacctcaagacagggctgtcaaatttctgaaacaggggtctgacctcagattacaaggctgagccagctccaagagggagcttcagctgtgtctcttgggaaatatctgttaccttcccctgtccctacagcccctgggcctgcccctcctgtcagaattgaggcctcatcctc

SEQ ID NO: 29428 - DNA, 1391 bp, Mus musculus
actcacaggagcacacagttacattttatgccaaacatgacagcttggacctgtaaataaaaaaaataaagtccagggggctggagcactgattgctcttccagaggtcctgaattcaattcccagcaaccacatggtggctcacaaccatctgtaatgggatccgatgccctcttctggcgtgtctgaagacagctacagtgtactcataaataaaatgaataaatcttttaaaagcaaataaataaataaataaagtccacataaaaggacatttccatcataacagaatatggaattgggaaggttaaatgaattggtcaaggatgtgggaccttagagcagagcctagctcactgttggtgcttgccaagggagtagctgagactgtcctgggctacaggctttgtgcattgtggaatctaaaccccacttgagaatctgactcaggccaacctgcactcctctgtccttagcccccgccagccctgcacccatcagaatagagtcttcctcttcacgtgtggccgaaggacagaccctggatctgaactgtgtggtccctgggcacgcccatgcccaggtcacatggcacaagcgagggggtagcctgcccactcatcatcaggtatgaaatggaaatgagagacgttgtccgggagcccaggagggaggcctgagagtgctgccggggatgccgcacgtacctgtctgggaagctggaccctggctcccaaccttccgaggctcttgcctgacatcttattcctgctcctctgactctgccccacccctggccagacgcacggctcaaggctgcggctataccaggtgtcctcagccgactcgggcgaatatgtgtgcagcgttctgagcagctctggccctctggaggcttccgtcctggtctcgattacaccagctgccgctaatgtccacatccctggtgaggttccttgtatgggtctggcgaaagagacaagggagagagaacagcagctgagctgggcagaagaaaagctctttgagacctggcaggcagctgatcacagacttctgcctcctgtctctagcccacccttgatattacagaacagacagccaggctgtgtcgtgtgggtcctgtctctctcagggcttgagaacacaagcttgcaagtgtggcatccgtgggcttgggtcccaactggggatgtcacacaaagaacttggcctctccaccttgctgtcctcaagggaaaagaatagtgaggttcctaccctctgctatcttacccaacaggccattcagtgagggcccaaaggcctgagcttgtcctgcagggtattagcagtcatctgaggtgtgtctctcaaggagtgtgtactagctgtgggatagcaacaactgt

SEQ ID NO: 29429 - DNA, 1140 bp, Mus musculus
cacctctaagagaatcaccacagttaagtccttgccctcacacccggagccttaactgttccccatctctgtgccaacagccccgggcctggcccagcctgtctacatagagtcctcctcctcccatttgactgaagggcagactgtagatctgaagtgcgtggtaccagggcaagcccatgcccaggtcacatggcacaaacgagggagcagcctgcctgcccgacaccaggtaactaggtcaggatggggagaaacccagggtaggcaccgtctcctctcgtagactcctctgcgcctaagcctcatgcagactctagtattcatgggatcgtgggaaccaggtatctgtcagggaattgttccccagacggagaggcctgggcttttaccctttagcattgtttggcagcttgcatttgagggagcttcctcttcctctgtaaggagagtgggttgatttcagagattccacacagcgctggaggcctagctcctgactctccagaacccttgatggcttctttctctttctctctggcagactcatggctccctgctgaggctctaccagctctcccctgctgactccggcgagtacgtgtgccaagtggctggtagctcccaccctgagcatgaggcttccttcaagctcacagtaccctccagccaaaactcttccttccgtgagtgcggggtgtgtgtggggggggggatgccaggagtggggaagggagcctggagcctaggcaggacctacctggatagaggcagcctactgagcccggtgtctgaccttgcaggcctcagaagccccgtcatctccattgaaccacccagcagcacggtacagcagggccaagatgccagtttcaagtgccttattcacgagggagcaacgcccatcaaggttgagtggaagattcgggaccaagagctggagggtgagtgtctggctgcctgggctggtggcaaagggaaggaccatcctctgtgatggatcagggttgccatgtaaaagatggagcaggacccaggagactccaaggacccccactttctgccatctttgatcaagtcccacgccctggcacaaaggatcaacagtgggctctccctcccttgccttccgttatagtg

SEQ ID NO: 29430 - DNA, 1239 bp, Mus musculus
atcctctgctcagggaatagctttcttcacagttatgttaactgtcttcccacgccaattaacccactccggataatccctcacaggtctgtctccaagatgattctagatcctattgagagacagttgacactaacctcacccttccccaatgcaaccctacagacaacgtccacatcagccccaacggctccatcattaccatcgtgggcacccggcccagcaaccatggagcctaccgctgcgtggcttccaatgtctatggtatggcccagagtgtcgtcaatctcagcgtgcatggtaagagacaccaacccacctatggcttggcccctctcgccagcccagcttctccacgtttaaagcctgccccaccgctgcacaccctgtacattagcagtcacataaatggtattcagctgtggcctggagtgtaccccaaagctctgcctgtcatttttctctcagggccccctacggtgtctgtgctccccgagggccctgtgcatgtgaagatggggaaggacatcaccctggagtgcatcagttctggagaaccgcgctcttcccctcgttggacccgactcggcatccctgtcaagttggagccgcggatgtttgggctcatgaatagccatgcgatgctgaaggtgagcgtggtttgttccgtgtgtgcatctgaggtcttttctatggcctgactgaggcaggtgcctagaagggggcataagtaggtggacagagaagaggaggaaggtggaagatggaaaaggagaaggaatggcacagaagcccagggaacaggtggttgagtgataggtaggttggaacctaagcagatggacagactccatgggaagttggaaggatgaacagtccagcagcacacagaagagctaggaaggaaggcaccgggggaatgcagctcagttgagaaagggcttgcctactgtgaaccaagccctgcctgtacttgaagcattcaggtgtggaggcaggaggctcaggagatcaccaagtgtagaattcgaggtcagcctgggctacatgagaccactgctcagaaaacaagtaataatcacaaatcaaaggaagggacccatgtccaagttgtctactgtacgccccccaaacccgacttctttcttttagatcgcatccgtgaaaccatcagacgcaggcacctacgtgtgccaagcccagaacgccctaggcacagcacagaagcaagtggagctg

SEQ ID NO: 29431 - DNA, 1170 bp, Mus musculus
gacatatgtctgtcaggcccatgggccttggggacaagcccaggccactgcccagctgatcgttcaaggtaggaggtggcttcaggcctctgcaaagagcagggccagagatgagcaaggaaaggggtgatgcatgaccctgcctctgctcctcaggaagccccgtaagtgagcacgggtcactttccttgcttgcaccttgtatggagtaatggctgtgatcagtgttgcaaggaagggaagggagatgagcgcatgagtgggtgctcagcagagcaataaaggctgaattaccagctacttgggtacgagagtaaacagaggtttaacgagggatgcacgcgtgaccacgttatatcgctcatggaatatgtcatgcgtggcagtgctccgagtcatccttctcccagacttgatctcactctggcctggctcaacccccctgcccctccctaccaccatgcccctcccccagcccagctcaccactctgcccctcccccagccttgccctccgtgctcatcaacgtccgaacctccgtgcactctgtggtagtcggccactctgtggagtttgagtgcttggccctgggtgaccctaagcctcaggtgacatggagcaaagtcgggggacacctacggcctggcatcgtgcaaagcggaagcatcatcaggattgcccacgtggagctggctgatgcaggacagtaccgctgtgcagctaccaacgctgcgggcaccacccagtcccacgtgctgctgctagtacaaggtagagatgttgagggactatggaagggacctggaagggacaggacgctgaagtgctgccagctccatggtgctgtgtcactcactcctatgctttcccggggatctccttgtgttcctgtttaagggacagctttcccagcaaatgaatggatgtgagtgtttgtcccagcaggctctgtgccaagggctatcaagaagagaaagtaggcctgatgtggtggtgcgtgcctttcgtcccagcactctggggaggcagaggcagggggatctctgggctcactgactccagaggcagtggcaggccagtctctgaatttgaggccagccttgtctatacatattgtgttccaggccagctcggggtacatagtgaaatcctgtcttttaaaaaaaagag

SEQ ID NO: 29432 - DNA, 1193 bp, Mus musculus
tctccctctctccctctccccctctctccttctctccctctccttctctccctctccctctccctctcctcatctcctcatcttgctggtctctccactatctttcactgtccaggcctccttctctactcaggtgagttcctgtctctctcctctccttcaggcacaccccaaggatgcatgcccaaaagtcaggtcctatcttggagctcttagcatggctcttctcaggtcaccgagtctctgattgggaggctcctggccacatgccagagtgacgtatcacagaatggaaaggctcaaaacagtggtcctcaacatgtggggtccctttcaccagggttacctacgactatttacataaagatatctatattatgattcacaacagtagcaaaatgaagtagcaagggaaatagttttatagttgtggggtcaccacgacgtgaaactgtgttaagggtggaagcattaggaagttgaagactggcttaagagcttaagtgagagtgacagagggctggtgaccagcaggggtggggccaggggaggctgctcacactgctgtgccctccagggatgctgctgtacaatgggcagaagcggagtcccaccaacctagccaacagacagccagatttcatctcctttggcctcgtgggcggaaggcctgagtttcggtgagatctcttcctccctgtcctcagggagagatgggctggggactgggcacggggtttcagctgggcatatcctgcactaggctgagttacactatcaagaatcgagagagagaggagttgcagctgccagtgttaatgaccacttgatctacgggagtaggcgccatatcccaggcaggcagaggaaagagcctccaaagactactataggctcattaatccatccatctgtctgtccattccttaatttatctatctatctatctatctatctatctatctatctatctatctatctatctatctatctatctatctatctatccattcatccatccatccacccacccacccacccatccacccatccacccacccacccacccacccatccatccatccacccacccacccatccatccatccacccacccatccactcatccatccatccatccatccatccacccatccatcatccacccacccatccacccacccatccatcca

SEQ ID NO: 29433 - DNA, 1792 bp, Mus musculus
aacaccaaggacatcatctacattggtgagtgccgggcagggtgttgagacagacggggaggagatggcagccttcggggctgtagtctggcttccttgcctctcggttccaccgatgacccactgtcacaacgatcctcttcctgccacaggtggtgccccagatgtggccacactgaccaggggcaagttctcttctgggatcacaggctgtatcaagaatctggtgttgcacacggcccggcctggagccccacctccacagcccctggacctgcagcatcgcgcccaggcaggggccaacacacggccctgcccctcataggcacccacctgcctcccacggactcctgggcagcacccagcctgacagtgtcgagtatattattattaatattattatgactttttgtaagagactgaggcaaggccacgcttcgctgctaccaccctgggctggactggagggtgggtgcgccaactcccacgcattcgtgggcagagccccgaggctggtgggcaggacaaggggactggaagaggtttcctcagaaggctcccggaacttggagtcaggcatcgtgactggtagggctcagaactgttcccatccctttccctgcttcagcgtcaggctgggccacccacttcagcaggccgtgcgtgcggacagtcctcattgctgtgagcgcagttaccacctggtgcctcactgtcaaactgaacgagggggtgtggccatggcctgagccactgttctgggagcagaaggcagctcactgcccccccccacacacacaccgaccacataccatcccagcctcctccacacccacctagccagaggtcccatgtccttggcagtgtcccctcccacccagccctcctccacctgcattcccccacccctacccccatatcccccacacacacacacagcccagggctctgccctcaggagctgcaagggagaccaactctttcccagaatcgctaggcagagcccagcaatgaggtcccaccacaccaggccacacccccccactcttctggaggtgaaggcccagggcgtgggggagcagggatcaggagcacctgtggcttggtggaggcagctgagacctcagcttgggaagggaacgagggatgatgataaccctgcccatctgggagcctgaggacctgactaaggggtaagcaggcccagactgtggctcttgggtcctagagggaaccccctgtggtctttctctgattttttttttcttaataaacggtgctatccccgctagatgtctcctgtttcaatgacaagggattcactcagtaccgctgggggaagggcaaggcagggtcgagtctctgagatgtggaagaggagcaatccctgaggttttttttctgatcaaggcagaccccagttcctaccctaggccccctgccctgtccagcacaatgatccacctctaccctcaggatctgttgtcccctctgtcatgagcactctgcctcagaagcagatggacagattgtcttcccacaaatcaagctttattgagtgacaataaatttatataagctacgtcaaatatcattggctgcagctgggcgtggtggcacacgcctttaatcccagcacttgggaggcagaggcagaggcaggcgaatttctgagttcgaggctagcctggtctacagagtgagttccaggacagccaggactaaacagagaaaaaaaaacaaaaaacaaaacaaaacaaaaaatatatcattggctacagcttctctctca

SEQ ID NO: 29434 - DNA, 1136 bp, Mus musculus
atagcattcatttaagacagggtctcactctgtcgtcctggcttgcctggaactcagaaggtggcctgtctctttccgagtgctggattaaaggcatacactaccaccccaggcttcattcatgcattcacttgagttttatactccattgctgtttatacagtttccatcccacatgttgtcctctccaactcctcccatcttcttacctctccctctccatttttttttaaagatttatttattatatgtaagtacactgtagctgtcttcagtacactgtacctgtcttcagacactccagaagagggactcagatctcgttatggatggttgtgagccaccatgtggttgctgggatctgaactctggaccttcggaagagcagtcgggtgctcttacccactgagccatctcaccagcccccctctccactttttgacctctttttttaaaattaagatttatttatttcatgtattgagtgctgtctgtatgtctgtatgtacacctgcacaccaggagagggcatcagaactcataaatggttgtgagccaccatgtggttgatgggaattgaactcaggacctctaggagcgcagcataactgctgagccatctttccagcccccacctttttctttaatcattgttttacacacgtgtggtttccccctcttcattcactctctcacacatacacatccacacacatattagtacagcatacacacacatataaatacagcctgctgaatctacttaatgtggcttatctgtatgtgtgttaagggctgagattcagtgactttgggggcctggtggtccctgggagacagcacattttacttatttatttatttatttatttatttatttatgttttttggttttttgagacagggtttctctgtgtagccctggctgtcccagaactcactttgtagaccaggctggccttgaactcagaaatccgcctgcttctgcctcccaagtgctgggactaaaggcgtgcgccaccatgcccagcgagacagtacatttataggaccttggacgttacttatttcatgagtagattgtatgttcactgtaaagagcataagagaatagagctatcagggtggctaagaag

SEQ ID NO: 29435 - DNA, 1214 bp, Mus musculus
gaactcaggacctctggaagagcagtcagtgctcttaaccatggagccatctgcagctctgtaaactatttctttttgtttgtttgtttgttttgttttgttttttgtttgtttgtttgcttttggagacagggtttctctgtgtagccctggctgtcctggaactcactctgtagatcaggttggcctctaactcagaaatccgcctgcctctgcatcccgaatgctgggattcaaaggcatgtgccactgctgcccggcctgtaaactatttcttttcttttttttcttttttttttttcttttttttttttttttttttggtttttcgagacagggtttctctgtctagccctggctgtcctggagctcgctttgtagaccaggctggcctcgaactcagaaatctgcctgcctctgcctgggattaaaggcatgcgccaccacgcccggcttgtaaactatttcttaaaactgatttgtgagctgggaagcaagatacaactgttttttcttttcattaatttaaactgtaggatgcacaagagttttccaagctctttatgtcgctgttggaagacactttgtctaaacagaagaacccggatgttcggaatgttgtgcagcagcagttctgtggagaatatgcctatgtgactgtgtgagtctactgcagctctcctgccattaattacccttcatctcagtctcaggttatcacagtggtgggttatcactgcacccgaggtatttatagcagtatatttccatgggaacatgttgaagcagctacctggcctattgcagttgagtgctgcgggtattggaaactggctgaagactgtgaggctgtgtagtgtgggctgagatgtgaggttggaactgcctggcagactaaagcatgctggacattgctcggggaggctctagtccaagagagactgatccctagtctggttctatttttattttgcaggtaatttatgtgctacaatttctctaacagaataatgaacattataagcactccctctcctctgtctagagcagtggttctcttttttttcttggttttttcaagatagggtttctctgtgtagccctggctgtcctggaactcactctgtaaaccaggctggcctcgaactcagaaatccacctgcctctgtctcccaagtgctgggattaaaggcgtgggccaccaatgcctggct

SEQ ID NO: 29436 - DNA, 1166 bp, Mus musculus
gaggaagagtttacagaatatgatacgaatagcaataccagagttcatccagaaaccctaagtcttcaaatgatgcatcccgtttgaagtggtacagtaaattctttagaggccagttgtatccagataggagctggagatagatgtacagagaatatgtgtttgtaagcactgttaatttttagctttgtaatgaaaaaccataaggacctgaattgccttgatatttctggatgattgtgtacagataaaattctcctcttcatgggagtgcatctttcatcatataactgaggtagctcttcatgggagtgcatctttcatcgtgtaactgaggtggctctgcacttgggcacgcagtctatgctttggcaatgaatcattaggtgtcagaactttgcagaggggctcagcctttgcctgtgtgtgctaatagacttctggttggaatcaggctgctgtggagcctgtcaaggatctggcagcatgtgcacaggctcccgatggtttgactgtatcttcttcatggcaggcaaactggacacaagaagaagctcaatgcatacatcggcttctcagagagtctagatatggagccttacgtggagcacaaaggtactgttgtgaccaagctgtgactgttagcttgagagggaaccgaggcctgctctctccacgtgcagagtgttccttgaatccctgtttgcagtctctgaacagcagctttttgacaagaagttactttcatttgtaagagttagcacacttaaattttacagatctcaccggaccctgccccgtctccttttaaagttcaaaatggaaatgtggtttgcatactatagaagtgaacatcttcatgaaccacccaaaagggaagacaccatgccagcaacctagtgtccacagggtgcttacagattgtcccttgtctctcccgtccacccagcaccacattttttctttttgccattaagcatctccctgaactgatagtcgggattactctttttgtctcctgggatattgccaggcaaagataacatgtaattaatcctgccattctgctgctctgggttggtgggtggtgcctggagaaagcgacatccctggtgtgtgtctcccagtagaaaggttcaggcagcacacagaggtctaattggaca

SEQ ID NO: 29437 - DNA, 1078 bp, Mus musculus
catcctggccgagaatctaccaaatagcccatactgtcctccaacttgtcctctaatctcctgtttgaattgtcattttgttttgttttaaagacacttatattttgtaaacatcatcctgggtggctctttgcccatttgaatggtttggctgtgccttgcgtttgttggtcctcttacctcagtctttggggtgctgagtggtgggggtgcaaccccctgccaggctcttaggtgtcttgcttgtgtcctgtcaggcacataagcacggcagtgatagttcatgttcaggctacaggcttctcactctctcattctctcccttcccctcccctcccctcccctcctctcctcctctcctctttctctctctctctctgcaggcgggtccttcgtgtacgagctcagtgccgtcctcatccacagaggagtcagcgcctattctggccactacatcgcacacgtgaaagaccctcagtctggagaatggtacaagttcaatgacgaggacatagagaagatggagggcaagaagctacagctagggattgaggaagatctaggtaaaatctttaagttgtgagtgcccttttcaaatataaatttttttgttattttttttttttaagacagggtctcactatgtatccctggctgtcctggagcttgctatatagagaccaggctggccttgaaccctagtactaaattaaaggcatgcaccaccatgcctggattaagtataaatttatttactggtaatcgcaatctttgatagtgtcctagcccgagattaagggttatggaggctctttaacaccactaggcattatttgtaacagttatgcttcaaggataaccaaacatattttgtcacagggatgggtgtgctatgaatgcccataggcaaaggagtcagtttcagttacagggtttattccctggcgggggaagggaaggtggctgaccaggaggatattgtttgctagagggagattgtgtcatcctcttcccagggtacagacataataactgtaggagagaagctgttgtgagccagtctcatggcagctctttc

SEQ ID NO: 29438 - DNA, 1140 bp, Mus musculus
ggattgctttcaggaatgccttagaattctgtactccaggttgattaaagactgtgactgactgttcagtatggtaaatgttactggaaagtaagccctggtcacaaatttaccaattatccagcttttggaatgactgaagcttagcctattctattatcccaccccaaagagaggcagaaagaagcaatttttaataatgttaaaaggaaaaagtaacctagattaaagtttggttttatcttgttcaacctctagaacaaaagaaattggaacaactggcggtcccatttgttagagccatttgctgcttctgggcattctgggtgggtcacctggcttcattgctccttaggtttcacgtcttcgtcctggaggtctagtaaaagatgaactctagtggaggtttccattacagtattcatccatcttggatgacgtatatatcagtgtctttggaaaaggggataaggttgttttttgtgtttgtcttttgaatagcctttcttcaagagctggtagatcgtgataattccaaattcgaggagtggtgtgtagaaatggccgagatgcgcaagcagagtgtggacaaaggcaaagcgaagcacgaggaggtgaaggagctgtaccaaaggttgcctgctggagctggtctgtgagatattccaggacgacactattgccattgaatgcctggggttttgttctgtggtgtttttatctttacctgttgcaaaaatgtatatgaaaaacccatttcctcctctaagaggccagcttattctaaaatcattatgctaagtaggcatagagtatcccatatacttcgaaaaggaccttttcaaagtgggaggctgttagagaatgaaatcctaagtcagcactctgcactcatgacctgtgaagacttttactgtgggctggtgtggcagcttagggaaaaagtgcttgccaccaagcctgccaaccttgcgtctgactttcaggacacatggtggaggagagctgacccctccaggccgctctccgacctttgctggtgtgcttcccctcaccacacacacacacagaacataaggaaaaaggacatttttactgccagatgtggtggtctttaatccccacggaggctggcagatc

SEQ ID NO: 29439 - DNA, 1331 bp, Mus musculus
agttagactccagggtttggagaattaaaaacagtttagtgtttgatgctagctactaaatacattgttttagaatgctgcctttcaaagtgtgcatgacaggtgtagagttctgctcacagattaaataaaggcctttatatctgaacttgctgagaaaaggaacttaatataagcatctccacttcccccgggatttcttttacccttttgaccttcagcccacttacctggtgggaggaggagctccttcagccatcgtttgtaaacttgagtttagtagcattgtccacagaatcatgcagaagaccacatcctctttccatgtccccgttcctgtcagaggataggaatttgatgtttctagcacctgagctcctgagcacatacatacccatgaagctataggattaaaatggtggccctggtctacatagtgagttccaggacagcaagaacaacaatagtcagatgaccaccacccccccttaataaaagtgaatgaataaacaaataatccacagggttagacgataagaaactaaagggcaatgaaagtagttcttgttcctgacccacccacacctcataggccctaggcctgactcctctttctgcttctggtgtgttgaggtgatgaaggactcggcccccgagttgaatgtgagtagttctgagacggaagaagacaaggaggaggctaagccagatggggagaaggatcctgactttaatcaagtacgtttgtattgaagtactccatcattgtgtctttgtccgcaacagccccctgctgtccgtcttccctggctgggtattttctgggtccctccctacttgttctacacttttaactcttagtttttatagcacgctgtagctaatttttcccttcacccctaaaaaaaaaaggtctgcatatcctccgaagttcatttaaggaagaaaaagtaactgtgtgatggctgtggtggcacagcatcgtgccaaagcacttacaggcattgctaagtgggggtctgggtctgaggccagcctggtctacagagaaacaaatgaaaagtgctcacgtctaagaccagtggggaggctgaggcaggagcacctacccgtgccttgaagccatcttggcccaaagtgagactgtctagagacaaagcaagagcggctatggccataggtgtggtgacacaagcacagtcttgctttcctgaactgaggcaggaggattaagagtttgcaggccctactcttacagaagtcctgggtttggttcccagctcccacctcaggcagctgtaacttgagcgagctttgtgggatctgataaa

SEQ ID NO: 29440 - DNA, 2399 bp, Mus musculus
ggagtgaatcatgtttacactgagggagtgaagccctggtcagtccacacagatgccctgctcactagcggatctgtgtcccaggacatgggctagcatcctgctccaaactccaagtgaccgtctagagacaagatctgctaacccagcctttatttaacctatactcatctttcaataaagcatgaacgtgaaggacttgccaacgaggaacgtgtcttcagagcaccacgcctgcagggcagccacagccctgccacctccctgctcactgtctgtcagtgctgagtagtagggtcaagccagtgactgtctcagttttcctccatcatctcagagggataggaaatgttcagtgttcggtggcagcaaagagagtatccctgaacgtttgaaaagccgaaccggagctccgtaggatagcacgggttttcatagacagccctcccgctctccagttctgccttcctcggacctcactgctttttgaaaacccttaagactatacagggtgtgctgcctcaccaactcaggatcactgttgacggtagtttaagcagcatcaggatctgctcgaacagaaaaaggttttaggggagcacggacggggctgggcagcgatttgcattttctctatcaagtggattgttggtatgtttgtggcccagttgctgatacagatttttttttttttttaaaaacctagttggttgaaaaactttaaatgatgtatacatgctgatctcaacattggcagcatcttttggtagctttctgctgctgggtagaactcccaacatggcatttatgtttgcaatgaagaaagagtgttctgagatggtgagaagcgcggggcagagccaggagagctgcacacctaccttcctggaagactgacttctcaaggagctcctgcctttggggacacagggactcacgggaccctggctttcagatctgtcctttaccgagcaccacagaaatgggaccaagcctcactcaccaagagcccactctttcccaaggccaagacatttgaaagtcaccagatatttgacaaatggtctttactgtccttagaaagaaacccagagtttgtggctttgtaacaaagcattggcagggcctcagcacccctgaaaggtggtggggctaggtggcaagaagcagctgttcctccccctttctcttggcattggctgtgcacaagccagaagttagcactgtgaggttggttgcataggcatcctttgtttcctttacgaaatgttagcaaggtaatagccattaactcctgtcaggcaaatacagtggggcagacccagttccagcgagctgaagtgtgctgcttccgcctcacagccggtgcccgccactgcagagccttactggagcttcagctcagacccccgcacccactgaacaaggccactcccgaaaagcttgggatccctgggctgcggcttcctcacagcttgaagcagacatatttcaaagagtctgcatttggacttaccagctgccatgttcctgctcactaatccatgctgtttggttgtcctctgagctggggtggctgtatacagcacaggctagctattctgctgggttctaaagctacattcaggaaccacattaaaccagattatgaatctccaggcttctttatgtttcctttttctttcccaggcagggtttcctgtaacccaggctggccttggactcactatgtaaccaggataaccttaacttctgatcttcctacttcctcctcccaggtgctgggattgcaggcatgtggccactgtgacaggtttcctgtgctgtgccgaggcccgggcccagcgcctcgtgcacactagagaaaattctgcatactgacccacatccccagctctacccgtgtatatttctagtcattctttaaacccaagcaaatgtgtagagtctcctatgctgagatgttttttgccactaccagacatgtaggctatcatttgacgtctttattccctgagagaaaacttcttttctgtatttatgaactttattattgagaatcactgttaacctttctgccaaattaaagacacttgtgtctctgtttccacggacctttatccggagtgagttctttgtcctttcacctattagttgttggtctttggtcccaggccggaccagatcctggtcaccatcactcactgatgcttggcctcaggaaccagagcagagaatcctgtctttcctgttccagactggccaggcagagcaccaagtgtgcaggtgcagacagggagggtacagggcagtgggcccgagtgccactgtgtgaagggtgttgaccttaagtccagacccctaaatgaacaggtatttctctgggggcagttcttcct

SEQ ID NO: 29441 - DNA, 1423 bp, Mus musculus
ggttcagataggcactcaaaagatatttctgacctacagctcacaacaactaccaggcccagtccgctgttcccctgcgccatgagacccacggtggagaagacgtggcggtctttgccaagggcccgatggcacacctgcttcacggcgtccatgagcagaactacattccccatgtgatggcgtatgcctcctgcattggggccaaccttgaccactgtgcctgggccggctctgggagcgcaccctccccaggggccctgctgcttccactggctgtgctctccctacgcaccctgttctgagggtgcaggtcccacaagcccgcaatggacagccagctcccctccttttgtggcccaccaccgggcagcccacactcaagggagaggtccaggcaacttccagcaggaacagaagttcgctatctgccttgcctgtatctggaatcctccatgggccagattcctggctctgcctttattccctagttattgccctttggccagcaggtttctctcttgggcaggcaagacacagactgcacagattcccaaagcaccttatttttctaccaaatatattctccagaccctgcaacctccatggaacattccagatctgaccttctctcctccatcccttcccttccctctggaacactgggccccatagtcacggccagtcctcaagcccaaccctccctggggggaagaccaggtctgctcaggatgagactcccaggaagccacctccggggttggctgtctacccagggttgccaagctgggaagaacactccagccggacaggacacacacacacactccccacccaattgcagagactcgccaacccttcactgaagtggctctcctgtttggaatagcggggtggggtgggggagaagaaagaaagaaagaaaaaaaatttttaatttctctttttggtgttggttaaaagggaacacaagacatttaaataaaacatcccaaatatttctgaggccagagctgagtctttgtggtcagtgggaaagtgaccaaaataggcccattgctgaggaaagaactggactcggggtgagggcatgccaagcagagatgccggggcttttgccaggcaaggggggcttcaccgctcaccagctgtgatgctaggatccactatgtttcagtgccactgcgtatggcaatgggagacgatccacttgtgggtcagtgtgaggagagagagagagggagagagagagagagagtcctttgtctctaaacccacatcagggagggcttcagtgacctggggtaccttcatggcatgacgctcacaaaatacactgcatagcccgggtgccatgtagccactcactcctgccttcatcgacacatgctgagcgtgtgccaggcaccgcataagggctcaa

SEQ ID NO: 29442 - DNA, 1177 bp, Mus musculus
taagacaccccatacccagagttgttgtaaaatcaaacacgatgcttctttatcgtgccaagcacacaatagggacttaggcatgctcccctgcccttccctcccttcccctctgctgaaggcttcagcgaccccttaaaacagctaaggatgctgagccaggagccgaggcttgtgggagagatccaggcttggatcccgtggttctcccttctctgtggctctgctttccccacatgccccgccccctacattctccttgctcaccctctgaaggccacttggccatgagatgcctgaggtagacctggcacagggagtccctggtgaaggtcgctgtcatcccatatcaaggagatgttaatctgatgacagtgtcctggggcctgtgagggcagggctccctcccctgtcgcctcatgggaggcctttgtcttgatgtccctaggaggcaggattgaccacggacatcatgagggtaaggccaagcaggctctgcatgaagcagtggagatggaccaggccattggcaaggcaggcgccatgacatcccagaaagacaccttgactgtggttactgctgatcattcccacgttttcacattcggtggatacaccccccggggcaactccatctttggtgagtagcctgtccctgggatacagcgaagcagcctgtcccatgagaactgatgacagttgagatactggaaggggaggggagaatccaagagagctgaacacctgggcgatgggtgggtgtgcagcaaagagaacatgggggaggggcatggggaggaaggagatcattggaaggatgaaagacctggcatttgtgtgctgtcttcatggaggtagctctgactcctaaggaggatcacaagaaataccaagccacagaccccggggagctgggttagggccaggctgccacttctccattgtgaccttgggccccttccctacgcaggtctggctcccatggtgagcgacacggacaagaagcccttcacggccatcctatatggtaacgggcctggctacaaggtggtggacggtgaacgggaaaatgtctccatggtagattacggtgagactgcagaggccagggctgggaggggaaagggtctttatccctcgaggctgggctgacggggtcctggaggagtccagattt

SEQ ID NO: 29443 - DNA, 1128 bp, Mus musculus
caggctcagtccattcaggagaggaactgggtggatgacagcccttaatgattaagcacctgaaaatccaagtctcttttctctgttacgattttgctccatggctgctgtgcccaagcaggtctcctaagacatagctccaaccctgcctctcctcttacaatcaacaaagattccttccgaatcaataacgatttccttgcttacctgctgtgtactacaggtccagttcataattcagtcacacactcagtcttttaccggagccacaggtaacagtgaacttgtatttcctggtttctcaaaggacaaggttgaacaggtatggggccctgccctgcctgctgctggtctagaatgtctcccactgccacatctgcgtgctaatggtagaccatcctggtcccccaaccctttttaatagggtctcaggtgtcccagtctggccttagactcactatgtagccaaggatggccttgaacttctgctcctcctgcttctgcctcttgagtgccaccacatctgttcttatgcagggcttagatggacctccaggcttcctacaagatagctaaccactctaccactgagctacatcccttcgccctcattactcatttttatctatatgaatgttttgcctacacgtatgtaagtgtaacctgtgcctgagtgcctgctgaccagaaggggacatccaatcccctaaaactgccattacagacagttgtgagctgccatgtggggtctggggatgagatgcaggtcctctgcaagagcagcaagttttcttcactgcccagccatctctccagcccccctccctgtattctttattctttagccatcctctctatctgcgaaggaacgcactctgtctccagatctccccatacctccatgcacgactgcaggggcttgtgtggaataaactctaattactagtctgacagtcagctggaggcggggagcagaagaggttcctgacttactggccagaagtctgacagcgcaacaccctgacaggtgacagacatttccgcattctaatcctgaggaggcacaacagcagcccttagactgggccagtccctctcctcctcctgccctcagcctaccctccctca

SEQ ID NO: 29444 - DNA, 1188 bp, Mus musculus
gctcacagaggagtgttggccaagaggatatatgtgtgtgtgaaagccctggggtggatgacctacgtggtattgttctgtgaaatcagcagcaagggtgagaggaacaggagatggccagggcttggggccctgcaaagtcctccaagccaggtgagagttttggccttaacacccccagagcaatgaacgtggagccacgaggccgtgtgtacattcaagccagactttatttcttccatgccaaaggaagccctgaaaggaagaggcaaaaagtggtagctggcagagtggagtttcctttgaattagagatctctcttgccttctgtcaggcccattctggcccttgggtggagatgggtttgggggagggccatgccggggattggcaaggcagaggagggaaaggcagcagatgtggaggaatggagttgtcagggtattgtgactgatggagatccagcccactgcttttgacaggtgacagtagagagcctagaagggttgtgtgagcggctggtgccacagctggaagcaatagtgcccagatgctgggtggaaggtcctccctccccaaaccctcctacccaaaccctgactgagatccacgttgctggcagctgcttttctggagttctcttccaggcctctggcggctggcccccacccccacccccaccccacccccaccccctgcatccccaacagtgccttcgacttcaaggcagggaatgctgcaataaggaggttctgtctttgaagcatccagtgggggaggggcagcattctgacctccaaattctttccccatgacctctgtgaccctggagagacccagccctttggaacccaggaggtccacaagtgtgtgtgtgtgtgtgtgtgtctactagatccacagtgctcaaaaaaagtccctccctgggggatgggaaggggttctaggggtctgtaaggatgcctctgccacagaaaggagctgcagaaccaaagtctgggtccctgacttatggggtctcctcagaagccgagatagtcccccatgtgaagcatctgagctggaagttcccggcagccactttgtgttcccatttttcttcttggttgcctctctttggcctgtgctatgtcagggcccagttaccagagtgttcacctgagactcgtctctacctccttcctggga

SEQ ID NO: 29445 - DNA, 1735 bp, Mus musculus
gtgtcaagctggtggcttgccagccctgggcctcacactgacaatggcagtgggacatggccccctgcccacatccaatgccagatacaccacaataccactgtgtcaaatgctttaaagatatatttttggggagactattttttaagcattatggaatacactggaaatcttcagggaaaatacatttaaaacactttttttttaaaaaaagaaaagaaaagattagtatatttattatgttctcttttttctaaacaacctgtggacaaaggaaaccccactaatttaccccctgggaaccccaggctgtggagaaggctgccagtttgagcgagcactactttagcccattgctggtgtaattacttctatagtcaccggtgcagtcaggagatgtaggggcccaggcagagggggtgagcagctgaagggcctggttatgggcgtgaccttctcagcttacctgtcctgtcgctggagtccaaccatgggaagcccaacaaggatgggttgatacccaagtgatagttgaggcagcacaaaggcagagtaatgaccttcatatcacgtggcacccgaacactctagactagaacataggagcctgttggagctgagaacccacaccccaccagatgcaccctgttgtccaaagatgtcttttttttttttttttttttggtcccacctcttctggccctgagacccgttgcctctctgtagcaattctgacatcctgaagtggtcagcttcactgatcctctgtgcagagggaaaggggaaaaaaaactcagcccagttctccctccaagctctgtagcctgtagttgccctggcctggctcctgggacccccttctctagtgccttaccccaggctgcagaccctgagccccactaggaggcagcatttggcttgctttcccagtggagcccccaagtgtcctgactagaagccaacaccatagccccattcccagaagccccagggtaccaccccaacctgcctacaggacagccattccagatagacgtccagtgtcaggagctgctgacctctcaggctttcagccacccgtggcacgcacattgaatcaattcagtccttgtagatagagggattcccctcaccccctccccctctctgtttttttggaggtggatgctgtagccagagcaggccaagactggaatgttcccagccccattgggctccagggaatggcagaaagtcatccacccacagcatcacgtagtagatatgtgggctcccactaggtggcgctcaccgcagttctcatgactcctgcagggagcaagctcttgtgatatgtgtgggagaagcctagtagtgcccattacagcccctggcaggccatgctcccacaccacacagcacggcgtgcgctcacacacacacacacacacacacacacacacacacacacacacacacacacacacacacacacctggaagccggagtcctccttgaccaagacgcagagacaatatggtctcggccccgcttgctaggatgggaactacaagcaggcacctggcaaggttcttggtccctgtaaacacattcgaggtctcggctcttcgggggaaaggtaacataagaaggcaggaaggtgctggagccgtgccctgccacacaaagggggaccttctgggtctggatcatctgccctttctatcccgtcgccttgcctctccatagagtggca

SEQ ID NO: 29446 - DNA, 1150 bp, Mus musculus
gagggtgggatgtgatggaaataccctataatagacattaacccctggggggaggggagagggtgggatgtgatggaaatactctataatagacattaacccctggggggaggggagagggtgggatgtgatggaaataccctataatagacgttaacccctagcttgtgccaataaaacatgtcagccttggttattttgaattctttcagaggctcaggcagttcaaggcctacatagtgggttccaggacaaccagagctgcacagtgacaccctgtctcaaaatgaccctcccatcccccccaaaaaaacagtttacaaaaacagatattaggagttaagtcagatgggatttcagagccgccctatgtcagccctgagtgcccagcttccgttgatttcccacccacgtgtcctgtgcacactactgagcacactgggaagggagtcaagcacaggcacccccacacaatgctgcctagggacgttaccccatgtgacacgacagcagccactcttccagaacggctgtgttgtcatcatctttaacgtcgaccttgaacaggatttgaatggaccgcagagtaagaactgctgagattatttcatgactgaatcacagtcttcagttttatgaatggggagaatttaagtattcctcacagagttgtcggttttcttggttttgttttgttttggctggggttaggcactcgggtctgaagctggagcgccgtgtgtggcactcacattggagcctgcctaccacctcgctgctttgtataattgttctggcatgtctctattcttagttgtacatatatttctaggtttattatgtctgtgaggagagggaaggaaagatggtgaatgagagcgagagatcagaggacagcccttctctccttccactgtgggttcaggcagtgaattaaaatctgcaggccttcacaaccactgttccctcaaggccaaatatttggttgcagaaaatgttttctttcttagtttgagaaacatttgagcaataccattgacagtaagtggcactcacattctctgcaggtctgattgagaaagtgcagccttcctggctaccatgtcctttactaggtgttgggaccaaacctggagtgtcctgtgcgagc

SEQ ID NO: 29447 - DNA, 1195 bp, Mus musculus
tacatggaatctgatttctggtgttgcttattaccaaaaatgacagaatattcttgatcaaatgtctagatatatttttaatatttggggcatgagttgtccctgtttgagagttcccattactaatgtagaaatgttaaatggtaaaacataatttgctaaaatgaccagttttcagattcacctgtgcgtgtgccccccactcccatcccaccctgttctttccatagaacttttgatatcaggcaaacggtttcctttttgagatattttaacagagaaggggtgggggagaagcagatgaagctgtactacccagccctcttcttgtttgtatttgtttagggttgtgaggttgtgtaaaatagtactagcttcttacttgagaactacagtttctgcttatcatttattcttccttgtggcacttaatattttaattgtcttaagctttttgatgtatatatcctctggccccttacatgctgccagaggagaaggtgtttgtttgagattcattccacttgaagtgtctcctgggatccccacagctgcgtatggctgggaaatggacttaaggcttgggcttgaattggtggctcctacctgtgaggtcccatcgtgagtcactgggatttgtgttgcatggaaggcagtctttcctgttgtaaatcttccttttttatgtacaaatattttgaaaaatatgaataaacatgaacttttaaaagctgctgaactacagcttagtgaaaagtttccagtacctgtcctgcaatctctcctcctgcaagggataccatggcttcctttttcttttgagttcttactttgatggtcatttattttatatatatgagtacactgtagctgtcttcagacacaccagaagagggagtcagattccaccaaagagtcatcttaggggctggagagatggctcagcattaagagcactgtctgctctaacagaggacctgggttcagttcccagcatccatatggtagctcatatttgcctctaacttcagttccagggtttctgacactctcacacagacatacttgcagacaaagcaccaatgaacataaaataaaagcaaacttgttttttaagagagtcatcttgaggctgtggtggcatacacctttagtcctggcacttaggagtcagaagcaggctgatctctgagtt

SEQ ID NO: 29448 - DNA, 1782 bp, Mus musculus
ttgcaggctggaggggaggcagcctgctcgctcacacttcagtaccgcactaaggacctcaggcccagggaaggcagaggtgctccagctgttgccctgcgaggagtggtcagccatgctcagtgactgcgggcctcctggagtccctgccacgtctggggtgggcattaagggcagtcctgacctggcctctcctctcaggagtatagcatcatcatagaacagctctccaatggcaagtgggtcccctttgatggtgatgacattcagctggagttcgtgcgcatcgaccccttcgtgaggaccttcctgaagaggaaaggtgtgtgtgactcctgccagagaaagccactcagctgtcacctgtgtctgccacaggacacacttccccctgggaaaccctcctggttttgatgttgcttcttccccaggtggcaagtacagtgtccagttcaagctgcctgacgtgtatggtgtattccagtttaaagtggattacaaccggctaggctacacccacctgtactcttccacccaggtaagtgaggggcagtccagtttctggccagtaggtgtcgcccttaggcctcccagccaccagggcctgtcatctgtcccattacaggtgtcagtgaggccactccagcacacgcagtatgagcgcttcatcccctcggcctatccctactatgccagtgccttctccatgatggccgggctcttcatcttcagcatcgtcttcttgcacatgaaggagaaggagaagtctgactgagccagaacctggggtccacacagtacggccgaggccatcacgaatggatcggtcgggttctgttttgttttgtaaaggccatgggaaaatggcacagccttacctcagagggcgaggactatggggtggggggcagggaacatttttttttttctgtaagttttccaagtttgaatcactctgtggcaatttttgtatgtgcagccgcccccatttctaaaataaagagaaccactgccctcacctgtcacctggccccatgacactgatgatggcagggctgctgcctagggacactgtgccagagcctccgtgcctctcatctctcctcatggaggtggggatcacacacccacagtgtagtggaaactagactgacagctggcctaagaattgctgctgaagagacccgagagggactggaaagatgactaggttaagagcactgcagaggacccaggttcaagtcccagcacccacatggcagctcacaaccttctataatggtagtctgaggagatctgatgcccttttgtggcctcccaggagaccaggtatttaagtgatacatcgtatgtacagacaaaacacgatatgcataaaataaagaaaacccctgtgttcctgttcactggctctaggtcctatcagtgttcttttagttcctttgtttttgttttgtttcaagacaaggtttgtgttcctgttcactggctctaggtcctatcagtgttcttttagttcctttgtttttgttttgtttcaagacagggtttctctgtgtggccctggctgtcttagaactcactctgtagaccaggctggccttgaactcttgagagatcttctacatgctggggtcaaaggcatgcacatgagccacagctcagccacatctgttaaactgtatgtgaactgtctctgttagggcatgagactcattcctaatgcaagaccctcagttcagcacactgtgctctgctctatgctgtaaactcacatttaat

SEQ ID NO: 29449 - DNA, 1144 bp, Mus musculus
cacagagagtgaaggtggctgccgtcctggcctctagccttgtagcttctttgcttgcttttgccaaagaaaggtagctggtgggcacccacctcactgtccccagcagccccctctccctcacccatccccgacttgtgagtacaagagaaattagagtctgtcaggtcatccaaacagcacttttcttccttggcctcctgtgtgaggagaagggcttcttcccggcgctgcctgacacaagtgcgtgccgtgtccgggtgagccgcacagattagacagaccgcagcacgtgtgtgcatggtgcttgcttcactaaagtgaagtggctgaggcgtccctgggtaggagttaaagctcccccaccacaggatgaagatggatcttggagacctctgctttcctcttgagtccggttcatggttgtcgaagccccatcctcaccaggcccacagtgggatgtagtgcgccctgaggacttccctggatagctgtcctcgggtgccacctggccttgctgatgtagttgtctgacaaaatgtgtcttgtttggaacactggagaagctgagatggcgtgggtcaagaggatattaatattcggtgctctgtgcccgatattgtccctgtttctatcataagctgggcctggtggcaagccagtcttgtgagtttggggctagcccaggctacatagtgaaaccctatctcagaacagctggggctggagtggtggctcggtggaaaggaccagccctcagcctgggctcccagccatcgagcgagctctagttcctgggcttgccacgccctaccagactgcatgctgtgcagacatgtgcaggtaaaacatgaatgcacacaaaactaaaaacctggaaaagaaaagctctgcatttgccaagggagtcactcagcacagtcagaagcccccccccccccccggcctttctgtaaggcagctgcaggggcccggtggggcttaggtagtgatttgggagcccacctctgccaggatcaggaacaaatctcatcaaaggggataggagaacgggcttatttgtcccacccagtgcactctgcaggtgcctcccaccatgggagacaggagcagaagagtctcccaggcatcagaagtggccgtg

SEQ ID NO: 29450 - DNA, 1167 bp, Mus musculus
tccctcctttttgctcccctccccctcggccgctcgctgcttcacagtccccgagtcgccgccgctgccgccgcccgcatccgcggcaggactggcccgcgcgctccccggggtgcgcccacctcggtcccgcgccctccgggctcgcagggacaccctcctccccgcgcgtcgcggccccgcccggctcggcccccgccccgcgcccgagagcgccgaggatgtgagtcctgcccgccgctgccggagcagcagccactcgcgcgcggagcccgagcgcagcgcagctcagctgcgggcgctcgttgggtcgctcgcgcgggctgcgcgctcctgccccaagcggtgtccctccccggcctctcgccggccccagcgccgcggcagccccgagggccgtccccggccggccatccccggccccagcgccgctgaccctgtcctccgcgggcggggacgcgggcggaggaggtgccgcctcggagcccccggacgcgaccatgtcggaggtgctgccctacggcgacgagaagctgagcccctacggcgacggcggcgacgtgggccagatcttctcgtgccgcctgcaggacaccaacaacttcttcggggctgggcagagcaagcggcctcccaagctgggccagatcggccggagcaagcgcggtgagttccccgccccttaccccctgcggtgctggtgctgcagcctggctggggctcaggggtccccgcggtagtaggaggaccatctgcgagatctagggatccctcctgcggcggaagctggatcaggcctcgggcaagagtccccgcttgtccgggccaccagcggggtcacccgggggcgtggtagcctctacttgctgccgaggcccaaaggttatacccgcgtcctcaaccgcaccaaagtttgcttttaggtttcacacccctccccctttttgcgcagtggagtcgcatctgcactctctctgctcggccaccctggggtaaggggtcctggagcttcttaggggtctgcgtggggcgctgcaggggaaggaccttaactcccgcggggaagggcgaggagcattcaggtcgcactggcttttcactgttacttggcagaggggagaagggtggtctagcctgagatattggagttggagaagccccagggaa

SEQ ID NO: 29451 - DNA, 1099 bp, Mus musculus
gatattaaataaaacccattctcaaggctagaaaaacaccaccccagcacttcctctgacggggctggggtgggattgcccacgcttttccaacccccccccccccccgaggcatctgtatgctctcggggatggaggtcaggaaacaggtgggagccttgacgccttgatgcctttcatggtttgtcttgagttcattttcttcaaccttaggctccttcaagccagacctggggtttatgtttcttctggaggaagatgagacacagccctatgccaccttgagctcctggctagagagggcaacaatcagctcccagccctggcttctggcagctgtatggtcttttaaacctttggatagtccgaatctctctggctctcctcaaaatataaaacaaggctccttccaggagtatactggtgcacaccccaatcccagcacctggaaggtggaggcaagagaatcgggagttcaaggccagcctctgctccctagcagggatagtagcctagactatgtgagactgtgtttcagaaaggaccctggtacagatacaggggagctggggttctgagatgtcactcagtgagaaaaatggtttaaataagattcggggggggggggtagagatatatcaatggcggaatgtctgtctatttttcaccgagttaggggctctgaaaatctcaagtcatctatcgctttataaaagacagaactttctcatagcaacaagacaggaggaagagatgtattcaacagtaaagcagtgtccttccggaggaagggtctaggcttcttcaaatggagctccagaatgtgcacgggacacatccgatctatatttagagacctttagtgttcaaacattttctaaataaagctaattatatgagactaccctgaattcacatgttttggtgtatgctagtgactatatttaaacaatactggagtggggctcacatgctggtttttaactcatgaaaatttcaaaattggggtggggggtggtgtgctggggagatggctctgttggctcacttcaagcaagcataaggacctcgaatggatcaccaggaaaaaaacccaaaa

SEQ ID NO: 29452 - DNA, 1175 bp, Mus musculus
cttcatgagatacaatctattttcatgattaaaaaatgtcataaattagatataagagaagaatgtccctcaaaatcttaaagactacgtccagaaaacccttagccaatgccctgaccatgggaagctgcgccatttctaagacaaggcaaccgtttgccactcataatgaggcagaaaagaaagaagactgaggcacaggaagagggaaaggaaagccttcatcccaagctctggctggtttgactttgctgctggcggaggcaggaaactccacacaccgctgacagtgccagaattgctggcgttttccttaacacacggggtgcgggtgagaatgaaagagaataagcaaacttagtaaaccacgcctacgcgggtctcaggtggcttcaaggcccaacatttggcacttcttgttcctgacaacacccctcataaatccactttacagctttttccggaaaagcaaactctttaacctttcaacttgccacgaatgacattatttgagcagtaggaacagaaagccacgggtttgtatattcagcctctactgagaaaataagtgccttgcctgtccttcgagaagtccacacctagacttgggtctgtctcactgtcccctgggcacctctctgtccataaaatctatgtccaaaatccctttgaatgaactccaactctacgttatcctgaaactcttttccatcgtgtgtgtgtccagggataggattttacttgagtggaagtgaaggcggggagggaataccgccggccgaaggcagccacatggaaccacttgttatggtgatgtatgctttagggtgacagaagataaaaggccttgctctgccagctgcagctggctaagctaagctgctgttcccagaacatagacactagagataagataagcaataatgtgaaacacacacacaccacacacacacacacacacacacacacacacacacacacacagagagagagagagagagagagagagagagagagagagagagagagagagagagagaaagagagagaattaaactattaaggattcagataaccccccttcagggcacagcatcttggttttagtgaattagtttatttttctatgacctcagatatttctaaagcaattaagttatattaattgtaagagt

SEQ ID NO: 29453 - DNA, 1180 bp, Mus musculus
ctctctcaggttggggagtgctcacacagtgctgtcccgagcagaccagacccagaggcaccgtccttgttgttgttgttgttgtttctctgtgtagccctgtctgtcctggaactcgctctgtagaccaggctatcctcaaactcagagatccgcctgcctctgcctcttgtgagcgccaggatcaaaggtgtgcatgggttaccacgcctggccccaagaggcactttgacaggaacgtcccccacgtccttacacgtccgctgttccaccaccatccttgtgtgtgctaaggttctaacagttgactgctgggcccagttggtggtttctgctgaggggaggaagggagggagggagggagagaggcaaccagtgtccctttgttgtaagtgggagcgcaatgtgtgactccctgcactttgaggctgggctcagagagctctgtcccaggtcaagttctgacagttcattcagtctgtttctctctagagtctcagttcagtaagtcagttgaaatggtgactctcctcacagttactggagaaggctggtagccgtgcggaggatgctgtccctgcatacagttgcacacttgcacaatgagtttatggtaagcggggcgtacctgcaggccagggctcctttgctgcgtcccgaacataggaggaacctttgggtctggctctgagcctgcacatgagcatcctgcaggcccctgtttcagcaccagggcagtcactgaagttcttcagccctctgacagagctctgttgaaacctgagccctgctgaggtggggctcttcttgtcttcctgttcttgggggctcattttttccatagcggcctccctaccagcatcccttactagcactaagctcagggaagggagacgagcctgcagtcaggctcagcaccccacaccccgctcccttcctggtcacagggatggatggatggatggatggatggatggatggatggatggatggatggatggatggatggatggatggatggagtgagtgcccatccccccaggaagagggccagtgtgtctgccttctctcttttcctaattgcactatgcttgttctggcttcagtctagaggtgtctgaggtctccatgggatcatgacccttagactcagcaagtctgccttagctctagagcgtag

SEQ ID NO: 29454 - DNA, 1162 bp, Mus musculus
gcagctggctgggttcctccctccagctcttctccatgttagctttctatatagtagcccctaattccccctacctttctgccttaagagttaagtgacagccctccccaatccaaaaacacaaagggaagactgtgtccccaagtctctaggtagaaaatgacaggaacatggaatggacagggacatctctgttgtaccgatctggtcccttagcacccttgggttctgcagaagtgccccaggaaccagcccactcctggagggaatgatttgggaccaggtaaaggaaggcccgctgtttgtcttggtcccagagcggtttgtattcccaccttgtagctcttgcagagggcatccatcggagacacaaagcctgatcttgtcctcccgtccctgcccccacctcagatgagcctgcagaagcctcagagcttgttggcgaggggaagcattctgttctacttgaagtttcactcggaattgaaatcctctggaggccctgctccactgtggaattgagacgctttggcttcatctctcctttgccctcctggagtcaaacacaaggaaattcatgggtttaaggatcagtgatgggcacccagctgggcacaggacgctagagcaaagctgtggcgccccagaagtggcctgcactgccaacatacataaatacatacagcctgaacttgacactgtataatttagcccagaacaatatgtattttgaactcatttagatggatgacttttgtattctgagtggctggggagccttcattggagcacatttactgtctacagaggcaggcctttgttctgagacgtggcttttggagcattttgctgagctgtccctttgagtgaatgtcaccctctccctgctttcaaaagacccaagaatgcagtcccacaaccctgctgtaggaaacagacactgggctaagaagggagatggctcttgtttttgctgttggttctcaaacctctgtttacattttttttttaatgtaaccaacccataattgcattttgcttgtcatggttcaatctgattgcattgttggaaggcctatttttgagcttgtccaaataaactctgcagagcgtttccacgaggatggagtccatggagctgggtctgccttcctcggactga

SEQ ID NO: 29455 - DNA, 1103 bp, Mus musculus
ccttctctctctgcccgggaaccaaatcccattggaggcttgtgtgggatggctatattgtgataactgctgggcacgaaatggccaggtcctgtatacctccctggggactttcttcatagtcttcttcctcccttctcagtagattgtgggagaggtgctgtgtcttcactcagcagaggacaagagttgtccagagtgaggagctgccagtgaccagagttagcagctgctgtctcagctgtgcttggcactcacctgtgacctcctgggttagctctcactgtccatggctgccccttccggtcttctccctcgcaggctggggactctgcttgtgagggagatggaaacagaaagtttgcagtgatgggaccattggtcctggggttgcttgaggctgcagcaggtggagtcagagcatcgctgtctgttctaaccaatgtccttgcttcataggagcagtgacttatgctgagaacatcccagcgggaggaaagagaaaccatgtttattcctcaggaatactgaagtgcccggagtgcgctgacatcctgtgatggtgccatcagcaacgctttcaactccagccactgtttgtgtttgaaaccaagtctgttgcttttgtattatctctttggaaattgtaaggaggtcttaaataaattaaaaacgggaagcccaatgcaagcaatgcctttattcctttatgttgcaggaggcttctatttgaatggcctagctgtggcctctgtgacctcctgaagacacagacatgtccaacgcactcccctaatgcacagttgaccttcccacccccatcccaagactggtggcaccccactgtgtgtgatgatggccacggtgaggtcttcaggagcacactcctgatgggtgcaccagtctgcctcactgatgtctgtcccctgctgcatggagctctgactgacagtgtggagctggtggccagccccagcctggatggaaggacatgctgaggtctgagcacaagtggccactgcagtaccctctgtccttgtgggtttgtgaggcatgacgtagaccgttttccagttacttttgatgtgtgcagcacatgtgag

SEQ ID NO: 29456 - DNA, 1195 bp, Mus musculus
gacttctaagtactggggttaaaatgtgggccattaccaactgactagactacactttaaacatcaacagtaaattaccttagctcatcttatcttggtggtttttagttgtttcttttttggtagaaaacaggtttattgagtatactataagtaaagtcagtgtgacggggagtgacatgaatacagcacacaagctcgccgtgcagctctggctccaactcactgtgtagaccagacgagtctgagctcacagagatcctcctacctctgttggggtttcaggcatggccaccattcctggcaaactttttattcttttgtagttgcatttagcttgaaatataaacattttatggtgtttcttttatattcatattctgtaatcttttctatttttaatttttcttttttacatttaatttttttttttgctaaaatttgcccccaccccacccccactcccacatatacacatgtaatgtcctaggcccgcatttattcctggggtcagaatcattcatagcaccttcttccagctccacgtcacacctcgctggaaggcgagctgcagtaaagcacgcagaactgtcccctcctgccatgacagtcactgcagggcacctggacagcctgcttgaggcgacctcttcagaaccagcctggagctttgttttgttttgttttgctttctgcttttctccccaggtttgttggtggcagggaatgcaccatgaacattcctctctggcaacaaaaccctcttggtgtggggtcctgtttaactttgtacagagctcgtcgagtcttcagaagtatctgctaggcccttcattgggaattctctgggcttttccttctgcgcttgcctttctctggtctctccctccactgctggttcctgtttcaaccccaggaaatttgtggtcctaccacacatgtagtctgtcattgaccacatgttaggtacttgtctgtctatgaaagaaacacatcacggtcatgtatgtgatagactgatggaaaaacctgctgagcaaggtggtacatgtctttaacccagcagaggaagcagaagcagaccatgtctacatagagattccaggcgagtcaggactacttagtgagaccctgtctccactcccctccccacaaaaaaatgctaataatcttcctgggaccggggagatgattc

SEQ ID NO: 29457 - DNA, 1170 bp, Mus musculus
agggaggtcactgatgggtgtctttacacctactaagaagttttggatctcattttaaagacctccctctcataaccctccacccctagaatcttgttgtgtagcctacacacactgctgttctgtccctactaagtttcttttttgttgttgttggtggtggtttttaaagatttctttcctctcccccccccctccttttttttttgaagagagcattccctctggatgttctggaattggctttatagaccaagactggccctgaattcacagagctctacctgcctctgcctcctgagtgctggaattaaaaggctgcaccaccatgcccagcttaaaagatttctttgaattatttttaagccctatgtagtggcacatgtcatgaaaacattgtgtctggacatgggtatgtatgcatgagggcaagtgcccagggagtccagaggcagcaggtggagttataggcagttgtgaacatacaacatggattttaggagtcaaacttgggtctgctacaaaaacagagcagttctgaaccatctaactggcatgagagagcatttgtgcatgcatgcattttcttgtgtctgtagaaactcttgtgatggtttcaagtgaacttgaaatgtagaaatagattttgttatcattctaatactaacttccagaaagcagtctatctttaaagaactgctttgttgctggtcataggtggcacactcttttaatctcagtactagagaggaacaggcagttggatctcttaagttcgaggccttcctggtctacagagtgagtcccagtacagccaaaaagcaaaaacaaacaaacaaaacccccaaacaaaccaacctgctttgttgaggtgtatctcaagcagtattcattctatttaaagtattcacaaaattgtacagtcagcctcagtcttatttcaggatatagctgttcccatttggatccccccagtccagccccagcagctactaatctatgctatttcggacattgtgcataatgaaaatattaaatatataccttgtggcatagggtgtggcatgtgcctgttatctcaacagtcaaatagcacaagttagatgattgcttggagtttgaggccagtctaagccacagtgtaagactctttaaaacaaaacacgctgg

SEQ ID NO: 29458 - DNA, 1225 bp, Mus musculus
ttcaaggagtatctgaagctcaaacagtcaagtgaatggtgtgatgcaggtctgtagcttagccctatgtgagactgtggatgtctcagaatattgacctcaggtataggggcttggctcaggtccgcctgtgagggctgggcatgcaagcctgtaagagtctagtgcacgttcattggctctaggatcagctagtgtaatgctgttttaggcagccacagactaacgtttcagtgtaaggaggtggagatatttatggggttctagccacgtgccatccactctgccagaagctgttgattttcgtcttgcaaaggcttgatgaggaaggttgagccgtggaccacagacaccagggtataagaagctagacttagagctagacatagtggtgcactcctttaaaagtcccagtgcttgggagacagaagcaggcagatctctatgaacccaaggcctttctgctgtacatagcagggctccaggccggctgggatacagagcgagatcctgaatcagaaatcactccccctctctaaaaaaaaagagagagagagagagaaaagtcagattggaatgcagtgtccttatgggtggagtcccctttgagtgatagggcagggaccggcaacagaatgccagattgcttgttccacagaaccttatcccctgtaccgcctggtgctcaggaattgttgcatagccctgaggaagcagcaggtagtgagagctgaggtgcttggctcttccttgctgccttcagagtggggcgtgtctgggtggagtcctgattgcctttctgtgtgacctaagtgagcgcctctccttccttcccctcagttccttgctgtacagcgtgaggagaacatttcatagggacaccaggaaaaggaaatgtttttaaatttatcttctgtgtgtgtggtggacagaggataactttgggaagttggttctcttcttccatcgttggcccagaaatggcatttttaatacacttggcacacagaaagttggggctatagctactctgtgtcatattttgtatacccaactgtatgtaacataaatggaagccacagttcctgtcctctcaccttggagagcaggaaaggtgtgttcatgaagtctcgtaagctgacaggggaaagttgtggggaagagctctggaggccatgtgtgcaagctagtcaggtgttccacctcttcctggaagccctgcaac

SEQ ID NO: 29459 - DNA, 1192 bp, Mus musculus
cctttcttgtatcattttaatggctgtgcccttagtaggaccagtggtcatagtcttgcttattgattgccccgtgtgttgtgcctagagtagtggcagataggaagtaagagtgttcgtttgtttgagtacagtaattcagtttccacacatccatcccagcgaggtgctattattctaatttattgatgagaaaattgagattcagggaggttaagtaatttgcttatcattatgctcctggttaattgtagcgttcagagtccttcctagcttgccagttagtgcaaggcccatcccctgttaagtctgtctatgcaactgcagtggccagttgaaaaacacatctgcaatgcaggctttaaaagtgaagttcaaggcttgcttttgttatgtctgctgaagttggaggcaggcgatggttcttctggtttaggatttagggatgacaggcaggtgtctgtctgcactagccctccctctctaggcatctccctaagcttccattgcagtgccctttgggggcgctgctcagcagaggctgggagagccgggcttctgccagcagctctagggaatagcagtgggtggggagagagaagaggtagaaccggctctgtcagtattctctggttgcctgcctgtcccaaaggcgttcatctactgtgagactgcattgctggctcagagttagaaagttgaccctgccacctctccctactggcaggtgactttgtgcaagggtcttgccctctctgagccgtgaagtttcagttcctccttctagcaggtcccgtggatgccatgccacgccatgccaggacccctgccaggagtggctgcaggagaaagcaagcagtgccttcgggagcacagccttgcagtggggctcacaatggggctaactttcctggtgaggctctgaagagaaagcgaaatgcctggccccactgcgctccgagatgagtagttggttcctgtagaccagcgagacgagacaatagataacacgcagatgcaggcctggaggtacaaatagagatataagggcactgtaggccttccctcggtgggaacaggactcctcctttgctgatgtccacacagccccggctggtgctcaacccagctaacagtccaggaggtgccatttcttccctcaacccttcaccttttgtagagtagaactttt

SEQ ID NO: 29460 - DNA, 1115 bp, Mus musculus
gtcagggatggcttcacagttgcagtttgaaaggctcagaaattggctcagcactttctatgacctctaccaggtctggtctctgggctcactgaccacagcaagctttgatacctgcatggtggagctggccacgggctggctacagaatgtgcccaggccctttggagttgggtttgggaggcccccacacagatctcaagacactgaagagagctgagcagcctggcctgaggttccatttgaaagctcctgccgctgtctagtgctctgtgttttgcagaagcaggcaggactcactggcctctggctccagtggagtgggagtgggaggcaggacccagctggggagaggggaagtaactgaggagggactgagatagcactggccttggagtcatgtggccaggatcctgtctgagctctttcctctttccccactcctttctcggtggccttgtcccatccgggaggcagggtgccgacagggttaggagagcagggttgggagggctctgcagtccagctctgttgtgactctgtggggcccagtcttctgatgtcattccctggcccagaatttaatgcacccaacagaaaggcggggtgtaacttgtgagttcacccagcagcattatttaggtaagacagcccctcctggtccccagtggtcctgagtatctgatctgtcaggcctgacactgggtcctgtggcaccaaatgcaccctctcctgccaggccagactcctccattcccagtaatgaggaaaacacgaggaacatctgagcctgtgtggggtcgggtgtgaacccctaaagaccggggccactgccaactgtggttgtggtgtgcagtcagttccagtgtcgtggtggccttctcctgtctctgcctttgcccacggctgccaggttcttgttcggcattgctgttgctctcttgctgtggcttcaccctctctgaacactctctgtagatctcttgatgctatccccgacaaccacaagtttaagcagttgcagagggaactttctcaagtgctgacccagcgccaggtctacatccagcctgataattgagccgacccaggtatcctgtctgaagggcgtgagg

SEQ ID NO: 29461 - DNA, 1390 bp, Mus musculus
cctctctgctagcaaaggggcaataggtgtgagggcaaaggcccaggctgcgtggtttctgaaagctcccaacagtttgcggcctgcatcgccatccatggacctaaaggccgggtcacccacagcctgggcagagatgacctctgtccatgatggcagcaaggtactgaggtgcaggcctgggctccccttcctgctctccaggacagactgcagcctggcaccccacagtggccccggccacctcgctctcacccttgtgcctgctgatgtcttctctcctcccccgcaggtctgtgcagacgtttgcagacaaatcaaagcaagaagcgcttaagaacgacctggtggaggccttgaagagaaagcagcagtgttgaagacctctgcttcacgctaaccggacacgccatgcactcgttaggttcctttctttagaaaactcgttttctgctccttttccctcttcctttcccgccctgacaggtcacataacagtttgcatcgaccacgcagcgccatctctcccccaaaataaagtccgataaccaccctcctctggctccaaggcctgcttcccacgacgtttccatagagaccgtgtggttttgttcgcctgtcccccttccttcccttgcccatttataggcacagatacactgtctgacaccgctccctccatctttttgttacattggtgtaaaaaatgtaaaacaaaaaattttatgaactaactggtgtgtgagagaagaaactggagatctgatccgtgtgtgtgtgggagttgcttggagtcagggctggggacaggggacagcagtggaggaaggagtgatgtcctcagcactgtcctgcacaggtggacccttgtcccaaggagaccatgctggggtggggtggggctggcgaccggctgctcttcaggccaggtgcttttctgtcaatttttatggaatgcaaaaggagttttttgttttattttggtttttttttgtaaagcttaaacagacaaaaaaatctacatcttctacttgagcctccatacttaaaaaaaaaaaaaaaggaaaaaaaagaacaaaaaaataaataaaaagaaactgggacacaatcggcgctggctgtacgttcttgctcacctgcctctctccagacgtgcatagccttccctggggactgaaggagggcccagtacctgctgaacccttccggcctcattagtcatctcccctgagtgtgatggctgcatgcttgccaccccatgttggtgatgtccccgacttagtcctggtttctcttattgtatgtgaagtacagactccatgggagatggaagagtgagcaggccagatgtcatgactcacaccgcaatagcaacattgaagctgaggca

SEQ ID NO: 29462 - DNA, 1459 bp, Mus musculus
gtagtttagactgttcagagaatcgagggtggagcgaatctcaagaagcaaacgttcactccaggcatctttaagaacatttatgcagtagggacttagaatttacaccaaatgaagactgtaacaagacgtggggataaatggataagattttctcaccattaaccctttaaaaagacagttgaagtcagggcggtggttcttgcttgcaatccctgtactctggaggctgaggcaggaagtttgccagtagttcaaagtcagtggggttatatagcaagcagtagaccagcacggaccaaatagcacatggtgtggtggtctacccctgtgattccggcactccagaaacagaggaggagaattgactaaagttcaaggctgttctgggcaacatagggacaacaggtctgccaagcccatagaacaagactgtttcaaatgtcaaaatagggtttggattatagcttagctgattggatgcttgcctagtcctgggttaaggacccagtgagtaaggtaaatcttttcctgattccattttgtgtttgcttagacatttggtgtatgtgcttggctgaggagccaatgggtcgaagctaccatctgtgggattatgactgaacgcctctaagtcagaatcccgcctcggcggaactatacagcggcgccgaaggagcctcggttggcctctgatagccgggtccctgtccgtccccgcgtcctcccagcggtggcgcagggtctccccccgcctggcgtcgggaccggggtccggtgcggagagccgttcgtcttgggaaacggggtgcggccggaaagggggccgccctctcgccagtcacgttgaacgcacgttcgtgtgtggaacctggggctaaaccattcgtagacgacctgcagtggttctcacccttcctaatgttgtggtgaccccctaccctcaaattatttttattcctactctatacctgtaattttgctactgaaatgaatgtaaatatctgataagcaggatatctgataggtgacccccatgaaagggtctgtcagcatccctaaaggggtggccacccaagagcacctgtagcttagatggttctcaaccttcttccccctcaacagtaatgttgcctggcaacacatttgagctttccatgatgttgtagatggcccacatatattaaccaaaataattattgtatatataaacttaaaattaactcaagaagttacaaataaaaaagatagctgtcacataatgtctgaaataatatgaaaaaaaaagttatgttctgccagaaatgagtgtttcaaggttactctgaccctcatttaacttggaattaaattatggtctttgctttgaaaaaacactgtaagtctgagcttttataagtctgagtcatgaactcattcttggtcactggccaataaaagactcatattctttctttct

SEQ ID NO: 29463 - DNA, 1324 bp, Mus musculus
tgcaggcagcaggcttgctctgttccagttttcgaggatagaattgatcagttttttcctgtcacgagtcagcatttgtttttcttgcagctctttggcatcgagagcagctctggaaccattctgtggaagcagtatctgcccaatgttaagccagactcctcctttaagctgatggtgcagaggactactgcccatttcccccatccaccccagtgcacgctgctggtgaaggacaaggtgaggccagccatgccgactgcagcccagtgtgttgcctttgcgtatttcacagctgagatttctcccatgttttgggcattccatgagaagctcttgggttggaaggcctcatttttgccagtttctggcctgggtggaggagccatccagctgtgacggggaactggctaggaaccagacccaccttcaccagcgcagttagcagttaggctatccctggtagctgatataatcacaaagctattatgatttctgcctctagaatttgaatggatttttgtggatccattttagctgtattgtgaggtagggtttggtagatattcttttgcacccaacaagcattagatggctgacttggttttgagagcacatggtctcaaatagccctgactagtctaaaaccagctatgtagaccaagtggcttcagacttgcagagatgaagatgctaggattaaaggcatgtaccactacagctggcccaggacttgactttgatttgctctttggcatgctcagttcttagctagacttggagctggaagcagtcccatcagcctaggggacctgtcatctgtggccgagatttgacccttcatgaagatgacagaaagcagggattcctcatggcttccttcctgagcatcccgggctcacctggaggacgtgcgctccctctgtgctcttctcttcccattgcaggagacaggaatgagctctctgtttgtcttcaaccccatttttggcaagtggagccaggtagctcccccagtgctgaagcgccccatcttgcagtcactgcttctcccagtcatggatcaagactatgccaaggtgttgctgttggtggatgacgaatacaaggtactgtgccttgtggggaatggagtgttccgtgtggagctggctgtgggatgggggtgtcaggcactggtgctggggccgaggcagcccacataccagacagcccgtttgttgtcaggccaccagcagcaacaggactgcccttgtgagcgcctggcttcataaggtgctcaccaccacgcctggccatggttttttattacttgaattctgtg

SEQ ID NO: 29464 - DNA, 3272 bp, Mus musculus
agcaccgtgccagagtggagcctcgggaagagggacagctaaggagatggccgtggactgttggatccctgaggttgggctgggctcttgtctcacttacgtctgggagaagaaggtgcaccttcatggagaagtgcttcgggaacacggtgacgaacagttcttgtggtcagatacccacctcagcgtggaggagctccgtgcatctgatccactccctgttccctttatgtgctcattcgtggatgctgtgagccttttgtttttgttttctttttgtttttttgttttttttcctttcatgagacctctggtttctttcttctgagactgtttaaattgaccttagttaaccttctgtatttccagtcttactagaaatattctgacaccttattctcttgtctcttgctttcaagcttgatgggccagctctggctttaaggtgtgtgtggctgcctgactgatggggtggatgcaggagccattcttagccaaggtctgaggacttctctctctgaagagaagttgaaggatccatacatggagtgagaactaattttaaccaagctgtcattccatgccaccatttatatggctgggccatttctttcagcctatcaaagccaagcacataacagtaatttggtttttcatccacaacctgtgctttttctcctgagctatagcaaggctaaaatctttaatacttttctttcttttttcttttttttgtttttgtagacagggtttctctgtgtaactctgactgtcctagaactctctttgtagaccaggttggtcttgaactcacagagatcttcctgcctctgcctcccaagtgctgggatctaaggtgtgtgccttagggctaaagccttttaaaactaacagtctgagccttggtgagatcttgaggtccagtacatcaaatctattgtccctataggcccctatagacatcctgtagcacagctggaggaaagcagctttgttaaaacctttttttttttttttggcttttcgagacagagtttctctgtatagccctggctgtcctggaactcactttgtagaccaggctggcctcgaactcagaaatccgcctgcctctgtctcccaagtgctgggattaaaaggcatgcatcaccatgcttagcttttttttttttttttaaagacagagttttgctcagttagcccaggctggcctcaaacttgcaatcctcctgccttagcctcccagtgttgggattgctggtgttggccatcatgcttggtggtgggcaagttttaaatctcattggtataattttctgcgtggcattaggggtagaatccaaggtctctcatgccaggccagttctctgcactgaagctctccataaggtgagccacgagggctgttgtttttcttagttttaaaatcttaataatttttttgaggggctgcaaggaggatgctgtgcctcaaacccagggcctcatgtgtgttaggacacactttactactactgagctagagcctcaacacatctaatctttttacttattttattgagacaggatctcaccatgtaaccatggctgggctagaactagctatgtagtctagggttgggcttctgtgtgtggtgtgtatgcactactgtttgggctccttctgtggtgtgtgtatgcactcctgtataggcttctgtgtggtgtgtgtgcattcctgtctgagtttctgtgtggggtgtgtgtgtgttttcctgtttgggcttctgtgttaggtgtgtgtactcctgtctgggcttctgtatgctgcacagaaagaatcccaagtttgaccttgcttatgaacttggggactgcttgttcttttgagcagggaagtcaaagagttgaccacgctcctggaataaagctgatgatcggtggctcagctttgttttgtgtcttcagagttcacttcaaggctgcttttgatgggggggtggggaagaaaagccacacatggaggcatacccctataatagcagccacttgtggaggcacacccctataatagcagcgcgtgagaggtggagcagggagagtcagaagttgaaggtcatcttcagctacatattcagcctatgctctaagagacagtggttagaagtacctgttgctttttcagctccgtccctagtacccacattgggtgcctcacaagcacctgtatccccacctccaggagatctagcatccttgcctggcctcggggtgtgcacatatgcacacacatagtaacttagaaaacaaacaggaaaaaatggagttatgtagggcaaaataccaacatcttcatcagtaataaccagtttcctctcctgggttagtgagtatctgacacttccagtgtcagtccctgcctggactgctggcttcgtggaaagccacctgggagaaggcattggaacccattacacttttctgctctagtttttgttttgttataagctctcaccttgtgaatctgggagatgtgcttggattaaaggcatatatcactgtaccccacctgctctagtcttgaaatagagcagctggaattttgtgcaagatagataagtaactcttaccacactgccctgtttgtttgtcttggttttggttgctttaagatttatgagtgtctcccctgcatctgcgtgcatgcctggtgcccacggaggccagaagatgctggatcccttggaactagatttagggacaattgtgaccatgtaggtcctgggaactgaactgagccctctggaggaactgaatgatgtgtctcttatagtgcctgctgtgtttctacagtacagttagtctgcaagactgttttttcacttaccggccagaaaaagtggctaatggtcgggaagtgacctaccttttctagaactcccggtatttcacctttaacctttaccatatcaccaaagctgctcagagcagctgactgaaatagccaaggcctgagtgaagtcttaacttgtctcctaagtctttattttcctttattattattattattatttatatattgtctgtctctatagctctgactttcctggaactccctgtatagaccaagctggccttgcattcacaaagctctgcctgcctctgccttctgagccttgagattaaaaaagtgtgggccaccatgcctggcttcatattatttttactatttgtgtatattgtgttttgcctgtgtgtatgtgtatcatatgcatgtctggtgtcaaaaaaat

SEQ ID NO: 29465 - DNA, 1439 bp, Mus musculus
gccgtagacaggctagagtctttcccaagaattgagagttaccatatgtgtaagcaggaagcagagagaaggatgtgtgattgacagggtagcaggcttgaaggaaaagagacccggttttatcattctctgcctatggctggttgttaccatgcagaaatggaggtgtcaagttactgtgttgtgtattattgagactcgtgaggtatccatttgttttaaggctttgtgcttttataaaagttaaccacagcctcaagttgaaaacagaaagaaagtggtccactctgagaataagactgacagcagccggtcaggtctcggtgagcgtcaggttgggatctttgctttggtgcttctcactgaagctttattctcctgacctccaccctcccttctggagccccagggattgaaccctgggccaggtgtatgctagccagttgctcccgccctgtcccacactcccacccagccttttacatggtagttacttgtaggaacccaagtctgaccccattactagttagaatccccaaagtatagaattttctaaaagacatatgtgactctgttttattttcagaaacacttgattctgctgataaaaggcctgtgcactggctgtagccgactagacagaacagagattatcacctttacagcaatgatgaagtccgccaagcttccacagacagtgaagacgctttcagacggtgagcgccctgcacacctggttccatgaccacctctgtgtccactgctgccttctggggtactctcctcatcctcccccctttttctgtttctgaattttatagtggaagatcagaaagagctggcctccccagtaagccccgagctcaggcagaaggaggtacagatgaactttttgaaccagctgacctcagtttttaaccctagaactgtaccatctcctcccatcagtccacaggctctggtgagttcttttgcccaaatatccttatcttcatgtgttaaagtgatagaaccggaaaaaattgtgttttatgttttatttaaaagatacatcataccattttggtcaggggcagaccatatatatgatggtggacctataaaacgttattttctagtgacctgtgaacatcttggttttcgtgagttactcaggtacttatacaatgacagattcattcaatgaggcatttcttagaatatattcccagttaaatgacatttctgtgcatggcttcagtggaaaaaatcatggaaaacaaatcatacaaagtgaagcagatgtgtacccatcttcctttgcatggttggcactgtggcgtgctggtcgttttttcgtgctttgtcagggcaggtacactggagcgtgtggtgtgctgctctccacgaggcaccgctctgtgtttgatgggaaatagacagtttctgtgccatgtctt

SEQ ID NO: 29466 - DNA, 1211 bp, Mus musculus
catggcacagtcgttcaagaaggctctgagagctagggatggaggaagggctccttatgaagcacaaatctctttcctaaaagccaaaggacatgcagacagttggctgtgctcactcctttttgtataaagctccctgacaagttcttgaatattgtagcatctcctttccctctccctttcctcctgggtcccactggcttagaactctgcgcccatgcgtgtgtgtgtgtgtgtgtgtgtgttgttgatcacttgtgtcacatcattgttgtagaggtcagttggttcgttcttgtgatgtgagacccggggttgggacaaggggtggcaggcttggtggcgcgagtcttacccccactgagccatcctcctggcacacatctgacttttggcttctctgcaccagttttgttctttaacttgttctcctcgcagcattaggagttgcggtcttggggcttttctggggtctctccaccagatatgttcccctttctctgctctaggtttttaactaccatgaagcagaatgcactgcagggggtggtgcccagtgagacagaagacctgaacgttgagcacctgcagctgctgctgctcatcttccacagcttctctgagaagggccgcagagccatcttgaccatgcttgtgcagagcatccaggagctgagtgttaacatggaggtgcagatgcgcactgcaccgctgatcctggcccgcctcctcttgatctttgactacctacttcatcagtactccaaagcccccgtgtatctgtttgagcaggtgaagacccacactctctccttgttctcctgccaagagctccattctttgcaggcaataaagttttatctgtggttgtgaaggctttatgggtagagctacccaagcctttggaattggcctttctgtttggtttggagtggtaaccagggtctactcagtgacggctggatgatggctatgttcgtgtttttttctcatctgccctgcatttccagtagcaatagtgtcctcagccttgcctctgcctcattattagtgtctgaggcagggttccgcagtgaatgccttcgttacagtcttctgtgaatacacacaggagggtggttaagaggtgctgtgctcagcaggttttaaactagttcatggagcatcatccccccgatgcactataaaaagtgcttcccaaaggaaattac

SEQ ID NO: 29467 - DNA, 1099 bp, Mus musculus
ctggttctatagcattctatgtagttctcatggttgacattgagagaggctctagcaggcctctcagttcacagtagacacaggttctgcctggaagtctgcctttggaacacttgttaccttagggagatctgagcgtgtcacatgcttccactgctctgttcacctcctcaggaggcctgcgccctgcagtattacttcttgattctctggaggatcttaggaattttgccaccttcaaagacttacatgaaccagctggccatgaattcacctgagatgagtgaatgtgacatcttacacactctgcgatggtcgtctcgcctccggatcagttcctatgtcagctggataaaggtgccaaaggggagctcagcctgctgtgggggagcttcacaggccatgtgctttgtcctctgggggcttctaaagttaatgaaagctttgcactttccaggttgtttttcctaactcactctcttgctatccataggatcaccttatcaaacaaggcatgaagcccgagcatgcgggctctctcatagaactggctgccagcaagtgtagttcagtgaagtacgatgttgagattgtagaggagtactttgcccgacaggtatgctgttattctgctggcagcgacaggactgggctctgccagagcctttcggcacagttaactaattaacatcctggctgttcttaaagatctcgtccttctgctccattgactgcactgccgtcctccagctgcatgagatccccagtctgcagtccatctacaccctggatgccgctgtctcgaaggtccaggtctctctggatgagcacttctctaagatggccgcagagaccgacccccataagtcatctgagatcaccaagaacctccttccagctacgctgcagctcattgacacctatgcctcgttcaccaggtgtggagacccgcactctctgaaagatccctgtgtctgtgtgtatccttttcttgtgtgtgaactttgtgttttccctttggtgcaggatgtgaaagggcgccagagaagtttcagtcagctcatgagtcccaggatgtctcatttttataattttacca

SEQ ID NO: 29468 - DNA, 1106 bp, Mus musculus
tactagatgtcttgtgctgtagtggttcaagtccagttctgaaattgctgtgtttatatgtttaatgcttaatttataacactagttctaattaattaaatttgtacactgccagtttcatgcatgtttttaatacattctgattattctccctcacatgcttttaaaattttttatttatctatctatagacaaggtctctgtgtatatagccctgggtgtcctaaaactcactctgtagaaaaggttggccttgaattcacagggctcttaaagacattttgtttatatttcattttattgtgggagtgggaatgcttgtttgcctgatgtctgtgcaccacttgtgtgctgttgcctgtgggagccagaagagggcgctggggtctgtgggacaagagtgacaggtggttgtgagttgccatgtggtgctgggactcaaacccaggctttctgggatagtattgggtgctctaactgctgagccatttgtccaacattcccacagagtctcttttctccctcctcctacccctacccctgccacacacaagttccttccccatattcaaattaaccacggccctctgtgtgaccatgagttttgagctgaccgtttgtagcctggtgtcttgagcactcttaaaaatgaaagactatacttagaataccttttttttaattagccaagttggagaaggtgtgtgtgctgtgcttctgggcaccctgacccccatggcaacagatatgctggcgaacggtgatgggaccggcttccctgagctcatggttgtgatggccactctagccagtgccgggcaaggagctggccaccttcagcttcacaatgctgcagtggactggctgggcagatggtaagagggactttacctgtactggtgttctgtacttaagaggaagggagggacggagggagggagggagggagggagggagggagggagggacggagggaaggtcgtgtagcttacttccttcataagtcagagttagtataaagtaaacctaatttatttcatcctgcctatctactgacacacacacatgcacgcatgcacacacacacacacacacacacacacaca

SEQ ID NO: 29469 - DNA, 1100 bp, Mus musculus
gcaccatgtgctctgagtactgagtgtctctccagcctctgtccactgggctttgaagagacatacagaaccggctgctctggtttgcaggtctctggcagggtgaatgctgggaaaccctttcaagccactcttgtcttgaggggcctcagtttccatctgtaatccattcttcaaattcactcagacttaacgcagaagagtgagcaaggccacaggagttgtttgtatctctctgagccgctgtgtgcaggccatggaggagctgtggggctgtatgatgtagtcttccctctctgccttgatactgacctctggtctccagtcctgttagaaagtgcttgacacgaaaactaacgcttccttgtctctcttgcagcatgtgatggtcttggagtgcacatgtcatattatgtcttacctggccgatgtcacaaatgccctgagccagagtaatggtcaaggcccaagccatctgtcagtggatggggaagagcgtgccattgaggtggattcagactgggtggaagagttagcggtggaggaggaagactcccaggctgaggactctgtaagtgctctagggaagggaatggctcttcagcctgtccagtgtgctctggtactctgcctcctcggtgggcttgaggacgttgagtcctgctgccttcttcctgctcacaaggctaatgcaagagtctgcggctgtgcttctctagccctgcagagcaggcgcggagccagtctcctgctgaagcaacttttcaataagtacatgtctttcttctctccggagttacttgttctgcttcatcccatacaagtttggggagggatggtgggctcttgaaagtattgaaggtttttgttgtctgtctcccccgttccctttcttgtcgacaaaaccaaaagagggcacttgtaattgtgggaagctttcagatagatggctacttcagatcagggcaggctcccattagacacgggtgtctctccatggagtgttggggcaggggtattcctatgggaccttgtatggagagggacatttatgattaaaaagatccattaatctttgaaggatgaagattctctttgca

SEQ ID NO: 29470 - DNA, 2174 bp, Mus musculus
aaaatactctgtatcattaccatcactttaagtgaaaatgcattttaacgttggagaacagcagcacttcatttactttcatgagactttgaccctgctcttggaaccagactgaagcagtagactttaatcagtggaggatagtggactgcaggctaaagtcacttacttgttttgagctctggctggcctgaactcattatatagaccaggctagcctggtactcggacttcaacctgcctctgcctcccaagtgctgggagtataataggcttttgccaccatgcccttctacttttcctttgttgttagtaattttattatttgagaattatgtgaatgcatataattgattttggtcagattcacaaagccctgcctcccagattgaatactgctgaatgactaagggttgcactgccccccaggtgacagtggatgaacccacctagtcttacttgctttctccaatactttctctgcttctcccttctgccaggttcccaccttaggctcacaggaaggtgcctttgagaatgttcggatgaattacagcggagaccagggccagactatacggcagctgatcagtgcccacgtgctgagacgggtggctatgtgtgtgctttcttccccccatgggcgccgccagcatttggctgttagccatgagaagggcaaggtaggtcccatgattccttcccattcgttttaggatcggtgttcaaattgaccctctgaggggaaacacccacactttgtttctgaggacgagactgatctcattaacccttttggcttggacctgagtattggttatcactagaactgaggtgacttgggaaaggctctggcaagtgattggctggtgttcaggacaacttagttcccatccccgcccatttttggacgtggaaaggtacaagcagagaggcagaagtcttcttaagaagccagtgttccttgtttaataattcctgctccagggatgcagacactccgttggggaatgctaggcatctctttgctgtttttgcctctcatcagggaggctgtcttaccttaactgacagtgtggacagtccttaaagcagatggtccagaaggagcttaatggggcgcttgaggcggtggtgcctagggattggatatgttaggaggagattctgcacagaacagtcgggttcattacttgccattcttgtcctcactgggagaaggggagcatgaccttccatgtctgtcttttggggagaagtagaggctgaacttgatctacaggttttctaagagactaaatccgcaaagccaggcagtgacttacccttctccccagggagcctccttaactgcctaccttagactccacgagggcctggggggccctggctggccagcgcctgggcctctgcagcttgcactccctttgcagatcacagtgctgcagctctcagcgctcctgaagcaagcagattccagtaagaggaagctgacgctaacccgcttggcttctgccccagttcccttcacagtgctgagtcttactggaaacccctgcaaggaggactacctggcagtgtgtgggctgaaggtaaggacccagtgcaggactgactcctggagctgggagctctggccaagtctcctcactgatagatagctgaaggcatgagagctgctggaatgtaaatgtctttctctgagctcactcagtgccttctgattgctctgatctttgtgtgttttggaaacctgagtgtctaggcagtctgaattgggagctgcaggccgggatggtaggaaaagggactcatgggagctcagggagaactagctgactgtcccaggccctgtccaattgctctgttcttgaactcatgtccaggactgccacgtgctcaccttcagcagctcaggctctgtctccgatcacttagtgttacatccccagttggccacagggaacttcatcatcaaagctgtgtggctccctggttcacagactgagctagccatcgtcaccgcagacttcgtcaaggtttgctttcgttctttcttgaatacttgagttaaaaaccagtatctgttatgttgccaggtaggtcggcaaccatgtacctgtaggaattatgtctgtacacacttgtgactacttgttataaatttgcgtatc

SEQ ID NO: 29471 - DNA, 1158 bp, Mus musculus
aggttctgctgctggctaggaaaggactctgaagaataggaagcacactttttagggatggtcctggctaagtgcaatatagtgcaggcctcatcacatttccttaaatttgttctagagcttctgtgttttgagatgaggatgtagcttattgtactgtaaagaaatagatactgttgttataagctgtacagtccatacagatagcaggttatatatctatatctatgtatgtgtgtgtgtgtgtgtatatatatgtatgtatatatgtgtgtgtgtgtgtttgtatgtatatatggttagggatggtatgctggagagttgaccttgagtaatcattgtgatgggcagtgatggagtcccgtttgattagggtagtgtgtcagcaggggcttagtcttgagcctcggagtgggatcagaagtgctgagactacacattaatgctctgtggcaatctggtactgttcccacagcagcccgcacatccagccaggtcaccttccccattgacttttttgaacacaaccagcagctaacagatgtggagtttggcggtaatgacctcttgcaagtctacaatgcacagcagataaagcacaggctgaactccactggcatgtacgtggctaacaccaaggtgagcagcacacggggctggctcactttgtgggtggcactcttgtgagcagcgttgttgaacaagttgtgcccatctcctcagtatgaggcttgaatccagagccttgcacatgcaaggcaaggactcccatcattgaggggtcgggctggcttcacagcttcctttagaatcagacatagaatatgtatttgaaattgctcacttctggtcaaatgatccttgaataaatcaaccttctttcatatgctgaaggtcttgagtcccccaggctgttagaagggttattgagtacagggcaccatttgatagtttgagctccggggaggagcctagcattctccctctcatatctatgacacgattaggatggagttcaaagaagttaggtcttacccaggcagccattgaggggatgtgggaggaaggaccctggagattctctgactgtgtgctctttccccgcagcctggcggcttcaccatcgagatcagtaacaacagcagcaccatggtgatg

SEQ ID NO: 29472 - DNA, 1200 bp, Mus musculus
aacaatgtatctgaaagacttggttgagagtcagtttagaagtagtgtggaaccagccaggaaagtgttttcactcatttccaggctgctgttgccttagtcctctcatgggtcacactcctgacgacccctcagccagagaggagagtagatgccaattggcctgtcaagagaccagctttgtcaacaggtttggggaatacaggggaggtggtattatctgcccacctcaagtttccccgccttgtccatggctgtccacagtgattcctgcttctctggttcaggttctgcaagggcttctaaggacacttagcgaattgaaagacttaatgaaaacactccagctacagctgataggctgcactacagtgtcgtgggtttgctttgctgtgtgtttgcctattgttgtctcgacaccctctaggtggtgctgagatctgtgcttccgtctcaggctctcaagggtctagagttgttttttgtcaacatattttcaggtgatcttttctcccatttaggccttactcatattgaagctacggttaatgcgttggtagacattatccacggttattgtacctgcgagctggactgtatcaacacagcatccaagatctacatgcagatgctgctgtgtcctgtacgtatcaacacagccccagatgcctctggtcagcctgggagtgtgtggaaaatggcctaatgagcactgacctgaaagaatgaaagaaagtagacttaaagtctgaggggctgggctgaagaggtggttcagtggttaacagcactggttgctcttccagaagacttgggttccattcctagcaagcacataggaagtaacaactgctgaaactccagttccagggtttctgacactctgttcttgcctgcttgggccctgtatggggtggtgcacagacctaccatgcaaacaaaacactcacgcacataaagtaaatcttttaaaaatgtgatgggaatcagcaatcgcaaatacatcaacgctgtagagacgaagtctgggaagggaggacttgctccctgttcagtgatttcttcccatttgtagtctggaacctgctgtagagagaatgttgagtaagtctcagttccatgactgtgcgaaggctgtgtagtgtgcctgttctagaagatgagtgttacaaggctgcttatagtgtggagcagagagga

SEQ ID NO: 29473 - DNA, 1191 bp, Mus musculus
tccatccttttctaacagttggggatcttacctgggctttccacagccttcccacagacaaggaatccagtgagatgtgtcacagtggccggcctcaggttttagtcgatggcctcagatttcaatcctggttctggttttggtttttctcatagtgattgtatagttgaaaaatcttacagacgtagctgtttggagaaatgaagtctaggctacagtaacgtggacaccattgacagatactcgtgagttcttctcctgttctggcaaaggtcttctgagaatggagctcacagggtctgtagtattccatttctttgtcttgttgaaatgtaaggttttcatcctttctggactggaagtctcttcctgttgaggggaagctgttgctgctgactgccatctccccagaccctgctggttgtagaaaacgagagaagtaggctgccagcctagcacctacaaatttgtccttgcaagtggggcctgtctttagactcttgctgtgtgacagtcacatgccaaggagtaaaaataatacctttaggttactggggtctctttgtctcaggagacaaggacgacgatgatgacgatgacgcagatgagaaaatgcagtcatcgggcatccccgatggtggtcacatccgccaggaaagccaggaacagagtgaggtggaccatggagattttgagatggtggtgagtctggcagcctgaaaggaaggaagagcctccatcgcccctctagactcagcagccggactgtttgctgtaggacactgatggggctttctctctgcagtctgagtcgatggtcctggaaacagctgaaaatgtcaacaatggcaacccctctcccctggaggccctgctggcaggtgctgaaggctttcctcccatgctggacatcccacctgatgcagacgacgagaccatggttgaactagccattgccctgagcctgcagcaggaccagcaaggtagaaggcaatgtcaggaacacagcaaacttgcacaggagatagggcgtgacagttgctgataccccactgacttagcttgtccccagttgggggagaggttgatctgggtgaaagctgctcagaggtacaggtggagagtgaggaatgactctgacgcttctgaggccaaaagccagtctcatagttactgctggtttggtttttt

SEQ ID NO: 29474 - DNA, 2753 bp, Mus musculus
acctcaggggactggtgttaaggtcacaaaagtgtggcatgcagcgtgagctgcaagttgcaacccttcaggttatagctgtggttaaaggatgtcatggtcatccagctaggtaattgacagaacttggaggcttcaaaagggtcctgtcacccactcagtcagccttctttttccaccctgggtggagcacacgctgtgctctttaatccttagatcagcacagtgtcttctctcacaccactggaattggctcattactcacttgtttttataaagtttttgtaaagccttttagtggtgtcccaaatggctcaggtgagttttacaaccctgggcacttaagctaggacagtcctggagtctggaatgccctcctgcatcgcaggcgagggcagagagtcagaggtcaggatcgcttcccaacacacatgctctgccctgccttcagaagtcggctttctgttcactctgccttctaggtcattctcatgctcactacagatctcgatggagaagatgagaaagacaagggagccctggacaacctgcttgcacagctcatcgccgagttgggcatggacaaaaaggtaaggtggagaggcatgctgctcggagagcagggctcagccgggaaaggtggggtggcagggctcaggttctcctccttacaggagcttcctctgggttctagttttatccctggtcctgggacacaagtagcaccaaggggaaggggtttatcggtcttgtagctgaggttatagccccatcactgcagaaaaacagggatggatgcagctctctgttcacacagtcctgagcacagatcccacttcagcctaggtctccctacatccattaaagcagtcaagtcactccctgaggctcttctcaggtgactcaggttatgtcaggttgacatttatggagtacaaatgacaagtaggataaagtctgtgccattgtcatatattccatggcctctgactgcagaggcgtcccttgcaccagctataacccacagccctactggaggcggggttggtcttgttggagcttagaggaagcataggtgtctgggcttctgcctgcaggatgtctccaagaagaacgagcgcagtgctctgaatgaagtccatttggtcgtgatgagactcctgagtgtcttcatgtctcgtaccaagtctggatccaaatcttccatctgtgaggtatttgtgctttgagcttatgggtttgaggcaaagtaagatagtggagtggttagcacaaggttgaggacagtggtaatagtcctgttagaataagaccattgcaaactacggaagtaccaatttgtctgtcttgaggtgcgaacttctcaattttttggaatccctgccaagcccaggtccttaccaacaaaccctccaatggaagggttaaagaaggggcttggaggttccactgttgaaaagcaagggcctgtactgcaaagcacagagtagctaagaggatctccagtgtctgttgctataaggtatggtaatagagtagagagaaagccagtgtgtggggggaaatgagattagcacaaagcagagacggtggaaatcagggttgaactgcatccaatcttaatgagcttatgagctgtggggtttgctgggatttccaaggctctcctaatggtcttatgtacagtagctttgctccttcctgcttcttatgcatgcagtcacccaccgttggctcccttggagactagttttctggaagagcccctactgggagggtgaggttgtcaagaaggacctatagtggaactttttgtctctctttcaaatgaagttctgttcgctttgctttgcttcaggggaaggagaaagctttgcctccctggcacagaggtgtaggagggtcagcttaagaactagtatttattttctcttagatacagttgttgcaaagagctggggagagtgacctagccagctgagaaactcccatgtctgtcagggctgtgcctaagacagcagtgtggtgtgttgccggtttgactcagtccagtgtttacaactcggccttgcctgctctgtgtgttttctccctcagtcctcttccctcatctccagtgccacggcagcagccctgcttagctcaggggctgtggactattgcctccatgtgctcaagtctctgctggaatactggaagagccagcagagtgatgaggagcctgtggctgccagccaactgctgaaaccacacacgacttcatctccgccagatatgagcccattctttctccgccagtatgtgaaggtgaggcctctctggtcggagacagctcttggctctcctcagagctgtgtgctctgcttttgataagtaaagctaggaagactagcgttaggagccacacaggaatgggttctaatcttattgtggcctaatagatggccactcctcccacatgaaacttcttgggaaactgagagtgtacatgagacaaggtgacagcagcagtagtcacttgtcctccaaacatcttcagaagcttgtgagcatgctgggtagatgagcccagggaaaagaagatctcctgcaatctaacctactagtcagggcacagggcaagatcctaagcagtctcagtaggcctcagctactgtacccagggaattagtgtgaaatcttagctgctccacagggtcatgagcactgccagcttaagatttataacggtattggcacagggcctggcatac

SEQ ID NO: 29475 - DNA, 1556 bp, Mus musculus
gttgtgttatgggtgtccagttggactgggctctcggcagttgggtcagttgtggtttttttgtactggtctctgttgggatgagaagtttctttgatggtggaatgaggactcactgacctggctagaccctggagaagtggctgcctgtctctccccccccccacccctccccccccttttttttttcttttcagaggaacccataagggaagtttcttttctttgaatagtcacttaattgccttaggaaactaggcagggtggcccatctcccaccaccagtccgtcttcaccaagggtcacatgggaggcttttctctttagcttttgttatctctcctaggccagctcgctggcacaaagccaagaaagttcagctgactcccggacagacagaagtcaagattgacctgcctctgcccatcgtggcctctaacctgatgatcgagtttgcagacttctatgagaactaccaggcctccacagagacccttcaatgtcctcgctgcagtgcctctgtccccgccaacccaggcgtctgtggcaactgtggagagaatgtataccagtgtcacaagtgcaggtgactggtcctacaggcctgggcaagcatgttctgtgttctcttctgtagcactctcaggatgggcaagtccctgcctggtgccctgtggttaggggattatggaattgtacagtggtctgtagggaggagaagtggggaggaggaggaggaggaagaggatgcgtgcacgagtttgctctacttactgggctgctcttaccctctcatgtgttggttgttatcccttcagtaattcctgccatttccagagtgggcatagcctctcctccttctcaccctaaccctttattcccactgacctgggcactttggttattcaggtccatcaactatgatgaaaaggaccccttcctctgcaatgcttgtggcttctgtaaatacgcccgctttgacttcatgctttatgccaagccttgctgtgcagtggatcccatcgagaacgaagaagatcggaagaaggtaagcctgcatcaagcccaccattgcttggctctgaactttggaggagagatgtgtggtgaactgagcttcagctcccagttaatgcgcctcagagaaaagcggcaaacatgggtctgtgaccaaagatgtgctaggctcatagcacataggaattagagaagcattgttggtgccaaatgagcaccgtaaggagcagcttagttaggattaagaaggacaggaggagctggtgacatgtactcctttgtcccatggttagcctcagcagagaaaggaggtgcctgttcagggtgacagggagacaggacagaatttttcacagcacttgtgctgttttgtgtctgtgtgatctgccctgagtcgcttgtcagcactaaattgtttgagtccagttcgtatacattgcatatttcttttaagggttgttctgaaggacagtatggagctgtgtgcctggtctgtatggggaccatgtctcataggtgacaggcagttaaagccatgg

SEQ ID NO: 29476 - DNA, 1059 bp, Mus musculus
tgccaggtggcggtggcgcatgcctttaatcccagcacttgggaggcagaggcaggtggatttctgagttcgaggccagcctggtctacagagtgagttccaggacagccagagctacacagagaaaccctgtctcgaaaacaaagtaaataaatgaataaatgtgttaaagtgtttgcggcaagtgaggagtttgcgcttgggattattctgatttctggttctgcccttgttcttgatcaagccagtcattcagagcgccagttccctcctgttaaatgaggataaaagaaataagtggtagggttattgagaagaataaattgtatcatacacacttctcatgtatttatttatttacttatttttaatttgccaatttccttgtttctattcttagaaagtttttgcttcacgcaaagagctgttggaatatgatctacagcaaagagaagcagccaccaagtcatcccggacgtctgtccagcccacgtttactgccagccagtaccgtgctttgtctgtcttaggctgtggccacacctcctccaccaagtgctatggctgtgcctcagctgtcacggagcattgtattacactactgagggccctggccaccaatccagccctgcgacacatcctcgtctcccagggcctcatccgagagctctttgattacaacctccgccgtggcgctgcagccattcgagaggaggtccgccagctcatgtgcctcctcaccaggtcagagcttcttccttgccgctgcagtgggtgtgagcagcggtggtgccggcaccagtggacgcagggttgagccaagtggttggctggcttaccccagagggtgggagggagatgggaggcgggtagctgtgggaagcactgctatcagttcctgtgagtggtctgcttatgagcaggtggtatgccctgagggaacttctgggtcttggtcagggaggagaagagagtgaaagaacccttggactcaacaatatcccagaaaaaaaaaaaaaactcaaaaaaaaggggtgtagggataagtggttagattct

SEQ ID NO: 29477 - DNA, 1145 bp, Mus musculus
cagctcctgtctgacctctccctcacggtcctgctctaggccatgttggagaccgaggtgggagagagccgcctgcttgcagagttcatgtcccaactaaaacttgtagtatagggtctcccatgtctctttgtcctagtaggacacccatgactggagattttagtaggggtcctataatcagagtttaccctggtccctagactcattaagaccccactgattctcctcgtcctgctggctttccaggctagcagccttcagtatgagatgctgctgctgacagattccatctccaaggaggacagctgctgggaactccgcttacgatgtggtgagcttggggcatctgccgggcacttttcaggaacacaaaggtgcaatcccggtacccgggcaagaggtgggagcccctgggcagcctgctgaggcaggtggctcgcatgtactgactgtgactcctgtccatccagcactcagccttttcctcatggctgtgaacatcaaaacgccagtggttgttgagaatatcacactcatgtgtctgcggatcttacagaagctgattaaaccacctgccccaaccagcaagaagaacaaggtgctgtgacattgagggggtggcagggacagtggggctgggtgagcaccagactttactttagtgtagccccagtctgctttagtacggcagaggtaggttgggatttgggggacgtgtgaaataatataaactcaacagcatagaagcctagagcagagtgagggccttgaagctgaaacagacggcctgtgactcccacaggcatcacgcccttccccgcacctgcacaggctctgcacacatgcataagtggacatccagggtgctaacacaggcttgccgtcaaatacggctctctcccctggtaactgaccctgaagacatgggcaagctaattatgttcctccattccctcatctctaagatacaaagcagtgcccacctggagtgatacttaaaacaaatgacagagtaaactccttagatctaaagatgcctgacttagtgtctaggacaggactttgtgtggtctcagtttgcaagttgctcagtgagtcttgactaagggggcagtaaagctccactttcattctcaagtaaa

SEQ ID NO: 29478 - DNA, 1148 bp, Mus musculus
cagatggcctccgtccacctgtaggaggaggagaggctgaacagtagatacaaaggagggagctcctggctctcgggccgtgctctctaagggtgtccatctccgtccgtccactgcagttacctggacgagctcagcgttgcgggggagtgtgctgcagagtacctggctctctaccagaagctcatcgcctcgtgccactggaaggtctacctagctgcacgcggagtcctgccctacgtgggcaacctcatcaccaaggtgccctgcccctccccacttgtcctttctcgcacttgtggggattaataagttccagactttactggaacaggacggctgtggcagtctgttgagggtatctgagctgttttggggtaaatggtctccagcaatacttgagcctctttagcctcttggaaaggcattttttaagtattagaatggatgtgtggcttttgtgcccctctgctgggggctgcatcctgggatggcagcggaggcggccctatcacactgcttgttgttctgtttaggaaatcgcccgcctgctggccttggaggaggccacgctgagcacagacctgcagcagggatatgccctcaagagtctcacaggtagagagccacccagcccctcccctgggtgtctcagggatgtatgaggcctgagcctctgctcttggggccagttgacttctctctctgggacttttctcctactagatgggtctgcacttttgagctcttcactgccagccatttggctcattcggcatctccttactttttgattttcttgtttctttggatagcaccggccttctgtgttctcctgcagatcttacggcggtttttcctgtccccgcaggccttctctcctcctttgtagaggtggaatccattaagaggcattttaagagccgcttagtgggcactgtgctgaatgggtacctgtgcttgcggaagctggtgctgcagaggaccaagctcatcgacgagacccaggacatgctgctggagatgctggaggacatgaccacaggtaaccccatcgggaggcgtggagctggggagatagatgcgcataaatgtcgtttcctagtaccatggcaccagatggtgacagagctcaggtgtgggagagg

SEQ ID NO: 29479 - DNA, 1101 bp, Mus musculus
tactctgtcaggttgaaggcactcactgatggaagccgggcatgacctggctgaacaggcagtgttgtagctcaaccctctaccctacagttggcctgacttgtgagtggtgcagtcaggcctcggggttgaaatcagtctcccctatgtgcatctggatcttcctgcctctcggggttggtgatttggccaggcctatggtcccaggagtctatagccgtctctgttctcctgggggagcagggcattgtattggtgtagtttggctacctgagaaccatcacagtagctccgatactcatcagggggacccaggctgcttattgtccccagcaagcgctaaggaacagttctgtctggtgggggtggcaactttgggggggtcagttcttggctacagccaccatctttattcccacccttttccattgcagggcaacctcctcctcacaggtgacaaggatcaactggtgatgctcttggaccagatcaacagcaccttcgttcgatccaaccctagcgtgctacagggcttgctgcgtatcatcccatacctgtccttcggagaggtggagaagatgcagatcctggtggagcggttcaagccatactgcagcttcgagaagtaggagcctgaagtttgatacaatgagcctcttgggagagcccacagagtcccaagctagacttgtgaggctgaacagggctgcctggggttttgttgagtgtctgtgtccatgatctggcagatgggagctttgtttagctggagaggcagtcaccaaaccctagtgtaatgaagcagtggtaggaagggtatgagaggggaaagggcctgacaaggtgcgcggagctgcgtttgcaaaagcctggagatgcagaacagtgcaagcctagacgcagggcgggcaagaggagacgtctggtctgagtcgagctttacctgtcgagtttagactggatcctgtagacatttgttaaccaagagggtgactgagctctgctgtcatgctgagactttatgctctcctaggtacgatgaagaccatagtggggatgacaaagtcttcctggattgcttctgcaaaattgctgccggta

SEQ ID NO: 29480 - DNA, 1212 bp, Mus musculus
gatgtgtgaacagccatcacatgttgccctcagccaaatcacagccctgttccttagtctcccatgcaaaatacagctgtggtcaggcagaagagacagtgtaggctgggagaactggcacaggtctgacaactgctgatgctcatatgcagaacttggggagctcctatgaatccaaggcttctgcccaggtgtcccatacagccctgctgggtgcttcgggcgctatcttgccttccatccttacagccgccttgacattccccctgttttatacgtgggattcaagagctaactagtcagaggtctctgtgaaaccagtagtacaagacaagcttgtgcacttggactgactgtacaacattgactgggccttggtggcagggcccctccataactggaaaggttgtacacgcttgtgctgtcagaggctttggctgagcctttagtggaaggccgtgtccatgactagataacctacatctctctggttctcttttgataggttctgattggaacggactccatcacgagcctgcataagctggagcaggtgtccagtgatgagggcattgggaccctggctgagaacctgctggaggccctgagagaacacccagatgtgaacaagaagattgacgcagcccgcagggagacccgggcagagaagaagcgcatggccatggccatgaggcagaaggctctgggaactctgggcatgacggtaaagtccccacaatggacaagatgccaccacgggcagactagtgcttcccagcagaactgagcttgacagtgtgttagggtgcatggaggaagacccaggaattagctgtgccaggcactttcaggtacagctactgctgtgccacttgagggcggggggaggcacttggggtaaagtgaccttgcaggtttgtgcaaacggtaaaaatagagatggcgaccattgtgtgtccaggatatggtgcatgccacacactgcaagacctcacatgttagctgtgcttgacatcactgtacccatttccagatagagaaagtgaagcacacttgccatagcatggagctactaagtgctgaacaggactgtgcacagggtctgctcaacacaaagggctctgctgtcctactttggaggaaatgtcagcagtttgacacttgctggggacagtaaatgatgagagcacagcagcccttggcagccgagac

SEQ ID NO: 29481 - DNA, 1407 bp, Mus musculus
aaagaccatgttcacacacacgcacatcaccactctggggtaggggagtgtggctcagctggaagagtgcttgcttgcttgggatgcatggaacactgagttctgtccctccagcaccatatataccaggcatagtagcacagaagttcaaaggaggttgtcagctacatagtgagtttgaggccagtctgggatcaggaacaagacaagaaagaaaaacttgggagttgcagtattttatagccccttgagtgacccctggacaggtggaaatcctccactccagggaatttaaaatggtatctgccacactgtcctagcagcacccacttctcaagcagagtattagtcacacagtggtcacctcccctccattgctggaatcccatcagagcatgctggcacagtatatcctattcgtgaaccaggcttctgtgactcggtggggctgggggccctgtgctactcccactcacactgtctttgctttccaggtcttctatcagaaatcaccgatccagagagcttcctaaaggacctgttgaactcagtcccctgaccatccccatggaaatgagattgaagctagcttgcattctcccctcattcatctctccgtgtgcactcatttcccccacggatgctgcattagcaccccctcctccctcagttttctcggagtggtttggggtctgtaggcttcctgttctatcacgtgtgtgtgtgtgctgcgcaggctatgaagttgtctgtagctcaagccattgaaggacctatacgtacctaggagctgtgagctgtcccggccagcttgagtgtgtacatcttgaaataaatgaatgacttagtacacattggaaaggggtctagctgctgcttgcccagtgctttccagtgaactcacagccttgcagtgacacaccaggaagactgctggagttgaattgtgttctctggggtctgatggtttttttgtccctagccaaaagagggctcagcagagcaggccctggtcagcatctacttcaaaggccttgaaagcatttgacagtctcctgctggctgccaggcagagaggagagacttcagggaagggtgagaatagtgagaatagctgtgtccactgctagggctcttctgcccaccgccctaggaagagcctgtgcattgttctgcaccccaagtcgcctgctgagacctcagttgacaggtgaggcgcctctgaacttagtatctggacctctgagacctgcccccacctcctggctcctgagagcctttctcagacttcagcaaaaggctgacccagtcacagcctgtcgggaggaagagctggctaactcccatcaaccaaaggctttggtgacatcagcccctctgaatgtctggttcacaaggttgctccct

SEQ ID NO: 29482 - DNA, 1114 bp, Mus musculus
tgatgacggaggcccgacgctcctggtggtcttggtgatggggtccagcctcctctccccactgagccgtgtgggctccactcctcgacacagacttctgtcctcccttctccggaggcccagcgggaccgctgcttccttccttcctccaccaccgacccatggaatggtgctgtcgatttttctattgtccccacacacaccacaaacgcagacttttgtgcgtcgatgcagtgcaactgtgccttctcccttaagctgagccactttgagctccaaagaattcttcctagcaggtgtttttttaaatataaaactctaaggtgagggtggggcctggaggcgtggtagcttttggttttctccctcccacctgctcctctgattggacatgagctttgctccctccctctgtcccaagatgacttgcggtggtctgctttctcaaggaagtagactgtgttacctccagagctgggcgaggaggagtcgtcaatactttctcacccagggatagagtggtggacggaagtggagggagggaagaccaatttttttcttcttcttttggatctagtggcgatgtatcggggaaaggcactgtgggggaaggaagaacctcactgtgtttaaactatgcaaaaaacaaaaacaaaaaacaaacaaacaaaaaaacctaaaagcagcttgccttatatcattggggaaggcaggccctctctcagacttctgggaactgggagagaggccaaggttggcatgagtccctcatagcctctgaggttcagaggtggctttgggggtggtcccagtcagattgctggtaaggcctgcctgcattctgcaagccggcccactggactgatggttttcttggggacctctgtggggtggggtggggtgggtggtggtcttttattttcctgatgacttgatgttcattcccgcctctccaatcacctgccaggttccatggttgtaatttctctgtgagaaagtatgaacaggccaggcctgctacctactctgtcctccacagtaccgtcttggtcctccgttgtccctctggctggggggaaaaagccttgttgggggggggggagtggcatggctg

SEQ ID NO: 29483 - DNA, 1162 bp, Mus musculus
ccagcccagtggtagccagggagagctcctgcttgggtcctggataatcaaatgtttctagtggcttgaaagcacacatgactttttaaggacatttgcctggggtccacatggaactggtatagctgtcaccaagggctacgctgaagggtggggtaccagtaccagggccagctctgccttctgcttcctttcagggtccatgttgcttcccagggagcaggactcggctacaaatgtcccagttgtgcagttgtacactgtgagggggtggggctactgccacccgagaaaaaaaatgccagatatctactcaaagtggccatggagggaggggaggggcagactggcttctcattcctaatctaatgaactgccagagtcttgtcacgtggttctgtgtggtgtcgtgggagggaggagtaactccggagcccaatggctaggtttagaaatggctttctgtcccacccccacccccccaaatggtcaaaaaaatcatgtaatttctccaaccttccatgtctaaaatggtgacgattccgtcatatgcacggaggatcaatgagctaattcctgtggatttcagacaaatgatcagaaatgtcacccgttcgtttgttctcctaccagtatgtgctgtggtggctgatcttatgtgtcacctttgcctggccatggttcccagagacctggtcagccactgtggaagtttttatgatggtgcagtaaatatgtgggcaaaatacttatattttgatcgtgtgtgtcctttgcatgtccgcgcatgtgtgtacaggtgcccacagcagccaggacgggtggatcgaaatagttggggctggtgttacaggcctttgtgagtttacctctaaattctagttgcccgagaaagcagtgagcgccctatctgactgtccatctttctagctccaatatgcttctttggagacatgctcttgctaggtagcccaggttagccttgaatctggttcctcagccatctgagtgctgggttttctagcctgtgtctccaggcctgacttcaagaagcacagcagacgttttgtactgtgagcgttcaaatagaaccgaggatgagttcgcccaggaggagaatgtcccccggagatggttctggcctgccccatccattctccca

SEQ ID NO: 29484 - DNA, 1202 bp, Mus musculus
gctgtccctcgcttcaaagggtcacaagtctttgggatttcccttcaaagcagagccggatacagggagtttgaccagggccggtgtctttgggaaacagctgcaggaggagactggcgacctggcggtgggccagggacactttggagcacaaagtcctgcatggtcccacagctggcagcttcctcttcgttgacaacacgtgtagggggtacccagtgtgatggctaagcttctccagatggggagactgaggcatggagaggaagccccagtctttgaacaaggcagggttcaggctgccaaccatggagtactaattgtgtgtcctctgtatgctgcctggtggcctgaatcctgacagtggcctctatgggactgagtgaaggagcctttgcccccaccctggctcggtctgtattttcttgaatctcacagatggttgcagtagtagatgcttttattccattcaataaagacaatttgtagcatatgcaacctcagcacgtgacatttaaaccgctataaaatgctttgtgtgagtaaattcactgtcccttcccttacacgaatgcatgaggaaggaacatggtgaggcagggaacagaacaaggggtgcaggctgactcacaatctttgcggtgggggccgcgcctgggacagccccatgacagtcagggactctcaacctctccacagctggaaggttgcaggacttcttgggtgatgtctcctacctgctcatctcccagatggctcacggcctctgggatatcccatcctctttctggcaccctggcatcctcaaggtctttaccccaacacacaagagccacccagctgggtgtggctgtgggcaggtcctgtggcatgctggtaactgctggtctgatttctgttgttgtaacaaaataccagaggctgtgtcattaataacatggaagtttatttgacttttagttctggaagctgggaatctggagcccatgctggcaccccattaaacaacttggggtgcaaccggggattcagcccaaccctgtgctaaaatctggtcctgttgtatgccaggatgtgactcaggacaaactgaccagctgctctgggcctgtgtccttcccagtgagatgggctggctaagttaactgtgccttcttctgtctgtgccgagacactgtggcttttcttgtgcctccactcca

SEQ ID NO: 29485 - DNA, 1133 bp, Mus musculus
tttaccgtagcacttgctgcttggttgcctttggccctgaaactaatgtgtttccttgtggctgggagccatgcagggtgtgtgtggacaggaaagagagagttcctctccatcactatccctgagagctgtgtgttgtgtgtgtgtgtatgtgtatctttgtgtaggtgtgttgtgcgtgtatccctcagaactgtgtgttgtgtttgtgtgtttgtgtgtctatgtgtctgtgtgtctgtttcgatgtgtgtatgtatatgtgtgtctgtgtatatgtgtatgtgtttgtttatgtatctgtgtatgtatgggtatctgtttgtgtgtgtatctctgtgtctgtttgtatctgtgtgtatcgatgtgtgtgtgtatctctgtgtctgtgtatgtgtgtgtgtctctgtgtgcatctctatgtgtgtgtgtatgtgtatatgtgtgtttgtgcatatctgtctttgtgtttgtgtatatctgtttatatgtctgtgtgcatatttcctctgtgtgtgtatgtgtatatgtatatatatgtgtgtctgtctgtctgtctgtgtgtgtatatgtgtgtgtgtgtgtatatctccatgtctgtgtatctctgtgtgtgtgtgtatctgtctatctccgtgtctgtgtgtgtgtctgtatctgtgtatctccgtgtctctgtgtgtgtgtgtgtctctctctctgtgtgtgtgtgtgtctgtgtatatgagtctgtgtggcagcctgacagctactccgggcctctgcttctaggttggcggtggtcaggagggtgctggtggccaggtggagatcttctccctgaaccggccttcaccgcgcacggtcaagtccttcccagtggcggcccctgtgctctgcatagagtatattccagatccggaggaggaggctgagggtgcagaggagagccgggcagccaccgatccctcggtcacagtgcatcccactgtctgccttggactgcaggatggcaggtgagggtgagcggagacagctagatggctgcaggaagtccagctctgtgggctgctaacctaagcagccttccccagctctgtgtcaccagaaggatggggactggagacagccaacgtgtcaggagtggcttatgt

SEQ ID NO: 29486 - DNA, 1180 bp, Mus musculus
tgcttcccaggccgttggctcacccccagagtcctcagcctcacaggagtgcgcagtctcagtaacacttaccccttttgtctcttctccaggccctccaaccacaggtaggtagcttgtggcttggggactcaggcatgtgactctgattctaggcctggctccccggtgttaatgccttggtgtgggttttctgcactgcctggcctggctgggtttgggcctaaggtcttagcttgtgctgcctggtgcctggctaagcgaaggtgctgggtgctggagctttgctgcctctgggctgggctgcagcaggctctccagcgctcttcttctatcccacaggggccagctagagatcagcagcctggtacctctggggcccaagtacgtggtgaagtggaacacagctctgcctcaggtgcaggtggtagaggtgggtcaggatggtggcacctacgacaaagacaatctgctcatccagcatgctggagccaagaaggccactgctgcagggcaggcccagagtgagtaccactggctgctgcctgtcacctgtgagttgtagaaccggggccagggaccacaggttggtggggcctgggccgagagagtcttgctgttgtagctcagtgcagagctgcgacttcccttgcacatgtgcgtccccgtggtctcatggctgtcgcacaccctgcacacattccctaccctgaattagacgccctcacaggaacacaggccaagtgtgacttggctattaactgcctcctgtgggctcttggacaggtgccttctgtctgtacctagtgtgcttcctggtacagcgaggaacttaccccatgacccacaggggtggtagggaactcaggtctgtctatctgtctgtctgtctgtctgtctcttcccgggtccctgtcttctcatcctgacccaatctcttagactctgcttgaagacaggagcaccgtgcctggtagcatctccctgtctgtcttctacttgcaaaatggtctccactcctgtgcacatggaccagtgcagtagcttctggctgctctcctccctctctttgtccctctagtcccctccacctgccccagaactgtccctttcacgtgtggcctgtgtatgttgtaggatgccatcacaacctgagtggtctgatgctcttgggatacag

SEQ ID NO: 29487 - DNA, 1173 bp, Mus musculus
atcctcatggcaggcaggtgctggagcagcagctgagaaccagatcctgattcataggcagcagcagataaagaaactgggcctggcatggtcttctgaaccctcaaagcctgtctccagtgacatacctttttcaacaaggtcaaacttcctaactctttcctgacactcattagttggggactaagcatgcaaacacatgaacctatcttttaaggccattctcattcaaaccaccacagcaagttgggtagggtaggccctgtgggcccgaggtgtgtgtgaagatttaaatgcaagcctcagctttaaaaatgttcttaaagccgggcggtggtggcacacacctttcatcccagcacttgggaggcagaggcaggcagatttctgagtttgaggccagcctggtctacagagtgagttccaggacagccagggctacacagagaaagcctacaaaacaaaacaaaaacaaaataaaatgttcttaaaatgttatttatttatttatttatttatttatttatttatttatttatttatttattttgtgtgtgtgtatacatgtgcatgtgtgtgtgtgtgtgagtttggtgtgtatgtgtgtgtgtatgtgtgcatgtgtgtgtgtctgaaggataacataaggttggatctttccttctgttatgaaacataatgcggcggcagcggcaggtaaggaggtacctggtgggtccatgcccaggtgtccccctgagaaagcacaccatgcaacagacctgacataaggaaagtttattgtggaggaagggaggggagcagtagtgtggaaagggggaagaggcagagaaaggagagagagagagagagagagagagagggagagagagagagagagagagagagagagagagaaggagggagggggtagcgagcaacggtgcagggagtaatggtggcaggtgatgatgagatgatgtaactgttgctaggtcactgttgggaggagtctagagaattgtctgtaagccaacaccttccactccgtgggtcctgggaatcaaactcaggcccttagacttggcagcaagtgtctttacctactgagccatctcgcctgcctcccacctctgcttctgaatagtgggagaacactgtcctcacagcagacaggctggtgtcccgctgtcc

SEQ ID NO: 29488 - DNA, 1068 bp, Mus musculus
agaggaggcagtcccctgtagtttgtgcttgttctgtgtgtacagctaacttcccatatctgtgtagaaccggagcttaaaaagggctttgtgtccatccccttaaagctagggggactatcactgtagaaccgacccctcagtggtcagttagggggtggttggataagtgaacccaggggcctctggggacttaactttctcgctgttacacctgggaagtgtgtgcttccagcttctgcccctgttagggtcaggttgagtttggttcaaggtcaagaacacagccttgcagcctaggctggcagactgcccagtgtctctggcctaagggctgtggtctccctctgctaggcagacacaggactgtctctgcagtcggccactatcctggatatttcagaaagctacttaactcggcagagaccagcctctcccctgagggaggctcctctgccagtgtctgggcctcctgccttcacttttcccttaccttgaacttgaagttgtcttgggcttgggaagatgagccatgtgttctgttgagttgtcctgctagagttaggtgggttaggaaaatcaaacagtagtccttaagagtcgatgtgtggaaaacgagccttcagtcttgtcctatgatattcaaggacctgaggctcaggcgcaggcatccagctctgtgtgttaaatcggggttgctagggtttcacggaccctgcaacatagtgttggttcttagtgcagtgggaggagggttggtagggatggttgttgccagcctcttgctccctggttctcctagtccctgagcatcagtctcctaaatggatgtgtttaaaggtggactctcggcctcactcagggagtgtatgtacttgggtggtaagtcagaaactgcggtggccaggaagcccccgtttgctgattggagacacttggtgcattttctgccttggccactcatctgcattcaggtcacattcaggtgacctgtcctggagaggtagctaggtgaggttgagttcacccgacctggactgttggttggggtacaagtgtaggctgtca

SEQ ID NO: 29489 - DNA, 1656 bp, Mus musculus
tctcctggatcccccaggttcaatgcttgctgctttgtctgggcctcagcctggccttgcccagattctgcctttggtctctgactctgctgtgggaccaacctgtcacccgcccgctgtctttgttcttccttatttgagccgtttcagatctggctcctcactgacagctttggtctgggggcggcatgaaagcctcaagttggggctgatagcagtgtgagcaccagaagtgacctttggggtcactgagttttctctgttcatgcctgtggttgagtcaccggatgatggagggttaacagggttaaggtctcagcctctgctgtcctggcagcatgggggtcgccagcaattaagagcccttgtagtctaggctttgcgatccgtagccgctcaagtggcagcctttgaactgttgtgggcggctgttgtttgatgccaggcagaatgaggaagagactggtgaagctgaagttggctgtcttctcttttcagataatgtacaacgggcagccaatcaccaagatggcctgcggggccgagttcagcatgctgatggactgtaaaggaaacctctactcctttgggtgccctgagtatggccagctgggtatggaggtctctttctaaaagctctgtagtctagctgtaaatgtggggttgcacgcacatggtacaagtgtaattgatccagatagcagtggctagccggtaagtgcgtctcgtgctcagcagaacagcttgccggtaaccagccgggtacaggggtcagtgcagactcgaggactgagtctggtgtggaaatccatttgtgtcaagagtctcaggcagaaggacaaaagctgagtccctttcatccggtttcgcgtatataaatgagcctttattggaagtgagagttccataagagggaggttgttctggagatcctggctagactggcagctggtgtgtctccagctcacccctcaccacactgggctccgtcctgtacagagcagaagaggtcagcaagcctgttagagctgaccgtgcaagatctccattttcctttccccgcagactcgcagccagttagttcttcctagtcccttctgcagtcctgagcacgaggtgaggtgtgggcgccacctactggtgtctgaacagcctgcagcagtccaggatctgggttgctgggtctcggcgtcattagaagtgcgcagatgggagcatataaatagaagcagagcattgcactggccacagactgcagggaacagtgactctgtggaactaaatatacctcgcgtcagagtgaatgggaaggaccggccccttacgcacacacgtccctgctggttgccagggagttctcaggctgttggataaacggtttccatggccacgggcgggcctcctgccatccccaggcccagcacaggaagtgcgcttctgtcctctctgctgtgtgtgcggcttctctgccacccttagacaagcatcttgctgcagccagcctgtttgccgttgggaacttgatcttggcggtaggatggtatccatggagtggctttggagggacagttaagtacagcgtgcactgtctgctactgaattcttgttgacatctactaaggaacctgcttcacctgcttctacagacgctctcat

SEQ ID NO: 29490 - DNA, 1099 bp, Mus musculus
ctatgccggctacacctgctccttcgctgtcagtgaagtgggtcagtgcctcttcccctgtctcgtttcttaggtccccgcagttggagccaggtgcaggggcttcctcctggggacatctgctcccacaggcccacagccatgtctgtccctccctggcttgttctgttctctgcagtgtccttttaagcagttgtccctcaacttggttttcttttttttttttttttaaagatttatttatttattatatgtaagtacactgtagctgtcttcagacactccagaagagggagtcagatcttgttacggatggttgtgagccaccatgtggttgctgggatttgaactctggaccttcggaagagcagtcgggtgctctaacccactgagccatctcaccagccctcaacttggttttctaagatgcttattctaacacttctttggtttgcaaccttccaggtggcctgtttttctggggggccaccaatacctcccgagagtctaccatgtacccgaaggcagtgcaggacctctgcggctggcggatccggagccttgcctgcgggtaagtggctgtatccagggcatgtggtgtgtgcctgctctgtgtgcctgtttcctgaggatggcactgtgcctgctgaatctgagtcttcctggctggacataggcgacaccaaacccccacagatgtgggagagggggagagttaaggcttggtaggtgctaggacaggcagctccttccttcacagaaagtaattttgaaagtttttgtttggggagaaaaaagcagagggtggcagttttcgctcagcttggagactgtaggcttttaatttgtcaacacgctggagagaggacttactgaagagctcctgagccacccagtacttacaggtgacgaatgagggtgtgtaggagttagcttagttactgcttcctggtccttgtgtccctgtctgtcccccatcccaaaggctccctctgagagccccaggacccagctgggcagtgaggccctggccttggtattgatctgcaaacaaatgtggcccctccctgtctgggaagaaagagccactaacactgta

SEQ ID NO: 29491 - DNA, 2340 bp, Mus musculus
ggctccgtttccaagcgattcaacgttaactacctttttctgtatgctttccaaagtgtttccctcaatgtttgattaaaacatttgctcatagccagcctgcctttctacgagataggcaggacctctgagcgatgtaggtttttttatttttaagttgtatttcttttctccctgctcttgagtgtccttgtcctgccctcccattccagccgtgatgagcattgtgatccgagtgggtgccacgtgagagagggactgtcactttcccagacagaaacggccttttcaggaaccagcagccgctaggccaatccctggtggtcggtctccatcccgattcctgcctgcccgctttgagagacccggtcacttgcttgtgggccctcccacttgcctctgccacctcccctcatagctattcctggcttgctgtctgcaaggcccatgtgggccttttggctgaagcatttgtagaagcagccatcttccccctggtggggctttggggtctatgttagccatttgtatctactttagctctcaagtccagatgagaatagggaccgtggggtatggggtgggcagttagaggttggtcatccagcagtcagatgtgtcctcggtcctctgtggccctccgttgccgcctgtgtgctttgcccgtgtgctcctgctgtccctctgcctgggatggccgccctgctctgagacttggccactcttgtcctggccaagtgttctgcttgcatttgcttggctctggtaccaaatagttgggattcttgatgaaatcccctgccccgcgtgcgtgtcagtgcagatcctgcgcaccacgccccctcccccaagtgccctctgccgagcccgtcctggtattgactttgtggctgagttccgaggtgcctttcccggatcctcctcgctgggcccgagtgtggcagcagctcgggtcggggccttggtttccagagggtccgggctggtttgactgctttaactaggattagttcagtggtgcttgggggaggggctgaggatggaagtgtgaggggggtggatgggaaagtcaaagtctggtcttgagggtcatgggtttgcttttgctgttgtgacgcctgttcccgtctctatgttaaaatgccaaaaatgacccagtctgtcgctttcctccgccccagcgcttcacagccgcttctggctttgcaaggtgtctgtctcggccagtgccgtggcctgctgggaagggtcagagtcctcactgtcccccgtctgtccagcaatagtctgtccagagacaagcttctgtagcggcagggcttccgcaaaactaacctgctttgtccaggtcaccccagacaccgcccctcacttcatgtactggacgggagccgtccgtccatctgtccctgctggtctctgtctagagagtgctgttcgggatctgctccttctgtcccaggaggtctactggagttagttgtgtggtcaccaagaggactgaggacacagtagccctgagccaagttgggctcatcttccagggagcaaacctaaagctggcagtcagccgccctggctagaggcctgcagtggatgagcgcaaagtgcccggccacagccccctccctttaggctaaaattctcacccaagctttcccacgggaagctctaggacaggaggaaggcgggaagccctgggcaggaaccactctggctgtccaggggctcctgaaatcttctggtcatctacaaagggtaacaggaagggagttaacgaggatggtgggattcggttgaaggtgcctggtttagtgctgttaattgtcttatttttttttttatatctatatttctgggagtaaacattttaaataaacggcgtcattgtttactctgcgttggctttcatgattcctcttcagtagcgtggagtgtgtccccagccctgtgcacgtgccccggaagagtgaccaaagagagcttcctgctgggctggaagggtgcagagagccacgggcccgtggggtagtggccaagggcttcccaactagggctggacacagtcctgaaacacacatggtcctagctggtttttgtgggtgggacaaagtctcgtagcccaggctggccaccttcccagtgccctgcatatatatgtgaggtattcagccctaggttaagtgggctaagtgtggctggctggtgacattttgcatctcagtacctgggcagttaaatgaatcctaacctgtagtgctaatctggttatgccccagcagtttaataagctctctacttctgaagtttcttccctcgctgtcttctctgaccctctgc

SEQ ID NO: 29492 - DNA, 1250 bp, Mus musculus
gtgagccaccatgtggttgctgggaattgaacttaggacctctgggcgagcagtcaatgctcttaaccactgagccatctctccagccccagacctacattcttaggggaacaagatttttaccttggattatttcctcagctatgcaatcaacgggttgtatgctactgagcagtgggcacagacttagactccgataacataagctaaccgtagactcgcttgtcccctgcagacaaagcgcacatctacgtggccgcacttgcccttgctgtggtaggctctttgggaacactacccagtatatccaataagcatacgctcaacagtcactgccttcgagagttagggtcgtgtcttcttctccatccagttgggccaacagccatgccaggtcgggcctcagagcctccaaagctgccatcatctgtctctggagacagtggtccctgctcttgagggcaaagccccaaatcctgtctcctgctccagagtagaaaacacgggcacctctctgagggagctgatgtggagaggtgggggcttgtggtgttcggttaaagtgactttactgcttttatttttatctggggtgggaggaagtgagcacctcccatatggcagccgcgtggctttgtagactgctacaatactccctggtggcattggttgtctcagaaatttctggaactccaggactcagacactgcctgtcccatctcacttactcacccagtgtgactcccccccaagtgtggatgcccccttgcctcccctgggtggactccttgctcttccccacccccactgtgttttgttttgttttgtttttaacttaggcccagatgcttctgggctacaccagttcctgtttcgatgtgagttttgaaatgctccgtgaagggctgagggacggcaggaagatggcgggagccaggcagtaccaacttcctggcgaagaagccaagatggagactgagaagtgtttggggaagagccaaaataaagagcaataaaataagccgtccacgggaagctacgcggctctgggtgacattctttgcggcttctgagacatagacacaagtcagtcagatcacatgtggcccttgtggtcatgaagctcctattgttctgaacataaagtcttgatccttatcaaactcatctcgaggacccagcaccaccccatcttgccccccacacacacacacatacacacacatacactctcaggactgtgtgtcaca

SEQ ID NO: 29493 - DNA, 1184 bp, Mus musculus
cagtgctctcgccctcacgtcagcctccccatcctagcagcctcactcctgcctttcctcctgcctactaacactctgctcatcgggctccagttaaaccctaggcagggcagccatgaccccagctcacctcctcaggatccctccatgcactttgtcacgcaggtcccacctcactgtaggtcaccacagataagttctgtggagcgaaggttctgtctgtgtcagaaatgaagctcggtgtggtgtcactacagtgcagtgtcactgcccctggacccatagctgccatatcatgggggattaacatctgttgggtgttgatgaccgtgccttccaaggaagctggataccagcgtgtttgtgcccagaagtgccatcatcatgcttgataagtgggggagtgccttgcagtttttaatcaatcaatctctctctccctccctccctttttgtggctttttcaagtttcaggcctgtcgaggggcacagacagctgctgctgcagctcccagaatcaaaaaatttgccatttaccgatgggacccagacaagactggagataaacctcgaatgcagacgtacgaggtggatctgaataagtaagtgtctgggccagccaggcgctggcgaaggagagcttgggagggtttgctgggctctcagttaggtctggtttctgccattatttgcggtgctagggattgtggtgcctgtggggtcatgcctttcaggtcttgagagatgtaaaatccgattcccttaatgattgagataatcacatgttttctgtctttagagtcagttagatgtctctcaataactagcttgcgtgagcgcgctcgcacgtgcgctcgcgctctcgctctctctctctctctctctctctctctctctctctccagtcttttgtagtccaggcttatcttgaactcactatgtagctgaggaagaccttgcatttctaatcttcctctctatgcctccccaattctggggttactggcatggctcgtgtgagctgccatacctggtgtatgaggtgctgaggttgagcctgtagcttcgtgcaccttgtatgagtactagctagctgttttattaaggaaaaaattaaaaatattgccagataattagatgacaaaaattttgcaactcaaactcagtaagatgggcagtggtgg

SEQ ID NO: 29494 - DNA, 1195 bp, Mus musculus
gctgccgcgtggggggttggggggcgggctgaggggtggcagctagaatggagaagggacccagagtagagtgtgcatttgtgtgtgattgtgtgtggttgtgtgcgcatgtgtgcgtgcatgcatgcgtcccagggcgcagcgccattgctgacagactcccccacccccagtgcccttcctggtggccctggcgctcttgggctctgtcctggtgggcctcatcctggtccccggcctcctgcaggggcccctaggactgaggaacattgtggacagctccttcaagctactgctgctgggtctggtcgccttcaacttcgtcggcgcctttatgctggaggtaggcagggaccacagggatagaagcagtgggagggacgtggaggacccaggccctgcagtccctccacactgctccactgcactctgcagagcgtgctggaccagtgtctcccagcctgcctgcggtggctgcggcctaaacgggcctccaagaagcaattcaagcggctgcaacaggagcttgcagaacatccatggcccactctgcccgttggctccgtgaggtagtgcaggccttggagggcatgctggacactggatctccctgcccctgagccacgactggaactctctcaagagacagtaccagtcacctcccacagccctgaagctggctgctgtcacactgctgtccggacacactctcctggggaagtgctgactgctgtctcactttagaccatcctgtgtagagatagcagctaccaactccatccagagctgctggcactataacaaataaagtgctggctttcctgatgtgtcggcactggtcttgtcttgcgcgcgctcgactggccaggaagaacgatgctgcaacaggatccttctgcacatgtttattgggagagcttgattgtagaggcgaaaagacttcgagcccagaactggtactgcttttataggcctaggaggggcgtgtctcacacccggattggttatgcactaagcctcatttgcatgttcctcatctgattggttactctctctcagtaccttacagaacctcattatcatacctcatttgcatgtctcacatctgattggttatactctcaataccttacagaacctcattatcatgcctgggccaggcagtgtctttgcaaaaaactttactgcatatgta

SEQ ID NO: 29495 - DNA, 1487 bp, Mus musculus
tgacccacggaaggtggcagagtgctccctgcctggcccctggcccctggccccttgcctggctggcttgacagcctgagcacaagaagcagtaagttggcaccttgccacactgttggttgggcccaggtgctgctcagccaggaaacgagagcaaacactccagggcctttgcaagcccatcgccctcctcactggagacacccagacctgccttcctccaccaagagatccttattaaacacagcccccaaagcacagaatggattcaatttgtggcctgggttcagctctgcctctgcagttggcaggtgtcccagatttgctgttggacagggaccttctgcactccatccataatagcctttggtaccttccagaggagtccttcccgagagctggcaagtctttgagctgtagcttgaatgggctgtcgggggacactggaagggagtaagcagctttttgaaaatgttaatacattactctgctaatatgctgacctgcactaatgcacccctgtgagggaccccccatggcgagggcctctgcctctgacacacccttctcgctgccctgagccccggaggcagccatgggaggcagcctgcatacctggaagccagctgcacagtgctgtggggaaacagaagcgttacagaccgggccaggctgcctggctgctgctccctctgggctcatagctggcccacttgacggtccctggtggcttctggagggaagctgtacctctagatacatttttcttttccttcagagaccgtgacagagggagctctgtcagccggaagttcaggccaccagacgtagtgatttgtaagaaattactgtctcctcagtgaacctcctagtttctttatagacttaaccttcccttcagttaaagggtttctttttcagagggcctagactgtgctgaccttgtgtgaccagagatttaaagatgaaaaaaacaataaatgtgtttacttctgcaccacatctcagatggatatgtttttggcagcgtggtcctcagctcctgggtgcctgggcatcctgtcatccagaggagacgatttcactctaagactagcatggctcttaccgtgtctaaggagtcactggtgggcacccattgtggcacagccgtggagaaccttgtcctgcagacccatcacacaagcccaagtgtgaaaggtgcacagaggccaggcagaaagaggttttaaacaatgctaatacctgaaggtcctaggcaagaggcagctttatggccacagggtctggccaccagtcaccagcatagggcagaaaggaccggggctgcaggatgctcctgccctctgacagcacacgaggcctgggcgattgccctctctctgcatggagagtgaaaagtggagatgtacagacctacctccctataggatgcccataactacaagtctgccagggtggtagtgcccatcttaggtccagcattc

SEQ ID NO: 29496 - DNA, 1227 bp, Mus musculus
gaaggtttaggggctggagagatggctcagtggttaagagaactagctgttccagaggatctgggttcaattcccagcacccactgggcagctcagaactatatatcctaaaactcaggttggcctggaactcacagagagccacctgcctctgcctcctgagtgctgggatcaaaggtgtgtgccaccacgcccaggtactgtttatggggtcatttctgttcatttgtagctagatctaagctggctcaaggcatccttgaaaatgaaccaccaccttcttcttcgggaaaacaccatatgtcagatgacgccagtgcagcgggaggcgggaggaggtgggcggcaggattaggagaatttagcagcggtcttaggggccatcagggctcatggaggtaaagctgaagacagggagtggattcccatcaccaaggtgggcctcccggttagggacatgaagatcaagtccttggaggagatctacctgttctccctgcccgttaaggactctgagatcattgacttcttcctgggtacatccctaaaggatgaggttctgaaaatcatgccagtgcagaagcagactcgagctggccagcggaccaggttcaaggctttcgtcgctattggggactacaatggtcaccttgatcttggtgttaagtgctccaagaaagttgccactgccatctgagggggcatcatcttggccaaactttccatggtccctgtgcagagaggctcctgggggaacaagattggcaagccccacactgttccatgcaaggtgacagacaggccgctgtggctctgtactggtgcttctcatccctgtccccctagagatactggcattgtctctgctcctgtgcccaagaagctcctgatgatggccagtatagataagtgctacacttcagccagaggctgcactgccaccctaggcaactttgccaaggccacctttggtgtcatctcccagacctacagctgcctgacccccccgacctctgggaaaagactgtgttcaccaagtctccttatcatcttgtgaaaacccacaccagagtctctgttcagaggacccaggtccagctgtggctaccacataagggattttatacaagaaaatgaattaagtctgttaaaaaagaaaatgaaccaccagattttctttctttctctctttaaaaaaaaaaagatttatttatatgagtacactgt

SEQ ID NO: 29497 - DNA, 2699 bp, Mus musculus
gcctgcagtgatgcctggtgagctccgggttcagggaaagcccctgtcttgaggaagtggagaatagagaatgtacctgacggtctccggccacacacatgcacctacgcccacgtgtcccacactaaagaatctgggcagcttttctatcctcaaggcctgccttctctcttcctccaggccaaccaggatctcccaacccgaagacagcaggcagcccagcaatgtgatcagacagccgttgggtcctgacgggtcacaaggcttcaaacagcgcagataaatgcaggcaagaaaggacgccgctgctgccaccaccgcctcctggatggtctgccatgggtcgcactgctgtggcagacggctggacttgagcagagggaataacctgacttacttgcactgtgatcccccttgctccgcccactgtgaccttgaaccccatgcactgtgacctctgcctcccccccttcccactgtgattggcatgttgacaagggctgtcccaagtcaatagaaagggaaagggtggggactaggggaggattaggggagcctaccaaggactcagagtagaaggtcagacagtgccacttggccacttggggtaaagccagtgccagcaataacagtttatcatgctcattaatttgggatttcaaaccacaaatgagaacttccccacccaccccaagtgcatgtcgccatcacttaaaagttccattgaaaatagcctttcttttttttttttttcttcctatttttgtttgtttatacaaatacctgatttgcaagaaaaagtgcatggaagaggtttcagcagtttaatgaatttttaattgagaaagggtagtttagtattcacttaaaagatgtttctaggaaatttgctaggaacattaaccaataggagttcgatgagcttagcttctgtattcctactgccgcccagaagagaggccgggctcggaagtccccagagatgagcatctgtgcctaaatcgccttcctccagctaagtcccagctaagttgcctagagatagctcagagagcctgggggaggggctgaccccatgttagtattgtgagagatggggaaagtgacaggcttccccttcccacacccctcagggtgggctggctccctaccagccaggttcgctgcttctaaaggagggcacagagtgactctgggctcagaaaggcagtgaggacacttgtccagtgtttgctgtcggcacaagcccaagagagagtctggctccagaactccaggcctttgcctggagtggtcagagtagagaggcctgtcccttccagcaagactggatggaacacttaaggatctgaggccctggttcagagactgtactggaacgttgcctggtgaaatgagtgggactggagcagccggggaaagacagagtgtgcattgcaaaggcagatggccaaaaggttcctcggaggcctcggctgccccttctctccctgagcagaacaaggctggcatgaaggccatctctgtccccgagcctggaggtttgctttggctctcggtgggagaggcttgagagggcggctgtgtcccactaggtgctctctggctttgtgatctcttccaatgcacttggccttacccctcggccagcctgacagccgaccagcactctcctgaccagcactcgggtgtgggagtgggagtgggcggggtggggtgggattagggcagccagggatcacaccgccttcggttcctctggcttgtgcgctatagcagtggcccgtatcatcttccccttaggaagaggctcttccccagcacagccctagatctgcctgaaaccaggggccatctgtgagtgagcctcacagagcctcagcaggagggccggccacccccagggtagggaggaacttggctgctagctcagagtctagggcccacccacagaggctagtggttttggttggaggacagactgccctttctttggagaagggtgcagaaaccctgcttgcctggtcccctctagtggaagccaagggcgggcggcatctgcacgtcgagagctcacaagagtggctctcccatctcagtctggccaaagaaggccccgcccacagtgcacctgcctccccactcccaccagcagtcatgcctttggcctcctaggtgagaggtggccggcaccactgaagaaggaaaggaagaaaggaaaacagactggtgttgggggagggggtgtgggaaacggtttggattttgtgtgtgtgtttgtggggtttatttttgtgtgtgtgtgtttccatttttttgtagttgtctataaatccataagtgctttttttttttttccttttttcttctttctgtctttaagtaagttgcaggctttggcttggtaattcccagggggatgaagggcaggaacctgaggctgctgcccctttgtctgccttcatggtactgccccttcccccagctcttcctggaccccacgagccaggcctcggcccttccagctaaccgcttcccatgagccactactctgatgtcagcctataaccaaaggagctgggggtccgggtctggtgaccagcccttctcagtcccctcaatcagggtgctccccacctgcaggcaggaggcaacaccctatctgctgccatcagccccttccagagcccacctgtccc

SEQ ID NO: 29498 - DNA, 1118 bp, Mus musculus
cccccccaaatcaaaactctagaagcttataattagtcagatttatatatcaatagattctcagttcacaagatgcccacacaataatctcagagccaattgaaaatgatgcaagctgcccacctaggttagacaagttatcccaattattctatcctcttataatattcatatttactggtggctatttaaagccacatggaatctggattggcttcctctccttccaccttcctttcctcctcttctctggcgctgcaactcttagctcctcctcctttttctctgtccaatcacaggctttttgttgtgttaatatttaaagtgattggacagggaaaattctgcaaaggaagggaatttggtccttgttggaggcaggaacctccaagcttcttgatccctgtgtgacccaacagtgcaggctgtgtctggaggagacctgcttgttcttctgggagaacactgtgggagagatgtaactgcactctggttctcaggatgagcctgggagcaaataggttggagagctgcatccagagcaagtggactgactggtactcggtgcagggccctccctctccagcggcttgcagagtggtctcccttctcactaacctggacagtctgcagacagtcagctccactctaccagagcagttcagcttcgtgtctcattctgtgacctgacaggagacaccgccacctccaccacccccacttggctgcccaacaggatggctgatgtggcagttttagttcttgcagtgccagtgatgtggcttggagaggaatgggatcaaatctaaaggccttcccagtagctcatgtctgggtataactttcaggaaacagtaatacacggctgttgggagttgattcaggcggttcctcagacacacttgaaggcgtctttccttgcaggcccatgtgcgggaactgggcagatgattttcctgtagccctagagaagaaggaagctcagaatcaatccacctgggtatctgagcagtttgcctgtctgtgtcctttgacctttgcagcattaggaaagtaagagtcacccggttaaggtttttctcctgtaaaaatcatgtatttcgaatttttaaaaattg

SEQ ID NO: 29499 - DNA, 1218 bp, Mus musculus
gcctctgcctcctttgtgctagaattaaagaattagaggtctgtgtccacttggtggcatttttgttttttatatttaatgtgttttagtgtttacctactacacatgtgcagttcccatagaggccagaagatggtggtaggtcccctggaaatggagttcaggctattgtgagctactggtgctgggaaccaagcctgggctctttagaagagcagtgctcttaactgctgagccttctacccacccaccccccccaagtcttcctgttcgaaggttatactgggacttgtgtgccattctagggggagggaggatgtggcgggcttggcattggcactctacctatgagattaatatggatccgactggttacggggaagtgctggagcagcttcatgctgtgggaaggaaggaggctgtgagcagctcgggtgctcagtgctcctgtgcttctgagagctgtgcactgatgtttacttcttacactagagcttcgagtgtgtcatggccagctcctcggacagtgaagatgacagtgtcatggccgtggaccaagaagaaactgcactggaagggacaatggagcaagatgaggacccccacccagtgttggaggttgaggaaacaagacataataggtccatgtctgagctgccggaagaggttttggagtatattctgtccttcctttcaccataccaggaacacaagactgcagctctggtctgcaaacagtggtatcgacttatcaaaggtacacttgttttaaagaggtgtgtgtgtgtgtgtgtgtccatccatctgtccatctgtccgtctgtctccatgtatgtgtatgttgcatgtatgcaggtgcctgtggaggccaggtgaaggcgtcagattcactgggtcttgagttacagggtctgggagccacctgtgtgggagctgggcttgaactcagtcttctggaagaacagcaagagtacttagccacagagacctggctatgtccattgtggttttgtgtgtgtgtgtgtgtttttttttttttaagatttatttactattatatctaagtacactgtagctatcttcagatgcaccagaagagggcgtcagatctcattgcaggtggttgtgagccaccatgtggttgctgggatttgaactcaggaccttcggaagagtagccagtgctcttacccgctgagccatctcaccagcccgacc

SEQ ID NO: 29500 - DNA, 1139 bp, Mus musculus
cagcccaaaatgcagttctttcaatttgacattccttgattctgtttcctttctttgaacaaaaatgagaaatttggacttcctccaaaatatacaagtgagaaagcagttaaaagatacaattttgccaggtggtggtggcccacgcctttagtcccagcacttgggaggcagaggcaggtggatttctgagttcgaggccagcctagtttacccagtgagttccaggacagccagggctgcacagagaaaccctgtctcgaaaaaccaaaaaaaaaaaaaaaaaaaaaaaaaagatacatttgtaatgattttccctctgatgttagtatctaagctgagggctttggtttttctcacctttaggtgtggcccaccagtgttaccatggcttcatgaaggctgtccaggaaggaaacattcagtgggagagccggacttacccttatccgggaacccctatcactcagcgcttctcccacagtgagtatccacactgcctgtgctgtgtctctagaactttcttggagacatggcgtttcgtctggcttctgaatgaagagactgtaaaatgagggtttctaacagaattaggaagaagtgaatgtagacacgtggtgaggactgaagtataacagtggtagagtgcttgcccaggaaggcccaggctcagaccctgacagataaggtgctagggcttgatcatgttagattgtgcttttttatttgactcgactcctgcttcagactcctgaaggtgatggttttgggcatgtgccaccataccagctagagttgggctttggtcggaaggcgcatgcattggttacccatgccatcagaacgcgacctcaaaacttagcagcttaaacagtatttcttacctgttcttgaaggtgtgggatttggagatggccgtgatttctggtttagaaatgtctcctagagttgctatctctgtcatccagaggcctacgttttgtattcatggacttggtagacccagtcacactgtcagctgcttgctgtagagctgagagggtgtctgatggaagccagagcagtcttcataatctccgaagtgagtgcatctcttccttcctgttctcttggtcacagagatcagcaggacttgtaaa

SEQ ID NO: 29501 - DNA, 3176 bp, Mus musculus
gctgtgctggcctttgtactctgctgctgactagaccgggaagtaaggggagagaccgcagtaacttcccacaggaagctgaagaagcgcccctgtgagctttctgtggccttctcagagtcagaaatgatggtctaggcactgaggaagaggctctagatgccgctgcaggatcagagtcacagaagacagctcttccccgcctcctgtcagccacagaggacccatgatggctctgtagaagcgccctgtgcctggtcccttctgtcctctgtgatccagagaagtcacccaacaggaaaccctgttccccacgtgctggagtcatgctgaaacaatgtttatagagccgccgtccatccgtctgtctgcctccttcctgtccgttggtctttttgagttctccctacatgtcttagcaaaacattcaaatgtctgattagggaattttccgacaatcgtgtttggttgcaagttgccaaaaaccatagttgttttccttttagaactgggtcctcagaggcctctcctgtctgccggctgctgcctgtccttcggtgctttgctttgggaggttttcttatactttttggtttttttggttcatctttgtaaagcatccgaacttccgaacttcttcctctctgacaaagctccagtgtccacagaattcagagctgttagagcctcccggcatcctcatggcccgtcgggacccaccacagtgtgctggtgcacgcctgtgtcctagcactcagggcagacagaggcaggatgacttcaggtttgggcttagcctgagttatatgatgagactctgtctcaacaaaacagaggacatctgtaaagcatcgaaagacaccttttccagttttctctttttctgaggcagtgcctcactatgtacctcacagcgatcctcctgcctctgcctgtcacttgcggcacagccctctgtgctgtgcagtgctgtgtcgtctttttcttgtgtcccccaaagcagagctttccttgctgccttcacttcatttcctagaagaggtgcagccaaccaggagaggggttggttggttggttggttggtttgtttgttcatagagaaagctataaattattggtctctaagccacagcctagacataggagaaatcaaaaaaggttatttcaaatggccatgcaactatggtttggtggtttctcatcagtggataaagcatttttattttacctttaaaactgaaattgaaaggacagcagcgtgtttcccagcggcagtctcccattcccctgtccccgcatctcccaggcacgagcctgctgcggctcgtctggctcatggccagcactcaccttccgacaagcgtgtctcctgctccatgctcagtctttccttagcctttagctttgctctgctggtcttggcaagagagccctcctgttttgaaacttggaaaaggccaactctagaggaggggtattcgatctggagccgctcccgagggagcacccctgtgcctacttcctgtgtgtcccactgctccagctgcctgctctgttgctactaccagtcctttggccaagactgatcctgtgggatcttgactcaagagataaggccagcagataagcagcctagcattgctgaaccctctctgtggtgtttgcgtgtggatggcgcctctggatttggtctctactgaaacatcaagcattcggacacctgaaagttaagaatctctactttgtagtctttctctttcccctgtggccttcctaagctggctgtcaactgttgattcttcgacttctcccaagtagacaggcaacagaaatcttaacctcttagaaagctatgggttcctctgcctgagatctctgcagtccctccagagaaaacagaatgagcctcgactgcaaccagccatttgggacttgatggtccctgagtgctgtagatgttgctgtgggaagtgaatcagcagtggagactgtggtctcctcagcctcatgaggctgtgtgcgtcctacaacttgcagtacgctagcagagctcagtgtccacagaacactgtcagttcagatttaaccaccaccccttttttgacacgataccaattttgtcttaaaattcaccaagagacatgagacaaaatattttgtttgaaccctcaggagcacctaaagaaaatatttatcagtatttaagtatttaaaatacatcttgtttctacttgaagctttaaccctttccattcctgcaagtgtgcctttgagagccctcggtcatattaacttcagtcatttggttggcctgtgagagttctgggcgctgctctgctcctgcacagagcttcctggtcatgcatgccacatagtgtgcggcagagagcattcgtttctcactcctgttgctgcctttcttccttgtttgggacgagggctccacaaccccacctgccccgtgttttgggagcaccagtaaggtagaaggaaactggagttttgttgaaggcaatgctgggcttgccctgccagccttctcattttaatgtctgagctctggcgagaactgaaagcatgaactgtggaggaacggtctcggaactcccctaacttaagaagaggagagaaggcaggattgcaggaggctcagcctggaaagacagacagccgccgcagtgggacgagggggcgctccctttactttgtctttataagttccttctgcctcgcctttcccttcctcttcagtctgtccatctgtctgtccttgtcctcatggtgactctggcatggtgacgtactctatttgcattatctgtggtcaccagcaaaaatgacagcggggaggatctgaaggagtccagggtaaggaagcctggcctggtgactgccttaaggcctgctctgctgtcatctgcaggtggcctctcagcagccccatccttgggaatgaaagccaacctctggctccactgtgctcgctctgccccctcctaccaaccagggctcacgtcggtgcacgcccaccgtgccctgacaaagctggtgctgtgagtgatgtttcccatacaactcaggggtgccaggcggctccccccatagtcattttaggcacatcacagtgtgggaatgaaaatggattccatggatatttaaatctgtccatttcattt

SEQ ID NO: 29502 - DNA, 1203 bp, Mus musculus
ctggaggtgagcggtggctctccagtgctatgcttcaaggtgtgacattttctgcaaaaggcagctggcatccgatgtgccggggtttggggaagttggggccacttgagacagggtgtctaggagacactggccatgggtgtgatgttctatcagcaagaacacagctggggactggcatacagaattaacctcctgtctctccttgtgcctctcagcctgttctccaggattcttcaagtctgaggcatctgagagcccttgcctggagtgtccagagcataccctgccatccacagagggtgccacctcctgccagtgtgaagaaggctatttcagggcacctgaggacccactgtccatgtcttgcacacgtgagtcttacagagatccagagagaggtgtgactgaggcgggggtgggggtggggggtggggtgagatgggtgggtggggagggagggagggaggggcagctccactgacctccactctctggacaggtccaccctctgcccccaactacctcacggccattggcatgggtgccaaagtagaactgcgttggacagctcccaaggacactggtggccgccaggacattgtctacagtgtcacttgcgaacagtgctggccagagtctggcgagtgtgggccctgtgaggcgagcgtgcgctattcagaacctcctcacgccctgacccgcacgagtgtgacagtcagtgacctggagccccacatgaactataccttcgctgtcgaagcacgcaatggtgtctcaggcctggtgactagccgaagcttccggactgccagcgtcagtattaaccaaacaggtgagccaggggtagtgaggactctccaggggcacctgcctgggtgagacttgaggacgggtacccaggactcagctgtgtgcagagaggaaacaggaagtggctaagaattccatccttcctggtctatgtagtgagcaccaagctagccagagataaatagttaagactcctgctgagtgtgatagcgcatgcctataatcacaacactcatgttctgaaggtggaggcagggagatcgggagttcaaggacatccttagctacataatgagttcgaggccattgggaggcacaggaaaaacgggacatggctcaggtgttacagtgctttctacataggcttggctgaatttggatccctaagac

SEQ ID NO: 29503 - DNA, 1199 bp, Mus musculus
gcacgagcttggggcctgggtttgactccttagcactgtggtaccaggcagacaccagcgtgtggttgcaatttgagcacagggcttgtggagacaggcaggtccctgaagctgatcagggagcctgactggatgagagaactccaggctcagtgagtctctgtctcaagaagataaagtagagtatgactgggaagacgcctgatgtcgacttccgtctttatcacgcatgcttgcataccaacatgcacttgtgtgtgtgcccatacaaatgcattcatacatgcaaatacagaaacacaatatacaatataaggcttttcaaaccttgcctgatctccagaaaaactcggtggcaatcagctagtgacttagttattattatttatatgttagtgaatgtccccagaggacatctgatgggctagcttctgctgtcagggcagcatccataacaggacatccaagaaccccatgcaggatctgagggccatggtactctgtcgctatccttcacccctgcatggcttctcacacctctcccctccctcttctgcccagagccccccaaagtgaggctggaggaccgaagcaccacctccctgagtgtcacctggagcatcccggtgtcacagcagagccgtgtgtggaagtacgaagtcacctaccgcaagaaggtaaactcgatgggggttggcacaggccatggagatattcagtgcacagcgatctggaagggttcccttctgcgtctggggaagctgagacctggggtttcctagaagcttataggggtgactattttgggttctcagagccagttagaatgagctcttggaattaagctagtcctggggatgtatagtccccctctggcctctggtgaatctgtactcctgtacctcagtttcccaagagcgtctgcctggttggacaatacaggaagccatttttctgggtaggatcttggctcttaacttctctccccaccaccacccacagggggatgccaacagctataatgtgcgccgcacggaaggcttctccgtgaccctggatgaccttgctccggataccacgtacctggtgcaggtgcaggcgctgacgcaggagggccagggagccggcagcaaagtgcacgagttccagacactgtgtgagtcaggggaccctgaaccacgtcggacattgttggggag

SEQ ID NO: 29504 - DNA, 1715 bp, Mus musculus
ggaacctggtgctaaggaaagacaggtcaaccctcagagcttgccaccgagaaaataaagtgggggggggggttcctaagttaagattgtgctttggcttcgccctgcgtgtacacacgtgtgtacagccatacacatatgaacacaggcacacacacacacagagcacctatcccaggccccaccccccaccccacccccatgaagatttgattgagtgtatcacatcctcgactctgggtggcagaccatgctagaatatgaactctttagcctgcataaatggatgttcctcaccacaggtccgcaaaggcccctctatgtccggctttcctctctgcctcccagtcttgtctctgaccctccctctcttcctcttcatccacagagacatcaaaaggatcggagtgcgtcttcctggccaccagaagcgtattgcctacagcctgctgggactcaaggaccaggtcaacacagtggggattcctatctgagtccattggggccgtgcccaacaatacttgaagagccacagtggtctccctgccgacctggtgctggcccactggaactttatttatttctgtttcctcgtctatgcctccctgaggactctgcagggggcttttgaatgacaccctggcctgagcctgggaaacttggatgctggtcagggctctctttcccctgcaaaggacccagctaagcacttagcagtttgccatggccttcccagcatcccctgaggctaaagttccaccaagaccgtcgatatcgacgagggacatttccaaacggacctccccatcttcatttggcctcctgagaagccacctcaggagctgaggctaagcactaagcccaggaccatatgactagggcactgtacgccccgcccctagttagagggtaggttttggacttggctgggtgtggtcacagcaatctcccagtgccttttacagacccagggctctgccctccgccctcgagggccagcttcttgctttcctagggccctctcaggatgcttggctgtgctgaggtttttattaaatatatattttatacttgtggaaagaatgagtgtgtggcagggaccttgccagggctggagacagaggatcccctgcaacagacattcccgggctgggggctggcggacctgcaggagactttccgccagccacccagtctccagcccctttggacaaatgtcgctgtcagtgttacagatttcttttattgggttgtttttttgttgtattttttgaaccttaacttattattttttttatatttattgttagaaaatgacttatttctgctctggaataaagttgcagatggttcaaactgattttggctttcattcctggatgctcagtggggttctgccgacaaccttaggggtagagggggtcccccagaatccaagtgtttaaatagaactgcctctacaacaagggagggtgttgtttcacccttagagaaatgtgggagtgtacacacacacacacacacacacacacacacacacacacacacacccctggcctccacaccagcaggcctgatcacctttgatctctaggtttttgcagggctgggaggcagagagcagctgtcagcctccctcccaccctacgagtgtgtgaccattggaggggaggggagggggcctggcttcaaagcctatcacaagttttgtcatg

SEQ ID NO: 29505 - DNA, 1573 bp, Mus musculus
cctgcctacgtgcttcagatcttcccaccctgtgagttctccgagagtcacctctcccggctggcccctgacctccttgccagcatctccaacatctctcctcacctcatgattgtcattgcctcggtgtgaggctctgaacggtcgccacctcagggcattttcctgaggctctgctgcaaaaaaaaaaaaaaaaatgaacaccgtggacaacccagccaggcagagaggcaggctgccaggcgccaccagctgccccgcccttcggctgcccagctccgtggatagacctcctctgggggtggtgctgcttgtatgtttacatgaaattctcccaggacagaccaccaaccatggacacagagaccttaggggctgggcttctctccgcacatggagaacaggagccgggccctgggatccttctgttctgttaaacagaacagaacagcctttgcactaaattagtgactcgcgcagtgaacacaggctgcgatgctctggacatgtgtgcatgagcacgccgtggactctcgtgcaggacttgggactcgtgctgaagccttggggtcaaggaacatttcagtgggtttttgccccatctcctcctcccgtcccctgctcatgggacatgttatctttcttaattctcctgccgccgccgccaccaccaccaccaccaccaccaccaccaccttcagctcatcggatgtacagtttacagttgagtaacagtgaacggaaggattttctttcttggtcggatgtgcagaacttgggatgtgtatatataaatatataatatatataaatatatataatactgacttaaatcaaatttccctgacatacattttttttaatctgtgccaaaaatgtgttttcaaagaaaatcttattttcatactcaagactttgtaccgtcactcatttgtataagtgcgcttcgtcactgcacgggccctgctcctgcaacatggaactgtcgcgtagcacctgtacaagagacccggccactccactccctcctgtgacctggacctctccctgacttcctaacacttattaatttatgaaactgtttttctcagcgcagttttgttctgtgtgtccattggattacaaactttattaaaaaatacaaaacacctcaggtgtgaaggtggttgtcactcagtgggcgcctcggtttcttgacttgcacagcagaccccaccccacatccgggaacaaggagcctttcccctgtgctcagcctaggccactgggacggcaggcacctcagactctggtacatactgagaccctttctttctccgcccccttgctggctcctgctggtgccatcactccttgtagtggccaggagcccactattcctggggctaattctgtacctaccctcaagaagaagccgaggcaccaatgttttctggggaatgcagttgggactatagagcaggcctgcccaggtccctggggcccctgctcccttcctgtccccttgccatcctggtagcacactgcatgcagcagtgagtactgccacagcacggcgctgctgtggcctagg

SEQ ID NO: 29506 - DNA, 1231 bp, Mus musculus
gccccgccctgccagccctcccaactcagccagcctgcccagccaccgagtggcaagattcctcaggtctcccaagaagcaaaggggacgcagacaggaggggtggagcagactcgcctcccagccatccccacaaacaggccatctgagccacacgctcagcttcagagggcgccggtggaaacagcccagccagcccacccctcccctgtgtccgtctccatgaagccagacctcccaagccctctttcctctcaggctgccccaaagcagccattgtttgtccctgcaaactcaggcccaagcaccccacctggactggctctgcctcacgctgaagtccagccagctcccaaacaagagtcttctccacacgggacaccacaacggcctgtggatatggtccagctgctgaaggtaagatgcagaggctgctctaagtgttaacacaggctgctgtgggccatgctgggcatgccatgaccctgtctctgctctgtttatcctgctaagcagaagtaccccatcgtgtggcagggcctgctggccctcaagaacgacacggctgctgtgcagctccacttcgtctctggcaacaatgtcctggctcatcggtccctgcctctctctgaaggtggtcccccactgcggatcgcccagaggatgcgactagaggcctcacagctggaaggggtcgccaggagaatgacagtaagactcgagggctgggtaaatgcccatgcagttcaaaggaggcgggtgacgggggggacaagacgacacagcagtgatactctatagacgggcaagaagcaaaactctgcttggctagagagatacctctagacctcgtgtgcgtgcgctcacacatgcacacacatgctcgcaggtgcacatgtgtgttgtgacacaggcaccttagggcacttagttaggacccacactgtttagtcagaaggcccctaaccgttcccctctgctccaggtggaaaccgactactgcctgctgctggctctgccctgtggccgtgaccaggaggatgtggtgagccagaccgagtccctcaaggctgccttcatcacttacctgcaggccaagcaagcagcagggattatcaatgtccccaaccctggctccaatcaggttggtcattgtcccatccctaccacacaggtaggaccagtttagggctgggcaggagggctggtcttccggtggcatggatatttc

SEQ ID NO: 29507 - DNA, 1024 bp, Mus musculus
gaactcgcagaagatcacgttggcaaagccagctcctcagaccctgactggcctggtgagtgccctgactggtctggtgaatgtctctctggtcccggtgaatgccttaaagggccctgtgaagggctcagtagccaccctgaaaggtttggtgagcacccctgctgggcccgtgaatctcctaaaggggcccgtgaatgtcctcacggggcctgtcaatgtcctgactactcctgtgagtgccacagtgggcacggtgaacgctgcccccggccccgtgactgctgcctgtggcgtgacggccacaacaggcacagcagccgtgacgggtgcagtgactgccccagcagccaagggcaagcagcgggccagtagcaatgagaacagccgcttccaccctgggtccatgtcagtgattgatgaccgaccagcagacacgggctctggcgcggggctgcgggtgaatacatcagaaggggtcgtgctgctgagctactcgggacagaagacggaaggcccccagcggatcagtgctaagatcagccagatccctccagccagcgcaatggacatcgagtttcagcagtcagtatccaagtcccaagtgaaagcagactccatcaccccgacccagtctgcacccaaaggccctcagaccccttcagcctttgccaacgtggccgcccattctaccctggtactgactgcccagacatacaatgcctctcccgtgatctcctccgtgaagacggaccggccatccttggagaagcccgagcccattcacctctcggtgtccacccctgtgacccagggtggcacagtgaaggttctcacccagggcatcaacacccccccagtgctcgtccacaaccaacttgtcctcaccccgagcatcgtcaccaccaacaagaagcttgctgaccctgtcactctgaaaatcgagaccaaggtccttcagccagctaacctggggcccaccctcactccccaccacccccctgccctgcccagcaaactgcct

SEQ ID NO: 29508 - DNA, 2790 bp, Mus musculus
ggaagagaaacttggcattgacattgatcacacgcagagctaccggaaacagatggagcagagccgccggaagcagcggatggagatggagatcgccaaggctgagaagtttggcagtccgaagaaagatgtagatgactacgaaaggcgcagccttgtccacgaggtgggcaagccccctcaggatgtcactgatgactccccgcccagcaagaagcgaaggacggatcacgtggatttcgatatctgtaccaaaagagagagaaactaccgaagttcacgccagatcagcgaggactcagaaagaaccagctgctctccgagtgtccgccacggctccttccatgacgatgatgaccccaggggctcccctaggctagtgtcagtaaaagggtcccctaaaggggatgagaaaggcctcccctatcctaacgcagcagtgagagacgatccattaaaatgcaatccttacgattctggcaagagagaacagacagcagacacggccaaaatcaaactgtctgtcttgaattctgaaggggaaccaagccggtgggaccctccgatgaaacaggaccccagccggtttgatgtcagtttcccaaacagtgtaattaagagagacagtctacgaaagaggtctgtgcgcgatctggaacctggtgaggtgccctctgattctgatgaggacgccgagcacaggtcccagtcccccagagcttccagcttctatgacagccctcggctgtcttttttattgagggacagagaccaaaaactacgtgagcgagatgaaagactcgctagctctttagaaaggaataaattttactcttttgcactggataagacaatcacaccagacactaaagctttgcttgaaagagccaaatccctctcatcatcccgtgaagaaaattggtctttccttgactgggactcgcggtttgctaattttcgaaacaacaaagataaagaaaaggttgactcggcccccaggcctattccgtcctggtacatgaagaagaagaaaatcaggacggactcggaggggaaactggctgataaaaaggacgagcgcagggaggaggagcaggagaggcaggagttgttcgcctctcggttcttacacagctccatctttgagcaagactccaagaggctgcagcaccttgagaggaagagcgaggagcccgacctcccccccggggggctgtacggcaggcaggcgtctgagggtgcaaacagcacgagtgattcggtgcaggagccagtggtcctgttccacagcagattcatggagctgacgcggatgcagcagaaggagaaggagaaggaccagaagcccaaagaggctgagaagcaggaagagccggagactcatcccaagactccagagcctgctgcagagactaaagagccggagccgaaagcccctgtttcagctgggcttcctgccgtcaccgtcaccgtcgtgacaccagagccagcatcctccgcccctgagaaggctgaggaggcagcggaggctccttcaccagcaggagagaagcctgcagagcccgctcctgtctcggaagaaacaaagcttgtgtctgagcctgcgtctgtacccgtggagcagcccaggcagtcagatgtaccccccggagaggacagccgggatagccaggacagcgctgccttggcaccttcagctcctcaagaaagcgcagctactgacgccgtcccttgtgtgaatgctgaacctctgactcccggaaccacagtttcccaggtagaaagcagtgtagaccccaaacctagcagtccccagcccctttcaaaactgactcagaggtccgaggaagccgaagaggggaaagtggagaagccagacacaactccaagcactgagcctgacgccactcagaacgctggggttgcatcagaagctcagccccccgcttctgaagatgtagaagccaatcctccagtcgctgcaaaagacaggaagactaacaagagcaagcgttccaagacgtccgtccaggcggctgccgccagcgtcgtggagaagcctgtcaccaggaagagcgagaggatagaccgggaaaagctgaagaggtccagctctcctcgtggagaagcacagaagctgctggaactaaagatggaggcagagaagattacaaggactgcgtcgaaaagctctgggggagacacggagcaccctgagcctagcttgcctctcagcaggagcaggcgccggaacgtgaggagtgtttatgccaccatgaccgaccacgagagccggtccccggccaaggagcctgtggagcagcccagagtgaccaggaagagactggagcgggagctgcaggaggcggtggtacctcccaccacccctcggaggggaaggccccccaagacccgccggcgtgccgaggaagacggtgagcatgagaggaaagagcctgcagagacacccaggcccgctgagggctggcggtcaccgaggtctcagaagtcggcagctgctgctggaccccaagggaaaagggggaggaatgagcagaaggttgaggctgccgctgaggccggtgcccaggcgagcacgagggaaggtaaccctaagtccagaggcgagagagaggcagcaagtgagcccaaacgggacaggagagaccccagcacagacaagaacggacccgacaccttcccagttgaggtcctggagagaaaacctcctgagaaaacctacaaatcaaagaggggccgtgctcggagcacgaggtcagcgatggacag

SEQ ID NO: 29509 - DNA, 1231 bp, Mus musculus
agcaccccagaggcagaagcagggcatctctgtaacttggaagccagcctggcctacagagtgagttgcaggcccagagcttaatgaaaacctggcattttacacttgaatcttattaacggccagctttgaaatccttggtgcttcatttggcttaggagccactgctaaacacctgcgcgtggccaagtgactacgtaagcactagagggggccagagctgcctgtgtaagagaatttcactgtgcactgcgggctggcctggaacttgtacagttgagccaggtcccacgtgcggtcctcctgcctctgtcccttgagtcctggggttgcgggggtgggagtgcaagtgagaagacagaggagctaacataatctttctgatgtttggcagagaggaacgaagagggtcctatgagtacagtcaagaacggacatactatgaaaatgttcgcactccaggcacctaccctgaggactccaggagggactatccggctcgggggagagagttttactcggagtgggagacgtaccaaggagagtattatgactcccggtactatgatgagcctcgcgaatacagagaatataggagtgatccctatgagcaggatattcgggagtacagctataggcagcgagaacgagagcgagaacgggagagattcgaatctgaccgggaccacgagaggagacccatagagcgaagccagagtcccgtgcacttgcgtcgtccacagagccctggggtgtctcctgcgcattcggagagattgccaagtgactctgagaggaggctgtaccgccggtcctcggagcgcagcggcagctgcagctcagtgtcccccccacggtacgataagctggagaaggctcggctggagcgctacacaaaaaacgaaaaggcggacaaagagcgcactttcgatcccgagcgggtcgagagggagagacgaatagttcgcaaggagaagggagaaaaggacaaagctgagaggcagaagcggaaaggaaaggctcactcccctagttctcagccttcggaaaccgagcaggaaaatgaccgagagcagagccccgagaaaccgcggggctccaccaaactcagcagagacagggccgacaaggaagggccagccaagaaccgcctggagctcgtgccttgcgtggttctgacccgagtaaaggaaaaggagggcaaggtcatcgagcacccacccccagaaaa

SEQ ID NO: 29510 - DNA, 1159 bp, Mus musculus
atactctaaatacagtactttttcttagtcgcatccttgtgacttaggtttttgttgggactgacacacagaccagcagatgaagctcctgattggttgttgtgttgttttttccaggtggtgtttgaccgcttgaaaggcatggctctggttctctacagcgagatcgaggatgcacaggcggctgtcaaggagaccaagggcaggaaaattggtgggaataagattaaggtgtgcacagtgactaacaaaggccagaggctgcatgcacctatgcctttactgtgaaggtccacatagcatgacatgcaacagaagcaacaaacaaaatctattcagatctctgtccatatttaccttcgtaggtgaccagcatggagtgctttataaaacatgcttttatttgccctcagagtttaggagaactattagaattttcatgcttgctatttgtggacaaaatataagcccttctcgaaggctttctccttccctgagtgacagatgttcttacctgtactcttggtcagggaccccccttccccttcccgttacactgtgtgtctgtgtgcctgtggctcatttagtcagtcagcttccaaaaggaagctacctgtggctgtgtgtgtttgtttgtatgtgtgtgtgtgtgtgtgtgtgtgtgtggtattgtttagttataaaagctttctattcactggttgtttggcataattatgtattaagaactgatgattagactaaaatatagttatattttggcactaggacataaaagtgatgcttggcagcctgtaactggagctgtgttgtcctctgtgtcctgctataatggttattctgtctgcaaatttacctgcacggcaccttgcccgttgatagactgcctgtctgattgtcccaagcattcgccaactcagatctctctctctctctctctctctctctctctctctctctctctctctcattttttggttgtttgcattgcagggggagaaagtgtgtgtctcggccatgcgggagggaagggctgcactgtgtggctagccccaagcttctgatcgctaccatcctgtctcagcctctccttggtttggggattgcatcaaatccagccctctcattcctgattgggctctgggaccttaaaatgtat

SEQ ID NO: 29511 - DNA, 1173 bp, Mus musculus
tgctgctgtactttgttttctttctctttctggtcttcgttttgttttgtatttttcgagacagggtttttctgtgtagccctggctgtcctggaactcactctgtagaccaggctgcctcgaacgcacagagatctacctgcctctgcctcccgagtgctgggataaaaggtgagtaccaccatgcccagctcaggtattgtattaaagggtttggctctactaaagcttttttgaccataccaaagggaattacctctaagtagttcactaagtaggtaaccttttctttgttaagaatttctttttgtccggatttgaaatttgatttttttttttttttttttttttgagttgcacatagttgcttttctccaggagccttccgtgggcttgcctccattaaatgtggtctttgcacctgtagtttacagtgtgtgtgcgtacatgatcctctaagcagttactgagaatcgacttgtagtctttctccttggcttcttgttgccctgttgctgagtggtaccactgatgggctctttcaggacattgacattaagaaggtgaacggggtgcctcagtacgcgttcctgcagtactgtgatatcgctagtgtgtgtaaggccatcaagaagatggacggagagtaccttggaaataaccgcctcaaggtgagcagcttgcgtgaatcggaggttgttgctgtttgatttgctttaggcctgtagggccttactattttcgggctgcagaaggacagttacacttacacattgatttgaacacttgagggtgtggctcactggcaggtgacacatgctaacacgtgtgagctccttggttcagtagcccagttacagcacgcacgcacgtacccacacacagctgactcagcatttctatagaagtcgagctcttttggaaactttgtaattggatagtaattatgatctgtggtgatagaattttcccttttaatttcagctgggttttggaaagagcatgcctaccaactgtgtgtggttagatgggctttcttcaaatgtgtccgatcagtatttaactcggcatttctgccgatacggacctgtggtaaaggtaggtgcttgcgtttgactttgttttcttaatattttgtccttcggtttctctctctgctgttgatgtttcctt

SEQ ID NO: 29512 - DNA, 1254 bp, Mus musculus
ttacatagtaagaccctgtctaaaaataaacctcagctaaacagatagaacaagggactttcacattaaaatcagggtgcgagccaggcattgtgcgttgtgcattgtgcacttgcctgcaatcctgatgcttaagaccggaagtttaaggttatccttagctggatagggagttggaggttagcttaagctataggagacttttaaaaaggcaaacaacaaaaacagaagaaaggttgatgttaccacacacacacacacacacacacacacacgcaatcacacaatacacaccttttgatacaagttggaaaacccccaataaagggattaccacccagaaaggcccattatatagagaaagtaagtgtgcacgttcgtgccgtctggagtcaggtgagacgcctggcatgtgagtgtttgcttacaccgaggtttgtgctgctcagaaagaggcgaggcgtaaaggcagctctgacgtgaatgtttgcatgacttgcattcagttttgcgtgctcctttctgattaaatattttcccctcctaaatgcagggcttcagataacagggagcgtgcttatgaacatagtgcctatggacaccatgaacgggggacaggagcatttgatcggacaagacattacgatcaggattactatagagaccctcgagagcggactttacaacacgggctctattacacttctcggagtcgaagtccaaaccgctttgatgctcatgacccccgatacgaacctagggcccgggagcagtttacactgcccagtgtggtacacagggatatctacagggacgacattacccgggaggtacgaggcagaaggccagagcgcagttaccaacacagcaggagtcgctcaccacattcgtcccagtctagaaaccagtccccgcagaggctggctagccaagcgtccagacccaccaggtcccccagcggcagcggctccaggagtcgatcctccagtagtgactccatcagcagcagcagcagcagcagcagcaacactgacaggtaagttctcagctgctcatcggcgcgggtgagtgagctgtccacgtgttctcactcagtggtcggtggtaatggccataatacttcatgtttatgtaataataacttcatgtttaaataaatactaacttcatgtttaaagaaagtaatcttggatttttgtgtttaatgagtgacatgcagttaaccagagtctaagtgatggtctgtcagagctg

SEQ ID NO: 29513 - DNA, 2221 bp, Mus musculus
gacagggtaaggatagtttcaggaaatacaaacgagattaataaaataatgattgtttccaagtatataaaacatggaagagcaaaggagccttaacaatctgtgaggtagtgtgtgtgtgtgttttaaataggagttatttaaatagccattttggggaccagggaggtaacttagttttgtaaaatgcttaccgttcaaacatgaagacgtccctgagtgtgttcagtcccctgtaatctcattgctggatcacatctctccagatcaagtccagtgagatcccctagctcaggtacaaggaggtagaacaagaaacttgacttggctctctgcctctccacacagtaagcacatataagcagatacctccaacaaaaagctttgtaggttgtgttctatacatatataatataaattatcttaaaagaaaacattttgtaaaattattaattactctttggaaaattatcgatataaataactgcttctttttccctcccagatatggccgcgtggaaagtgtcaagattctccccaagcgggggtctgaaggaggagtggctgcctttgtggattttgtggacatcaaaagtgcacagaaagctcacaactccgtcaacaaaatgggagaccgagacctccgcacggattataatgagccaggaactattccgagtgctgcccggggactggacgagacagtttccatagcgtctcgtagtagagaggtttctgggttcagaggaagtgctggagggcctgcttatggtcccccaccatcacttcatgcacgagaaggacgctatgagcggagactcgatgggtaagttccaaggtttcggtaggcaggtattttgtatttgatgtggtgagaaacagaaactcgtatttaggggccccagatggatttaaagttttgggcattctcaatgtttcctgttttgggttggagacggaagttatttctatcccagtggctggtacctcactgaatcgtagaggatatttcctgcagcagcttggatatctaccgggagatcacatggcggaagagctcctgtagagcttcagttttggggttacctggcttctagaaggacgtgtcctccctttggatattatcaaggccttccttggatatatccttactaccagatggagctatttggctgctggttttgtcttcgggctatttggaatatatccggagtatcagagcctacaaagcttgtagaagctgatgagcacctctcggttttcagtgtgtgaagtctacaaacagattggattgtcacagagtatcttgcagatcactgattccctcacttggatgctacaaacaatacgccagcgtggagtggaaatgtgtgcgtgggtgaggaggaacgcaggctacccttgattcccattttggatctactcactttccgtggaattacacttgatggaattggggaaactgaggcgatggacatttctaaatgctggatatagccgttcctaactgctgggatgtatgggatgctatgagctcaagactccagtagccgagggaagaggattactgtcgcttccgccccgctgagggaactttagcttcggacggtccgatcagttgtggatacagcagtcagattgtctgggctggatgtctataaagtgaacagttaccagcaactttgttcctcactggttggaattatagagaaattttccttgtttccatctgcctggctcctctttagggatgcagattttttatgaatgtggatcaatttataattgtctactatctcaagaaagaagtctgggggtttaagagttacagtttgtttgggactccttgcttcctgtggaattctttgtctggtcactaagatttttttccttgtggttcatctaaatatcacttgacacccttgcccaccgaggaggtggattacccccgtaagaggggccaatgggggaagttatggtcacaattctctccctagatttaattgggattataggtcgtgtttccacagttggaaaaggttggtatgtcctgacctgtgtatattagcccctcttctaacccaagtcatactttctcttccccactaactctagatgcatttagtactaatagatgaatccgagactagcagttagatttcagctctgctcctctcgggcctgcctctgtgcttccctaatggataagaactgcacatac

SEQ ID NO: 29514 - DNA, 2341 bp, Mus musculus
cctggtctacagagtgagttccaggacagccagggctacacagagaaaccctgtctcgaaaaacaaaacaaaacaaaacaaaaagatcctatctttaaatgaagaaggtggggggagctgaggtcccctggggaagctccgtgctggcgggatccaggcttggagacacccacacttgcttctgtatccccaggactgcagcgtgctcctgtctgtggaacctaccgaccaaggctgctacccactgaatgaccacctcttctgcaagccctgtcacctgaagcggagtgctgctggttgctgctgaagagtcccgatagctggcccttccctgacttggtttcccctcctgacttttcttgagtactttctttttgaacctcactgggcaccagcacactgctcagcccatagtgtctaaatgcacagacaggcttgagacactgggctttggcctcctagtacacagcaccccccacccccagactttctactcctctcccttcattgaccaggaggcctctcaccaccagactgcaaccctggtccatctctagtgctgccctgacatgtttatggggacaggtctcaggatgatacctgtgtctctgaccatgatgcttagctgcctagcagaaggcgctgagacctcagcttagattgtagagctaagttgtttgaagtgcgccttctcagccactccaaaaagtattttttgagaatataagtgtgtagtagacatgatagcacacacctttaatcccagcacttgggaggcagaggcaggtggatttctatgttcaatctagtctgatctactaaaagattcaaaacaatattctttggatttgggggagagaaatctttgaatttttctctttttctttttttggtggggtaaaatcagtaaacatcttcccttggttcaggggctgcgaagatggctcggtgatgaagagcgagctcttgctcctcttgcggaggaccagagttcatttcccagcatccctcatggaggctcataactacctgtcctgcaactccagtttccggagagctggcgccctctgctggcctccttggaaccttaatgcatgtggtgtacacgcttacactcaggcacacacacatacattaaaaaaaaaaaaacaatttagccatgtctaatggcaaacacctttaatctcagtacttgggaggcagagacacatggatctctgcatttgaaggcagccacagctacaatcttaaaatgcacaaactactggggtttggtggtgcaaatctgtgatcccagtgctgggggaaattgccagaagcttgcgacctgcttagacttcatagaattcccaatcagttttggccacattcagagatttgtctcagaaaataataataaatcataagtgcatagaacgtgaggtagcggcgacccagccttccttcctgtagaatccgtgctgagctgggctcaggatgggagggaggatggtcacgtgcctctgcttgcttccacaccctgtgagctcctgtgaggggctcccagacctggattaagagcctttgatttgctaaggaacaagttcgaggctgagcctccttcctccagactttactggggctctggcctctacaagtgcgcgcacgcgcgcacacacacacacacacacacacaccaaagaggctagggaaagaagtcacatctctttggtctcccatgtgtgccacccagcctccacttcagctttgctgctaggctgcccgtaaccactgtctctgtgaagccacacctagaacattctccctcttaaggaaattcactttaaggcaggcaagatgattcagctggtagaggtgctggcttccaagtctgatggccggagtcctgtctctgggacccacagtgaaggagagagccaattctataagttgtcctctggtttacacctgcataccaagatacacgtttgtgcacacacatctaatagagataaaatgtaaagtagaaaaaaaatcatttttgtgctttgtaacttctaagttgcacacagaaaaaaataaacatatgttctttccttgtgtcttgtttttgtctggggtggggggagttggttgtttttatttgggggttttgtttcagtgagatagtgtcctgagtatcccaggctgaccttgaactaactatatcgtcctggattgccttgacttcatatcccttgtctccaactcctatattctggaattctaggaatcgaacccagagcctcatgaggcttcgttttaaatatatgggtaactgggggtggggggtgtcgcagtgatttgaatacacttagcatgt

SEQ ID NO: 29515 - DNA, 1175 bp, Mus musculus
tccacccccgccacaggtaaactttgagtgtccccaggcctcctcagcccgaggggtggggggagcttcccagaattaccaaggtggaggtgctttggttccttctgcttgaaggccatcagtctccaaagcccttccgagttccaaagctggtagaaactgggatttgtacaaagtaagttcaaggccggcctaagcaactgcatgagaccccctatctggaactaaaagaaagaaaagagattggggatagaggtagttcaaagatagagtccttgactagcaagcatgggaagagtcactttggtggagagagccccaggcacagagaagggatggttctggctcttgctgctcagcattcctgttgagctatagaagctgggtatttgctcctccagcctcagtttcctcatctgtacaatgggactaatcgtacttggagcccccctcagaaaaatagtcaagctgggaggatctggtgaggtccccaccagccgacttctcttctatctcctcatgtgtatctccctcccacccccaggctccatcaaagggatcgtctgtccaccctccgcctggtcacgccataccctcggaagaggagcttcctcctcctccagaagagcctgtcacacttccagagagagaagtgtccacgggtatggctgtgtgcttactctctgggtcttcaggggtcagaatgggcttcgcatgtgaagtgtgggagagcagggtcccgcccctgctcacatgacagcagggactgtctatacagtgtgtaactgctgaatctccatcgcagccatgtgcttgcttctggtttgctgataatgatgatgcttttgagatagggtctcatgtagtccaggctagccttgaatttgagatgtagccaaggctggccttctctttctccacctgcctcaggtagctgtcttcagacacaccagaagagggcatcagataccattacagatggttgtgagccaccatgtggttgctgggaattgaactcagaacctccagaggagcagtcagtgctcttaactactgagccttctctcctttctttctttctgagacagagtttctccctgtagtcctggctggacatccttaacccatgtttgtttgctttgagatctcactgtagccaaatctggacttcaact

SEQ ID NO: 29516 - DNA, 1282 bp, Mus musculus
accctccagagcagaactcagccaaggcctctgcagtgtgtgaaggagaatccagagcagaagtgattggtgttggggtgggcaaacaggattgctttacagaagtctaccagctccacaagacattattcaatcctccatttaagatagctggtatatgcattcctgaagcatagaaggaaagtagggtcttagtgatttctgagctgtactaggaatatgcttaaaagttgatcagtaattagactcgggggtccggggcttgtggaatgggggaggagggctgctaagttttaggttaccaagaaaaaaatggctcaacatgggagtttgtttacctgcaaagtttgaaccccagatcataaggcatagaacatgagtgcatcttacatagctctgtctgagaaagcaactaaagaaggttttgattggctaacttgggaaaggggtgcttccccttccatccttcctgtcaggtgatgggcagtgattgtacttaagagtttggttgccccaaacctgccaactaaaatgagtgtgtctgtgacctgcagaatagacctgtgttcctacaggagccaaccagatatgtgttcacaggctccttgagcagcccttacaacctggaagacatgtggcctcacactcttaacacgggaagactgaggctgtgctcctccctgcatcccctgggcgtcccttccttctggcgagacattagagggaatctgttgtgttgagtgactctcccttacatgcaccttgcatgggaaaccaatagtgcatttgtatccagatctcttcatggcaagcagggcccgatggcttcaatgccccccccccccaaaagcttcagcccccagtaaaggctccctggctctctaccgcagcggcagattgaaactagggagcctctttggcttcttgcagttgcctgagtgtcatgaggtttttctggcttggacactacttcatcttttgagatctggtctggttagcaaaacctgcttgccagtggccctcccagccacggtcagatgctttgagagtctgggagactgagaactgcgaagatgctctcaggaatcccgacgtcagttgctgtttgtgctggttagaactgtctgcagccgaacgcgctagatgcctttttgcatttgagtttgttttggtttggtttttgtcatactttgaaatgtaagtcagccctgatgatccaaacacttttattttatttttcttctttaataggaactttctgaagaaaacgtgatgtgtaaaa

SEQ ID NO: 29517 - DNA, 1282 bp, Mus musculus; identical to SEQ ID NO: 29516

SEQ ID NO: 29518 - DNA, 1196 bp, Mus musculus
aaaatctgcaagcaaaatgttgagccagattttttttttgccggccaaagtaatttatgatcttttgtctgaatttgtctattctacttgttaacatttgggccttttaaatgtattggcagtgtgtgcatacaaagctttttattctcatgacgatgatgtattctggaataaagcagatggttttgtgtatagcataccattttagaatgagtgagtgctttgaaagcaggagtcatgaggaacctgccatctacggagctaggacagatcagctgcccgccgtggctctggctgtgctgtgtgcaggggatggcttttaacaggaagctggagaagataataacttctagagttgtatgttttgagaaggagaagataataacttctagagttgtatgttttgatttgtgtgctcagggttgacatttaagtagggcgagcgggagggcttacaccttgggctaccttgtttgtacatcataggttgctgcatggactgattgccaaataccttcatgaccatgggaagggtgtggggaaattcacattagcgtgaaacctggtgctacttgtattttaaaagggaaaggaaaaaatcgcgatcataattccatttgtaaatgtcaaggactgagctaaagataatggcttagacagacactggcgtgtactagagacagggtcgaggcgtctcactgacaccccagccctcccagtgatcagggctgaccgccaggagcctgctggctgtgcagactctgttaggaagacttctgctaggaagttcttctcatgctcagtcggagctgagtgagacagcgagcaagtgctgggagagccttttgtccctggcccctctctcggtacttgtttgtgagcgcccctcatggcggtggaaatacaatggaagttctgacaacagtggccttggtgcagtcttcatccctttctttcctcaggagtttcctttctaagcaggatccatgtttgtgttcatcaagttgagctagagtggggcagaatgtgtagctgtgtttgttgtggcctttttagtgtaagccctcgccttgcaagtctctgtccgtgggccccactgtgcaataatcactctggataggtttgaaagaatcctttcctggaatataaactgttgtcttaggtgtctggcaggaatctgtaatcttacttttctt

SEQ ID NO: 29519 - DNA, 1196 bp, Mus musculus; identical to SEQ ID NO: 29518

SEQ ID NO: 29520 - DNA, 1668 bp, Mus musculus
tggaggctacgaaggcttcagctgaattccagacaaactctaagaaaacagaccctcctcctctgcaggttcttcctgaccttgcttcctcagcagagcagagtctagccatgcctttccataagtcatcaaaagaagccgttgttgcaggtaatctggagaaatctgttgagaaaggaacccagggcctcagagtgtatctccacacaagacaggacgctagtttaactctcacaactactgggatgcgggagccacagatatttgcggaggaaaagagttggcatccagaaaatcagaccccaagtcccgtgaacggccttcagcagcacagagaaacagggagtgtacagcgagaggctggacagcagagtgttccacaggaccagggctgtctttgtgacgcagaagaccttgagcttcatgaagaagttgtcagtttggaagctctgaggaaaggtgagctacaaagacacgctcatcttcccagtgcagagaagggtcttccagcttcaggactctgtagctgtccatgctcagaagccctgatggaagtagatacagctgaacagtctctggttgctatgtgcagctcaacaggcaggcaggatgccgtcatcaagagccctagtgtagcacatctcgcttcagataatcccactatggaagtggagacattacagtctaacccgtcctgtgagcctgtggaacattccatcttgactcgggaattgcagctcccagaagataatgttgacatgtctacaatggataacaaagatgacaattcctcttcccttctaagtggccacggtcagccctctgtggaatcagcagaagaattttgttcatctgtcacagtggccttgaaagaactccatgagcttttggtcattagctgtaagccagcttcagaagagtcacctgagcatgttacctgtcagtcagagataggagctgagagccaaccaagtgtttcagacctttcaggaagaagggtccaaagtgtgcatttgacccctagtgaccagtactcacaaggctcctgtcaccaggccacctctgaatcaggaaagacagaaatcgtaggaactgccccttgtgctgcggtagaagatgaagcatccactagctttgaaggtctgggtgatggcttgtcacctgaccgagaagatgtccgcagatcaacagagtcagccaggaagagctgttctgtcgccataacctcagctaaactgtctgagcagttgccctgcacctcaggggtagaaatagcacctgaacttgcagcaagtgagggtgcccacagtcagccttcagagcatgtgcataatccaggcccagacaggccggagaccagcagtgtctgccctggagctgggttgccccgtagtggattggaccaacctcccacacagtccttgtccaccccctccgttcttccaccgttcatctttcctgctgcagatgttgacaggattcttggtgccggcttcactctgcaggaagcgctcggggctctgcatcgagttggtgggaatgcagaccttgcccttcttgttttgttagcaaagaacattgtagtcccaacataattgtgggaagtgggctaggccacacgtcattccttttgaaaaagcccttttcacacaaatatactacacacac

SEQ ID NO: 29521 - DNA, 1668 bp, Mus musculus; identical to SEQ ID NO: 29520

SEQ ID NO: 29522 - DNA, 1229 bp, Mus musculus
tgtccgtgttaggttaggtaagtggtctaccactgggctatactgtcccaacactgacacacctgtaattccaggaggctgaaggagggtcacatgatcacatgattaagactatacagggagtgagaccctgactcggcaagcaagaaaatgagatgttggcgtataaggcgctgctgcataacctaacatttccatcttcactggggcagcgttgccccacacaagcttattttctgttggtggagtttttaagtagcctttagttactctataaacaacatactcttttctctcagtcatacttctgtactttggtagactctggtgtgaatttcaatatcaggggtgtcagtgcacatctgaaatccctgaacatgagggtggatccaggaggaacagcaagggctttacaaaataaacaaagaaaaagctaggcaggatgatgttacgtggcttatgttttacagtctgatatttctctctcccttcaggagcccagatgactattatgagccaggcctgtgcagaaaggtgtaacataatgagactggtagatcgtcggtgggctggcattgccaaaggagtaggcacacagaagattattggaagggtgcatctaggtgagtgaaggtgggcagtttgctgctttttaaaatagggattttgtagtgtagtgagttttaaagttctttcacagtacctctgactggtatggcatgtccttgagagcaagtgggtgtgtccttgtgtacgggtgcccctctgcaggtcagagggcagcactggggattggtgctcacccttccacaagtccctgttcttgatttcaggttgccaggcttttgtggcaagcaagttacttgttaagacaccttgctgactctgggtgtggcttctttccctctagcttgacttggtcaaaggtcaagctgcgttttggtcaaaggcactgcattttgatctcccggttgtcatcatagctgtggagatgcttagtgttcttgggctatgtggccctctctcctctcagctccctggagggtgtttccatgtgcctgagtatggttcttcttcatttcttgtactcaagtgttggtggattttttagtctggaataccagttccatgatggaagccggtgccttagcacatgctaagcgcactctaccaccaggctgtcctccagccctccttggtgcattcccgtgtgattcactcaaaatatt

SEQ ID NO: 29523 - DNA, 1170 bp, Mus musculus
tttactacctgggagaatgcagatttgcggttgaaagtgaggggaaaaagtttgagactcactctgccattgacgtctctggaaatgcatacatttttggttaatttattatatatgtatacacacacacacatatatatatgtcatatattaattaaagtaatggttaggttaactcagtctgtctgcttctctcaggccaaagccctcctcctttctgggcccagtttagttgggtcagttcaaagctcagtgctttcgaaggatattagcttgaaaatggcctactgtctgaagacccccgagggattcggcggccaggagttcagccttctcatgttttaacaagaaaatatattctcaaaatgctttggtgtccttagtagacttcatcaaacaataggtggactattttgtaacctttgcactaaatcccttaagattctaaccaaagtggcccccgctgggtgtagtctaaacaccagaaaattatagacagctcccaaggccccagaatgtaaatcttgatttccttctgcaattatgaaatagttccaaaaactgttgcccaacgactgcctgttctgtcctgacttacggtaaactctgcgtgtcaatattgtgttcagaagtaccattccttcacacaatgtgaactttagaaccttggcatgcagctctttctggaaggatctattttagggaaggaggtgtcactcacatacgcggtctggcaaaagttgggaataaacagttcccccaatttccacagaaaaattaacccacaaaaacctaggaccccattcctgttggtcagcctcctcatacaggtagcaggggcaagctaggaccagggagtttggggggctgggggagatttgactttttagaggattgattaattgctggttgttgtttgttttgtttttaaggcaggtctcactatataaaacactggctcccatctacactcagagatccctgttgactttgcctcccaaatgtttggagttaaggcctgagccatcacaaccagctgcttttggtttttgtttgtttgctttggttttttttgttgttgttgttgggttttttgttgttgttgttgtttttgagacaaggtctcaactgtggggtcaaggctagtctcagacagcagccctcctgctt

SEQ ID NO: 29524 - DNA, 1328 bp, Mus musculus
ggcttgaccctgagccgtgcctggaccaacctcaggatcttcatgagcctgtctcatggggtgggtcactcacctctcccccagcccctgcagcaggctcctgctggcccctgcttggcctctgccaaggtgtgtgctctcaacacgggaagccaccacggcttctaggtcctccgtcttcaaaagaggcctagtgtgcaagcagttttctatgtggttgtgcttctgggagcaagcagtgagaagtatattttgggggtatcccccacaacagtcggccaagcatggttttgagaagaaaggggtgagcagggggtgaaggtgcagcattcacatttagtctcccgaccgagagggagggtgagcactggctggaggcgcagagccctgtgaccctgcgtgcacttccctgcccgtccccttccctcaccgcactctgtcagcaccagcacagccagggtgtctgccttgccagcactggagtggctgagctgctgacctgtccccagaggcctttttgcttctgggttttagagtttgatactaggagccatatcctgtgatcttgttctctgaacatagataagctgctatagagccagtagatttaagatggcagcacttagtcctacccaccaagagctaggtgcaggagcccttcctgcctcgctctccagtaaaacgccaggtgtgtcttcataccaaggaacctgacctctctgacaattgcattttgaacattgttgtccccaaagagctgaatcttcaggtcgtctcttgtgactgtgagcggagacttgtccggactcctgtcagtaggcagctagctagcatcctccttctggcgtccctgcttcactgtttcctccttcccttattgctgcttcccgctgccagatcacacccatcagctccagttcgcctggctccacgcaccttgagctcagggccggatcatgctcgcccgctcaagggcatacccttgtttttagagccaacccatgaggggagtttggacaactgtcacacatgatgtgttctactgtcaagcaagtgcccttttgtaaagggaagggcacaaatcagggaccggacattcactcagtgagtattctccagttgtaattgctttgaaccaagcacctcggatcctgactactttaaacactgagctccagtggtaagtgagaaattatttgaacccaggaactctgtagttttcaaagagtctttagctttattaaaaagtaaagaaaacactgccaggcttcattcttccatctgcccctctagcagtacatgccgattctccatggttctcgtgtgcc

SEQ ID NO: 29525 - DNA, 2695 bp, Mus musculus
agtccaattagaactgtggatttatgtatcagaaaacttgaccaggtggtggtggtacactcctttaatcccagcactttggagtcagaagcaggaagagctccgagtctgaggccagcctggtctacagagcgacttccaggtcagccagggctacacagagaaaccctgtctcaaaatcaaacaaccaagcccaaaaccaaaccaaaccttgaattttcccttcttttacagtagctaatgggtttattctgtaatccacctcaggatgttgtaggtggcattgccttcagatggccccttcagtggccctctccttgggagccctcctcagccattgtgtcagctaaggacactgcacccacagatacccccgttcttctgttttgcaggttgccaatgctgtttctgcgaaagggacttacaagcagattcctggctgttttaacttcctccggaaaaagctgttttttaaaacttcatgaggctcggggctgctctctgcctcattattctctccgaagctctcatggcttggagctggccaaggccataactgtcctgctaagataggattttgaactggggcaggctgctctttccctttggcgatgcaaacatgctcctagcagctttcaggttgtagggcaatgtggagcagtggtcggaagaagaccggagtgcaatggatgctgcctggccccttcatctgtggttagggattgtgccctgggactcccaggcctctcaagaacagggcttctctgccactgtactactgacatgtgcggttgtataatcctgtcatgggactgcctcgtgtattgtagagggttttaagctgtctctgtcctctacctgccagctgccaggagcacccctcctgagatctgccaaccaaaaatgtcttcagacattgtcacatgtgccctgggggacattatagcactcctctctgctcccccacccgggggggggtcatcaaccacaggggtctatgcatctctcctttccagactcaaagtccagctggcccagtgtgcatacctggatctgggctgcatctcttccaagttaccagaagggctaattcttccttgagaacattatttattcttcaacaataaatcttcggcaataggactgtatttagcctgtattgtccctaccccaactctgtccttcttacaaaggagacatgatttttcctgcgtttttctctgtgtcttccaaggtccctgcccgagcccagcaggtgaccgagataggagtcaggagtccccacagatcaagtctcctgtctgaaggatcttggttaccctagtggggacaccaggacagagctctgctgtttggggtctcccaatctcccattgtcttccttgctaagtgagcctggtccccaggtggcagtgaccaggcagtactgaagtgctgggacttccttgaaaatgtgccctcccctgtctttaaagcgattctgcctttcacttatttttctttctttctggtttcctctactctttgctttgtgaaagtccacttgagtttagatggtagatgtgccaagccttgtttgtttatttttgagctagggtcttactttgtagcccaggctgaccacaaaatctccataccactgcctcctgggtaccaggattatagcttgtcccactgccccaatctcctcctgaaagagcattgctttcagggccccgaggttagggtatcggggtaagaagacagactcattcaaggatgtgattcttaaattactttattactatttcttttctatggcatttccagggggacagtggcagtaatgtcttcagttagttccttgccatcacctgcaggacacacaggagagagaggaggttagctggaacactgggcattgagttcagtgactctcagggccaagaggggtcaagaagggtcttagcccggaatcctgcttgggtatcaggccaggaaggcccggaatcaccaatcattacatgccaaatgcaccgatgggtatgttttggttttttttttttcatgttgtctgtttctttgttgttgttgttgttgttgttttccctgagactgggtctctctgtgtagccctggctgtcccagaactcaccatgaagacaagactggccttgaactcagagatccgcctgcccttgcctctgagtagtggtcttaaaagtgtggaccagtgcacaggcccctcacagttcagaatggcaggtgccagctgagttcattaaacaaggaaaatgtgttgatggcttatggtgagcagaccatctacacatgcagttgtgggcgtttctttgttgtttgttttgaggctgggactcactatgtagcctaggctggccttattaccaccatacttggcttcatttggttggttggttttgtttgagacactgtctcatgtagcccaggctgcccttaaaacaatcctcctgcctcttattcccaagttctggccattatgcatctttaccaccatctctgccaatacaggatcctttgttttgttttgttttgttttgttttgcagttttggcgtctatgcacacaaggcccaggtgagcacagagcatacaattgacagcgattgcctctgtggattgggcgcaaaggttaaagccaggggaatcttcatttcttacgtgatacactcttgtgt

SEQ ID NO: 29526 - DNA, 1188 bp, Mus musculus
cctgccatggtccagcagagagtgagaccctccccaggacgcttcctttcagatcaggccccatctctgatggaagtggagagactcttctattagtgaggagatccggggactcctacattagtgaggagatccaggccctagcactctaagctgatttcaatggggcccagccaggcagggtgaaggccactgtgcgaatctacctcacaggctacactctgccaggcatgccttggggatgtgagtgatagggttccgaggggaggggcagaaatgtcaccctctgacagcctacccccgcagcaagctgagggtcccaaggggctgtggagagaggggtggggtccctaagggattggccttttcagggtggacctcagcactctgccttgactccccaaggagtgcctgacgtgtttatgttcactggcagtaggactcggggccggcacccctttcacactctccttccttgggtttgtcacccgtgatggcaccagcctgtcgtgcccacccgtagactcgcatggggactccccaggccacagtgaaacccgtgccgttcctctatagctccatgtgcttgctcacgtgtgtgtatgtgcgtgtccgttgctgtgttgtgaaactgtgacgtcacccagtctaagtgaatggccaccggggccaccgttatgcaatgttcagcgtgtcactgcttgtgaagctcgataactctttattttactacaatgtccccagagtccctgggacccctgtgggacttgcaaaggttttattttttcggtcttagaacctatgagaatcggaggggccgagccaagcccagcccagcccagctgccgtggccttggcttgcgtttgcctcagcggatatgtttatacagatgaatataaattctctttacttttggctgtttgcattttatttttggttccccctctcagtacctcccaaaaaaagaaaaaaagaaaaaaactacttcttcattcggtggtacgattattttttttaactaaaatgagataaaattctatattcttatgtgtgtgtggtttttgatgactaactagaaacaaaggtggacaggatcaggatgaggtcgctggatctgggccgtcacatcaggagcctggggaggaaggcactcctgctggagagctctgtcccttagcatctacaaa

SEQ ID NO: 29527 - DNA, 1145 bp, Mus musculus
tgaacgtgccacttaagtcttaaaaaaaagtgtgtcttaaaaggcacacgcctttaatcccagcacttgggaggcagaggcaggtggatttctgagttcaaggccagcctggtctacaaggtaagtttcagatagccagggctacacagagaaaccctgtctcaaaaaaaaaaaaaaaaaaggtaacttataaagccttttttcctattccccattctagactgaaagtataattctctgtgacattacaggactatacctctggtccctctctcctatctgcatctgtccctagcttgcctgtaacagaactttacaaagctgtgataacctggaatttatgaacattctataaaagacacagcaaagataacggccaacggtgcctacaaagtcacagacactctgggaatttgtagattgctcaacagcatcctcgaagccaacggaggacagggagcaaaataaaacaaccagaatacaattttggaagcagaaatcatggcgtggcttttctgggttataaatcttctcaggaagacgaaaggaagaaaacttcagataagacggtgtggcgcccggagataagcctcagcgctgcggagaattcagaaacggtgtgcagcttcaaaagcaggcaaatgtcctcagtagctgtccttgggctgtcatagctgaacataccttcgacgacagtgcccagcccaaaacagtcaccagcgtctgtgaggaaaatgcagagcatctgtgaggccactgcagagacctaaaacttacttattgaggaaaatccaataagccgtgtggctagtgtttgcatgggaacgaggggggatttgatgtaagctagtacttaaatgtagccatgacatcgaattttctgcttccttcaaaaattaaatgatagagatcgagagctgaaatctcttgttcctgataaatttcttgtttgtttaaaaaaatcgaatcccaaggactagaccacaagttattttgttgttgttagtttggggtttctgtttgttttaggtacaagcacgccatgcaagcctttgtggagagtaaattcagttttgtgtcagagtctgcataaaggcagccgagaaagacgggtcttacaggagaggccacagaaggaagacaac

SEQ ID NO: 29528 - DNA, 1180 bp, Mus musculus
gacagcctgtcattaatctgacaaacctctcttgtgatgtccctgtcagctgagacaggtaagctcacccatgagctaacggaggtgcaaatcctacaaaacaaggtcaccccggttgtcagagtagggcctttctagccgctgtcctgatctgccagtgtttttgctgtgtggcttcccctcaatggcctcacctctctgtgcctcagtgtcttacctgtcatacttccggttcctcccagaggagctgtgaggattaacattcactaacatttgtcccgagctttgaacctctcaggaaacagctggaagggatggggcaggggaggaaggagcctaacttccatccacaacattggcagacaccgggcgagttcaccccatttttggatagggagataagcaagaggggcttgcagaaagtttaatatcgagagtttccaaaagccatcggtgaggtctgggagagccaccagcacagcctgcgggcctactgggtgcagggtccaagctgactgagcagagcctgcctattgatgatagggaggatttcggtgtagctgtgctcagtcagtaccagctctcctcagattcccacagctgacggcagtcggtgggggtgggggtggggcactgcctctgagtcaccaaagccagtcttctgcattgtttctgagagcttccctttgcgggaagaccacaggaagcctgagaacttggaggaggattccctgagtcccccaggtccagtctccttcccaacctgagtccagggccctcggggactgggaggaacctctctgtctgagtgtcagcctccgaaggacacacggcggacaccaggacttgcagggtcaacctctggggtagaatccagcttggctcaggctccacatccctgagtgtttataacacgcattcccctgcccctggaatcctgaagctacaaatcccttagcccagcaaagagaggggaagaaggtcctcttctaattgaagccagctgtcactttcacaccaagtccccaaagggtgacaaagcttctggagccaggaggatactgagagccttcctggaaatgtcgctggcgatgtgggctcctttcaagggccaaggtctaggtagggagagactcacactttcttcccacgggctcggaggcccacggcatctgaaggc

SEQ ID NO: 29529 - DNA, 1693 bp, Mus musculus
agccgctactcttactgcagcccatgtcgccaagaacgtggtctgtttttcatgttcccctcctcccgacccttcttcggtgtgaacgtgtgggaccagaccctgttctcggggtgtgcccgagtcactttaaccacaaaaacaccccgccatcgtcgtcagggtaaggtcactctgcagagactctcgtgagcacatccaagacttcttggctgggctgcagtgtttataagggggtcatatgggctctttttaatggcctgcctgtttttaaattgtgttgctgtttctttctttatggaacaaaaagagagaaagaaaactgttgcatttaatttatttgcacaaatgcagaaaacgtattctatctaaattattacataaatattggaatgtatatttttccacggggtgggcgggaggcgggcatttctgcggacttgtctgttctgtgttcatgccgctgcagacactgtgcaaggtagaattcaggtggctagagctggggacctcagacgaccagcttgcttatttcttttttttttctcttttttctgtctctcccggctgctgtccctgcatgagagaactcccaccttctgctctggcctttctctctacatgtatcctctctttatatatatatatttatttatctgacatgcagatcgtgacttaagtgagcagagcgccaacagtcacgttcccccctctcttggacctgtctttggagtcatgtggattgagtgcagggaaggatagcctgagatagcctggggcacatccgtggaggtctaaccagacatctgggcttgagtcagtgggtaagaggcccccggtggtgcacacaatgcctctccatccttagtttattccagacgtaggccaggccggtgtcaatagagaagatgcccacctcctgggaagggctgttggggacagtatctagcaggcaagccctctgccctcttttgtcctgttggcttctttggccacgcgtggactttcccatgatccccagagccctgtcctctgattatatcagcagctcgagcagactaagcccaagagggctggcaggtgcctgtacctgtgcctgtttgtggggcatcactgtccccacggggctgcactggggcctggagaacccacaagtttccagtcagtgcttactgccctactccccggaactcagtttcctctttctttccctccccgtcccctctaactgatcctaaaccactaacaactcatccctcatcccttgtggccactgcagtgctccccctaacggaaacattctccactcttgaaaagtgagttttcagtgcttgatggaacatctggaatgtataggatcttgtgtccaaagtctctaaaaaacaagccaaaaagcccccaccaggtcacctcttccctcccaacctggccccagaggcagagagagagagcaagcagggacacctaatgccaccctgtgtgtacaaaccgttcagctcagctgattaacccagcctggtgttaagggagagaggccagagctggtcttagaaaacactacccccaccccctgaattttttgggttttattttattttgttttttatggttccgccctcccttccttttacttacaagaagataagattgcaacctctcctggtaatgacttagtcattctttttcatttcag

SEQ ID NO: 29530 - DNA, 1159 bp, Mus musculus
tgctccaagaggcaggtgcatctctgagttcaaggtcatcctggtttacaatagtgagtttcaggccagggctatgtagagagactctgtctcaaaaattattagttattacttttattaattattattagttgtgtgtgtttattattgttaagtgtgtgtgtgtgtgtgtgtgtgtgtgtgtacatatgatgtagtgcatgtgtggcacacagaggacagcttttgtggagtctgttctctcattcaaccttgacatgggttatagggttcatgtcaccaggattgcacaacaaatgttctagccactgaactatcttcaagccaagatagtttgctctgaagcccaggtactgtcataacaatacaagctacccctgatttgcctggggtttcttagttcatttgcaaactctgtgaggccatttgctagatgccatggtttgcaggtctgtcattctttcaagcaccagtttctgcaagttgtctgcagacctctacaaacatctcccaacatgcaagtaaatagatacagataggaatttttaagtggatagtttagctgacaactgaaacacctaactatttcccatcaaccttttcccctcagttttcctatcccacctctgtatgcagcaaagaaccatttgattataagacatatatgagggggttcaaagttattgatcaattttactgcttcagtaagcacacccttttttattttattttattttattttattttattttatttgtgaatttattgaaccagggactggtgtatgcttgcctatagatcctacagctgagttatgatcacattgttatcaaaggcactcttaagttctctctctcccccctaacccccctccctgtgcgtgtatgtgtgtgtggggggtggggtggggggatgtttgtgcatgtgtacactcccagaagcccacatgcaaaggccagagactggtgtttgttgtctttcttagtggctctccactttgtttcttgaggcagagtctcgtactgagcctgaaacttgatgttttctctgactggctccctgtctctaccctgtgagcgactatgtctgtcttttttatgtgcatgctgtgggatttgaactcaggttccccgtgcttgcatagcaagcgtttttaact

SEQ ID NO: 29531 - DNA, 1118 bp, Mus musculus
tctgcagagttcacacttgagatctgggcagtccagttataaaacgtaaagaattgcaaacaaacaaataaacaaacaaaaagcccatgttttaagtcagtttatggtttgcgtgctgtacctgaggactggaggttgaacgtagagtctatcgtacgttcctgggacaggaacaaaagctagacaggtagaaaagctttgtccctgaagccagaactggcctgatacttagaccaccacgacacacagagcaggaaaggtttctcaggtgtgggaggggggagcgtttgagcctcctggtccacgagacactatgcaaggggccacagtggaggatggaaggttgtccttgccaggagcctggtcacatatcgcgacagggtgaggagtctggaagatgaacttccttgctctcccaggtgcagctctcacagcgtgaagggaaggggattttgctggctgatgagccgcctgggtcacagcagcgttccctgaccctagctttggtatgcatggctcactaagcagatgaccatatgatatttcattgacatgcccaggatgcacaaggagtctctgggaggatagcgtgtgtgactctgaaggccacttccttggcaggaatcttattttgtcagtgtctttgttaggatttctatggctgtgaagagacaccatgaccatggcaactcttataaagaaaaaaaaaatgtgtctggctgactgttcagaggttttagtccattatcatcatggtagggagtatggttgactgcaggcacacatgctgttggagaagtagctgagggttttacatcccgatcagcaggcagcaggaagagagaaggaccattgaacctggcttgggtttctgaaactccagtgttatacttcctactccaacaaggccacacctcctaagagtgccgctctctatgagcctctgggggccattttcattctgaccactgcactcaggttattgtgaccctgactactggtggtggtggatattgtggcccagctggtacaaggtagttggatgcttgggaagccacttctcatccagaggtccatctgacctaggtcacctccttttgaaacctcaaagcccactc

SEQ ID NO: 29532 - DNA, 1217 bp, Mus musculus
cgagcagacacgtttttgccccagcagataagccaagacatcattaaagctggccaaagcagtcaccaaggagccctgtgttggatttgagtcactaagggcttaaaccctccagagaggggaggcaggctggggaggtgtgcacgagtgtgtgcatgtgcgcgtgtgtcgttattttaatggagttactctcagtaaaggcgttggatgtcatgtgtatcagatgagtaccttccagggaggggggacgtcgggatcaccaccaattcccaaggaccacttcccctgcagtccctgtgcgagccttcgcggtggtagagacttcaggctttctctcgtctgctgcttggatgctttcaaaagaggccagatggaggaggactctgctcagggtgattcctctcagctcctgcccaatatccacggccctgcagacgctgtagaaacccctgatctggaaggaattcccagccaggtgggaactgcaggtatgtgagacctgatgtctcagccctggcctggagacactgaatcctggctgtggagagggagcagggagggcagtgtggtatccgtccctagggtgcatgctggatttgcgggactatgccagggaacacccaccacctggcacctggcggcagatctgcaggtgcctggattaggaaggtggcacaggctagtttgggccgtaactttatctcaggcattgaatgcgtttcatgccttttagttgtgtagaagctccaaaaggctatccctggagaatgacaaagaaggcgcaaacaacagcccagtctcctgggagctctgttcccacacctacctacacagccctggcaccgggctcctaactttgaaaccctgtgcagccaggcggggaggaatgtgccctttcctcaggacaaggaagaatgtgttctctccttagggcagggcttgctaatgccaagctcattctctgggggccagccgagattcaagtttttgctctgatacatgcgctagggtctgttgattcccatggcattctccccatcttacagatgaaaccattgaggcctaaagaagttattatatactaaatatctgttccagattgccttcgtctgcaaggcagaattcttggtagtttggcccacagcagaagttgagatcctggaaacaatgggcttttctttctgtctttctgggtttttttgtttgtttggttggtt

SEQ ID NO: 29533 - DNA, 1218 bp, Mus musculus
catttagtagaagcagtgtctagggacgctggggtggagatgtgactctcctgtgcccttctttgtctcccatggtgggacccactacaccattagcatctgacccttgcaagttagctgcaaagtgaagcaaaggaaaaaaaataataaaaagggaaataaaaagtatatggatgggttcaaacaaacaaaaaccaggaggatttgaacgggtgattttcagatgccataaaaccgcttgccaggggagggcagggctgacctctgacctctgctgtggtggacagttggagcccggcagaaacacggaccttgctcactgaggtccttgggttttgtgcctttggggcggaggatgcctgagacgattttggtaatgtttcctcagctccgatctggtccctacctgtcaaagtgggaggacagaacttgggagagttgtcacacaagagaggggctgtctttttcagggctactatggttgatattgcaactctgtagatatgtatgtagacacttttaaaagcacgtatttatggaccctgctgtaaatgccccatttttaaagttttataacatgtgttatttaattaatcagttgactggctgcagtaaggggactgactggtccaggaaaaagggtccctggagaccctcacatgggcaggaaaacatccatcaacgtccagtgtcacagttttccgatttacccacccagccagactctggcgtgcccctcttttatttcttcaactggaattttctccttctacgcaccctgcagttagtcctcgaaagcatggactcatggctgtcgccaaccccactgacacagtctgtcctacagctggtcgcgtgcactgtatcccagccacgccctgcagccgggaaaaaccgcacgaacccaaagccttagcaaactgctttcagtcaaacttggaaaatgttgctgggctcgtgggggattctctctctctctctctctctctctctctctctctctctctctctctctctctctctctctctctccctccctccctccctccctccctccctctctttgcatgtgcaaactgtgctgggtcacccttcaacacttcccagattgtcaggaaaacaaagagaaagttttgtcagacgaggtgtttcctggtcagtggcggtcttcccaagctagcggatttccgtcccagtgaagaagattcagtattctgc

SEQ ID NO: 29534 - DNA, 2160 bp, Mus musculus
tgcagattttcaaggacatagctgtagccagaacagcattgagcacaggctccacaggttgccggttggtcacttcctgaagcaccagctggtttaccattccaggataaagagccatcagaaaagccggtgagcctctccctgagtctgtcccagtctgcctggaccttcctgctattgcctttggcttggttcctttctagagagaagagcagactcttccatgttcttccctgtaatccaaagagagctgttctatccaagcaacgtttccatttttcatgatgcccactacccctgtgtccagaagttagagaagaagcaagtccaagacaggttcttcactgccaccaccaggtgcccctacccccactgcatactgtgcgtgggaaactgccctgtgtcttgggagcaggagtggagtttctaactattagagttgtttatgtgtttctgtcttggtgacatttgtcgtacagtctcctcacctttttctttaattggtcagttcatacaaggttgtgtatgttgtcatttatcttcagttttcttattttctaggaacttcctgtagaaaagtcccccccacaaaacaaaccttaactgactaaaagatattgcatgctcaacttaggataagcactacggcaaaggatacgaaatctacccagcttgcaagaccagttgaagctgactcaaaagctgtaacatacagctgcttaccgacaggcttcttgccctggttagtgtcaggcatccgtctctttggtggagctcacgtgtgtgctgggctctcaggggattgaaatccaaagagaagggtgccataagatgggctagatggactggctcttcctcatcaccggactggcagctcagctctgagtgtggcccttgagtctggcagagagcagctaagagagcaattgaactgaaccttgcaaagcaagtgcccttgttttatgagtggtcctagtttcagggatgacagatcgggtgtgcccacctcaaaacgcttgcgttacaccagccctcgatgccttctttcatgtgaattatacagagaggcatttagttgatccctatccctctcccctttaaaaaaaaaaaatcataagcagattgccagcgtaatgcagaggatcccagattggataggactccttctcatgcctctgttagtgtttgtgtgtccaactggacgttaccctctcactgtctggcactaatttatagctgttatattacgagatgctgtgtagcagtgtatcagtgcacggaaagcatccaggcctgtatagctgtttgttatctgcacaccaggccttactcttgtctcagtagattcaaagcaacagatcagcctcttccttttgtagcgggtcagcaccacttctccatgagtgctgatgcttcccccagagtaatgaccgaggtggtggaaaacggctacattttattcatactgtgttttgtactcaaccttaaaagtaatctacctcttacactttgtagttgaatacttgtgtgatgaatttgtgccactttaacctttcactaccattcccattttgttacctttctgttcaggagactttatgttggaatactgtataaagcatttgtagcagtttaaaaataaaatatttaaaattatttaaattgttttgggtgcttcaattgtattctgtgatttagagcttacatttgtgtttgcattgttaatccggaaggtgtctgctgtactgaagtttgctgttagttattttattgcttcttgtcgcaaagtgctataaagattattctaatgaaaacattaaaatttataatttgacatacaaaagggattgttcattgtttttaaccaatgtagccttgacagagtttttattacagacacacaagagtgatgtttgctactttgccctgttagcatggacacatcctctgtttgtcagatgtctaagaaagctcttttttcatgttatttaaaatacctgataactaggggagacttggatgatacaatctatatcattgtaacgaataaacactttgtaaacacttgtgaaaggactgcattttgtccataaaggggaaacaggccacttggaccttgtttggtatgtagacgggtagtcagccgttgacctgggacct

SEQ ID NO: 29535 - DNA, 1130 bp, Mus musculus
ccgatttctgcttcatggagtcggaaatatctttgtgtgttctgtatgtaagaaagaatttgccttcttatgcaatttacagcagcatcagcgtgatctccacccagatgagttatgcacacaccacgagtttgaaagtgggaccctgaggccccagaacttcacagaccccagcaaggcccatgtggagcatatgccgagtttgccagaagagcctgcggaagcttctagagaggaggagttaaatgactcctctgaagagctttacacgaccatcaaaataatggcttccggaataaagacgaaagagccagatgttcgacttggtctcaaccagcattacccgagctttaagccacctccatttcagtaccaccatcgaaaccctatggggattggggtaacagccacaaacttcaccacccacaatatcccacagactttcactactgccatccgctgcacaaagtgtggcaagagtgttgataacatgcctgagctgcataagcacatcttggcgtgtgcatctgcaagtgacaagaagaggtacactcctaagaaaaacccagtgccgctgagacagacggtgcagcccaaaaatggagtgctggttttagacaactctgggaaaaatgccttcagacggatggggcagcctaagagactgagcttcaatgttgaactcagcaaaatgtctccaaataagctcaagctaaatgcattgaagaaaaaaaatcagctggtacagaaagcgatccttcagaagaacagatctgcgaagcagaaggcagacctgagggacacttccgaggcgtcctcacatatctgcccttactgtgacagggagttcacgtacatcggcagcctgaataagcatgctgctttcagctgtcctaaaaaacccctttctccttccaaaagaaaagtttctcattcatctaagaaaggtggccacacatcatctgccagcagtgacagaaacagtagtagcaatccccggaggcgcaccgcagatacggagatcaagatgcagagcatgcaggcacccttgggcaagacccgagctcggagtacaggccctgcccaagcctcgctgccctcctcatccttcagatccagacagaatgtca

SEQ ID NO: 29536 - DNA, 1229 bp, Mus musculus
acctaaattactatattgatggtaagattcagaccaacaacagcactagtgattgtgatgtgattgagatggagtctaactctgcacacttgtatggcatagactgtctgctcactccagtaactgtagagattactcaaaacataaagagcactcagggctctgtgacagatgatcttcttaaagagtctcccagtagcacaaattgcgagtctaagaaacggaggactgccagtccacctgtactccctaaaattaaagcagagacagattctgattccacggcaccctcgtgttccttaagtctgcctctgagcatatcaacaacagaggtggtgtctttccataaagagaagggtgtctatttgtcttcaaagctcaagcagcttcttcagacccaggacaaactgactcctcctgcagggatttcaacagctgagattcctaagttaggtcccgtgtgtgtatctgctcctgcatccatgttagctgtgacttctagtaggtttaagagacgcaccagctctccccccagttctccacagcacagccctgcccttcgagactttgggaaacagagtgatgggaaagcagcatggacagacacagctctgacttccaagaaaccgaagttagaaagtcgtagtgactcaccagcgtggagtttgtctgggagagatgagagagaaactggaagccctccttgttttgatgaatacaaaatatcaaaagaatgggcagccagttctactttcagcagcgtgtgcaaccaacagccgttggatttatccagcggtgtcaaacagaagtcagagggcacaggcaagactccagtcccatgggaatctgtattggatctcagtgtgcataaaaagccttgtgattctgaaggcaaggaattcaaagagaaccatttggcacagccggctgcaaagaagaaaaaaccaaccacctgcatgctacaaaaggttcttctcaatgaatataatggtgttagcttacctacagaaagcacaccagaggcgaccaggagcccaagtccttgtaaatcaccagacacacagccagatcctgaacttgctactgactcgagttgctcagcccccactgctgagtctccacctgaggttgttggcccttcatcaccccctctccaggcagcctccctgtcctctggtcagctgcctcctctcttgatccccacagagccttcttcccctccgccctgc

SEQ ID NO: 29537 - DNA, 1130 bp, Mus musculus
tcttagcagcttctagcaatcgagtcataggagttgattacagagcaagcgctgtgtcttcatctctgtgcttctgctccttaggtccaaaagaagaggatgagaggcctttggcttctgcacctgagcagccagcccttctgccagaggtggtaagccaggatgcagttccacaggtggccatccctcttcctgcctgcgagtcacagccaggggcagatgggaaacaagaagtcacagactgtgaggtcaacaatatgaaggaagaggaggaggaggaggaggaggagctggaagaggaagaagaggaggaggagttgggagaagatggggaggaagaagcagacatgccgaatgaaagctctgtgaaagaaccagaaatacggtgtgaagaaaagccagaagatttactggaagagccacggagtgtgccaactgaaacttctgaaggctccccaggcgccacccctcctccccacgctcccagggctagagaggaggccaacggcgaggggcttgaaacattcatgtttccatgtcagcattgtgaaaggaaatttgcaacgaagcaggggctagaacgtcacatgcacatccacatttctacaatcaaccacgctttcaagtgcaagtactgtgggaaaccatttggcacacagatcaacaggaggcggcatgaaaggcgccacgaaacagggttgaagagaagacccagcatggcattacaatcctcagaggacccagacgatggcaagggggaaaatgttacttctaaagatgagtcgagtccacctcaacttgggcaagactgtttgatattgaactcagagaaaacctcacaggaaatactgaattcatcttttgtggaagagaatggtgaagttaaagaacttcacccatgcaaatactgcaaaaaggtatttggaactcacaccaatatgagacgacatcagcgtagagttcacgaacgccacctgattcccaaaggtgtccggcgaaaaggaggcctcctagaagagccgcagccacctgcagagcaggccccgccctcccagaatgtctatgtaccaagcacagagcccgaggaggacggggacgcagatgatgtgtatatcatggacatttctagc

SEQ ID NO: 29538 - DNA, 1198 bp, Mus musculus
tttgttcttttgtttttttctgcatcctagaactttgcaaagatgtttgctgaaccttagttctaacacatatgctggatggagtaggtgttaagggacagtgaagtttagaaaacagttatcacctacatgattgattcacgtgtgtccattttctgacatctctgtaaatcatgccagaaagagaccactgaactgtgtcctcagcagtacagacctggattggaccaatagagtatcttagaaggcatgttgttaagtcacacttgagagaatgtagtggttacttatttccatgcccagggaacatttgtagatcaagcaagtggccttcagtccctcatatggtggcgggaggtgggaggggaaaccaagcctaaagaaagactaagatttgacagcttctgttttctgcttgtatttttctatattgcttctatgaagtgctttttagagtgcttttatatagtgagaaaagctgtttggaaagttgaagatgaaactgtttttaggcattcctatcttaatacacgcttgttcttctccatccctaggtgtactacccaaatttggggtggatgtgcattgatgccactgatccggagaagggcaactggctccgctatgtgaactgggcttgctcaggagaagaacagaatttatttccactggaaatcaacagagccatttactataaaaccttaaaggtaacagtgttagtgttagtctactcctagctactttgcatgcattctctaaatgcagtctaattgtaactgaaaagaacaacttcccagacctagaatggattgtgtttgaagtggttcatccacacacctaaaactctatgttaaacacatggttcatgaggccttgcatatattggagaactagagcaagaagactgtgttgagtaattatagactgcatctttcttcatactattgattatctgtggcatctgctcccctcctcttcctctgacacagatgcactgggaactgactggcaggtttagcccactgtgcgtcgctgttacgtggtaccatggtagtgcctgtaacagaaagcgcactcgcagtgtttagagtgcgtgaagccttggattagcttttcctttcctttgattatattcaggatagaatttgggatttagttcttcctgtcaaaatatttcttgggaaaattgattgcagag

SEQ ID NO: 29539 - DNA, 1900 bp, Mus musculus
ccaacagaaatctcttgtgatgtgcatcagctctgatgtaaacagagcttcaggcagtaaggtcagaagttgctaccagacaaggacatctcatcaaacacagggaacagccaacttcgggtgactgatcatagctggtgtggtgtccctgtgtgcttgctggatggaatcctcgtaccagctagtggcagaagtaatggggatgtcatttgccaggataggaaggggggtggggggcactcggcataggaggatcttagaactgtttcccaacttcttttcaggcatggaatttttgcccacatgtttaaataatcacatacctttgtttaaaacatggagggttggtgaggtggctcagtgggtaaaggtgcttgctgcctgtggtggtttgaatatgcttggcccagggactggcaccattaagacttgaggcctccttggagttggtgtggccttggaatgggtgtggccttgttggagtgcctttggtagagtgttctctggggtggtgtccacaggcctgaaggtctggatcctgggccccaactacacgcctgggaagaaagaggacctgtacctgaagcctatccagagaaccattctgatgatgggccgctatgtggagctgattgagtatgtgccctgtggaaacattgtggggctggtcggagtggaccagttccttgtgaagaccgggaccatcaccacctttgagcacgctcacaatatgcgcgtgatgaagttcagcgtcagtcctgtcgtccgggtggcagtggaggccaagaacccagctgacctgtccaagctggtggaggggctgaagcggctggctaagtctgatcctatggtgcagtgcatcattgaggagtctggagagcatatcattgctggcgccggtgagctgcacctggagatctgccttaaggacctggaggaggaccatgcctgcatccccatcaagaaatctgaccctgttgtgtcataccgggagacagtcagtgaggaatccaacgtgctgtgtctgtccaagtcccccaataagcacaagcggctgtacatgaaggccacgcccttccctgatggcctggcagaggacatcgataagggtgaggtgtctgcccgccaggagctcaaggcatgtgctcactacctggtcgaaaagtatgagtgggacgttgctgaagcccgcaagatctggtgctttggccctgatggcactggccccaacattctcaccgacatcaccaagggcgtgcagtacctgaatgagatcaaggacagtgtggtggctggctaccagtgggctactaaggagggcgctctctgtgaggagaacatgcgtggtgtgcggtttgatgttcatgttgtgaccctgcatgctgatgccattcaccagggaggtggccagatcatccccacagcacgccgctgcctctatgccagtgtgctgaccgcacagccctgcctcatggagcctatctatctggaggagatccagtgtcctgagcaagtggtgggtggcatctacggtgtcctgaacaggaagcgtggccatgtgtttgaggagtcccaggtggctggtacccacatgtttgtggtcaaggcatacctgcctgtcaatgagtcttttggcttcaccgctgatctgtgatccaacactggcggccaggccttcccccagtgcgtgtttgaccactggcagatcctgcttggggatccttttgacaacagcagccgccccagccaagcggtagctgagacccgcaagcgcaagggcctgaaagaggacatcccagcgctggacaacttcctggacaaactgtaggcagcctcacactgccacacgctgcacagtgcccacccatcagaagacaccttgagactgtcccacagtgct

SEQ ID NO: 29540 - DNA, 1520 bp, Mus musculus
caggccctaaagagctaaacagaacaggttgttctcccaacacatctgaaaataagagagcttccaacttgccctgttccccatcctcttcctgtggaggaagatgacccatggcgtgcccacccaccccacccacagccatggtgacccctccgcttggccagcagtaccaaaggaaagatacaggacaagccacagcccctcaaagcatctgcctttggaaaactaaatttttaacataaatgttatgatcgatgattcaaaagacaacatgcttagaaaatggagcaaagccaagacagtatcgccagctttagcaactgtaaccatgggttcaccctggccagtccctattactgttaagaggcatagagtctggaaatgttacatcacagaggcatgggtccttttgcagttgccaacttgtaactgcacttgatacatacacattccagcccagtcctaagcatccactgtgccttcagttccgggaagacactgcttttttttttttttttttttttacaagtctccaaaccatctctaagcctccgatgagttgaggagccacgtcctcatctccctaggactcaagccctcagatcagctgcatctttctggataatagagacctcatcctggatgctgagaacactgttggatgtcacaagatgctaaaaggctcagccgctgtagaaccaagaacatttcagtagaagtgactcatgttggctttagtataggaagtcagaccgaccagtttctaacacctgccttctgcttctcaggacagacagggaaagcaaaaataatcttgtataatcttaactgcttttatggggtggatgtaaaggtttgcggttaatagaagatatttccagtcttcgtgacacggggactcagtgttgctgggacagagctgtagtgtcttggtcgtctgtgttggtacccaatacagtgtagacatcttttcaaataaaacctgattgtgtccaagaatgaggccaacatttgacacttccattgactttagatgtcatttctgctgagattagaatttttcttttcttttctttttttttggggggaggggagttcagttttttgagacaaggttatccctggctgccttgaaacttgttttgtagactaggctagcctcaaactctgtcagcatctacctccttagtagtgggactaaaggtgtatgccaccatgcctgcctggctaagatcttttttttttttttttaatttatttttattttttcaagacagggtttctctgtatagccctggctggcctcgaactcagaaatccgcctgcctctgcctcccgactgctgtgattaaaggcgtgcgccaccacacacggctagattatatcttttatacctagcttgcctgttgacttaatggagagagaagcatccagggtcacaggaagttcaaccccaggggggaaaaatggaccacagcttttaccaccgtctactaaaacagagaacccaaggccaagga

SEQ ID NO: 29541 - DNA, 1347 bp, Mus musculus
gtttaagcgcagtgcggggccttggccgggggcggcggtagtgaagccagagccgcgctccagcccccttttccctccatggtttctctccgctcctgcgagtaacttggctccgggggctccgctcgcccgcacgccgcccggggaccatgccgccgcctcctccagccgcctccctccgacggccctcgccgcgcaggccgggtcgcctctcccccctccgcccccgccgcggaaagttaagtttggagaggggggacgaggggaacatggatatgaagaggaggatccacctggagctgaggaaccggaccccggcagccgttcgagaacttgtcttggacaattgcaaagcaatggatggaaaaatggaggggttaacagatgaatttgtgaacttagagttcctcagtttaataagtgtaggcttgttttcagtttcagacctcccgaagctacctaaattgaagaagcttgagctcagtgaaaatagaatcttcggaggtctggacagactagcagaagaacttccaagcctcacacatctgaacccaagtggaaataacctgaaagatatcagcaccttggagccgttgaaaaggttggattgtctgaaaagcctggatctgtttggctgtgaggtcactaaccagagtgattaccgagaaactgtcttcaggctcctgccccagctgtcctatctggatggctatgaccgagaggaccaggaagcccccgactcagatgtggaggtggatggtgtggacaaagaggaagaggatgaagaaggagaagatgaagagaaagaggaagatgaggatggtgaggaagaagaagatgaagatgaagaggatgaagatgaggatgtagaaggagaagatgatgaagatgaagtcagtggggaggaggaagaatttggacacgatggggaagttgatgaagatgaagaagatgaggatgaagaggaggaagaaagtgggaagggtgaaaagagagagaaacagatgacgaaggagacgatgattaagacccgaaacaacctgcaagaaacagaactgttgagtattggttggactgctcatggatttggtagctgttttaaaaaggtagctgtgatacaagccccaggacacccccacccaaagagccaaagaatagttcccgcgacattccgccttcctccgttagccccttggtaatccaccaccaagcctggggacttcgccccaacaaaattgtaaacgttgttaggttttcgtgtaagactcttgctgtatcgtgacagctgtgattggtgagttgaccatcctggttgccagttacactgtgattgtaacaacgttttta

SEQ ID NO: 29542 - DNA, 1146 bp, Mus musculus
gaatgttgccagcgctgtgtctatggcctggagacaaaactttgtcgttgtcggcagtaaataggggcaggttgttttttgatactgagaaatgaaagtctaggaacaggtcttgcatcaagagaacccaaagcacatggccacacactgctcattatctgggaacccaaatggtgtgctggagggttagaccacaaagactgagcttctagagaacaatgggacccaggacagatgtttgtggaatcaaaagacaatccttcatttcttttcttttgttcattcttcattgtttttttgttttcttttaagatttatttattttatatctgggtggtttacctgcatatatgtatccttggtgcctatagagttcagatgtgggcattggatcccctggaactggagttttggatggctgtgacccatcatatgagtcttctgcaagaacaagtgctcttgcctgctgaaccatctctccagccccagttgagcactttctaaataaatgagttctgtcaggtcatgataatgaatgactttctccttctcacatggtagtaaaatggccagattttagaacctggatgttctggtgtccttctcaccagatttttggagcttggtttcagtgttgttcttttcctgtggcttggctggaaagatcctgtgctgtctgacctctctagacatctgtaatggcaaacctggttgtcagcctgcccacttctgtaacaactagaacccacttgatgaaacagcacatgccctaaatggtgaccatgcattctcttggcagcattggtaaagagagagaagaaggaagctgtgctgccgagtttgtcctacttctttgggcagtattcattttcttcaggattttaacatagcctgaaagccagcagctctctaggagcctaggattgcagcaccagattggactgcagagacttccagctttacgaatgaactcccagatccttggccttttcattgtgagccagccattgtcagactgcgcagaccacagccggtaagccagtctagtaaacctcatatgttcctgatacacacggaactgtcagttctgctcctttagcctttagagaaccctgaccactacagcatcaaggtcaagtgaaagcc

SEQ ID NO: 29543 - DNA, 1102 bp, Mus musculus
gtcttccctcctttacctttgcctgggcatctgttatgtctcacttgtgtgctcattgctttagtatacaaaatgtcaatgtaaaatgagcaatgcattctcctctgaggggtttgggggaatggtagaggaatccaatctagtacacttagactaggaggtattatggacatatcaaagatggctgaagtgaagtcaaagataacaaagagcaaagaaaatggaggctaagccactttgctttatcactctttatttttttctctctctttcatggtcacatattgcccaggctggccttgaaatctcctgcctccaccttctaaatgctaagattactgaagtatggcaccttggctagtttgtagtccacatgtatgtaagactctatttttcagggcttctagcctccggctgtccctttgaaaacaaaggtctccagtagatgtccctgtcccctaaaggattgacaggccttaagaactgcattataggtgtccaggagtaaacttttattttgttaataagtatctaagcctagccattgcgatcctctgtataatctggttgcaataaagaattttggttcataacctctgtttcacttcctttgtatatgtgttaaaaatacaggggaggactggagagatggcttagttaagagcatggtgtgttcttgcagaggcctgggttccattctcaatacccacagctgtctaactgctgttcaagaggattagtaaataatgaggaggagataaagaacagaagagacttcggaaagtgccttctggttcatatgtgggtcaagacaagtgctgtgtcatgcacacacatacaccctcaacactaaatattaatagatacagcctgatggtctgcatttagtagattggcctggagctcagagattgtttctcttctgcctctggagagctaggattaaaggcataggcttccacatctcctactgaaacagttttacctggcgtgccttggtcatatattgtctggaggaaggtggagtgcggtaggcaacatgaggactgggagctactaatgggtagagcaagtgggattccagaggtctttcaggcttcag

SEQ ID NO: 29544 - DNA, 1152 bp, Mus musculus
cagccttggctctgtctggacaggtccagacgactgacaccattaacactttgtcagcctcagtgactacagtcatagatgaacaggcctcagctaatgtcaaaatacagagaggtctcatgctggttaatcaactcatagatcttgtccagaaacaactagatgtattatgacaaataactcagctgggatgtgaacaaaagtttccgggattgtgtgttatttccattcagtatgttaaatttactagggcagctaaattgtcaaaaagtctttttcagtatatgttacagaattggatggctgaatttgaacagatccttcgagaattgagacttcaggtcaactccacgcgcttggacctgtcgctgaccaaaggattacccaattggatctcctcagcattttctttctttaaaaaatgggtgggattaatattatttggagatacactttgctgtggattagtgttgcttctttgattggtctgtaagcttaaggcctaaactaggagagacaaggtggttattgcccaggcgcttgcaggactagaacatggaactccccctgatatatggttatctatgcttaggcaataggtcgctggccactcagctcttatatcccatgaggctagactcattgcacgggatagagtgagtgtgcttcagcagcccgagagagttgcaaggctaagcactgcaatggaaaggctctgcggcatatatgagcctattctagggagacatgtcatctttcatgaaggttcagtgtcctagttcccttcccccaggcaaaacgacacgggagcaggtcagggttgctctgggtaaaagcctgtaagcctaagagctaatcctgtacatggctcctttacctacacactggggatttgacctctatctccactctcattaatatgggtggcctatttgctcttattaaaagaaaaagggggagatgttgggagccgcccccacattcgccgttacaagatggcgctgacatcctgtgttctaagtggtaaacaaataatctgcgcatgtgccaagggtatcttatgactacttgtgctctgctttccccgtgacgtcaactcggccgatgggctgcagccaatcagggagtgacacgtcctaagtgaaggataac

SEQ ID NO: 29545 - DNA, 1563 bp, Mus musculus
ttaagcttggagatgtattctaccccttgggagatttatggtgcccagggtgcttcctaccataagaggctagaacagcttagagaggagctgagcaaggcgatgcagcatctagaacacaacagaacggtctggttcagcgtcgcgccctgtcttccttgaggcaaccaggccatacgagtcagagcccaagcttcatcaggcagggctgttcccctaactgagtacttatatggcaagtgattccttctagctcttgggaacagaatcctctggtgtagatgaatcctttagaaaatatcagggtggggggtagggtggggatgggggattggttgagcagccgaggcaacctcccaaatgttgacctaaagagttgatgtcccttgggacatgtgtatttagcagtgagagatgaagtttctagatggagaaacccttgagggtgtttacttcatgggtggagggaaagaagttgccagtgtgttcttccccacttcgggctatagggtaaatggaataaaccatgttacagcttggcaggcccaagtagccactggcagtcaccaccttaatctccagctctgagccctagagactttgctcaccagcagtcccatctatccaagaaggctacagttctgctcagagggccgtgtcagtgtagattctaaacaatctcactgagaggaatgcaaagagagatggtgctgttaggtgctgaggaccaccacaaacagtgagaagggataggcttaaactcataagtagccaacaactaaccatacatcatgcttgaaaatcagtaaagctgacacatagtaaagggatgtatttgttagtcctaaggtacctaagttacagctgaccaccaagaacagatgtatctatcacctgacctttgtttggtctacagatgattggccctattgcactgtgggtgggcggctttattagtaatacgctactggggattaaatgtaggactttgtgcacgctaggcaaatgttctaccactatgaatctttaaatcattacactgctgtgtatgtaggggaattttcagtgttcaaataaacatgtggcaagtccttttgttgttggttttgcttttgttgttcttgtttgtttgggttttggggatggagtctctacatagaccaggctttcaaactcaatgtgtgtgaatcaggcggacctcaaactcccagagatcctcctgcctctgcctcccaagacctgggattaaaagctgcaccaccatgactggcaagaagtcttaatatatgtagtccataccgaactcctgataattctcctgccttatccccccctaccatcaccacatgtgtttgattataagagtgatccacacatctggcttggaatggtatggtttcaacaactctttcccactcttgacagctttcctgggcatttgtggccactcttttgagttcatacacacaagatgaggtaccttggtcgggcaatgaagatctactctccagaataaagtttttttttaagatttatttatttattttatgtatatgggtacac

SEQ ID NO: 29546 - DNA, 1147 bp, Mus musculus
ctgggctgaccaagcgtgtgaagaaaagcaaacagccacttcaggtgaccaaggatctgggccgatggaagcctgcagatgacctcctcctcatcaatgctgtgctgcagactaacgacctgacatctgtccacctgggtgtgaagttcagctgctgcttcacccttcgggaagttcaggagcgctggtacgccctgctctacgaccctgtcatctccaagctggcttgccaggccatgaggcagttacacccagaagccattgcagccattcagagcaaggccctgttcagcaaggctgaggagcagctgctgagcaaagtcggatcaagcagccagcgcaccttggagaccttccaggacttgctgcatacacaccctgatgccttctacctggctcgtactgccaaggctctgcaggcccactggcagctcatgaaacagtattacctactcgaggatcagacagtgcagccactgcctaagggggaccaagtgctcaacttctcagatgcagaggacctgattgacgacagtaagctcaaggacatgcgagatgaagtcctggaacatgagctgacagtggctgaccggcgccagaaacgagagatccggcagctggaacaggaactgcataagtggcaggtgctagtggacagcatcacaggcatgggctctccagactttgacaaccagaccctggccgtgctgcggggccgcatggtgcggtacctaatgcgctctcgtgagataaccctgggcagagcaaccaaggacaaccagattgacgtggacctgtctctggagggtccggcttggaagatctcccgaaagcaaggtgtcatcaagctgaaaaacaatggtgacttcttcattgccaacgagggccggcggcctatctatatcgatgggcgaccagtgctgtgcggctccaagtggcgccttagcaacaactctgtggtagagatcgccagcctgcgattcgtcttcctcatcaaccaggacctcattgccctcatccgggctgaggctgccaagatcaccccacagtgaggcggtagcagaaaccagggtattctccagcctcagtttccctgtcattccagctcccttgagctgggaactcaggctcctggaaaacccttgta

SEQ ID NO: 29547 - DNA, 1179 bp, Mus musculus
aaggtagctcttacatggaatacttcagcctagacctagttacgatttttggatttcccaacctcaggactatttacctatgagattttctgagggaggagatgtaagtttagatgtgaaattcacccaggttcatactgggattcatacacacctcacacacagtctggcgcaccagcatctgatttgcaatcctccacatggggcagggcatggaattttccactgtggtgctgtgtcagtacccaaaaagattcagatgttagaatatcttgcatgtaaaggtttttttggatttgggttgttcagcctaaattgtacaacagatgtgtaatgctttgagagggttcttctagtgcctcttgtttccctgtgtctgctacccagggttttaagagacaggctgctggggcagatagtatgtaactcagaagttaacctttctgtgtaatcacaatttacttactcttagctaagaccaagggaaggtatttatttaatagcaaaaatgttgaagctttaaaactcctctttgtgttttattttgttctagtttgcagggacactatcagatggcctggggaagacgatggacaatcggcaccagtcagagcgagagtacatcagataccatgctgccaccagtggagagcaccttgtggctggcattcatggattggctcatggtaaggcacttgcaattaggttaaggaagaatgcccctcttgccatggcctctcataagtacctttatatacacatctcagtgcaaggggtaggagggggatgaaagctgccagcagcagatactggtgaggtgtcttggtgagtctgatagcctttcttttcactccttccctgaagtccttgtcccttttcgggatgctgagcgcactgcacttccttccagttctctagcttccatggctaagggcatcagatacaatccatcaatctcctcttagaatctggacctgttgctttaaaactatctttagagggctcagaaaatggccaagttggtaaagcactggcaaggcaagcacaaggcccgagtttaatcccagcaccacatcaaaagccagatgtggatccctggggcttgccattcagacagccaagtgaaagacactctaacagcagcagcagcaacaacaacaacaagaggtagatgactcc

SEQ ID NO: 29548 - DNA, 1201 bp, Mus musculus
ttaggttaggcattgttagtcccagtgtatcagtggagctcccaggtaaggaaggaccccagtgagcaggtgcctacagaagctttctctttcttggatcactctttcgttttgaaagttccatacattgctacagtgtattttgatcacatccatccactacttcctcttcccaactccccctagttgcccctattttgtctccctcccaacttccagtccccctcttcgttctttttctggttctgcataaaccccgagtccaattagtactgattatatatttgcatgggtgtggggtcatccacggtagcatggacaagttatcagcagacatgtcccccaaagaaggttgagtctccctcagccgttggctggcaggaaggagctcctttaccagacctgcctcactgacttaaactttacacatgatccttaactctaaggttatggcagacatttccctgaatattgaaaaacaaaacaatagattaaagagtaaacaaaagaaaatatcatagccaggagtggtaacacatcctcaaagcctagcactcaggaggctgaggcaggagaatcttgagtttgagacaagcaaactcaagagaggctactgagtgagatgctgactgagcaaacaagccaaacagaggccctgcctgctgctcttggtgtgaactgtcaagggttttagcaactctgtagatcaataggggcaggtagagaatgaggctggccttgaatgacttccacagaatccagctaggacctcagatgatgtgttctgtttctttgctccctattttgggcagcagtgtgccattgagccatttcccctgtgctggccctttgtcccaggaaaccagatctaggacatggcagtggtcagaggacccggactttcctatttcagagcttctctgacaggtcctgttccagtgcctgccttatctgtggccttgcagcagacagggcaggcagcccaactgcctttgtttaggaactagtatttgtttgtgtttgtgttgcaggcactatatttataggactcagatgagactaacacactgtttgttcaaggagaaagttagatcttcgcacaaaagaatgttctgtgtggattctgaaggggaacggcaatttatgacttgtgtctgtttttgtcattatgtgtgactgttccattttattgtcgagctga

SEQ ID NO: 29549 - DNA, 1195 bp, Mus musculus
agttcagtctcaggtgcttggatgccatgctcaccgattccactggatatgaacttggcagaggagcctagttgttgccatggagacttaaagagctcagcactctggaatcaagatactggacacttggggccgacttgttaaggctctgcagcatcagactgtagaggggaaggaacacgtctgccccctggtggcccgtcctgggatgacctcgggcctcctaggcaacaaaagaatgaattggaaaggactgttcctgggtgtggcctcagctcctgtgcttgtgtggatccctaaagggtgtgctaaggagcaattgcactgtgtgctggacagaattcctgcttataaatgctttttgttgttgttttgtacactgagccctggctgagccaccccaccccacctcccatcccacctttacagccactcttgcagagaacctggctgtctcccacttgtagcctgtggatgctgaggaaacacccagccaagtagactccaggcttgcccctatctcctgctctgagtctggcctcctcattgtgttgtgggaaggagacgggttctgtcatctcggaagcccacaccgtggatgtgaacaatggctgtactagcttagaccagcttagggctctgcaatcagaggagggggagcagggaacaatttgagtgctgacctataacacattcctaaaggatgggcagtccagaatctccctccttcagtgtgtgtgtgtgtgtgtgtgtgtgtgtgtgtgtgtgtgtgtccatgtttgcatgtatgtgtgtgccagtgtgtggaggccagaggttggctttgggtgtgtttgatcactctcagttactgaggcagggctctcatctgtacccagagcttgcacattttctagtctaacttgcttcagggatctctgtctgcctatggagtgctcaggttacaggcaggctgccatacctgcccgacatttacatgaatactagagatctgaattctggtcctcacacttgtatacctgcattttatccactaagacatctctccaagggctcccccttcctatttaataagttagttttgaactggcaagatggctcagtgggtaaggcagtttgcggacaaacctgatgacctgagttggatccctgaccataaggtagaagagacctgattcctgcaagttgtcctctg

SEQ ID NO: 29550 - DNA, 1170 bp, Mus musculus
ccggtcaacagcagggagcgttgggctgggcagctgggaagtgagcacacaggcatgtaagggtgatgcatctgccatcgtagtagaggtgagctagggtctttagcctcttggcccttggcctattgctctaacctgcccctgggacaagaggcaaactgcaaagacaccctgtctccaagatccccagactcaccctcccatcctgtgcttcacagattcttcccacggaagccacgggacccacgtcaacgtcacctgcatcgtgaacgtctgtagcagctctgaccacagttctcagtgctcttcccaagccagcgccacagtgggagacccagatgccaagccctcagcgtccccaaaggatgagcaggtccccttctctcaggaggagtgtccgtctcagtccccgtgtgagactacagagacactgcagagccatgagaagcccttgccccttggtgtgccggatatgggcatgaagcccagccaagctggctggtttgatcagattgcagtcaaagtggcctgacccctgacaggggtaacaccctgcaaagggacccccgagaccctgaacccatggaacttcatgacttttgctggatccatttcccttagtggcttccagagccccagttgcaggtcaagtgagggctgagacagctagagtggtcaaaaactgccatggtgttttatgggggcagtcccaggaagttgttgctcttccatgacccctctggatctcctgggctcttgcctgattcttgcttctgagaggccccagtattttttccttctaaggagctaacatcctcttccatgaatagcacagctcttcagcctgaatgctgacactgcagggcggttccagcaagtaggagcaagtggtggcctggtagggcacagaggcccttcaggttagtgctaaactcttaggaagtaccctctccaagcccaccgaaattcttttgatgcaagaatcagaggccccatcaggcagagttgctctgttataggatggtagggctgtaactcagtggtccagtgtgcttttagcatgccctgggtttgatcctcagcaacacatgcaaaacgtaagtagacagcagacagcagacagcacagccagccccctgtgtggtttgcagcctctgcctttgactttta

SEQ ID NO: 29551 - DNA, 1138 bp, Mus musculus
gagaagagggagctaggtggacaagagaaagatgaagctaagacaaaaattctgatcaaagctcaattttactaattcgtgcaccaagttatgaaggaggggaagggggccgattcccgccaaatcatcttacaggtgaacacgtgatagctccagaacagcttcttggcaggcagcagcagtgggagtggcaggacgatagggctgcaattcttctgttgagggacatctgggttctttccagcttctggctattataaataatgctgctatgaacatagtggagcatgtgttcttattaccagttagaacacattctggatatatgcccaggagaggtattgctggatcctctaatagtactatgtacaattttctgagaaaccgccagaatgatttccagagtggttgtataagcttgtaatcccaccaacaatggaggagtgttcctctttctctgcatcctctccagcatctgctgtcccctgaattttttattttagccattctgagtagtgtgaggtggattctcagggttgttgtgatttgcatttccctgatgattaacgatgttgaacagtcttctaggtgcttctcagccattccatattcctcagttgagaattctttgtttagatctgagccccatttttaaatttttttttttattttctggagtccatcttcttgagttctttatatatattggataatcctcccctaacatcattttaattcatcatcttctttgactgaggcatccatctcctctaccttttctttaagtctgataatctgtctcccacaggttctctatgtattatttttatttgccttactgcattttgttttcagggtcttttggggaggacatttctaagcacctattgaactcaatttaaatattttatattgtcgacatttccttcaggaatctggtattattttcttgttcatcattcattttcttcctctctgagtggattttcatggtttacaaactttaatctccttgatcatgactgtggcttttcaattctttatcttggatatcatgtaaattgtgctccttatagggtacatatatggtttgaagtttgagacaaggacattttatcgtagtttctgtttgttttgg

SEQ ID NO: 29552 - DNA, 1122 bp, Mus musculus
cttgttgacagttgaaatggtgtctggttttgggggttgtttatgggatggatccctgggtagggcagtctctggatggcccttcctttagtctcagctccaaactttgtctctgtaactccttccatggctgtgtaccctatttttttttgtttttaatatttatttattatatgtaagtgtactgtcgctgtcttcagacactcaagaagatggcatcagatttcgttacagattgttgtgagccaccatgtggttgctgagatttgaactcaggacctttagaagagcagtcagtgctcttaaccgctgagccatctcactagcccccatgtaccctatttttaatagggttatttggttctctagagtctaacttcttgagttctttctatatagtggacattagccctctgtcagacagaggaatggttaagatcttttaccattttgtgggttgctgttttgtcctattgacagtgtcctttgccttacagaggctttttaattttatgagatcccatttgtccatagttgaccttcgaacttgagccatttctgttttgttcaggaaattttaccctttgcagatgtgttgaaggcttttcccccctttctcttctagtagattcagtgtatctggttttatgtggaggttcttgatccacgttgacttgagcattgtacaaggcggtaggagtgaatcaattggcattcttctacatgtggactgacacttgaaccagaaccatttattgaatatggtgtctgtttttcactggaaggctttggccatatatttgcttctgtttatctgtttggggtgtagatgtacaccaactttgtgtgatgtctttctagcatttctcttctttgccttttacataatattatccttttggcaatagtataaggtttgcctaaggaaagaagaattccatgctaatctgtgcagtcctcagatactgtcagaggaaactcttcctatttcagtctgacccgttcttgatgtgtgtcctacttctgtaatgtagaagggtgatatttttttcactttttttctaggactcatcacatcttcttcaattgtgatggatttgtgtatacctctctatagtactg

SEQ ID NO: 29553 - DNA, 1126 bp, Mus musculus
atgcctttaatcccagcacttgggaggcagaggcagaggcagatagatttctgagttcacggccagcctggtctacagagtgagttccaggacagccaaggctacacagagaaactctgtcttgaaaaaccaaaaaataaaaaaatatatatattcctgcatctagacctcaaatgtatacattaaaatatctaaatgtatgctgtgagaccattatgtcatgtacttttactgagagaagagaacacaatatagactatgatgattttagatgatatcatttcttaaaatggcctcatagttcccatgacctaacatacatcctgttcttgattaggtttccgaatatgacatgaattctctctctgaaagggaaccttaaatccaatcagaatatgttttactgtatttggtctgtatttttgtctattgctttcatgttcaaggaaactaattgaagaaaaagactactttgggtattttgttcctctctgtcacctatgacttcctcaactgagccagctccttcagtttcattgacaggctgatttttttgattgaatgctgtatcttcatatattggccctctactgagttaccattaggcttacagggttcatttcgtgtttcatttcagattgagcattccttagagttttatacctctggatacaatgttcacatcctgcattatcataattattcctttagccactcacaggagttatctggtctttcattaagtttgtttctgccttctttgaattcctgtgattggtcctctttatgtcatttgaccacattgaatggtgttcagagtctattttgacttctgtctcttgagtttgtttcataattcattttgtcatgagtattgctattatattagtgatttgggtagggaaattttattaacattatgaaattgctttagctacagcctctcaattttcttttcttgtgtgtcatttaggtcaggtgacagggatttccatatgaggtgttttgaataaactttgagaatctaggttggtgggcaggaactaggttacaggtacactctaaatatatcattacttgctttcgtggctgtacaaatgttttctagattcctggtatcattttg

SEQ ID NO: 29554 - DNA, 1174 bp, Mus musculus
tctttgtccctctttttctttaagagaggagcaattttgggtcattatatttgaggtgggtatgatgtcaaatttgaaaataaaagttggcaggcttttatcatttccagtcatttgatataaatcatatttgaggttcttctgaggatacatgtaatgattcaaaaaaaaggaaaaaaaacctcttttgagagtacaaatccatgagatcactgattattgaatcccttactccttatataagtaaatcatgtcacctctaattgccccccacccgttttttttttttcaggaaatcattgcatatatggaatgtatgggaaggtcatggatcaagacagccagtacattgttcttgaacacatgaatattcaagagaagtcttctaaatgtaacaagcctagcaatgtgtttctagaatccccccattatacacctcacaaatgtactgaatgtgacaaatgcttttcccaaaaatctcatcttaatattcatcagaaaattcatgcaggagagaaaccttacaaatgcagtggatgtgacaaatgctttactgaaaaaggcagtctgagaaggcatcagagaattcatacaggagagaaaccttacaaatgcagtgaatgtgacaaatgctttactagaaaaggcactctgagaattcatcagagaattcatacaggagagaaaccttacaaatgcagtgaatgtgacaaatgctttacccaaaaatttaatttgagatctcatcagagaattcatacaggagagaaaccttacaaatgcagtgaatgtgacaattgctttactgaaaaaggcaatctgagaaggcatcagagaattcatacaggagagaaaccttacaaatgtagtgaatgtgacaaattctttacccgaaaatcccatcttagtattcatcagaaatttcatacaggagagaaaccttacaaatgcagtgaatgtgagaaatactaacaaagacaatctgagaattcatcagagaattaataatggatagaaaccttacaaatgtagtcaatgtgacaaatgctttacccgaaaaatccaatcttagtattcatcagaaagttcatacaggagaaaaatcttacaaatatagtcagtgtgacaaatgctttacctaccaagccaagcttagtattcatcagaaaattca

SEQ ID NO: 29555 - DNA, 2384 bp, Mus musculus
gttgggtagtctgcccaccaaagaataatttgaattctatgtcagtgtttagcattaaaaaattagaaacactgtattagatatgttgatttgtgttaactaaaatagggaagattcaattcagtgttccaggctagtattactaggttaagataaaaaggctcaaaaaaggaaatatgtagacactttcagagcatcagcaataagtctgctctctcttgaattcaagaagtatgagagaaaaagatagaaaaatacatgaaagtatggcttcatagatttcagggatagctatctagactttgctgtgtctcttcatggttctgaagtcattaatacccatgtattgaacaaaagtcctataagtctcaaaaatgctgcccatttagatatattacaaaacattgtggtgactggtcctgttgtgccttaatactacactctaccgtaaggaatgaattggatttccattcttttcttcacttaatcttagccaaaatgctgaggagcagaatttaggaatttatcttaaattcaggaagtttcagtaaattaggatctaagaaaaaaattgaatggtacaatgaacaaatccatatcactccatatattttccttgagtttcaaaaaaaaaaacaaggaaattgttcaacttgtgtgaaattaatgaatgataacatttcactggtctcaatattggaatttgatgaaacaggacctcctcattggtagaatctaagtaggagtggaagcaatattggcccttgatttcaaatgatcataggtattttctgcagattgcttcaacagggatgttgaaactcacacaccaggcaaatgaaaattaggtggcttgagtagctcttaccagtctggaaattgcaatcagctggacagtccctcttgattctcattgcacatgttcagtagatttaggactcagtgcttaatgacttagaggtcattacccaaatctgaagtgacttccaggttcatggaaaaatttctagaagtacacaatgaagacacatcttaccttgtacccctcacacaatgattgtcttcattctataactatttatacacacacttcttgtctatggtacaacaagcatatggtgatggttgacaaaatatgtccaggtaaaatcactgtttgagttatgtggaagacagcatgtgtatattgataaagatgcaagtccttggctcaggataattaaccataccatgtttgaagaacatggagactgaagctcactggatttggaacattaactgtttgtggaagagcatcgtaagataaataataagagccacactataggagcctgatgggcatttctagaagaacttcaagtggctagattttaaggaacccactaggtctatgtcagtaccttgcagggaaaggacaattctcagctgcagggcaactgatgggacagcgtggggattggatacacatggagtaggtggaaagtgttattccttggttgtaattggttttgttacaggagaactctgaagaggaactgagggcctgaaggaagagagtgggatcaacagcccatccttgccagtaggagtctggagctgcatggtttggaactaggactagagaacactgcctggggactcacagtattgtccccaagttaagccttgtggaaattttcagtcaccagagcagtggcaggaactgcaaacaagaagacttggaaactccaaggtcacagtaactacaaggctagtggatggacaggcagtggaccatgattgaaaccccttactctgctgctcataagaacactgatcttcaaattctattgtgcatttcataactgtgtaattaaattgctgactatgtaaatgtgacttatcctgatttttttaattcatcttattgttgccagaatacttacataataatttttgagagaatgggattgtttgttggaaacatggttatatttctctggtggcaggttcaaagctcatacaattcgcattcatccatgttttttaacgctgctatttaatcactgtgctagtcaagatctttgccattggagattatgcatccactgggaggtttaaaaattagtcccataaggatcactggagttttcattgaattttaagcaatatttatcaatttaaaaaaattttagctgtctttagattagtaaaaatttagtaaaatttttttggctcacatatatatactatcatatcatatgaaaataggtaaatcactatttttttctttccaaatggtattcccttagattctcttagttgccttattgcttgagctagaacttctaatactatatcaaagagacatggggacaattgacagactttttttgtgttagaga

SEQ ID NO: 29556 - DNA, 1272 bp, Mus musculus
tattctaagtttctgggctaatatccacttatcagtgagtacataccatgtcacttcttttggagcaattctgggttattatatttgaggtagattgatgtctaatttgaaagtgaaatttagcagggtatcatcatttccagtcatgtgatatagatcatatttgaggttcttctgaggatacatgtaatgattcaaaagagagagagagagagagagagagagagagagagagagagagagaaacctttcttgagagtacgaatccataagctcactgattattgagtcctttactccttatataagtaattcatgtcacctctaattgcccccccttttttttccagaaaatcattgcatacgtggaaagaatgggaaggtattggatcaagacagccagtacattgtccatgaacacatgaatattcaagagaagtcttctaaatgggacaagcttagcaatgtgattcttgaatccctccagtgtacaccttacaaaactaatcacagctctgactctcttcaatactcgaaccaaaaaagacttaaacccaggaacactaaagaagtttgcaaatacaatgactctgtaaacagtttaagtttgttttctaccattagtgtcaatcaaggaatttacatgcagaagaaaaaacacaaccgaaatgcagaattagagaaggtttttgtttctaaacataaagtcatggtgaaacgaaacaatattggagggaacccttacaaatgtagtgaatttcacaaatatcttacccagagagaaaaactacaaagtcagcagagaatttatcatggaaagaaaccttacgaaagtagtaaaagtgacaaatgccttacccatcagatccatcttagtattcatcagggaattcatacagaagagataatttacaaatgtagtgaatgtgacaaatgttttaaacacaaattcaatcttactatgcatcagagaattcataaaggagagacacctcacaaatgtagtcaatgtgacaaatgctttacccacaactttaatttgagaatccatcagagaattcatacaggagagaaatcttacaaatgtagtgaatgtgacaaatgctttacccgaaaattccatcttggtattcatcagagaattcatacaggagagaaaccgtacaaatgtagtgaatgtgacaaatcctttacccacaaatcccatcttaataatcatcagagaattcatacaggagagaaaccttacaaatgcagtgaatgtgacaaatg

SEQ ID NO: 29557 - DNA, 1286 bp, Mus musculus
tgagaattcatcagagaattcacacaggagagaaaccttacaaatgcagtgaatgtgacaaatgctttactaaaaaaggcaatctgataattcatcagagaattcatataagagagaaacctcacaaatgtagtgaatgtgacaaatgctttacccaaaaatcctatcttaatattcatcagaaaattcatacaggagagaaactttacaaatgtagtgaatgtgacaaatgctttacccgaaaatcccatcttggtattcatcagaaaattcatacaggagagaaaccttacaaatagattgtatgtgacaaatacaatactcacaatgtctgtcttagaaatcaaaagtaatttcatacagtagagaatctttataaatgatgtgaatgagacaatccttttccaagatgtatcatcttgaaattcattagagaatacttagagaagacaaacttttcaaatatattgggggtatgaatcctttacttttggcctatttcctaaaatgtaacagtgaatacttacaggctagaaacttaactcatgcattgtatgaagaaatatctttgacttcatttcaggtcagagagaacatctaagaatttttaggggcaagtatttctgttggggaaaatattgtattcttgacaacacttgaggctccacactagagaattagtgtgattatgaaaatgttgtcaaaacattcatgcaatgttcaaatcttaggtaatatcaactatttatgttgggagaaactctgaaaatgtgaaaatgtagaaagcttttcatgacacctttttacttgttcaccctcaaacgttaccagatgaagacaagttgggaagtcagaagatagtattgtgtaacactttcattgagacagaaataatccatttcaaaaggaaactatttaaggtctttaatacaaccctcaaaatagcaaataaaactgttggcattttgtatatttaatttaaataaaccaattcagaaaaaatatccttaaaagagtatctggcaaactgagccacccagacagcatattctttatcctgtaaatatgcttacagatgtgaagtgtgcttcgagtatccagtaataataataattctcaaatacttgtttcacattataggataacaagtgagtctgagtctcttgtgatctgctcaacaactcctttcttattgtcctgtaactaactccaataaagctgaaagattcaacaaatttgctttgattgtttccaattttcactttggatactcagatgaatatatg

SEQ ID NO: 29558 - DNA, 2590 bp, Mus musculus
gttaaaaaaaaaataacaaggaaattgttcagcttgtgtcaaactactgaatgataacatttcattggtctcaatattggaatttgatgaaacaggaactcattagtagaatctaagtatgagaagaagcaatagtggcccttcatttcaaatgatcctaggtattttctgccaatagcttcatcagggatgttgaaactcacataccaggcaaatgaaaaataggtggcttgagtagctcttaccagtctggaaattgcaaccagttggacagtctctcttgattctcattgcacatgttcagtggatttaggactcactgcttaatgactgagatcattagccaaatctgaagtgactttcaggttcatggaaaaatttctagaagtacacaatgaaaacacatcttaccttgtacccctcacacaatatttattctataaccatttatacacacacttgttgtctatggtaccgcaagcatatggtgatgattgacaaaataggtccaggtagactcactgtttgagttatgtggaagacagcatgtgtagattgataaagatgcaagtctttggctcagaataattaaccatatcatgtttgaagaacacggagactgaagctcactggatttggaacattaactatttgtggaagagcattgtaaaatgtttaacaagagccacactataggagcctgatgggcatttctagaagaacttccagtggctagattttaaggaacccactaggtctatgtcagtaccttcctgggaaaggaaacttctcttcagcttcaggacaactgatgggacagcctgaggatgggaaacacatggagtaggtgttaagagttattccttggttgaaagtaattttgttacaggagaactcagaagagggactgagggcctgaaggaagagagtgggatcagcagcccatccttctcagtaggagtctggagttgcatggtgtggaactaggactagagaatacttccttgggtctcacagccttgtaaaaattcccttcctctgcagttgtcccgaagttaagtcttgtggaaattttcagtcacctgagcagtggcaggaactgcaaacaagaagatttagacactccaaggtcaaagaagcagctaggctagtggacagacaggcactggagcatgattgaaatcccttactctgctgctcataagaacactgatcctcaaactctattgtgcatttcataactgtgttgttaaattgctgaccatgtaagtgtgacttttcctgtttttttttttttaattcatcttattgttgcctggatacttacataataatttctgagacgatgggcttgttggttgcaaacatggttatatttctcttggagcaggttcaaaactggtacaattcatatccatccatggtttttaatgctgctattttacaactgtgctagtcaagatttttgccattggagattatgcatccactgggacgtttaaatattagtcccataaggaccactggatatgtcattgaaccttaagcaatatttagcatttttttaagttttagctgtctttagatttatcatactttaaacatttatttttttatatttttttatttttccaattttttagtaggtatgttcttcattaacatttctgatgctatcctgaaagtcccctataccctacccccctgctatcctaccctcccaactcacacttcttggccatggtattcccctgcactgggtcatataaagtttgcaagaccaaggggcctctcatcccaatgatggactactaagtcatcttctgctacagatgcagctagagacatgagctctgggggtactggttagttcatattgttgttccacgtatagggttgcagaccccttcacatccttgggtacttttactagctcctccattggccctgtgttccatccaattgctgactgtgagcatccacttctgtgtttgccaaccactggcatagtctcaaaagagacagctatatcagggtcctttcagcaaaatcttgctggtgtatgcaatggtgtctgtgtttggttgctgattatgggatggatccccaggttcagcagtctctggatggtccatccttttgtcttagctccaaactttgtctctataactccttccatgggtgttttttcccaattcgaagaaggggcgaagtgtctaccctttggtctttgttcttcttgtgtttcatgtgttttgcaaattgtatcttgggtattctaagtttctgagctaatatccacttagcagtgactacacatcatgtgagttcttttgtgattgggttacctcactctggatgattccctccagatccatccatttgcctaggaatttcataaattcatcgtttctaattgctgagtagtacttcattgtgtaaatgtaccaaattttctgtattcattcctctgttgagggacatctgggttctttccagcttctggctattaaaaataaggctgctatgaagatagtggaaaatgtgttcttattaccagttagaacatcttctggatatatgcccagga

SEQ ID NO: 29559 - DNA, 3121 bp, Mus musculus
tttgcatttctctgatgattatggatgttgaacatttttctaggtgcttctcaggcattcaatattcctcaattgagaattctttgtttagctctgtgccccattttttaatggggttatttgactttctggagtcctccttcttgattcctttatatatattggatattagtcccctatctgatttaggaatggtaaacatcctttcccagtctgttggtggcctttttgtcttatttacagtgtcttttgccttacagaagcttttcaattttatgaggtcccatttgtccattcgtgatcttacagcacaagcagttatagttggtggtcatgagacactgtgtgtacctatgaacaaactttcatcccctgaagaacacctagtgctcttaaccaccaagccatctctccagctcctagttcctctctttaaaatgtggctggctaaaagcatccttgcttcaagtggtggagtgttaaatacaaatttatatttataaagcatttggaaaagtgcctggcatcttttcttgatgctcaggagcaaatgcatcattagctgtgaggtgggttctgagcgccacagactgcacacagctggcactttgtaaattaaggctgggggcagtgaccccagaatcctggccctcagtcattttttgcctccttgtgtttcaagagagggtctcatgtagctcagtctggtcttcctcaaactgactctgtcacagaggatgagcctgactgtttcatccctctgcttccacctcacaaatgctgaggggactaaaagcgtgtacctcctcaacgtgtgacatgggtctgagctctgaatgcaaggtttgtggtgccaggctagcacattctcagcctgagtcactactctccttttagacgtttattcttcatttattcaaaacattttatttttatgtataagggtattttcgcttacatgtgtgtttgtgccctaccgcatgcatgcctggtgcccacagaggttagaagaggacattgtacttcctggaactagagtttcagttctgatccaccatgtgagtcctgggaattcaatctggtcctccacaatggcagcagagtgtttttaattactgagctgcctccccaagcctctaaatcacttcttaaaatgcaggaatgtatataaacccactggcaacatatcctcagcaacctcagtaaaactgtgatatagctctaaatgtcacacaggaggagcaatgaaaagtacttacaaaaaataaaaaagactggagcgggacacttagagctagcttcaaagcacaagaccctctcctggcctctgcaggtacctgtacttgtgtgtgtgtgtgtgtgtgtgtgtgtttgtggcatgtgcacgtttgtatgcatgtacatatgtgtgtgctatgtttgtgtgcatttacatgtgtatgtgcagtgtgtacagtgtatgtttgcatgtgtattagcagtgtggtgtgcaagagtgcatgtatgtttctgtgtgtaggtatattatgtgcagcatgtgtgtgtgtatgcgtacatgcgtgtatctgtcactgtgtatataacaaaggtaaccaaaaaatcttttttaaaaattagttaggctggagatatggctcagtgggtgggagcactgacagttctgcaagaagttctgagttcaagtcccagtaaccgcatggtggctcacaaccatttgtattgggatctgatatcctcttatggtgtatctgaagagagtgacagtgcacacagatacataaaataaataaatctttgtgtgtgtgatctgagtgtttactctcactctgggactgagaaagcacagtcctccagcagtcagggcagatctgattggcaaacaccactaaatgtcagcaatgtaggaaaatcaccacatgatcaaaatctatgacactctcctaaagggatttttctctgcaaagacatagggtgcaattttataaaataactcatgtcaaacatttaataactttattaagaaggctgaggcaagaggatgacaagtttgatgccagctaccattaacatagcaaaaactttctcttaaaaaacaagggtctgagaatattactcagtggttagagcactggctgatttaccagaggacctgggtttggttcctagcacccacaaggtcatgcacagttccacggaatctggcgccctcttctggtctctgtgagtatggcatgcacatggtgcagaggcacatgcaggcaaaacacccatacacacaaaaaggaaaataaaaagtaaattcattaaattgggcatggtgatacatgcctgtaaaaataaatttagattgacaatgtgttcagcatgcaatgtatacttcttaaataacacaacaccatacatgattttaaaccacagaatgagagactggagagacagctcaatgtttaagaacatttgctgctttgcaaaggaccttggttcaacttccagtatccacaaagctccgactccaagagatgtgacgctcttctgacctctgtggacaccagacattcacatggtgcacatatgcaaaataaaactataaaaaaatatttagctaagtaaaatttaaagattgggggaaaaaagtaaatctaggcaaaaagttattacctcacaaagactgctcaatgtttcttaagcctgttcaggggaatggaaggaactaagagttgccggagtgatgtgaaacagacatttgaataaacggacataagtgaacatgcagagcctcggttcccaagcctaccacaccactctgtcctgagcagtgttcatgtagtctatgtgtgctcagtctgtgctgcatgtgtctagacagtatctgcctatccacacaaggcagagcacataattatgcaattagctaaagcatttctccctttgaccagcaacatggcttactgtcagctacctcaactactacaagaagaacatgtggtgtctggagccacaacagctctaggctaccagaacacttcctgagaggtcctgtcatccagccagacttaagttgctccctctccaggccaggcttgtgtacagtgcacagcttggccttcgtacctgcaaacca

SEQ ID NO: 29560 - DNA, 1151 bp, Mus musculus
tcacaccatgaacatcatcattaatatttcatgtgtaggcattagtacttgtatctcacaaattctattctcaaatttctggtcttttctgcatttttctgtgaaacattttgctggctgctgataaagtatattctctatgggtcattataaatgaaaaacatcaaaaagctaaaatttcaaaggggaagaaattttgtgctcaaaactgagtttattagtcagaatgaaagactatgattgatgtttactggttaagtgatacaagcatggcggtctctgcaaaccctaggtctggtagaataacaatccatgagaccaaaagaaatctagttcaataccactctataagtatttcagcactgtttgtggatgtgttgtgggttattgccgatgaaattcttgcagcactcagggaaaatctatcccagtgaatatacgaacagctctgaagtaaaaggtcttctggcagtcagaagtcatgatataccacaatgccccatggaacatttaaccacacacagagatttaatgggataacactggagggagactgcctctgctcaggtgagaagcagaagagaaatgagtgggaggcaggcttttcaaagggttttattttggggggggaatggggaggaaaggattttcaggattggaaatatatctggttgaatattgctagggttttatgttctgagtttgagtaaaataaggagtttctgaattattaaaactgggatgtaaactataagttttccctgtagactcagtggccaatgctgactgaagcttcaagattctgatctcaggatggtttattttaggaacaagtaagcacagtataatttcgaaatgaaatttcttggtaataattgtctcaatcatctgtgcacagtgaagatgaaggtgtggctacctcaaaagtcttttgcaaagtacaggtgtttctttcttaaagttggattctaaaaataagggcctagaggaggaataaggcatacagtgtagaggacaccaagctgtaaggtacatgtcctatgtcccccaatgatggtttgtactcatggagaaacaatgacctaggatgattatctgggataatttaatagtctgggactttcaggtgtggtctggcactacatctacca

SEQ ID NO: 29561 - DNA, 1132 bp, Mus musculus
actggtaacattctgtatatttaattcacatgaactaattcagaaaaattatacttaaaagagtatctggcaaactgagccacccagacagcatattctttatcctataagtatgcttacagatgttaagtgtgcttcgagtatccagaaatcataattcttctcaattgcttgtttcacattataggataacaactgagtatgagtctcttgtgatctggtcaaccattcctttcctattgtcctgtaactaactccaataaagctgaaagtttcaacaagtttgctttggttgttttcaatttgcacttgggatactcagatgaatatatgttgcatcttcccagaaaatgcctcacataaaaaatacgtggaagtcataaatatttttgcaaggctgtatcataaagttaatagttattttcaagtgatagataaccatccctttggggtgtaaagactctttcacagtggttgcttaaaagcataggaaaacacatatttccaattgtcttataactgagaaatcattcattgaactgcagggtagtctgctcacctaagaataatttgaattctatatcagtgtttagcattacaaaagttagaaacactgttcagttcaatgttccaggcaagtattactaggttaagataaaaaggctcaagaaagcaaatatgtagaagctttcagagcctcagcagtaagtctgctctctcttgaattcaaggaagcatgagagaaaaatttacaaaaataaatgaaaacatggcttcatagatttcaaggatagctagccagacttttctgtgtctctgcatggttctgaagtcattaatacccatttattaaacaaaagtcttaaactctcagaaaaatgctgcccattgacacatattacaaaacattttggtgtctggtcctgttgttacttaatattccactctaccgtaagtaatgaaatagatttccattcttttttaaatcatctacagaatgttaatattttgtacatctcagaatatacattctgaacaaaacctcaaaaactcactattagggtattcaacttaatttcatgtatgagttcattcatataaatatcatgaatctgtaaatcttagagaaaaa

SEQ ID NO: 29562 - DNA, 1267 bp, Mus musculus
gaatcctccgaaagtacaccttataacactaatcacagagatgccactctccaatcctcaaacctaaaaagacataaaactgggaccactaaagaagtttgcacatataaagactgtgtaaactgtttaaaggggtcttctatcattagtctcaatcaaggaacccacatagagaagaaagaacacaacagaaataaaaatcttgatgaggttttggtttctagacaaaacaatagtgaaatgagcacttacacttgtggtgaatttgacaaatgctttactcagagtgacaatcttcaaagtcagcagagaatttatccaggaaagaaatcttacatatatagtgaaagtgacaaatgctttacccaactttcccatcttagtattcatcatacaattcattcaggagagaaaccttacaaatgtagtgaatgcgacaaatgctttactgacaaattcactctgagaaagcatcagagaattcatacaggagagaaaccttacaaatgtaatgagtgtgacaaatgctttactgacaaaggcagtctgagagttcatcagagaattcatacaggagagaaaccttacaaatgcagtgagtgtgacaaatgctttacccaaccatcccatcttagtattcatcgtagaattcattcaggagagaaaccttacaaatgtagtgaatgcgacaaatgctttactgacaaaagcagtctgagagttcatcagagaattcatacaggagagaaaccgtaccaatgcagtgagtgtgacaaatgctttactgacaaaggcagtcttagagttcatcatagaattcatgcaggagagaaaccgtaccaatgcagtgagtgtgacaaatgctttactgacaaaggcagtcttagagttcatcatagaattcatgcaggagagaaaccttacaaatgtagtgaatgtgacaaatgctttactcacaaagactctctgagagttcatcatagaattcatgcaggagagaaaccttacaaatgtagtgaatgtgacaaatgttttactgagaaaaacggtctgagaaggcatcagagaattcatacaggagagaaaccttataaatgcagtgaatgtgacaaatgctttactgacaaaagcagtctgagagttcatcagagaattcatacaggagagaaaccgtaccaatgcagtgagtgtgacaaatgctttactgacaaaggcagtcttagagttcatcatagaattcatgcaggagagaaaccttacaaatgta

SEQ ID NO: 29563 - DNA, 1208 bp, Mus musculus
atattccacataggaatccaggtaattgtggacgcccactcgccagcaagtaagatgccacaacaggatccttctgcaacatgtttattgggagagcatggactgcgtaggtgaaagaccccgagccccagaaatggtgctacttatataggcctagggagtgacatgtccataactgattggttatgctaccagtacctcattaatatgcctcgagccaggcagtgactcggcaaaaaactctggcacatgcgcacattggttgtttacccatattcatgggcattggcttactgaaaccggtgccatcttgtaatggcgtttgcggcttcccacatctccccctttttattgtaataaaatgatgctggattaggcctatgcaattatgtccatccgctacggctcctgttttaggtcgttcctctgtgtcacagccttacccgtcatagggtaaccctatcgccaccaggccccgtgtcttaggttgctctgtgcatgaggaaagttgcccatctttggataatgcaatgctgtgtgacagtaattgctaaatgacttattttgttcgtcctgaaatgtcatgatattcccgataggaagccaggtgatgttaattcttttaactgttatcatcccaagggctgcaatggcttttcttaatgaagaaaaataagtttcattattttttgtcccaattccatgaaccaaattaataggaggatgattagtataatccaaaatattccaatcacacagggtggtattagagcaaaggcatgaaattgtaatatatgtccatcagaatactctcctaaatatttggtttgattgacataaacagtaatatctacagtctcatcccaagtgacaggatgaattataggtggatttggaacatatgcccaataaacttatgcagagctgcctcgatgtaacatccagataatgctaatcaatagggcaatcagctgtattcgatcctgtgctgtcatagacgttatcattcgaggttcctggcggtggcgttgaaaagaaagacgaaacatctgtctttaatattcccatcttggttttcagcatggcgtacacactgggttggcaaccacctaggggaaggtgtgtctgttgggaaaacataaacatacccacggccccataaaagtacaggatctgggctgtgtaatgagccgtccatcggatctttc

SEQ ID NO: 29564 - DNA, 2203 bp, Mus musculus
agttcatcagagaattcatactggagagaaaccttacaaatgcagtgagtgtgacaaatgctttacccaaccatcccatcttagttttcatcgtagaattcattcaggagagaaaccttacaaatgtagtgaatgcgacaaatgctttactgacaaattcattctgggaaagcatcagagaattcatacaggaaagaaaccttacaaatgcagtgagtgtgacaaatgctttactgacaaaggctatctgagagttcatcagagaattcatacaggagagaaaccttacaaatgcagtgaatgtgacaaatgctttacccaacaatgccatcttagtattcatcagaaaattcattcaggagagaaaccttataaatgtaatgaatgtgacaaatgctttacctgaaaatcccatcttagtattcatcagagaattcatacaggagagaaaccttacaaatgcagtgaatgtgggaaatgctttactgacaaactcactctgagaaggcatcagagaattcatacaggagagaaaccttataaatgtagtgaatgtaacaaatgctttactgagaaagttattctgagaaggcatcagagaactcatacaggggagaattcttacaaatgtattgaatgtgacaaatgttttgcccagaaatcctatcttgttcataatcacagaaatcatacattaaagaagccttacaaatgcagtcaatgtgacaaatgattttcccacaaacttagtctgagaatgcaccagagaattcatacagtagagaaaacttacaaaaatgcagtgaatgtgataaatgctttactaataaaggcagactgagaattaatcagataatttatacatttaaaaaaaccttacaagtattttgtatgtgataaatgcagtacccacaacatcagtctgacaaatcaacagatatttcaaacagtagagcaacattataaatgaaatgaatgagataatcctttaacaagaaatatcatcttaaaattcactggagaattcttccaaaagggaaacttttcaaatacattgacggtttgaatcctttattttggccaatctcttagaatgtaacagataatttatacaggcaagaatcttaacaaatataatatatgctgaaatatctttgacttcatttcagtgcagaaaaaatatgtaaaaaaattttttatgggaaaaatagttctcctggggaaatgtggcatatgttttacacgggtaatattcttttcaacagtcagtgctctaaactagagaattattatgaatctgaaaacttttgaaaaccttcatgcaatcttcaaatctaatgtcaactattatgctggcagtaactctgaatatatgataatgaagaaacattttcattaaacttttacttgttcaccctcaaatattatatgatgaagtcaggtgtgaaagccagaagaatatgatgttgtgcaacaattcatggagatagaaatgatccattccagaaggaaacttaaagagtgtactatcgccttcaaaatgtctaataaaactggcagcattttgtatatttaattcaaatgaagaaattgacacaaattatacttgatagagtatttgacaaactgagccaccaagaatgcatgttcttaatcctataatacacctacagatgtgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggctgttttcagtttgcactgataattagatgaataaatgttgcatcatcgctggaactatttctcataaagtatttgctgaagtcatgaatattttctgtaaacctgtaacttaaacttaatatttgtgattttcagctggtcaataacaaccttgacccacatacaaataatatgaattgtatataagtgtttagcattagaaaatttagcaacagtgtattagagatgatgatttgtgttaactaaaacagggaagattctatacaatattccaggcttactgctcgatcagtactaggtttattaaaaacaaacaaacaaataaagacaacaacaaaaaacaaaacaaaa

SEQ ID NO: 29565 - DNA, 1185 bp, Mus musculus
tatctggttggttgatattgttgttctttctatgaggttgtaaacaccttcagctccttcagtccttcacataactttactttggggtcactctgctccatctgatggttggctgcaagcatctgcatttattttggtcaggttctggcagagcctctcaggagtcagctatatcacgtttcagtcaagaagcattttacagcatcagccataatatcagtgtttgatgtctatagatgggattgatccccaggtgggttagtctctggatggccttttccttcagtctctgctccagtctttacccctgcatttcctttagataggagcaattctgtgttaaccttttttatatgggttgctgttacaattttaaagtaacacttagaagactattatcaattcttgacatttgatgtagataagatttgaggtacatctgaggatccatgcagtgataaaaaaaggaaaaacctctcttgagagtatgaatacattagaacactgattattgaatcatacttactcctcatataagtaatccctattatccctaattcccacttttttcagaaaatcaatgcatctgtggaaaaaatgagtcgttcttggatcaagacatacagcacattgtcaatgagcatgggcatatccgaaagaagtcttctaaatgtaatgagcttagtaatgtgattcatgaatcctccgaaagtacaccttataacactaaccaaagagatgccacattccaattctcaaacctaaaaagacataaaactgggaccactaaagaagtttgcacatataaagactgtgtaaactgtttaaaggggtcttctatcattagtctcaatcaaggaacccacatagagaagaaagaacacaacagaaataaaaatcttgatgaggttttggtttctaaacataaacccattgtgagacaaaacaatagtgaaatgaacacttacacttgtggtgaatttgacaaatgctttactcagagtgacagtcttcaaagtcagcagagaaagccaggaaagaaatcttacaaatatagtgaaagtgacaaatgctttacccaaccttcccatcttagtattcatcatacaattcattcaggagagaaaccttacaaatgtagtgaatgcgacaaatgctttactgacaaatgcactctgagaaagc

SEQ ID NO: 29566 - DNA, 1170 bp, Mus musculus
gtttagtctatatatgtttttcctgaggagccggcctcagcttgaacaggaaagccttttgttacccacagatagccttgccactatgatactggaggccatgccttgcctggcagattgaaattgtagcacacaggatacaaatctgggtatggccattgataactctgcctcctgccccagtttgcatagcagtttctggactctgaatgctaccaccagagagtccatccacaatatttgttgacagagtggatggtctgatctgagttgttcttctccagaagatgctcttgctttctgaatcacgtcttcggtccagtctacacgagtttaagtccttgaattgtgttcacactgatgcagtttgttgaatttggccttattatattgtggataccaacaagagcttgctgaccggaggctgatatagctgtctcctgagaggctctattagtgcctgacaaatgtagaagtgggtgctcacagtcatcctttggactgtgcacagggtccccaatgaaagagctagagaaagtacccaaatacctgatggggtttacagccccatagtaggaacaacaataggaactaaccagtatccctagagctacctgaaactaaaccaccaaccaaaaaacaaaacaaaacaaaaccaaaaaaccaaaacccaaaaaaaaccaaaacatattgtgggtctcatggctctagctgcatctgtaggtgatgatggcctagtaggtcatcaatgggaggagagcccttggacctgtgaaagttctatgccagaatataggggaacactagggccagtaagcaggagaggatgggttctttaaaatggggaggggggagaggatagaggaattttggagaggatactaggaaagggattaacatttgaaatgtaaataaagaaaatatctaatacaaaatggaaaaaaaaggatggaataatgacttttctaccttttctggacggtttggtttagtttcaagtctatttccatttgttttctgaggtgtgtttcttctcttcttacattctagaaagcttttatagtgagtggtattagattttccacagaaccttaaaagtaacttgtattttcctattataattgttgtctgggaggcttactgcctctgtctacttaccttggcctagtc

SEQ ID NO: 29567 - DNA, 1184 bp, Mus musculus
atgctcacaaccctaatttgagaggctgaagtatgctcatgtcattgtggacactttcagaacaattccccttatgtacattgatgcaaaatactcaataaaatactcaaatactgaatccaaaagacatcactaagaatctatccaaaatgacgaagattgttttctcatccaatatatcttgaagagtttccattccctctattcttctcagttcctgtccactttttctcccttctggatctaacccctttctgtatctcagtaggaaaacaaacaagcaaataaacaaacaaacaaaatccatagactcactaattgacaaatctgcccccaaaaagctaaggtaaaagttataatatatttcaaaacaactggtccaagcattagtatttgtacatcaccctatctagtctcaaatttctgatctatgtttgtgcaatttttgtgtgaaatattttgctgattgctgataaagtatattttcctattggtcattatgagtgaagatatcaaaaagctaaaatttcaaaggggaagaaattttttggctcaactctgagttcattacttagaatgaaagatgatgattgatgtttactggataggtgatataaatgtgggagtctctgcaaacactagttctggtagcgtaacaatccatgagacaaaaaagaaatctagttcaatacctctctgtaattatttcagcactggttgtgggtgtgttgtgggttatagccaatgaaattcctacagcactcagagaaaatctttcccagtgcctgtgttaacatctgaagtaaaaagtctcctggtactcagaagtcaagataaactgcaaagccccatgggacaattaaccacacacaagataatgactgggaagaacactggatggagcctgtccctgctcaggtgataagcagaagagaaatgagtgggaggcaggctttgtatagggtttagttataggtgatggattttcaggattggaaatatctgcggttggagattgctggtattttatgttctgagcttgagcaaactcagggatttctgagtagttaaaacctgtaagtatgctaaccattctccctgtagacaatgttgagtgtaactttagattctgaccccagggtggtttattttagatataattaagcacagtataattttggaaa

SEQ ID NO: 29568 - DNA, 1202 bp, Mus musculus
actttgcactaaggacacagaagcaattgctgtaaccataatagaaactatcaggacagccattcctgctaaaatcatgcctatggcccttttagatcgcaacaacaattctgtggttgcatgctcaagaattcctcggcctttatcatcataccaatccttagttaaattaactggtaaataaacataatcaggttgcttaacaatcaaaaaattacttaaggtataattaacacagttagttatttgacaattagtacagttaacagtattattatctatcaataaattcccactcaaagaagcctatggctctggaacacacaaacatacaaaaacttcagtcttattgtgtttgtcctgaaatgccatgatattccacataggaatccaggtaattgtggactcccactcgccagcaagtaagatgccacaacaggatccttctgcaacatgtttattgggagagcatggactgagtaggcgaaagaccccgagccccagaaatggtgctacttatataggcctagggagtgacgtgtccataactgattggttatgctaccagtacctcattaatatgcctcgagccaggcagtgactcggcaaaaaactctggcacatgcgcacattggttgtttacccatattcatgggcattggcttactgaaaccagtgccatcttgtaatggcgtttgcggcttcccacatctccccctttttattgtaataaaatgatgctggattaggcctatgcaattatgtccatccactacggctcctgttttaggtcgttcctctgtgtcacagccttacctgtcatagggtaaccctatcgccaccaggccccgtgtcttaggttgctctgtgcatgaggaaagttgcccatctttggataacgcaatgctgtgtgacagtaattgctaaatgacttattttgttcgtcctgaaatgccatgatattcccgataggaagccaggtgatgttaattcttttaactgttatcatcccaagggctgcaatggcttttcttaatgaagaaaaataagtttcattattttttgtcccaattccatgaaccaaattaataggacgatgattagtataatccaaaatattccaatcacacagggtggtattagagcaaaggcatgaaattgtaatatatgtccatcagaatactctcctaaatatttggttt

SEQ ID NO: 29569 - DNA, 1209 bp, Mus musculus
atgtagtaaatttgacaaatatcttacccagagagacaaacttcaaagtcagcagagaatttatcatgaaaagaaacatttcagaagtagtaaaagtgacaaatgctttacccatcagatcgatcttagtatccatcagggaattcatgcagaagagaaaatttataaatgcagtgaatgtgacaaatgctttacccacaaatttcatcttaatattcatcagagaattcatacaggagagaaaccttacaaatgtagtgaatgtgacaaatgctttacccaaaaatctcatcttaatattcatcagagaattcatacaggagagaaaccttacaaatgcattgtatgtgagaaatgctttactgaaaaaggcaatctgagaattcatcagaggattcatacaggagataaaccttacaaatgcagtgaatgtgacaaatgctttacccaaaaatcccatcttaatattcatcagagaattcatacaggagagaaaccttacaaatgtagtaaatgtgacaaatcctttactgaaaatggccatctgagaattcatcagagaaatcatacaggtgagaaaccttacaaatgtagtcaatgtgacaaatcctttactgaaaatggccatctgagaattcatcagagaattcatacaggagagaaaccttacaaatgcagtgaatgtgacaaatgctttactaaaaaattcagtttgaggattcatcagagaattcatagaggagagaaaccttacaaatgcagtgaatgtgacaaatgctttactttcaaaggcagtctgaggattcatcagagaattcatacaggagagaaaccctacaaatgtagtgaatgtgacaaatcctttactgaaaatggctgtttgagaattcatcagagaattcatacaggagagaaaccttacaaatgcactgaatgtgacaaatgctttactttcaaaggcagtctgaggattcatcagagaattcatacaggagagaaaccttacaaatgcactgaatgtgacaaatcctttactgaaaagggcaaactgagaattcatcagagaattcatacaggagagaaaccttacaaatgtagtgaatgtgacaaatgctttactgaaaaaggccatcagagaattcatacaggagagataccttacaaatagtttgtatgtgacaaatacaatacaatgtcagtctgagaaat

SEQ ID NO: 29570 - DNA, 1181 bp, Mus musculus
aaagatgtgtcccatgatacctggacctaacgttttcctccttagaacttgatctgttccaggctgttcttggactttgaaaactgcccgcattttcaaactcaaaccagaaacttaactgggtgaaattttgcctgagatcatcactctctcactttctgttactcctttattcctcacaccatgagccttgttcttttaaaccatccctttccctttactgactcattagtgtagctacctctgtaattttaggtacttggagccccttatacaaatcatattgcatgcttatagtttgcgtagttgagaaattttgggcaatgggtgcggggaattaaaggggattcccacatcccaccagagctccagtgctctgggcaagtggacagcaatctccatgaggctcaggtgggcatctggctgtgggaagctatggatctccagtccgcaggggtagagagggagcagtttgtggtttctgggtctcacagaggccacagaccacaggtcctcagtcatggatatcccagatgtcattgtatgttgtggaagagctgagaacaaagtaagggctctgggggcaactcggtcagccccagagctgaagggagaatggagcagggggataaggcactctgtggctcccaggatgtgagggtctttggtctgatctggtgactagaaatgctgagaggctttgctgctggaggtgacatgtggctctttagggtcaggcctattccatcattgaagaacagagggctttgatgagtggagagatggttcctggttttaaggtgtttattgtagaaagtcagagagagggagaggcgtagggaagtagaagccagccatggccatgtggagagagggaggaaaggatagggaggaggagagctagagatgagaataagagatttaagagcttaagagagagaggaggggccaaacagccctccccccccccttttcttttgtaaaacagaactgttagagtggcatttttatttttaaatcattaagactggtcaagaaataaaacagaaacatagtaaaatgtttaaaaaattaaagaatattcttccaagtataaattttataaatacaaaacaaattcacaaatgactttgaatgctaaataaacatctagttaataaattcagtcggcactggctacg

SEQ ID NO: 29571 - DNA, 1142 bp, Mus musculus
atctgaagtgacttccaggttcatggaaaaatttctagaagttcacaatgaagaaacatcttaccttgtacccctcacacaatgattgtcttcattctataactatttatacacacacttcttgtctatggtacaacaagcatatggtgatggttgacaaaatatgtctaggtaaagtcactgtttgagttatgtggaagacagcatgtgtatattgataaagatgcaagtccttggctcaggataattaaccataccatgtttgaagaacatggagactgaagctcactggatttggaacattaactatttgtggaagagcatcgtaagataaataataacagccacactataggagcctgatgggcatttctagaagaacttcaagtggctagattttaaggaacccactaggtctatgtcagtacctttcagggaaaggacacttctcaggtgcagggcaactgatgggacagcatggggattggatacacatggagtaggtggaaagtgttattccttggttgtaattggttttgttacaggagaactctgaagagggactgagggcctgaaggaagagagtgggatcaacagcccatccttgccagtaggagtctggagctgcatggtgtggaactaggactagagaacactgcctggggactcacagtattgtccccaagttaagccttgtggaaattttcagtcaccagagcagtggcaggaactgcaaacaagaagacttggaaactccaaggtcacagtaactacgatgctagtggatggacagacaatggaccatgattgaaactccttactctgctgctcataagaacactgatcttcagattctactgtgcatttcataactgtgtaattaaattgctgactatgtaaatgtgacttatcctgatttttttattcatcttattgttgccagaatacttacataataatttctgagagaatgggattgtttgttggaaacatggttatatttctctggtggcaggttcaaagctcatacaattcacattcatccatgttttttaacgctgctatttaatcactgtgctagtcaagatctttgccgttggagattatgcatccactgggaggtttaaaaattagtcccataa

SEQ ID NO: 29572 - DNA, 1103 bp, Mus musculus
agttagttatagaagggaaacaatttaagggaattttagatacaggagcagacaaaagtattatttcttctcactagtggcccaaaacctggcccgtaactcagtcagcacactctttacaagagctaggttatcagtcctgctccactattagatcccgttcttgagctggcaaatggatgtcacgcatatttcctcctttgggaaaaatcaatatttacatgtttgctaatctgtctaggcagatttctatgtatcttgcaggaaattggtctgaaagattcgatgagacccttgaggccctgagagtggctgttctcaggatcaactcaacaggagtggacctgtcattgacagagggtctctcctcctggatttcatctgctttttcttattttaaggaatgggtgggggtggttttatttgctgctgccatctgctgtggacttgtgcttatgctctggttggtttgtaagctcagaacacaacaaaaccgtgacaaggtcgttatcgctcaaacacttgcagccattgaacaaggggccccccctgaaatttggctgtccatgcttcagacctaaatggcatctgaattctctgctattgcatcccacggatttgtggatacattgcactgggatgtaagagactcaacgctcattgatcagcacttacacctcgctgaggtttactaatttgttttttggctggcctcttttatagagttcgccctaggtaatttagcagttactgtcacacagtactgcagtatctagagacgggcaactttcctcatgcacagaccaacctaagacacgggacccagtggtgatagggttaccctatgacaggaaaggctgtgacattggaggaatgacctaagacaggagccacagcagatggacatgactgcagaggcctagaccagcctcaaattttaataaaataaaaagggggagatgtggagagccatgctgcaagcaatcaagtgcgtgccgtgagcaatcgccattataagatggcgctggcttccactgagcctaactagtaaataagccttatgcgcaagtgcaagagtaaactcacgcctagtcactgcccat

SEQ ID NO: 29573 - DNA, 1145 bp, Mus musculus
gtgaaaggcagcctgcgacagagttggaggagtggttcctgctggggagggtgggcttcatgcatgattagataagtttaagaaaaagacaaaataaaaacaaagaatcaaccaaccaatcaatgaattaagtaagcaagcaattaaaaatccaaaacaataaaaattgctgtgaagaactgggaagctaattaattaaaaggtcctgaagtaggtgggcttagaagaattgcaggaagctgctgaatattgggcgggttcagaaggaggggctttgaggagccaggtagaagtgacaggaagttctgccttttcagcattctccctgtatcttggctgcctcgtggtcaggaagtcctggagggagactagtgcctagtatttgcagaacctgaaaacttccttaagctgcagttgctttgctggcctcctaggacattcagcagctggtcctgtcgccttccaggtcagaggagctgttgggctgggaaatgggcaggagcagggcaggcttgtggagcaggggtgcattttctgttgccactcttaaaattctgttgtggatatcttaacattgtcaggaagtttgagatcctgtgaattgggttcatggtgatgttttaatcaattttctggttgccagaatatttttctaaagtatcctcatagaaccttggctgcatctggagtttgcataccaagaggtttgtctttgcaaaagcatttataaagctcctgtaattcaaattccttcatgctttcttaactcccctgttcctccatttgccatttcatttccctttctccagggaactgagtaggcatcctgagagagctttgtagatatttgtcatatggggaattggtgaagatttgattgaattagaaaattatgttataaagcactatcatatggctgtaaatattaacattaagctaacaacgttatagtctccgttagtttcacactgaggtatatgtagtctttgatgtaaatacagcattcagagatgcgtcttcatagtcttagttattaatgttacaccttagctttcattgaagcatgaagacaggattgcagcaatgtacaactgaggagaagatatatagtaggttctgttaaccctgagtgtcgtcagagaaaa

SEQ ID NO: 29574 - DNA, 1958 bp, Mus musculus
ctcctcgtgttttaagagagggtctcatgtagctcaggctggttttcctcaaactgactatgttacagaggatgagcctgacggtttcatccttctgcttccacctcacaaatgctgaggggactaaaagcgtgtgcctcctcaacgtgtgacatgggtctgagctctgaatgcaaggtttgtggtaccaggctagcacattctcagcctgagtcactactctccttttggaggtttattcttaatttattcaaaacattttatttttatgtataagggtgcacttacatgtgtgtttgtgccctaccgcatgcatgcctggtgcccacagaggttagaagaggacattgtacttcctggaactagagtttcagttctgatccaccatgtttttaattactgagctgcctccccaagcctctaaatcacttcttaaaatgcaggaatgtatataaactcactggcagcatatccttggcaacctcactaaaactgtgatgtagctctaaatgtcacacagaaggagcaatgaaaagtatgtaccaaaaaaaaaaaaaaaaaaaagactggagcgggacacttagagctagcttcaaagcacaaggccctctcctggcctctgcaggtacctgtacttgtgtgtgtgtgtgtgtgtgtgtgtgtgtgtgtgtgtgtgtgtgtgtgtgtgtgtgtgtgtgtatttgtggcatgtacacatttgtatgcatatacatatgtgtgtggtatgtttgtgtgcatttacatgtgtatgtgcagtgtgtacagtgtatgtttgcatgtgtattagcagtgtggtgtgcatgtgtgcatgtatgtttctgtgtgtaggtatattatgtgcagcatgtgtgtgtgtatgcgtacatgcgtgtatgtgtccctgtgtatataacaaaggtaaccaaaaaatcttttttaaaaattagttaggctggagatatggctcagtgggtgggagcactgacagttctgcaagaggttctgagttcaagtctcagcaaccgaatggtggctcacaaccatttgtattgggatctgatatcctcttatgttttatctgaagagagtgacagtgcacacagatacataaaataaataaatctttaaaaagctgagtcaaaataaatactatctcaaaaataaaaagttgttttggctctattggtaaagaacctgacaaagcctgactgcctgaggtttggatcctcagaacctacataaaaggctggacccaggctggagggttggcccactggctaagagcacctgtttctcctgcagagaacctgggtcaactctctgcactcccatgactgttcacaacgggggatatgatggccttttctgacctcctaacaaacctgcacacgtacaggtaaaacacattcataaacttttaaaaacaaaacaaaaaggaaaaagaaaaaaaagaaaaattggaaacctggacacagccacatgcatgtgtgtgtgtgtgtgatctgagtgtttactctcactctgggactgagaaagcacagccctccagcagtcagggcagatctgattggcaaacaccactaaatgtcagcaatgtaagaaaatcaccacatgatcaaaatctatgacactctcctaaagggattttctctgcaaagacatagggtgcaagtttataaaataactcatgtcaaacatttaataactttattaagaaggctgaggcaagaggatgacaagtttgatgccagctaccattaacatagcaaaaactttctcttaaaaaacaagggtctgaggatatgactcagtggttagagaactggctgatttaccagaggacctgggtttggttcctagcacccacaaggtcatgcacatttccacggaatctggtgccctcttctggtctctgtgagtacggcatgcacatggtgcacaggcacatgcaggcaaaa

SEQ ID NO: 29575 - DNA, 1163 bp, Mus musculus
atccttgtaagctatgtgacgattgattaacaggccaagaagcgggccaccaattactggatataatgcttttatctgctcctgtatccattataccttgaaaggtttttccttctatttgtaattgtaaagtgggacgattatccaaatctaaagatatgtaggccacattagttcctgtagaaccgagtcccttatctccttgggaatcctggctactaggaagaatcagtaattgagcaatgcgatctccaggagaaatggctacaatacctcggggtgcagaacacataatcttaacttgtccctcataatctgagtctataactccaggatgtatcatcaatcctttcaaagcagaagaggacctacccaacagtaggcccactgtatcctttggtaagggacctctaaagtctgatgaaataggttggcaccccatttgaggtgtaagaattactctggaggtggcacagatgtccaatcctgctgaacccggagtggctctcctcagtctctgggtggcctcatggacactgtggtctgaaatgccccatacatttgggggcctggggacgggggcccctcaccccgttttttggctgttgcactttaaactgaggtattggccttcctttgatatctctgactgatctacattcatttgcccaatgtcttcctttcccacattttgggcaagtacctggttctgttttttcaaatctattctttctaccctttgtacactgcttttgcatatgacctgtttgtccacaattatagcagcttatttcttttgcttgtgccatcaaaactgcggcagccagccctgcatttgaaagaggtcctcctatttctctacaggctttcatccatgcttgtagccctttccctttccatggtgtgatagcatttctgcattctttggtacattgctcataactaattgttcaattaatggcattgcggcctcagcatcaccaaatatacgtcctgccgcttccatcatgtgagccacaaattcagagaacggctcattagttccctgaataatttttgtcaagttaccagatacctctcctcgattaggcaatgctttccaagctttcaccgctgcctgattaatttgatcatagacctgcactgggtatcctaattgattg

SEQ ID NO: 29576 - DNA, 1166 bp, Mus musculus
tacaggagagaaaccttacaaatgcagtgagtgtgacaaatgctttaccaaaccatcccatcttagtattcatcgtagaattcattcaggagagaaaccttacaaatgtagtgaatgcgacaaatgctttacccaaccatcccctctcagtattcatcgtagaattcattcaggagagaaaccttacaaatgtagtgaatgcgacaaatgctttactgacaaaggcagtctcagagttcatcagagaattcatataggagagaaaccgtacaaatgcagtgagtgtgacaaatgctttacccaaccatcccatcttagtattcattgtagaattcattcaggagagaaaccttacaaatgtagtgaatgcgacaaatgctttactgacaaaagcagtctgagagttcatcagagaatccatacaggagagaaaccgtaccaatgcagtgagtgtgacaaatgctttactgacaaaggcagtcttagagttcatcatagaattcatgcaggagagaaaccttacaaatgtagtgaatgcggcaaatgctttactgacaaaggctatctgagagttcattatagaattcatgcaggagagaaaccttacaaatgtagtgaatgtgacaaatgctttactcacaaaggctctctgagagttcatcatagaattcatacaggagagaaaccttataaatgcagtgaatgtgacaaatgctttacccgaaaatcacatcttagtattcatcagagaattcatacaggagagaaactgtacaaatgcaatgaatgcgacaaatgctttagtgacaaacacagtctgagaaggcatcagagaattcatacaggagagacaccttacaaatgtaatgaatgtgacaaatgctttacctgaaaatcacatcttagtattcatcagataattcatacaggagagaaaccttacaaatgtaatgaatgtgacaaatcctttactgaaaatggctgtctgagaattcatcagagaattcatacaggagagaaaccttacaaatgtaatgaatgtgacaaatgctttacctgaaaatcacatcttagtattcatcagataattcatacagaagagaaaccttacaaatgtagtgaatgtgacaaatcctttactgaaaatggctgtctgagaattcatc

SEQ ID NO: 29577 - DNA, 1149 bp, Mus musculus
atattgggcgggtccagaaggcggggctaggcagaagtgaagggaagttcctaggtttcatcattctctttgtatcttggttgcctggtggtcaggaagtcctggagggaaacttgtgcctagtattagtggaacatgaaaacttccttaagcaacagttgctgtgctggcctcctaggacattgagcagctggtcctgtcaccttccaggtcagaggagctgttgtactggttaatgggcaggagcagggcaggtgtgtggagcatggttgcattttctgcctccactatctcaattctgttgtggatatcttaccattatcaggaagtttgagatcctgtgaattgggttcatggtgatgttttaattaattttatggttgccagaatatatatacataatatattattattattcatttaaataaccccgtagatccttggccttctctggagtttgtgtaccgggatggttgtcttttcaaaagccttaatagagctcctcgaattcaaattcattcatgctttcttaactcgcctgttcctccatttgccatttcatttccctttctccaggaactgaataggcacccagagagagctttgtagatatttgtcatatgggggaccagtgcagatttgattgaattagaaaatattctttttaaagtaccgtcatgttgctgtacatattaatattaacctagcaaagttatagtctccgttagtttaacactgaggtatatgcagtctttgatgtaaatacagcattgagaaatgtgtctttataggcttagttattaatgtcacaccttaggtttgaataaaacatgaagacaggattgcagcaaggtacagctgaggagaagatatatagtaggttctgtcaaccctgagtgtttccagagaaaaactaattgtaccatgtgggcaagttttataaaataatacatcgtgaccaagagatggatttggtcacatgctacaggcagtttaataggccattgtagtttcctgtgaggctttatcattttcccaagacataaacctgcagcaatgcacgaagatacctggttcttatgctggcggtgcagttaatttttggcttttcagtctgagggagaaagcattcagagatatctgattggg

SEQ ID NO: 29578 - DNA, 1149 bp, Mus musculus; identical to SEQ ID NO: 29577

SEQ ID NO: 29579 - DNA, 1225 bp, Mus musculus
taaggaataaaatagatttccattcttttcttaaatcatctacggaatcttaatattttgcacatctcagaatatacattctgaagaaaaacaacagcttttgtaactaatagcgaagtcattaacatatgctgcagtgtgtatactttgcactaaggacacagaagcaattgctgtaaccataatagaaactatcaggacagccattcctgctaaaatcatgcctatggcccttttagatcgcaacaacaattctgtggttgcatgctcaagaattcctaggcctttatcatcataccaatccttagttaaattaactggtaaataaacataatcaggttgcttaacaatcaaaaaattacttaaggtataattaacacagttagttatttgacaattagtacagttaacagtattattatctatcaataaattcccactcaaagaagcctatggctctggaacacacgaacatacaaaaacttcagtcttattgtgtttgtcctgaaatgccatgatattccacataggaatccaggtaattgtggacgcccactcgccagcaagtaagatgccacaacaggatccttctgcaacatgtttattgggagagcatggactgcgtaggcgaaagaccccgagccccagaaatggtgctacttatataggcctagggagtgacatgtccataactgattggttatgctaccagtacctcattaatatgcctcgagccaggcagtgactctgcaaaaaactctggcacatgcgcacattggttgtttacccatattcatgggcattggcttactgaaaccagtgccatcttgtaatggcgtttgcggcttcccacatctccccctttttattgtaataaaatgatgctggattaggcctatgcaattatgtccatccgctacggctcctgttttaggtcgttcctctgtgtcacagccttacccgtcatagggtaaccctatcgccaccaggccccgtgtcttaggttgctctgtgcatgaggaaagttgcccatctttggataatgcaatgctgtgtgacagtaattgctaaatgacttattttgttcgtcctgaaatgtcatgatattccctataggaagccaggtgatgttaattcttttaactgttatcatcccaagggctgcaatggcttttcttaatgaagaaaaataagtttcattattttttgtcccaattccatgaac

SEQ ID NO: 29580 - DNA, 1157 bp, Mus musculus
cctggctgtcctggaactcactttgtagaccaggctggcctcgaactcagaaatctgcctgcctctgcctcccaagtgctgggattaaaggcgtgccaccgccaggcttttactatggattaagacaaaattagacaacatcttttgaataatcttgatcacttacttactggattgctgtctggaatctgggtcaaaataattttcttccagtcttccctcctcctcttctgtgttgctcagaaaaagactctgtatgtgtgttaactgtgtggctgactctcacatctttagggtaaactggaatactcggagaaaaataggtattctcatgatatcttctctttccttcatatttatccttttctccggcattgacgtctttcatttttgttccatgaacagttccatgttcattctaaactatattttctcattttcaggtctccatatgctcagtcaaatctccataactgtaaatcaacactaagagcactggatagttaaggtcaaggagactctcacaaaggatccaggtatgttagaggtattgaacaaggggtggagtggggctcacctgccagtacaaagaggacatgaatttgattttgccagattctatttccttaatgattctggaaaagaataatattagatgtgatgatatggatttaccatggaaggcagtgctgtcagctgtcacttgatgtcaatatttaattaattttgatcctgggaaattgctgctgcccattgaaatcaaagtttcttttatccagattgaaagcagcatcaggctatgggtgtgagaagggcaatttatacataaagcaaatatcatcagtagattccctcctagggcctgtgaccttccttaccggatttttaggcagattttcactgtaatctatggatttttttttcctgtggagcttgaaacagaaaacctgttacccacagatagtcttgccagtatcataaaaatttccatgccttgtctggcagattcagattgcagcaagcaggttgaaaacctgagtatatacattgataactctgcttcctgccccaatttccctagcagtttttgtcactatgaaagttcccaccagggtgtctaagatgtctgctgagagtgaatggtctgatatgaggtg

SEQ ID NO: 29581 - DNA, 2030 bp, Mus musculus
taattccaaaaaaaaaggagagagagagagaaacctctcttgagagtatgaatccataagctcactggttattgagtcccttattcgttttataagtaattcatgtcacctctaattgccccattttgtttttgtttttgtttttttcagaaaatcattgcatacgtggaaagtataggaaggtcttggatcaagacagccagtacattgtccatgaacacatgaatattcaagagaagtcttctaaatgggacaagcttagcaaggtgattcttgaatccccccaatgtacaccttacaaaacttatcacggctctcttcaatactcgaacaaaaaaagacttaagcccaggaacacaaagaagtttgcaaatacaatgactctgtaaacagtgtaagtttgttttctaccattagtctcaatcaaggaatccacatgcagaagaaaaaacacaactgaaatgcagaatttgcgaatgtttttgtttctaaacataaagtcatggtgaaacggaacaatactggagtgaacccttacaaatgtagtgaatttcacaaatatcttacccagagagaaaaacttcaaagtcagcagagaatttatcatggaaagaaatcttacagaagtagtaaaagtgacaaatgctttacccatcagatccatcttagtatccatcagggaattcatgcagaagagaaaatttacaaatgtagtgaatgtgacaaatgctttacccaaaaatccaatcttaatattcatcagagaattcatacaggagagaaaccttataaatgcagtgaatgtgacaaatgctttactgaaaaaagcagtctgagaattcatcagagaattcatacaggagagaatccttacaaatgcagtgaatgtgacaaatgctttacccgaaaattccatcttagtattcatcagaaaatccatacaggagagaaaccttacaaatagtttacatgtgacaaatacaatactcaccatgtcagtctgagaaatcatcagttacttcatatagtagagaatctttataaatgaatgaacgagacaatcctttaccaaaatatatcatcttataattcattagagaatacttagagaagacaaacttcaaatatattgtaggtatgaatcctttacttttggcctatttcctagaatataacagtgaatatacttacaggctagaaacttaactcatgcattgtatgaagaaatatctttgacttcatttcaggtcagagaaaacatctaagaactttttaagggatagtatttctgttgggaaaaatgtggcatatgttttattcaaggtgtattcttgacaacacttgaggctccactctagagaattagtatgattatgaaaatcttgtgaaaattttcatgcaatgttcaaatcttgggtaatgtcaactatttatgctggatgaactctgtacatgtgaaaatgtagaaagcctttcatgacaacttttacttgttcaccctcaaatgttacaacatgaagaaaagtggggaagtcagaagatagtattgcataacacactgagaaagaaataatccatttcaaagaaaatttattaaggtctttaatacaatcctcacaatatctaataaaactggtaacattctgtatatttaattcacatgaactaattcagaaaaatgatacttaaaagagtatctggcaaactgagccacccagacagcatattctttatcctataagtatgcttacagatgttaagtgtgcttcgagtatccagaaatcataattcttctcaattgcttgtttcacattataggataacaactgagtatgagtctcttgtgatctggtcaaccactcctttcctattgtcctgtaactaactccaataaagctgaaagtttcaacaagtttgctttggttgttttcaatttgcacttgggatactgagatgaatatatgttgcatcttcccaggaaatgcctcacataaaaaaatacgcggaagtcataaatatttttgcaaggc

SEQ ID NO: 29582 - DNA, 5633 bp, Mus musculus
caggagagaaaccttacaaatgcagtgaatgtgaaaaatgcttttcccgaaaattacatcttggtattcatcagagaattcatacaggagagagaccttacaaatgcagtgaatgtgaaaaatgcttttcccgaaaattccatcttggtattcatcagagaattcatacaggaaagaaaccttacaaatagattgtatgtgacaaatacaatactcacaatgtcagtcttagaaatcatcagttatttcatacagtagagaatctttataaatgaagtaaatgaggcaattctttaccaagatatattatctcaaaattcattagagaatacttagagaagacaaacttttcaaatatattgtaggtatgaatcctttccttttggcctatttcctagactgtaacagtgaatacttacaggctagaaacttaactcatgcattgtatgaagaaatatctttgacttcatttcaggtcagagagaacatctaagaactttttagggtaaagtatttctgttggggaaaatggtgtattcttgacaacacttgaggctccacactagagaattagtatgattatgaaaatcttgtgaaaatattcatgcaatgttcaaatcttaggtaatgtcaactatttatgctgtgagaaactctgaaaatgtgaaatgtagaaagcttttcatgacacctttttacttgttcatcctcaaacgttaccagatgaagacaagttgggaagtcagaagatagtattttataacactttaatcgagaaagaaataatccatttcaaaaggaaactatttaaggtctttaatacaaccctcaaaataggtaataaaactggtagcattttgtatatttttattgtcctgtaactaactccaataaaactgaaagattcaacaaatttgctttggttgtttccaatttgcagttgggatactcagatgaatatatgttgcatcttcccaggaaatgcctcacataaaacatagactgaagtcatgaacatttttgcaaacctgtatcataaagttaatagtggtgatttttaactggtggataacaatacctttgggatgtaacgaccctgtcacagtggttgcttaacagcataggaaaacacatatttccaattgtcttaaaattaagaaatcattcattgaagtgtagggtagtctgcccaccctaaaataatttgaattcaatgtcagtatttagcattaaaaagttaaaaatactgttttacatatggtgctttgtgttaactaaaataagtaagattcagttcaatgttccaggcaagtattactaggctaagataaaaagaaacagaaaatacgtagaagctttcagagcctcagcaacaagtctgctctctcttgagttcaaggaagtatgaaagaaaaatctacaaaaaataaatgaaaacatggctacatagatttcaaggatagctatccagactttgctgtgtctctgcatgattctgaagtcattaattcccatttattgaacaaaagtcctataagtctcagaaaaatgctgaccgttgggctggtgagatggctcagtggttaagagcaccgactgttcttctgaaagtcctaagttcaaatcccagcaaccacatggtggctcacaaccgcctgtaatgagatctgatgccctcttctggtgtgtcagaagacaactacagtatacttatgtatagtaaataaatctttgaaaaaaatctttttaaaaaaaatgctgactgttgacacatattacaagacattgtggtgtctggtcctgttgtgccttaatattccactctaccgtaaggaatgaaatagatttccattcttttcttaaatcatctacagaatgctaatattttgcacatctcagaatatacattctgaacaaaaactcaacaactcactactaaggtattatcttcatcttaatttcatgtatgagttcattcatacaaatatcatgaatctgtaaatcttagatgaggtgcatactcatgcactgtttagaaatccaaccatcctggagatacattgggaagtactgaaagaagtacttttactccgagttcaatatgatattagaatatttatcctaaattcaagaagtttcagtaaattaggatctaagaaaaaaatcaaatggtacaatgaacaaatctatatcactcatatattttccttgactttaaaaaaataacaaggaaattgttcagcttgtgtcaaaataatgaatgataacatttcattggtctcaatattggaatttgatgaaacaggacctcctcattagtagaatctaagtatgagaagaagcaatagtggcccttcatttcaaatgatcataggtattttctgccaatagcttcatcagggatgttgaaacttacataccaggcaaatgaaaaataagtggcttgagtagctcttaccagtctggaaattgcaaccagttggacagtctctcttgattctcattgcacatgttcagtggatttaggactcaccgcttaataatgactgagagattattacccaaatctgaagtaacttccaggttccaggtggaaaaatttctagaagtacacaatgaagacacatcttaccttgtacccctcacacaatattcattctatagccatttatacacacacttcttgtctatggtaccgcaagcatatggtgatgattgacaaaataagtccaggtagactcactgtttgagttatgtggaagacagcatgtgtagattgataaagatgcaagtccttggttcaggataattaaccatatcatgtttgaagaacatggagactaaagctcactggatttagaacattaactatttgtggaagagcattgtaaaatgtttaacaagagccacactataggagcctgatgggcatttctagaagaacttccagtggctagattttaagtaacccactaggtctatgtcagtaccttccagggaaaggaaacttctcttcagctttaggacaactgatgggacagcctgaggatgggaaacacatggagtaggtggaaagagttattccttggttgaaagtaattttattacaggagaactcagaagacggactgagggcctgaaggaagagagtgggatcagcagcccatccttgtcagtaggagtctggagctgcatgttgtggaactaggactagagaacactgcctgggttctcacagccatgtaaaaattcccttcctctttagttgtccccaagttaagtcttgtggaaattttcagtcaccagagcagtggcaggaactgcaaacaagaagacttggacactccaaggtcaaagaagctgctaggctagtggaaagacaggcactggaccatgattgaaaccccttactctgctgctcataagaacactgatcctcaaatcctagtgtgcatttcataactgtgttgttaaattgctgaccatgtaagtgtaacttttcctgatttttttattcatcttattgttgtctggatacttacataataatttctgagacgatgggcttgttggttgcaaacatggttatatttctcttggagcaggtttaaaattggtacaattcatatccatccattgtttgtaacgctgctattttacgactgtgctagtcaagatctttgccattggagattatgcatccactgggaggtttaaatattagtcccataaggaccactggatatgtcattgaaccttaagcaatatttagcactttttaaagttttagctgtctttagatttatcatactataaacatttattttttatttttattttttatttttccaattttttagtaggtatgttcttcattaacatttctaatgctatcctgaaaatcccctataccctaccccgctgctaccctaccctcccactcgcactttttggccttggatttcccctgcactgggtcatataaagtttgcaagaccaagggtcctctcttcccaatgatggccaactaggccatcttctgctacagatgcagctagagacacgggctctgggggtaatggttagttcatattgttgttccacctatagagttgcagaccccttcagatccttaggtacttttactagctcctccattgagggccctgtgttccatccaattgctgactgtgaccatccacttttgtgtttgccaggcactggcataggctcataagagaaagctatatctgggtcctttcagcaaaatcttgctggtgtatacaatggtgtctgtgtttggttgctgattatggaatggatccccaggttcagcagtctctggatggtccttccttttgtcttagctccaaactttgtctctgtaactccttccatgggtgttttttcccaattcgaagaaggggcgaagtatctacacgttggtctttgttcttcttgtgtttcatgtgttttgcaaattgtatcttgggtattctaagtttctggctaatatccacttagcagtgactacacatcatgtgagttcttttgtgattaggttacctcactctggatgataccctccagatccatccatttgcctaggaatttcataaattcatcgtttcttattgctgagtagtacttcattgtataaatgtaccaacttttctgtattcattcctctgttgagggacatctgggttctttccagcttctggctattaaaaataagggtgctatgaacatagtggaaaatgtgttcttattaccagttagaacatcttctggatatatgcccaggagaggtattactggatcctccggtagtactatgtccaattttccgaggaactgccagattgatttccagagtggttgtacaagcttgcaattcctccaacaatggatgagtgttcctctttttccaccctctccagcatctgctgtcacctgaatttttgatcttagccattctgactggtgtaaagtggaatctcagggttgttttgatttgcatttctctgatgattatggatgttgaacatgtttctaggtgcttctcagccattcaatattcctcaattgagaattgtttgtttagctctctgtcccattttttaatggggttatttgactttctggagtcctccttcttgattcctttatatatgttggatattagtcccctatctgatttaggaatggtaaagatcctttcccagtctgttggtgacctttttgtcttatttacagtgtcttttgccttacagaagctttgcaattttatgaggtcccgtttgtcaattcatgatcttacagcacaagcggttatagttggtcatgagacactgtgtgtacctatatacaaacttttgtcccctgaagagcagccagtgctcttaaccaccaatccatctctccagctcctagttcctctctttaaaatgtggctggcaaaaagcattcttgcttcaagtggtggagggttaaataaaaacttttatttataaagcatttggaaaagtgcctggtgtctcttcgtgatgctcaggagcaactgcattattagctgtaaggtgggttctgagcgccacagactgcacacagctggcgctttgtaaattaag

SEQ ID NO: 29583 - DNA, 1097 bp, Mus musculus
cagaggatgagcctgactgtttcatccttctgcttccacctcacaaatgctgaggggactaaaagtgtgtgcctcctcaacgtgtgacatgggtctgagctctgaatgcaaggtttgtggtaccaggctagcacagtttcagcctgagtcactactctccttttagaggtttattcttaatttattcaaaacattttattttatgtataagggtgttttcacttacatgtgtgtttgtgccctaccgcatgcatgcctggtgcccaccgaggttagaagaggacattgtacttcctggaactagagtttcagttctgatccaccatgtgagtcctgggaattcaatctggtcctccacaagggcagcagagtgtttttaattactgagctgcctccccaagcctctaaatcacttcttaaaatgcaggaatgtatataaactcactggcagcatatccttggcaatctcactaaaactatgatgtagctctaaatgtcacacagaaggagcaatgaaaagtacgtacaaaaaaaaaaaaaaaagactggagcgggacacttagagctagcttcaaagcacaaggccctctcctggcctctgcaggtacctgtacttgtgtatgtgtgtgtgtgtgtgtgtatttgtggcatgtacacatttgtatgcatatacatatgtgtgtggtatgtttgtgtgcatttacatgtgtatgtgcagtgtgtacagtgtatgtttgcatgtgtattagcagtgtggtgtgcatgtgtgcatgtatgtttctgtgtgtaggtatattatgtgcagcatgtgtgtgtgtatgcgtacatgcgtgtatgtgtccctgtgtatataacaaaggtaaccaaaaaatcttttttaaaaattagttaggctggagatatggctcagtgggtgggagcactgacagttctgcaagaggttctgagttcaagttcagcaaccgaatggtggctcacaaccatttgtattgggatctgatatcctcttatggtgtatctgaagagagtgacagtgcacacagatacataaaataaataaatctttaaaaagctgagtcaaaataaatcctatctca

SEQ ID NO: 29584 - DNA, 1085 bp, Mus musculus
cctttcctccccaacttgcttcttggtcatgatgtttgtgcaggaatagagaccctgactaagacaatggctgactgtcagctacctcaactactacaagaagaacatgtggtgtctggagccacaacagctctaggctaccagaacacttcctgagaagtcctttcatccagccagacttaagttgctccctctccaggccaggcttgtgtacagtgcacagcttggccttcgtacctgcaaaccacagcagtgaaactttatccagtacaatggtgtgtgtgtggtggtggtggtggtgggaggtccaccagcaccatgttatcattctcggtggttatcccgtggtaggtgggctctagccatggcttgtgcttgttaactgcattgggagaaaaagggaaaaaaacagtaagattcagatcactgcttcagtgttctgctgtctttgaagatgatcatgtgttatctggcttctgcgcaagtgaacacacttacaggaaagcaaagccaggcacataaatggaggagagcaaagagactgatcatctgaaaagggcaaactgtggtttgattatgggagtgccccatgtaaaatctaacccagatcatgaagacagaaattgactcgttccctccacaagacactcctgggacatgagctctgacagagcagcctcaggagggacagcactctcacccttagtccccacaggggcagcatggggtgacacaatagcagggatgactgtgggcattgacagaatctggtaaagctcacagcagcaagggccggtcttcatcaaagggttcatggaacaaaaggcacctcaactatgccatgggagatgggcaactcatccactgctgagaccccaatatattttatatgaaccacactaagaaggaagctgtgacaactcagggaattagcccgaggcaaactgctcacaaacaatgaagtctcagacacatctcaccatgctctagttttagggttctctctgtctctgtctgtttgtctctatccctttctctgtgtgtgtctctgtctttctgtctctttctctctgtctctctctgtg

SEQ ID NO: 29585 - DNA, 1080 bp, Mus musculus
agagaaaatttacaaaaatgcagtgaatgtgataaatgctttactaataaaggcagactgagaattaatcagataatttatacatttaaaaaaaaaccttacaagtattttgtatgtgataaatgcagtacccacaacatcagtctgacaaatcaacaaatatttcaaacagtagagcaacattataaatgaaatgaatgagataatcctttaacaagaaatatcatcttaaaattcactggagaattcttccaaaagggaaacttttcaaatacattgatggtttgaatcctttattttggcctatctcttagaatgtaacagataatttatacaggcaagaatcttaacaaatataatatatgctgaaatatctttgacttcatttcagtgcagaaaaaatatgtaaaatatttttttatgggaaaaaaagttctcctggggaaatgtggcatatgttttacacgggtaatattcttttcaacagttagtgctctaaactagagaattatgaatctgaaaacttttgaaaaccttcatgcaatgttcaaatcttagataatgtcaactattatgctggcagtaactctgaatatatgataatgaagaaacattttcattaaacttttacttgttcaccctcaaatattatatgatgaagtcaggtgtgaaagccagaagaatatgatgttgtgcaacaattcatggagatagaaatgatccattccaaaaggaaactaaataaagagtgtactatcgccttcaaaatgtctaataaaactggcagcattttgtatatttaattcaaatgaagaaattgacacagattgtacttgatagtgtatttgacaaactgagccaccaagactgcatgttcttaatcctataatatgcctacagatgtgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggct

SEQ ID NO: 29586 - DNA, 1196 bp, Mus musculus
ataattattgttgaccttctctgtactgtttgctttagttttgagtctgtcttatttctgaggtatgtttcttctcttatattcttgagagcttttatactgagcagtgtctactttttaccacagggctgtataagtaagtttcattctcctattgtcactgtaatttgggaggattcctgcctgcatctattaacctaggcctagtcatgtaagcttctactctacatacagtattatctaggcctggtgtgttttcagcctctgaaatttgctgctgaataagcccccaccttttcttattccttctcaatgcttacctggctgattcaattctgtttttccagctcacactcctctcccagctgagttcttctctcagacactgaattgttctactaggccttaaattaactgtcgaaatcttttgtaatcctctggctctttctcattctcctgctcattctgtctttgcccatgcctagcatgttctatcttcaatctgactctgtaaaactctcccagtaaaactgtgtccttctccctctctgtggatctactctctcaactgtactgtactgcagcccatgcactctactgtattcctttattattctcttctttgtgtaatgtctttctctgtctcaagtagcttctctttcctctctcattacagcaaagttgggcatatcctattctgtcagatctttctctaatattccatattttctgtcattcaattagacattgctttcaaacacaggtgtgttcttctacatataaactgtacctttgttattttggattaaagtgaatactaaggtcttgcctgtactaaaaccagagcgattaatgttgtgtcttgggctgaactgcaccctaagtcacaacaggttcaagtatcgctacacagtgtgatgtcagtttacttctgtacaattttttccttctgaaatgaaaaccaagatccacatatactattcttcaatatgttgatacctatttcattttttctgacttctacttgggattttattataatgttctttgaagatcggtcgatgatattctgttccttgtgagattgtattccttaggatttttaatctggaagattttgctggcagtttaggtggtaaagtatgtttactttgttctcaattccttgtgtgggatagagctttattgtgttgtat

SEQ ID NO: 29587 - DNA, 1497 bp, Mus musculus
agaaaaaaaaaaaaaaaagacaggatctagacaggaaacctaggcaactaaagaccgagcctcagctaaagaggctcagctgtgtcagactcaagttatctatttgagatacacccttcgaggtagaaaacagtggctaaaagaagccagaaaaagactataactacaccaaggcaagtaagagaattcttgggtactgctggcttctacagactctaggtacctgggttggcaaccttagctgccctgttgtaccacctaaccaaggaaggaaaagtgtttatgtggaccccagatcaccagaaagcctttgaagagattaaaaaggccctactgatggccagcctttgcctggcttaaccaagcctttcactctttatgtggaagagagatcaggggtcgccagagaagtccttactcagactttaagaccttgaaaaaggccagtgggttaaatatccaagaagttacaccctgttgccagtgggtggttttcttgcctgaaagctattgttgccataatctgcttgtcaaggatgctgataagctcactctgggacagtaactagctgtagtggcaccccaccccacgctcttgaaagcattatctgaaagtcccctgactgatggatggcgaccaacgctcctgtgacacatcagaactttttgttgactgaatgagtgaccttcgcttcattccgcctgctgtcccactgcctgagactgcacctactcatcactgcgctgagaaactggtacttgaaatgatctgaaggatcagatcagccgtggcctgagggtttgagctggtacacggatcacagtagcctcgaggttaaaggtaagcagaaggcggggacagcagtacggtggtggacataaagcaagtgatctaggccagcagcctccctgaagggacatcggcccagaaagctgaacttgtgaaagagggctgttgacatcggcagagaaagacctaagatactgtggctaaagaaaatcagatagcagatctaacggccaaacaggtggcccaaggagcaataatcctggcagtcaaggaacctaaagattattatgacatcagggaaaccagctttagatacaccgctgagcactatcaagttatggacagtatttgacccacctaggggccaaaaaaaattaaaaggtgtggttaggtcatttgactacgatgttacaggactctctgacttggcagaagaaatagccaaaagctgcaaggcctgtgctatgacaaagtagaatttacagaaattaagccagctagatattgcaacaagtacttattagtgtttatagacaccgtttcaaaatggatagaagcttttcctaccaggactgaagatcctaaaagaaatcttcccaaggtaatggacctgcctttgttgcccaggtaaatcagggactggccaagatattagagattggttagaagttacattgtgcatgcaggccccaaaggtcaggacaggt

SEQ ID NO: 29588 - DNA, 1185 bp, Mus musculus
tcatccaaatgttttaatctctatatgtggaatgttatctaagggcttattctctatgatctatattttcttttgtaataatgagaacttaatatttttccttttcatgcatatagtggctttatattttaccttgagttttatattttgagggtatataattctcttggactaaagacctgcatgtctcaaatagtatctatgatgctcaaagaacatattaatggatattttcttttttttcaatttatttatttattatatgtaagtacaccatagctgtctttagacacttcagaagagggcgccagatcttcttatggatggttgtgagccaccatgtgattgctgggatttgaactcaggaccttcagaagaacagtcagtgctcttaaccgctgagccatctctctagcccaatggatattttctatattgaataagttttgtccttttgtattagtgtgaagtaaggtctcttgtgccacatatatggcatttcagggatggtcaggtttctagcttgtgaatgaggatatagaaataagtataaattcacatcactaaagaagatatgaaagagtagaatttgtagaaggtaaaattataagagatctactgtcttgaatcctaatagtaaatatattattagctccctagggtcacagataatggaaggaaaatgtctttcttaccattagtgtaattgtgagctgatatagatttccgtattctgacacttttttcacacctcatgtcacatagtaatcaatgttgacactggaaatctatttgtctcaagagagatactgtccctgtggaaaattcacagtatagaaatagttatttacctctctttttggtttgagaaataactttaagtcctattttcttcacctttgtatttcatcacataagctatattagtaaaatttttctagagaggataactatggtgctgtgcataaaccatcaatttagaaacataaatgaatgtcctttcttattttttgtctctttttctttagaaggaaaaggcttgatacaatctgtgataatcttctccaaccaagctttgcattacatagggaaaactgaagtgttatgtcaatgtttctatttttcattatgatattattttctttaagtccataagtgtatatctgaaggtttttatgtacagtg

SEQ ID NO: 29589 - DNA, 1550 bp, Mus musculus
aacttttcaaatatatcgaaggtatgaattctttatttttgcctatttcctagaatgtaactgtgaatgctaataagctagaaacttaacgcatgtattgtatgaagaaatatctttgaattcattttagtcagagaaaacatctaagaactttttaagggaaagtatttctgttgagaaaaaggtggcatatgttttattcatggcatattcttggcaatactcaaggctccacactagagaattagtataattatgagaatcttttgaaaattttcatgcaatgttcaaatcttaaataatgtcgactctgacaatttgaaaaaatgtagcaagcctttctttctttctttctttctttctttctttctttctttcttttttttgggggggggttggtttttagagacagggtttctctgtatatccatggccatcctgtagaccaggctggcctcgaactcagtaatccgcctgcctctctctcccgagtgcttggattaaagacatgtgccaccacgcccagttgtagaaagcttttcatgacacctttttatttgttcaccctcaaatgtggcaagatgaagacaagctgggaagtcagaagatagtattgtgtaacactttctttaagacagaaataatccatttcaaaaggaaactatttaaggtctttaatacaatcctcaaaatatctaataaaactggtaacattctgtatatttaattaaaatgaaccaattaagataaaaatatacttaaaagattatctggcaaactgagctacccagacagcatattctttattctataaatatgcttgcagatgtgaagtgtgcttcgagtatccagtaatcataattcttctcaaatacttgtttcacattataggataacaagtgactccgagtctcttgtgatctgctcaacaactcctttcctattgtcctgtaactaactccaataaagctgaaagattctacaaggttgctttggttgttttcaacttgcccttgggatactcagatgaatatatgttgcatcttcccaggaaatgcctcacataaaacatatgcagaagtcatgaaatttttgcaaacctgtatcataaagttaatagtagtgattttcaactggtggataacaatccctttgggatgtaacgaccctgtcacagttattgcttaaaagtacagggaaacacatatttccaattgtcttaaaactgcgaaatcattcattgaactgcagggtagtttgccctgctaaaaataattagaattctatgtcagtgtttagcattaaaaaagttagaaacactgttttacatatggtgatttgtgttaactgaaataggtaagattcagcttagtgctccaggcaagtattactaggtgaagataaaaaggctcaaaaccgaaaatatgtagaagctgtcagagcctcagcaagaagtctactactctctcttgaattcaaggaagtatgagagaaaaacctacaaaaatgaatgaaaatatggcttcatagatttcaaggatagctatcca

SEQ ID NO: 29590 - DNA, 1874 bp, Mus musculus
attaactatttgtggaagagcactgtaaaatgcttaataagcatatgagcctgatgggcatttctagatcttccagtggctagattttaaggaacccactaggtctatgtcagtaccttccagggaaaggaaacttctcttcaggacaactaatgggacagcctgaggatgggaaacacatggagtaggtagaaagagttattccttggttgaaattgattttgttacaggagaactcagaagaaggactgagggtctgaaggaaaagagtgggatcagcagcccatccctgtcagtaggagtttggagctgcatggtgtggaactaggactagagaacactgcctggggtctacacagccatgtgaaaattcccttcctctgcagttgtccccaagttaagtcttgtggaaattttcagtcaccagagcagtggcaggaactgcaaaccagaagacttggacactccaaggtcacagaagctgctaggctagtggacagacaggcactggagcatgattgaaatcccttactcggctgctcataagagcactgatcctcaaactattgtgcatttcataactgtgttggtaaattgctgaccatgtaagtgtggcgtatcctgatttttttttattcatcttattgttgcctggattcttacgtaataatttcttagaggatgggcttgttggttgcaaacatggctatatttctctggtggcaggttcaaagctgatacaattcacatccatccatggtttttaactctgctttttaatcactgtgctagtcagattctttgccattggagattatatatccactgggagctttttagatattagtcccatacgaaccactggagttttgattgaatcttaaacaatcttaaacaatattttagcaatttgaggggctgtgggactcttttattcagtacaggaggatgggaagcacgtgaaaggggagtgatgccatggtgggtgccatgacaacagatgcaggagcagtcctgttgcctagagatgaggagcctcttcactgggttgaaaacctgactgtaaagacagatgcacctggtgctaacaacattgcttatatttgtagtacttctcttcaatacaaattcttttttgagccgggcagtggtgacacatgcctttaatcccagcacttggaaggcagctaagttgattttcacatttctcttttgttagcctgtttagtaacttctcataacaaagacaatattatatagtcaggaaggttcaacttctccatgtccaatgagttctctggatggcatgcttggtaatggagaactgctttcaatttctacagaacaaagagttatcttagcaagcgtctagattgcttgtggatccaagggacccacttagccaaaaactcaaataaaacccaggtagtgtactagaaagctcatttgaaggaaataccaggtcagttgggacttattcacccccatttgtacgttactgaatttcgattgtctttatagcatttaagaagtatgtaccactgtaggtttccatatcatcactcaaatgtccctctcaattccaactgtctctcagcattttctccttcaaccttaacttccctaccactctctacctcattttcccagtcacattcccatctgtctccagttcatccatggaatctattttatttacttccaccagggaatctgggtgccactgtgtgctctgaagtcaactcttctatacttaatatctctgaatacaatgggcctatgaatatcaagttcattattttagcattggctaatatccacacataagtgaatatattccatatttctccacctgtgtctggtttaccttagta

SEQ ID NO: 29591 - DNA, 1124 bp, Mus musculus
taatgtgaatatctatctatctatctatctatctatctatctatctatctatctatctatcatcaaaataatgaacaactactataaattagcggttgtctctctaaaaacagagaagtcagaactgagttccacatctagagtaagtggcctcagttgctgtgggaatgctagaactactgcagggctttccttgtgtctcagattcttcactccctccaggtatccaatggtacctatggaaggggaaaggaaattgttaaactccctaaccacagaaaggtcacacagaaaggtcacagtagctaccactactgatgttagctgctgtacatcacagcctctaatactagcaacagtatcaagaccagttctcaaacacctgtccccattgatccttcctatcctgactggctagcatacagcctgtgctccactgaaattatatggataggaaacaggaatccattcctcattaaactgagctttctaaagcagtcacacaccttcttaggaagtgtcttgtgatggtgctggaggatcttggctttcatgttctgcacaggaagctgacataggttatttttcctgggctgccaggatcttatggattcctttctatgggtgccctgaagatgagtagtttgtgttccaccaccagagaattaatcctctcccttcctgcttccaacctgtctatctgaaccatgctctgcctcaccccatttcacaactaattcttgttcattgcaagattacacttctgtttgtccagatgtcctgacacaaaattatccactttctgccccggcttctcgtgaactggcttggtatattgaccagacagttttggcaaaacttttcaaataggccatagatcttcaggtgttctactgtgagagcaatgagctgtcttccagagtcagtagaactgtgattgactgaaaggaataccccattcaattatccaaaatattcaaagaaatgtgtttttctagcaacattaataacacagcaacatttacacataggtaaataaaatgtaaacatatacatttcttagtttttaatcagtgaagaggatggacattttgaattacagttgttgctgtaccacagtgact

SEQ ID NO: 29592 - DNA, 1123 bp, Mus musculus
atgaaagactatgattgatgtttactggatagatgatataaatgtgggcgtctctgcaaacactagttctggtagagtaacaacccatgagaaaaaaaagaaatctatttcaatacagctctgtaattatttcagcactggttttgggtgtgttgtgggttattgccaatgaaattcatacagcactcagagaaaatctttcccagtgcctgtgttaacatctgaagtaaaaagtctcctggtactcagaagtcaagataaactacaaagccccatgggaccattgaccacacacaagataatgactgggaagaacactggagggagcctgcctgtgctcaggtgagaagcagaagagaaatgagtgggaggcaggctttgtatagggtttagttgtaggtgatggattttcaggattggaaatatctgcggttggagattgctggtattttatgttctgagcttgagcaaacttagggatttctgagtagttaaaaccagtaagtatgctatccattctccctgtagacaatgttgagtgtaacttttagattctgaccccagggtggttcattttaggaataattaagcacagtataattttggaaagaaagttcttggtaataattgtctcaatcctctgtgcacagtgaagatgaaagtgtgactacctcaaaagtcttttgcaaagtctatgtgagtctttcttggattctaaaactaaagggcctagaggagaatcaagcatacagtgtagaggaaaccaagctacaagatacatgtcacaactcctgcaaggcgtgtttgtattgcctgagaaacaatgatcaagggaagattgtctgggacaattttatagtttgggacttgcaggtgttttgtggcactacatctagcacagcttaccatgccacttactacatccattccctcacttctggtcagaaaaaaagtgtacttctcttccactaaagagagaactctgtggttttatgctcctggttaccttagagcttatttttgaccacaaggtccttttgctctctacagaaaaaaaaaattttatggatgtttctagttcttaagatgttaatatagtgttagtgtaaatagaaagacagtc

SEQ ID NO: 29593 - DNA, 1101 bp, Mus musculus
ccaagagttttaatctttcagtgtatattgtttcctaagtaaaaagtattttattaactaatgcttcttaaagtttaccttaaattcttactctcacccaaaagattcagagacaatatccttttattacttagggttttagtttactacaaaagtttctacaaaaaataaagcttttataattgttattaattagtaattaaaaattggttgtgcccaaaacaattctttggccaaaaaaaaaacattactgtaaagtcatttttctcatcctcccagccaatcgttggcccacgtgggcccaactagcttctgtggggcagagtcttaagacacagtttcccctgttccagcacagatgatctagttgtgtgctgtagatggtgttttaaaatactgaacaatcaaaccttaatttgtatattaatagtcaatgccatatctttgagctcgcaattgcttaaattgttcatccctcagatactattctcaaatttacaattgcttatgcatatttctagttaataaataaataaattatgcacatgtgactcttaataaccttgcaagccttctagttacaactgctccttaagaaaattgattgaaagtgcaattagtcactgcccctttacagccatgtgtttaaggtgttttgtcaactagttattaattcaaaagtttagatattgtaaaattttaaaactttaacttcttaaaagacaaaaaagagagaaattgtatccccgtgcatactatttagtgcattcccatgcacactattgaagtcttacctttattttcaaaatttaatattttaatgtcaaagagtttaataaatgctttatagtatcttaaagggatctacttattggcttatagattaatcctaaaacaactaccttattagaaaaggaaaaaacaggttttctccacagaacactgcagaagcatattagtaaattcgtgtgacgagctggtaggtaagttgactcatgtcctgattaaattgactaaaaaactaaattaaattcatgttttaaatccatccttacttgtcatttttccagtttagactagcttctagccttttaactttat

SEQ ID NO: 29594 - DNA, 1632 bp, Mus musculus
tattcatcagggaattcatacaggagagaaaccttacaaatgcagtgaatgtgacaaatgctttacccacaaatcccatcttattaatcatcagaaaattcatacaggagagaaaccttacaaatagtttacatgtgacaaatacaatactcacaatgtcagtctgagaaatcatgaattttttcatacagtagagaatatttataaatgaagtgaacgagacaatcctttaccaagatatatcatcttaaaattcattagagaatagttagagaagacaaacttttcaaatatattgtaggtatgaatccttttttttttttttttggcctatttcctagactgtaacagtgaatacttacaggctagaaacttaactcatgcattgtatgaagaaatatctttgacttcacttcaggatagagagaacatctaagaactttttagggtaaagtatttctgttggggaaaatgtggcatatgttttattcatggtgtcctggcaacacttgaggctccacactagagaattagtgtgattatgaaaatcttgtcaaaacattcatgcaatgttcaaatcttagataatgttaactatttatgctgtgagaaactctgaaaatgtgaaaatgtagaaagcttttcatgacacctttttacttgttcaccctcaaatgttaccagatgaagacaagttgggaagtcagaagatagtattgtgtaacactttcattgagactgaaataatccatttcaaaggaaaactatttaaggtctttaatgcaatcctcaaaatatctaataaaactgataacattctgtatatttaatttaaatgatccaattaagaaaagttatacttaaaaaagagtacctggcaaactgagccacccagacagcatattctttatcctataaatatgcttacagatgtgaagtgtgcttcgagtatctactaatcagaattcttctcaaatgcttgtttgtcattataggataacaaatgactctgagtttcttgtgatctggtcaacaactcctttcctattgtcctgtaactaactccaataaagctgaaagattcaacaagtttgctttggttgttttcaatttacacttgggatactcagatgaatatatgttgcatcttcccaggaaatgcctcacataaaacatatgcagaagtcatgaatatttatttttgcaaacctgtatcataaagttaatagtaatgattttcaactggtggataacaatctctttgggatgtaatgaccgtgtcatagtggttgcttaaaagcataggaaaacacatttttccaattgtcttaaaactgagaaatcatttattgaactgcagggtagtttgcccacctaagaataatttgaattcaatgtctgtttagcattaaaagagttagaaacactgttttacatatggtgatttgtgttaaatgaaataggtaaaattcagttcaatgttccaggcaagtattactaggttaagataaaaaggctcaaaaaaggaaatatgtagatgctttcagagcctcagaaataactcttgaattcaaggaagtatgagagaaaaatatagaaaaatacatgaaagcatggcttcatagatttcac

SEQ ID NO: 29595 - DNA, 1212 bp, Mus musculus
gtgaacagtctctcttgattctcattgcacatgttcagtggatttaggcctcactgcttaatgactgagagatcattacccaaatctgaagtgacttccaggttcatggaaaaatttctagaagtacacaatgaagacacatcttaccttgtacccctcacacaatattcattctataaccatttatacacacacttcttatctatggtactgcaagcatatggtggtggttgacaaaataggtccaggtagactctgtttgagttgtgtggaagatagcatgtgtatattgataaagatgcaagtccttggcttgggataattaaccataccatgtttgaagaacatggagacagaagctcactggatttggaacattaactatttgtggaagagcattgtaaggtaaataataagagccacactataggagccggatgggcatttctagaacttccagtgtctagattttaaggaacccactaggtctatgtcagtaccttgcagtgaaggaaacttctcttcagcttcaggacaactgatgggacagcctggggatgggaaacacatggagcaggtagagttattcctgggttgaaattgattttgttccaggagaactcagaagagggactgagggcctgaaggaagagagtgggatcatcagcccatcactgtcagtaggagtttggagctgcatggtgtggaactaggactagagaatacttcctggggtctacacagccatgtgaaaattcccttcctctgcagttgtccccaagttaagccttgtggaaattttcagtcaccagagcagtggcaggaactgcaaacaagaagatttggacactccaaggtcacagaagttgctatgctagtggacagacaggcactggaccaatattgaaatcccttactctgctgctcataataacactgagcctcaaattctattgtgcatttgataactgtgttgttaaattgctgaccatgtgtagtggttattcctggttgtcaacttgactgtatttggaatgaactacaatccagaattggaaggctcaccagtgacccttatctggaggcttggagatccttatctgaatcttggtttgaagatcttgagccatagtggctatggattccagaagattgaatctccgagtttaaggttacaccttctgctggagacaatataaggacattggaaga

SEQ ID NO: 29596 - DNA, 1173 bp, Mus musculus
tctctgctggggcattgaggcttcataggtctaagtgcctctcttccaattgatgaaagttaagacagtgctcttttacctaaacagctggagtcattggtccctccatgtgtgtactctttggttggtggtttagtccttaggagctctggagtatctggtttgttgatattgtttttctttttatgaggttgtaaacacctttagctccttcagtccttcccataactttactttggggtctctgtgcatagtcagatcgttgcctacaagcatctgcatctgtattggtcaggctctgcagaaactctcaggagaaactatatcaggttcctgacaacaagcactttatttattattggatcatacttactcctcatataagtaatccctgttatccctaattcccccttttttttcagaaaatcactgcatatgtggaaactatgagaaggagaaggtcttggaacaagacacacagcacattttcaatgagcatgggcatatccaagagaagtcttttaaatgtaatgagtctaacaatataattcatgaatcctcccaaagtacacctcataaaactaaccacagagatgccactcttcaatcttcaaacctaaaaagacataaaactcggaccactaaagaagtttgcacatataaagactgtgtaaaccgtttaaaggtgtcttctaccattagtctcaatcaaggaacccacatagagaagaaagaacacaacagaaataaaaatcttgatgaggttttggtttctaaacataaacccattgtgagacaaaacaatagtgaaatgaacacttacacttgtggtgaatttgacaaatgctttactcagagtgacaatcttcaaagtcagcagagaatttatccattaaagaaatcttacaaatatagtgaaagtgacaaatgctttacacaaaagttctatcttggtatccatcagaaaattcatactggagagaaattttataaatgtaatgaaagtgacaaatgttttaaacacaaattcaatcttagtatgcatcagagaattcatacaggagagaaaacttacaaatgcattgaatgtaacaaatgctttatgcaacaatcccttcttagtaatcatgagagaattcatacaggaaagaagccttacaaatgtagtgaatg

SEQ ID NO: 29597 - DNA, 1205 bp, Mus musculus
accttacaaatgcagtgaatgtgaaaaatgctttaatgaaaaaaacagtctgaaaattcatcagagaattcatacaggagagagaccttacaaatgtagtgaatgtgacaaatgctttacccaaaaatcctatcttaatattcatcagagaattcatgcaggagagaaaccttacaaatgcagtgaatgtgacaaatgctttactacaaaaggcaatctgataattcatcagagaattcatacaagagagaaaccttacaaatgtagtgaatgtgacaaatgctttacccagaaatcccaacttagtattcatcagaaaattcatacaggagagaaaccttacaaatagattgtatgtgacaaatacaatactcacaatgtcagtcttagaaatcatcagttatttcatacagtagagaatctttataaatgaagtaaatgaggcaatcctttaccaagatatatcatctcaaaattcattagagaatacttagagaagacaaacttttcaaatatattgtaggtatgaatcctttccttttggcctagttcctagactgtaacagtgaatacttacagggtagaaacttaactcatgcattgtatgaagaaatagctttgacttcatttcaggtcagagagaacatctaagaactttttagggtaaagtatttctgttggggaaaatgttgtattcttgacaacacttgaggctccacactagagaattagtatgattatgaaaatcttgtgaaaatattcatgcaatgttcaaatcttagataatgtcaactatttatgttgggagaaactctgaaaatgtgaaaatgtagaaagcatttcatgacacctttttacttgttcaccctcaaacgttataagatgaagataagttaggaagtcagaagatagtattgtgtaacactttcattgagacagaaataatccatttcaaaaggaaactatttaaggtctttaatacaaccctcaaaataggtaataaaactggtagcattttgtatatttttattgtcctgtaactaactccaataaaactgaaagattcaacaaatttgctttggttgtttccaatttgcagttgggatactcagatgaatatatgttgcaccttcccaggaaatgcctcaaataaaacatagactgaagtcatgaacatttttgcaaacctgtatcataaagttaat

SEQ ID NO: 29598 - DNA, 1178 bp, Mus musculus
gcatttacctttcttccagagctaagtccttctcagtcttggctggtaatttcctcgggctatttatatctttatcaccttgtaaggtttgaaataaattgctcagcacttgattggccaagccaattgtaggccacagccagttagtatctcccaataatttctgaaaatcattgagagtcctcaaatggtctttcctgatttgcaccttttgtgacctatcctgttacagacttattttaggtaataaagaattaatagaagccactcgttatattttttcaggggtgatttgcaatcttcagcaaggcaagttgtgttgttgttgttgttgttggttttttttttcatcaaacattctttccatgatatttaaatctgaattagcaaatagaatgtcatctatataatgacagataatggattggggaaattgtgaatcatctctaatggttgttgtactaaatattgaccatggccgagaccgaggagtggagcctggacaacttcttcaccaagagggacaagaagaagaaggaatggagcagtcgggctgccaatgcggcgagcagcacggacgggagcagcgcgtaggcgggctccaagccgggtgatggcgggagcttgggctctggtgctaggtcaggagacagcaggagcgcgggccctgctggcaaggatataatgaaggatgaaaatgagtggaaagaatttgagcaaagagaggttgattacagcggattaagagttcaggcaatgcaaataagtgaaaaggaagaagatgataatgagaagagagaagatccatctctctttggaagaaggtggaggtggcaatggagcagaaaaatcttcaggtccctggaataaaaccattccggtacaggcgcttccttgctccagtaacagttacagaaaccccggagccagcaatgcccagtggtgtatttaggcctcctggggcaaggctaaccacaacaaggaaaacaccacaaggaccaccagaaatatacagtgacacacagttcccatccctgcactccactgccaagcatgtagagagccggaaggataaagaaatggagaagagctttgaagtagtaagacacaaaaatagagacagggaggatgtttcaaaaaaccaggcccttaaacttcagctagacaaccagtatgct

SEQ ID NO: 29599 - DNA, 1843 bp, Mus musculus
ttaaatatccagaacaagaaattacatttctatacatataatagttgcaattataaaaatcttactattgctttaaaatgttcccttatttatgaatctaaaaatatacaaggtttcaagtggatatagagctgttggtttgggcaatttttttttatttaactttttgacatttgatctctgtgtttagatctggtacaacataatcattatcatagcattttagatgttgaaacaaatctatttagtgatttccctgacactatcggctatatcataaatttatacctgaccaaatttatacctgtttcagtgtcactctgaattgaactgtaaccatagaattagagatctattgtttagagttctactttcgggaaattcactacagatggatcctttatttgtcccagcttatgcaaagtacaattttgttttttatttattggtcttttatttatctacatgtcaaatgttatgccccttctgtttcctgtctggaaactctaaatcccacccctccgcctggcttttatgatgatgctcccaccacagatccacctactcccacctcatgcccctaggattctcctatgctgggatactgaaccatcacagtaccaagggactcccctcctgttgatgccacataaggcaatcctgctatatataaagctggagccatttgtacttccatgtgtactctttgtttggtgatttgatccttgagagctttgtgggtcttgatattgtttttcctcctacacagttgcaaagcccttcagcttcttcaggccttccctttactccttcattgtggtccccttgctcagtccaatggttggctgcaagtatctgcatctctttggtccagtctctggatggccttccctgcagcctcttttccattctttgtccctctttttcttaagacaggagcaattctgggttaatatatttgaggtgggtatgatgtctaatttgaaaataaaatttagcaggctattatcattttcaatcacttgatatagatcatatttgaatttctttgaggatacatgtaataattccaaaaaaaaggagagagagagagagagaaacctctcttgagagtatgaatccataagctcactggttattgagtcccttcttccttatataagtaattcatgtcacctctaattgccccattttgtttttgtttttgtttttttcagaaaatcattgcatacatggaaagtatgggaaggtcttgggtgaagagagccagtacattgtccatgaacacgtgaatattcaagagaagtcttctaaatgggacaagcttatcaaggtgattcttgaatccccccaatgtacaccttacaaaactaatcacagctctcttcaatactcgaaccaaaaaagacttaagcccaggaacactaaagaagtttgcaaatacaatgactctgtaaacagtgtaagtttgttttctaccattagtctcaatcaaggaatccacctgcagaagaaaaaacacaaccgaaatgcagaatttgagaaggtttttgtttctaaacataaagtcatggtgaaacgaaacaatactggagtgaacccttacaaatgtagtgaatttgacaaatatcttacccagagagaaaaacttcaaagtcagcagagaatttatcatggaaagaaaccttacagaagtagtaaaagtgacaaatgctttacccatcagatccatcttagtatccatcagggaattcatgcagaagagaaaatttacaaatgtagtgaatgtgacaaatgctttacccacaaatcccatcttaatattcatcagagaattcataca

SEQ ID NO: 29600 - DNA, 1159 bp, Mus musculus
cactaaagaggaagaaagaattaagatggcttggatctatctattcttttttctcatagccaacccccagtgtcatactttattcagtaatgttccaacagctaaattcctcaaacgattgtgacccactgaggacccaactttaaaagataaaagtattatccaataggagaatcagccttctaatatccttgtacttttaaaattgattttgatatcaatgtagaagacaaagctctaattttttgtatgggtttcctgtttgtttgtttgtgtgtttgtttgtttgtaaaacagggtcccacactctatttctaactttcacatgtccttatatagagaccagaatggcttttaggttacatccctgacagctaggatgaaagacctttctttgacgagctgattttttgtttgtttgtttgtttgtttgtttgtttgaatggtgtatcttcacatattggccattgagttaccaccaggcttacagaatttatttcagagtgagcattccttagatttttatatctctggataagatgttcacatcctgcacatgtataattattctcttacccacttgaaggaattctctggaatttcattaagtttgtttctgccttctttgaattcctgtgcttgttccctctttatgacatttgtccacattgaatggtgttcatattatattttgagtttgtttcataattcattttgtcatgagaattggtattgcattagtgatttggggtagggaaattttattaacattttcaaattgctttagctacagcctctcaattttcttttgctgtgtgtcatttaggtcaggtgacagggatttccatatgaggtgttgtgaataaactttgagaatctagggtggtgggaggaactaggttacacttacagtctaaatatatcattacttactttcatgactgcacattgtcaagattcctggtatcattttgcttttaatgtttatatatataaatgttgtttaccattgtctgtaatggtgttgtatttatttcatctctgaatcattcagaccttgatgtgaaatttcaagaagaattcaaactttgctcttcacagagaccctgggagaaggacaacaacaagaatgagtgtgtctctggtaaatacaccacag

SEQ ID NO: 29601 - DNA, 1136 bp, Mus musculus
cattgatttctagagtggttgtacaggtttgcaatcccaccagcaatggaggagtgttcttctttctctgcatcctctccaacatgtgttgtcacctgaggttttgatcttagccattctgtttgctataaggtggaatctcagggtcattttgatttacatttcttttatcactaaggactttgaacatttctttaagtggttttcagccattggggtgtccttagttgtgaattctcagtttactcaccattttttcattgggttgtttgggtttttttggtggttatcttcttaagttcttaatatattttggatattagccctctattgcatatggagttagtgatggttttttcccaatctgtaggttgttgatttgtcttattgactatgccgtgtaccttaaagaagctttctagtcaggaggtcccatttatcaactcttttgttgttgttgttgttgtttttgttttgttttgtttttgttttttcgagacagggtttctctgtatagccctggctgtcctggaactcactttgtagacaaggctggcctcgaactcagaaatccgtctgtctctgcctcccaagtgctgggattaaaggcatacaccaccaccgccctgctcaattcttgatcttagagcatgagacattccagttctgtttaggaaatatcccctggtgcctaatgagttcaaggctttttcccactttctcttcttttaggttgtgtgtatttgattttatgttcaggtccttgattaacttggacttgggcttcgtgcaaggtgacaaatatgggtctatttccatttttctacatacagacagccaaattagactagcaccatttattgaagatgcttccttttttccattgtatatttttggcttctttgtcaaaaatcacgtgtgcgtaagtgtgtggttttatttctgggtcttcagttccatttcattgatcaacttgtctgcctgtgtaccaataccatgctgtttttatcactatagctgtgaagacagaattagactgtgtttcctttcaggaatagcaaatgccatttacccctgagtcatctcttctttccagggatttacacttctggtacacttttatgatagagcctgaa

SEQ ID NO: 29602 - DNA, 1344 bp, Mus musculus
agctgctgagtattgggcgggttcagaaggaggggctctgaggaaccaggcagaaatgacaggaagttccatcttctcctggtaccttggctgcctcgtggtcaggaagtcctggagggagactagtgcctagtatttacagcacctgaaaacttccttaagctgcagttgttgtgctggcctcctaggacattgagcagctggtcctgtcaccttccaggtcagaggagctgttgggctggtaaatgggcaggagcagggcaggcatgtggagcaggggtgcattttctgtcgctactctcacaattctgttgtggatatcttaccattgtcaggaagtttgagatcctgtgacttgggttcatggtgatgttttaatcaattttatggttgccagaatatttttctaaagtatccttatagattcttggcttcatctggagtttgtataccgggaggtttgtctttgcaaaagcctttataaagctcctgtaattcaaattcgttcatgctttcttaactcccctgttcctccatttgccatctcatttccctttctccagggaactgagtaggcatcctgagagagctttgtagatatttgtcatatggggaattggtggagatttgattgaattagaaaatttcgttacgttataaagcaccatcatattgctgtaaatattaacattaacctaacaaagttatagtctccattagtttcacactgaggtatatgtagtctttgatgtaaatacagcatccagagatgcgtcttcatagtcttagttattaatgttaccccttaggtttcattgaagcatgaagacaggattgcagcaatgtacaattgagaagatatatagtaggttctgttaaccctgagtgttgtcagagaaaaagcaattctacaatgtttgaaagctttttaaaatattacatcttcaccaagagatggactttggtcacttcctactgccagtttcatatgccctgtcgtctaattaccatggcctagtcctgtaagcctctagcctcttaaaaatcttatttagtcctagagtgttttcaacccctgaaatttcctgcggattaagttccccctttcttttaggttcctttcaactcctttttttttaaaaaaaaaaaatgttttcttggttttcccgacagggtttctctgtgtagagtcctggctgccctggaactcactctgcagaccaggttggcctcgaactcagaaaagtgctgggattaaaggcatgcaccaccactgcccagcctcatttcaactcttaactgtctggttcaactcagctgttcaggctcaaactactctcccag

SEQ ID NO: 29603 - DNA, 1169 bp, Mus musculus
tgttgggtgccatggcaacagatgcaggggctgttgcctacagatgaggagtgtcctcactgggtctagaagttggctgtaaagacacttctagctgtccacagatgcacctgacgctaagcacattgcttgtatttgtaggatttctcttcattataaattcttttatgacatttttgtgatagtgacatgaaaaggctttactggattgattacttttttagggttgggcttcggggtgaattcttttctttttgtagactctagagaccagtttttttccatattgtgtcccagtctaatcttgtaggacatttgtctgagggaaatgcaaaggcagatacagatcaacacatcctcttttccttggaaatatcgacctaaaggaagcacaaatattttaggcaaacttccattagtatgcagcattgataaaatgagtttcaataacaacaacgacaacaaacagactcctgaacagaagtggagtgctcttcatgtacaaaatttaatatttgtaacccttgtgactcacacagtactgttgcaaaatcatgttttgcacattagtaatactcacaatcctagtttgagaggctgaagtatgctcatgtcattgtggacactttcagaacaattacccttatgtacattgatgcaaaatactcaataaaatactcaaatactgaatccaaaagacatcactaagaatccatccaaaatgatgaagattgttttctcatccaatatatcttggggagtttccattccctctagtcttctcagttcctgtccactttttctcccttctggatctccctttctgtatctcagtaggaaaacaaacaagcaagcaaacaaataaaatccatagactcactaattgacaaatctgcccccaaaaagctaaggtaaaagttataatatatttcaaaagaactagcccaagcattagtatttgtacatcacactttctagtctcaaatttctgatatatgtttgtgcattttttgtgtgaaatattttgctgattgctgataaagtatattttcctatgggtccttttaagtgaagatatcaagaagctaaaatttcaaaggggaagaaattttttggctcagctttgagttcattagtcagaatgaaagacgatgattgatgtttactgg

SEQ ID NO: 29604 - DNA, 1292 bp, Mus musculus
cacaatacatattgttaggaataggcaagtgtatatgtgtccataactgcctcttctccagccatcttagccttggcagactcattggatggtgatgagaatgagtgaaatcatttgaaggcatctgaatgcttggtgttaactgcaagcctcccacctccaccggatgcatggcatgaactttgtgccagggataattctgccttcccacacttaagaatctttcctcaatttcgcagcctcctctggtcgggctccaacaatctcctgccttgcagctgcctctttaggaccacaggacctgacctgaggcttaaaaaggggatcacccacaattgtaaggactgctgtctactcagggcttcattcccctgagtccaaatgtgatccttaacttactcaggtagaggctttgtttcacctaaacttcctcagctttgatgatcagggactaaaccctgtctataaacattgagctttcctacccaggaaaacccccttccattagtatagtggagtggtgccctaacatcataatgtcagtcacctgctccctttctgacacagggctgaggatatgtttgtgtttttccccaggaatccacaacaccaggatgaatggcagtatgggacacccaaccatccagggaaaagtagaaaagggatgaaccctgctcctcctcagaacttttgggtgaggaggctgcacttgtaggagataagtctctactcgtctgtgatccctgtattcataccatttgctttatacgctattaagtacaaaatatttccgaggcatatgaacaaactgtcccatttcagcaaggaaacttgagctaacatagtcttaaatgattcagtactctcagaaaaagtatatccttgctcaatgagagcagggtgtccattcttgcttttgatatggggttcattggaaacatttgggacaacttaaaaagatcttttgacacatcctggatagtatcttatgctataataataataataataataataataataataataataataatagtaatagtaataataataaatattgcttaagtgtcttgtacaacacatctcttggcaatgctctatctgcataggtatgcttcaactactggtggctcttgagcatctagactaaggcctacccagagaggctatttattatagcttagctcatagaaattccccagggttctgtttaggttccctccttacaccctgagatgccctctgggatggctgtcctttcagggctggtagtcaatgaaggctaagaa

SEQ ID NO: 29605 - DNA, 1100 bp, Mus musculus
atctgaaaaccatcaaatctatatcatgtcagtcaatgctaagcatcttgagttagctatgagagtacaacaagtcttcagcacccgtaagaaatccaagcacgacctaaatgttacttgaaaatataggaagcgtaaagcatagcttccaaaacccaaccaaactgtagacacagctgacaacctggacagtccctcacttctcaaaatggtggagtatcagtcttcagccttctggccaggatcatctgtcaggactttgtaaagcagaattttgaaggacagcttagcctatcttgacagatctattagttgctcttccacacagtatgtccttttcctggacaggacttctgtctgtagatgaagtgaggcaattcttctctggtggctatctcaccacaacttgagcaactccactgatgcacatttcatgattatacaaagagtggaatcctgtcaggagcagacatgtctctagtcaaattatttttaaaaatgaaattgccttattgtcgtattctgtggaattctggtgccttgaaaactatctgtgcaaagcatatctgaactgttaagccttgactactctcaaccatttctgattgaagtatctcaaagacaaaccccttttataattatcaggactatgattctgttacttggcccttaacttgtattttcaatcatctaaaaatagtttgtaatagcagatataaaaggcctgagtatgcttttttttgtttgtttgtttgttttttcgagacagggtttctctgtgtagccctggctgtcctggaactcacttggtagaccaggctgggctcgaactcagaaatccacctgcctctgcctcccgagtgctgggattaaagtcatgcgccaccatgcccggctgagtctatgctttttattcttaaatgtgttgcatgggcacaaatcctattgaatagcaataatattactcccaattttttgaatcaatctatgaatttcatacctttgaaaagcttaattgtattgaaataaattctgtagaaatataagatattataacttcaatactacatcaattataaagatttctatcactgtaagat

SEQ ID NO: 29606 - DNA, 1133 bp, Mus musculus
acttgatccagcaccatttgttgaatgtgctgtctgtttttcactggaagtctttggccatatattttcttctgtttacctgtttggggtgtagatgtataccaactttgtatgatgactttctagtgtttctcttctttgccttttacacaatgttatccttttggcattagtataaggtttgcctaaggaaagaagaattccatgctaatctgtgcagtcctcagatactgtcagaggaaactcttcctgcttcaatctgacccatgatattaatgctatctaaagctaacttccttatttatttcattaaatattctcaaattaattcttcattaagtattattaattcttctttatgaaaatatcaaatgaaatcacatcacaatgtatttgattgtatgtcttgtttttaattttgggtgtagacactgactttacacttcttaactgatacaatagaaagaaaactatttcttttgagtcattctttttttttttgatttttgttttttgtttttttgagacagggtttctctgtgtagccatcgctgtcctagaactcactctgtagaacattcttcctggcatctccacattaggactgaccattcaggagatggtaccaaggactcgtttcagtaaaactccagcaccaatagcccagcaaagaacacagaactcagttacaatatttataagctgcatgccttgggcagatattccactatactattctattctccagcttttagaacccttgctacctgtggcttctcagggtcatgtgttcttctccatcattcttccacctcttcttctgctaacttcccctgcctccttcatctcctcatctgcctcttctttttctgtctttgccttttctaaaatctccagctctacctttcccttctattgcccaatcacaagatctggcaattattcgaccaattaaaatggagagaaggttcacatgaaactacatgagtatatcccactgttcattggggcagcccctcttgaggaagcagaataagcattaaagtacaaacagcaccagggcagtccacatttcgttcattcccttttgttcaactaaaaggctcttttctctcacatgtaaattgagcaca

SEQ ID NO: 29607 - DNA, 1191 bp, Mus musculus
gctccaaggagttatgcatgtgtctgtgtctgctcctcacgctcacccggttgaaagtcactgtgcatttgataaagttttcctcagaatggcaccctgcagaatgactgatgggcgccttcacaggcatcaggcagccactcctactttctccagcctgagcacacctacagagagacagtgttgggggtgacaggatgccccagaaaaattcaggatacttctgaaattgccatgtttgtctcagaacttgtatcttgcgtttggccctcagctttagcactttttcccacttgcagagtctttcagttgtgcttggtagccaggctcaacacaccggggctttagactcaagcagcttatatgggaagctggagacccctgccagccagagcacagtaagggctcggagaaggtatgtgaactagggtatctgatgtggtagtgcagttggtgtctggcattgtgacgacaagggacttgcctcccttcttgccactgaggcccttgcttttccttcagctcttggcctgttggtccggtttattagtgagagctagtttgctccaggtggttaaaggatgtagcaggaggaatggtggaagatgggagctgcccgggttagtacagaagaggtctgtctatctgacctagcactgaggggttcacaaacctgtgaggtgcacctcactaattttggctcatccctgccttgctacaagctccctgtggccaccattctctggactgtaccgtgctgatgactgcagctggctacaaaacagcatgagaacctggccgctgttctcctactgcctccaccctcaggcaggcctcctcctcttctgcccctgaagcctcctgctgcttgctcctcctgcctccaccctcaggcaggcctcctcctcttctgcccctgaagcctcctgctgctgctcctccacctcagtcagtgctgaacttctcactgttgagtgttgaaattgttaatggtcaaagcagggaggatgccagtcaccaaggttgattgtcttgggaaagcagttttagagtgatgaatcctttgtaggacaggtagagagtatcttagagataaaaaaatgggctatgtcctctcctgcccatgtcttgtgctcactcgcccctcagtctaccctttttgctgggacagtgatggtcttggccaaggtc

SEQ ID NO: 29608 - DNA, 1175 bp, Mus musculus
gtttttgattgaccctctgactgtggcatgcctgaccctttctacactcgctctccctttactcttatagctgtgagcactgatgggactagggatatagctctgtcggaagagcgcttgccttgcatgaatgaaggcctgagttaatacctagcatttccccacacaccacacacacacacacacacacacacacacacacacacacacacacagaggacactgaaacttagactcagataagggagatgagtcccttccttgtcacttagttgatgagcatcagttagaatcctggcctcttgtttccaggttaggctcaccactgggatgctggggtctttgatgtgagcattgggaggtgttggtggtttcagcagagggggaaaagatcccaaaagcaggactgcaggccagagcagatgtggataagctctgctcagctgctactcagttctgtgtagatttaaccatgaatagaagaatcctgcctaagccgccatgtgcccaattgatccagtctctgtcccctcagggaattgtctgggacatttgctcatctgtgccagcaagttgacatcacccgagataatctggagcaggaaattgctgccatgaacaagaaagtcgaggctctggattcacttcagagcagagccaaactgctcaggtgagtggccaaggaccaagtgggggaggtggagcttgtctgccacctggtgtctccagtgtggacactgggtgctctctggggatttcgctttcttgtgagatgtttgcttggcactgctgaacgtgggatggacagtgctagtgctggaggcttaacagacagttccgctgtcctcaaggtgcttgcagatggggcagaatgacatccaggaaacaagcaaggcagtgctggatgtcacagctcatgggttgccctctgaacttgggcctcagcacttggcacagctgtcccacccagtttttgtcacccctataggtcatcagctctgcacattttgttgtgtttgagacaggatctctttgtggccttgactgggctggaacttgccatatgaatgaggctagtctcaaatgcactgagctccccctacctctactccccagtgctggggttaaaggtgtgtgccaccacacccagatcagctctgctttctaataggaaa

SEQ ID NO: 29609 - DNA, 1099 bp, Mus musculus
agttttgttcagtcaagaggtatctccctggcggggcagtggtgccttacgcctttaatctcagcacttgggaggcagaggcagttggaacactgtctcaaaaacaaaaaacaaaaaaaaaaagtagctgtagaccaggctggcctcaaactcagaaatccacctgcttctgcctcccaagtgctgggtttaaaggcgtgcgccaccactgcccggctggcaagcaagttttatccacgaagtgcttgctttagtctggtttgggagaagacaggaacatgaacattttaagagggacaactctggaaagctctgtgaagaacctggattgtgtagtactggcaagggtatggggtgggagggccacccctctgctccctggtatagagacactcagttaggcctgagtggcaagaagcagccagtcatgtgaccagaaagagggcattcaaggctggagactgccctaagcaggttaagccaggtgctgagcaggatcagggcggtgtgaacttgaagccttgaggaaggaccaggagtttattctgagatgggagaatgggaatgagcagagtatacactaaggggaaataggtacatagacagggcaagggggtcttgggagcccaagggcaggaggagacatcccagtcatgacatggacatagaagtggtgggtcttggtgttttggagggaggactgttaggcagtggtttgtctgtgggaagcgagacctggagggcagctccctgatttggggttgtgaacagttcaccctaagtcagttgtgcctgtcagatacccaggtgcagatgctgaggggggtgatgagccccatgagtctagactcattttaatagggggccatgtcacttaaagccacagtgctgaaccaggttagggtgctttcaggctgtaatctagcactccaggagagtgaggcaggaggatgacatacatagagagcctgcctccaaaaagaaaaaaattgaataaaatcagatattaagatagctttaataggaactggagagatagctcagtggttaagagtacttgttgctcttccacaggatctgggtttaattcccaacacgc

SEQ ID NO: 29610 - DNA, 1359 bp, Mus musculus
ctattagttaactctacgtcactgcaacaaaagcgatttgctgaagaaagtttattttggcttacagttcaaagaggggcaactcatcatggtgggaaagacacagtagcagaagtaggaggtggctggttggtcacacggcttctgcaagtcaggaagtcgggagagatgaatgctggtacctagctacagtcttggatctcagtccatggtataggacaaccaatatttacggtggctcttcccgcttcagtctaatgtagaaaatcttacgtagacaggcacggatgcgtgtttctgtggtgatttaagtcctaccacattcaatcaagatgggccatctcaggaagtaaggacagctctaccacacccagggcactgctatcttttattgctgatccaaagctctaccttctgtagctctcacctttgttccatctcttctgcctccagccaggccttcctccctaacgtgcaacctctggtattacaggtgtggagatgaagaggatcacggatgctcacacgccatctggcctgaccgtgaacctgaccctgtactacatgctctcctgctctccagccccactgctcagcccctctctgagccacagggaacgcgagcagatggaggcaacgctcaactatgaagaccactgcttcagtggccatgccaccatgcatgccgagaacctgtggcctggccagctctcctcagtgcagcagatcctgcagctggctgacctgtggaagttgaccctccagaagcgcggctgcaaggggctggtgaaggttggcgctccgggcatcctgcaaggcatggtgctcagcttcggcgggctacagttcacagaaaaccacctgcagttccaggccgaccccgaggtgctccacaacagctatgcgcttcacggcatccgctacaagaacgaccacatcaacctggctgtgctggtggacgctgagggcaagccctacctgcatgtgtctttggagtcccgaggccaacccgtcaagatctacgcctgtgaggcaggctgcctccatgaccccgtagagctgacctcagagcctggaggccacaccttctctgtcatggtgacccagcccatcacaccactgttgtacatctccaccgacctcacacatctgcaggacctgcggcacacgctgcaccttaaggccatcctggcccacgatgagcacatggcccagcaggatcccggcctgcccttcctcttctggttcagtgtggcctccctcatcaccctcttccacctcttcctctttaaactcatctataatgagtactgtgggcctggagccaagcccctcttcaggagcaaggtaggttacctc

SEQ ID NO: 29611 - DNA, 1430 bp, Mus musculus
tagatctaagacattatccctgtggtctgcttccctgtcagtgtgtatatttttctattttgagatggcctcatgtgaacttgctgtgtagtagaggctgatatgaactctgatcctcttgcctctacttcccaagtgctgggatcctggagagtgttcacccccgtgcgtggctcccctccctccccgtagctgtttctgcagcttggctgtgggttggtggtaaacagtgctctcttgtttcactgagcaggaagatcccagtgtctgagtgaacctcgagtcctgctctcggccaccgtttgcacaagacacccagcactgagcatcctgctgccgcatgaacagggagcctttggaaggaccaaccctttgtgccttgtgggggacagtggctcaggagcgctgtgggtacaggagtctgcactggagggaaggagggccgaggacttgtgtaagttttccagtcagtaaacaaacccatagggagcatacttgaagctgagcgcacccctccacttcccccatttcttcttctatcccaggaaatagatcctttttgaagacgtgtttaggaaaaattgtgttcttttcctaatttaatgtgttctttcttgaatggatttctaatttatttttgttgaagttttgctgggtggcttttcttccaccttagatcaggactgttggtgacaacaaccgatccctgccacctcattggcacccagaggccccacaaagtctgaaggctgggcctgagtcccagatggccaccctgcctggggaaggcgtgctccctgccctccctggtttgcacattgcctctttcttactttgagccaggggtctgtgcttttgtactttgggtccctgggagaggtgtttaactttctagtgatgatggttgttgggttttgaaataccaaagcttttttgttcttttttaaataaacatctttcaaacttccattactggtctgtgtgtggttaaacccttgagcacattcatcacatccccccatcactagattcttggggtggtctccagcagtacactcgacctcgacaagccgccttctcttgtgactgttggttgtgctgcttcagggcctggaacatctcccctgctctgctgtaggcatctcctcccttccctgccctaagggttctggaccctccagccctgggtttttccagctagagggaagaggcaacaggcagtgctgggcctttgctcacaggaggagagggatcagaaagggactaaaggggtgtgtggggggatagcagctcctgctggcggcttcacccttggagtgtctccccccacccacccccggggggggggggggcttccctgactttgtgactcaccaggaagcctggcctgattccaaggatttgtgtgtctaccacaacaggtgttcaag

SEQ ID NO: 29612 - DNA, 3174 bp, Mus musculus
ggagaaagcaggtggcccagagtccccttccagtccctcttcctctcctgctaccagctttctcccatttcaggacccactgattccatctgtgcccaggctgccatgactcctaacttcccctgagaggaggaagtctgtgtcgtgtcctcacgctatccaggtcccagttctgtctgtctgtttctacatcctgtgtacattgacgggaaccagctctctttacacacagtcttcctggtgggttttagcctgtgctgacctgggtgttttctccttgccctagatcgtggggatcattacacggcacaacctgacaaatgaattcctgcaggcccggctgcggcagcattaccagaccctctgacagttgcacccggctgaagccagcccactctcccagaggtgcctctgcaggtggcccgctcacttactggcccccacagccggcatgaaggctcccactcacccgtttgctcagatgcctggagtcctggaagatgggggtcagaagtttttggggatgtgttgagtaggaagttggggttttactaacttcctctgtaagaatcttccattccccagctcccctaaggagacgtcagggtgccgtcgggctggatcctaggtggacacttggtacctctctgttgctgtttcttggagagcccagctcttgcccagaccctcccgggaaggtgttggactgaggcaaacattgaggatgttatttgcatatcatgttcattactaggttcaagaattgggcactaagaactgttccccatgtttggggaggcctgggatcagaaccaagacttcagatacattctgcctcttcattggcccaactttcttctccttctgtttcctaggagcgggttcatgctctgaccccgtggcttgaatgtctttagactcattcctgaccagatccttgatgcactaaaattccagctaacagcctttgaagcattaaatcccaccacagggggacagcttctcccttctgtgaacattcagtagtccccactcactgattacacctgttctcccagtgacacacgctctcctcccattgtcattcctttcctctctacaactactcgactttctaagccttcatctgtcttcctggtgggacagccacaactttatcttggattcattcccaaagtcaaccaaaattgaggaacccctagacagaaccactaccagagtcctggtgaatttgagatcactctacaagctggcaagcaagctgtcctgagccaggaccgaccaaaggtccaaccttaggagaaagccaatggcccctgttgtggtcgctactcgagcccagcttcccagtgcactcccgactcggcctcttcccgaggacttgtaggggaacctgtgtggctgctggtctcggggcccaggtaggagtgggatgctcttgcccttgtgcttcattacttcatggcttctttctctcctggctgctggtcctctcggaaccaacatctgagtagggacatttgcattcatcttcctgcaacccaaggcccttgtggcagctgttctttggatacatgtggcattcatttgttttagattctttttaaatcatggaacttggtggtaggcatctgtgatacgcttggcttctagtagtgtggccaccaggcctggcagagtcctctgaccagcactcgggaaattgttccacggccatggtcaggggctaccttggatctttagggctgacagtgaccctggccctctgttttccccatttgcttacctttttaccagaaagagcttgacttactctgttttcaacttctgactgggggttgggagtggggtgggggttgaaactcttcccaagtagttgggaaaatagctaagcatggttgtgtttggccgctgccagcttcattttatggctgatttcaattcctgccctgctgtgtgctctatcaagaagaaaaccagttgctcccactaagagaaaagtgtgacacaccacagaactgtcttcccagcctggtgggtttgcagaattgtagcctgtggaggacctcagtccacagcttccctgcctccaagccagtcctgttgtgatttgtccatcgagtgtgtgtgtgtgtgtgtgtgaccatcagtttagcccagagtggacagggtccaggcatacccaccctggcccatgctcctctaggacactcagttttctgggtccctgctgaacctgcctttccagaaaagcccaaagacaacagctttttcacctgtgaactataactaagccgtggacccctccacccatggcagtcccttcgaactagtggctcagtctcttacttgtcgaagcttggtcccccaccccatcccccaatgcaccacagcaccttgtcagacacagttccatggggggtcactgaggttggcttgaggcagtttcctggctggcttctgcgcctgggcatttgtgtggctccggtactgctgtgggagttgggtattttatgagatgtctgcatgtgaccttgttaagcagttccagctgggacggacattagcttgactcagctagccatgtgacagtttgatgcagaccttggtgacaagaaagcttccggagaggccagcccagccttcctggcccagccatgttgacaaggagagttgcccttggctcctgtggacctcagagactgtccagttgcagcttccgcctttcggtcatactgtgtttatacggtaacattagctgattccactgtgtagataaatggtatcttttttaatttgtaaaagtctatttttatttggccctttggaaggtggacgttcttgtggtcactcttaagtcagaataaaaatgtctgcaccttctctgtagaccttgtctccacggtgctcgctcgctcttaagtagggaaagttaaggcgctgtagcaaagcagtctgtttctaagacaaggtctgatggaacgcaggcgatgacctgagctgccctgcccctccgtaccttccacatgctgggattccaggtctctgccatcagacccagccaggaaaggcagtctgctggcccgcacctccctttcactgcctgtccccacccctctttcttctgcggcacctgtcacctatgcacacttttggtctgttgatcttttcttc

SEQ ID NO: 29613 - DNA, 1163 bp, Mus musculus
gggtgactgcagtggagagcagccttggagagaatgagcagaagcagccaggaggaggaggtccttttattgtcccagagctccaggcgctggcccctccaactgtgggcctgttccctccctcggaaggctgggcttggttctcttatttctcaggaatatttcatagctgctgctggcccctactcaccccatgcctgctacacctgagccactgtaaactgtttccaggagcacaggctgctgctagttcttctcatgggctcttggctaccaaacgctggtgccacttttcaaaggcttggaggcagggcaggaagtactgcttgtctcaggctccctccagggtctgtactgggcctgtcagacttgacacctaagccatgttctgtgtgtctcaaccagaggccctttcctttgccctggcagccagcccaccctgtctctgcccaaatatctaggctcagaatagactggacttgtgacccgggaagctatgccccgtgacctgcaaacaagacatctgttctggacgcaggccctgcaaggaccagcatggggagccactgccacaaacagactggttctctgagtgagtgaaactgatacttggctgggcttgaggcccctagtcaagggctctaatgtccaggctgtgtgctctgtaaccaatggccaattcaactgaatgaggatagcgcagggtggtgagcagggacaccctcccctctccctggctcagcctggaggtggcactggtcttggagggctggctgggtgaaccaaggtaaagtcacctggaaaaggacccggctctcttctctctggtgtagctgttgagccacccggagctgaaggacctttttctgccatgtcctccacgcctgttccaggtgccattgtctgagctacagagagagttgatagaaaagatcctctgccatcctgtcagccctggcccttctgctgccaccccagggtgaaggagatgtgacaaggggccatcacctaagaaatgttaataagtgatcacacctgagcccatccctaaggctttgggcatgaggtgcaattagtagttagtgcctccagctagccaagggatacataggatgagtggggagttgttcccagggcctctgcttggtacagaggagctgagc

SEQ ID NO: 29614 - DNA, 1158 bp, Mus musculus
gctgaaaacatctaagcagaggctggctcagtactgcggtggagctcaggccagccctgagattgacattatgctcctgaattaagctttagatgttgccgaagccttgcctctcacatgtggcctgactccaaggtctgggctcccaactaatgcagcatacacaggggattcacagcaccacagaatggctcgccacctgcacgtgttgccaggggaaggctacctgggcatgcatgaacctgtggtaaagagcaggaccctgggtaccattctcagtgtctgcgtgtttctagaaacctcagtttatcagcatatcagccctgccttcactaacaagaagagaatgaaagtacatatacttttaaaaggttctagtgtactggtgaaatttcacgacgctgaggcaagagggcgagaggctgcctcatgagcttgaagccacctggactgtataagctgggtctacaaagcctgtaacatcaacaagcccaacagcatgaggcccatggtgtgccagcaccctgagcccgtacgaggattctgaaacccagcaacgctagtcttgcaattctgtttcaaaggcaaagccactttgatgccttatgttctttccaaagttaattctgttcctctggcatctgagcaagagtcttggtgaggccagattgtctttgggaacactgtctagcctgccagggacttgggctgagtcccctagttacatctgcagacctctaggcagtgttgtttcttgcacctggcatttgtgattatctctctcctcctgataggccttcagcctctcactgttgtgtcagagctaagaacttctggtctgaaggtgactttttggtacagaaaagagaaaaacccaaatttctactttattttctaaaatgagcacattgcatttttccaattaaaaaaaaattgctgtctccatatagctgtttttaaatgcttagcgtaatttatttttgtgtgcatgtgtgtgtgtgcgtgtgtgtatgtgtgtgcgtgtgtatgtgtgtgtgcgcgcgcacgtgcgtgtgcacacacctatggaagccagaacaggccattgagtcaacagatcacccggagcttgagcttcacagggttgaaagccaccaatgtggatgtgggtgctgggaa

SEQ ID NO: 29615 - DNA, 1766 bp, Mus musculus
cagtttctaggcagaaggaaggcctggagtatcagtgccgtgtctcttggaataggtcatgcttgcagagacgaataaggtgaggcaggggctcagcctaagtagctaagacaggtcccagagcctgcatccctcagatccagctgaccttagggaaaggtggaggaggaatatctctggaagagccccaaaagcagactagagcaggggagctgggctttctcattggtcaatggctgtcccacagtggatgacaaacttccagctgatggaggagaggccccgaggcaagcagaataggtgggtgaagagaagagacatgccctagaggcagcagtgggctagagagggtctaagtggaggggcagccccccaggaaggctggcctggaacactggccagcatgtggttaggaagtggtgtggctggagcgcttagtgtcagatagcagaagagcaggttgggagccaccatggggactgccttccactgagtaagaactcaagagagcatgcatcggtatccgaatctgaatgtgactggttgatactccctagaaggatactttgtacttgttggctgtgggaatgtgacaactgtcacctcctggacacactctgaaggtgggcctgcgggaactgctgatgcaccgaagagagaagccaggaatactaacagtaggattggggctgtaccctgtagttgccactgactggaaagccaagaggagcacacaggctggtggggcacaggatggccaggcagggtccagaaggctgtgcttgtgggacggggctcttcaaccagctgctctcacgggcacctgcctttgtgccacaaggccccgtggtggtttggaaacaggctggcccccaggttttagtctagagcctgccgttcttgggaggtctcttacctgttgcctgcagagctgaagtctcttgtcctgtttgcaagtctattgcttgcttgttgagttgaatcttcctgagaaactgcccctgaggcactcagtgttctgtctgccaaactgctggtgtgccctactcagtctccagaacagccctgtaggtccagccctctctgcaaccagagaaccttgttttaaatttcaaaggaccagtgagatggcctgttggggaagggccttgtcactaaaatatgagtttgatctctgggtcccatagggtggaactgactcctgcaagttgtcctctgacctccatgttagtactgtggcacatgcctcctccacaaataaacgtaattaaatctaaaggtaccctgagatttctgtataggaaacaactgttttaaaaaatctcactgtggggaggcagagacaggcagatttctgagttcgaggccagcctggtctacaaagtgagttccgggacagccaggactatacagggaaaccctgtctcaaaaaaacaaaaacaaaaaaccaacaaaaacaaacaaaaaaatctcactgtgtctcagtttcctgttctgaaaagtggggataagatgggccattgagatagctcagtgggtagagggtacatactgccaggtctgatgacctgggttcgagtcctaggacatgtataagaagagacttctcacctccatataaacaccatggcacttggcgtgtgtgtgtgtgtgtgtgtgtgtggcacacgcacacacggtaaaaatgtaaaataaagtgaggataaaaatcgtgtgtgactcagggactagtgaaggttgagaatagtggaacctcgatggtaata

SEQ ID NO: 29616 - DNA, 1123 bp, Mus musculus
tgagtcatgtgcccttggaggtcaagagcctctagcttctcagtggagaagagcccagtcctaattctccaggctacccctcccttcaagacacctgttaacccctgggctagagctgtggttggttttttcccctcctaccccataactataacacactcctactgaactgcccagagtgctcagggccagccaggcctcatgggttagtgatcactgccgctcgggctgccccatggtgatcagcccttcctagaagctctgtgagcttgtggtcccgctcagcctgctctgcaaaggggcaaagttcctgtgcctgtcacggcctcatgacttggtgtctgagaaccccaggcctggatgcagtagttcttcagaggcccctctcagagtgctggcattaaaaattcaggggttctgtggctgctctgtgtctgagccacgattgagctccaagcacagacccaccctgctgtcttggtatgatttttgcctttgagtcaagagcctgatggaaggaagggctacctgtgggcctgtggggggagcctgactgtggccaaacggtcagtgtggcatgtggacagacatctgtcctctgaatctaagtgactatcactgcctctgatactgacccatgaggcagggcatgggtgactccctctatctcctgcgttcttaccacagtcgactgcctcctgaggttccagggcccctattcttactgccagatctctggggacagatacttgaagacttatggggaaccacaggctgaggtgactgtcctgaaaggactgtctgcacacctgtggacaggcagggaggctgagtgacagcatctgtgaaaagtgaaccccaccccccacccccgcctctggacagggtcactgtggaacaccatcccatacaatcagcatcccatacaatcagcatcctgagcccagtgtgagcagagtgaggagcagcgtgtgccactagagggaggtagttgtgaggcaacctctcacaaaacccttaggtttgtttaggttgtatgcagcacagtataaaacatgagccggggcccagagacgaggctcagcagcaggtgaaaggagtcagtctactacttagcgtgaca

SEQ ID NO: 29617 - DNA, 1177 bp, Mus musculus
gaggcagcagtcttgctctgctgcccagagtggcctagaactgctgggctcaagcaagtttcaacccttagctttctgagtaactctgactccaggcagttacggtggcgcctacctctaccctaagggctttaactaaaagtcctggaacacaatttagaagcagagtgcttgctcaggatacacgaggccttaagttccatcgctagcactgccaaaaaaatttttaagagcttagttttgttcttgtggtttttgaaaaccaacctaggctgacctgacctagtagtagcccaagagatcctcctgctttaggctccttagtgcttggaacacaagctgccaagtcccgcacattgttcacattacatctcttccaaacgcacctagaacaggcccggaggacttccaagggccacactccacccccaccctgtaagcgcttcctggcagggtttccggtcaggggtggacctgcgatccagaacctgatgggaggggaggagtctgctgtttcaggtcctcagctcactgtcttccccctaccactcccaggtctgggaacgtaattctctgttgccaccatggtccacatcaacgagctgccagagaacattctcctggagctgttcatccatatcccggccccacagctgctgcgcaactgccgcctggtctgccgcctctggcgagacctcatcgatgtggtgtccctatggaagcgcaagagtcttcgagagggcttcttcaccaaagaccggtgcgagcccgtggaagactggaaggtcttctatatcctgtgcagcctgcagaggaacctccttcggaacccgtgtgctgaaggtgggccggccgggggcgagccctgggagccttctttacttccctgaaccgcagggccttggtgcttgcctgtccacgctagctaacgacaaatgtccccgtgtccctaacagtcctacactttggttccttgttctttgggtctcggaccagcttagagtcttcatctgttacattgttttataggaatgtttgggggatggggacatgcgcatgccgcgggacactcaagaagagagagtagcttgtggagttggcactctacttccatcatgtgggtcccagggatccaacccaggttgttaggcctgacagcaagcaccttacctgcata

SEQ ID NO: 29618 - DNA, 1183 bp, Mus musculus
ccccgcaccccgtggtaggaaccgggacccaaacaaaggcgggcagcagataaaaggcggcggcggcggcggcggcggcggcggcggcgagtgcttcgcgtgcgcgctggggacgtagttgtcacggacctggcggcggtctgctcgccagcgagcggagcttgggggccgctggcctcctacagctctgaggacctttcctcctgaaattaccctcaagggacaagtgttcgccgcggggtggccgaagccccttaacccctgcggcacccgtgtatcagcctagctcggctcagccagcgaggtgagtgagactgcccctgggcgccatcgggactggggatgcgctactctggagaggggaagggtctaacgtgccacatgcgcccggtctgggggcggggagaggggggagtgcgggaagttctctcgctctcaggccacccccggcctcaacgccctgagaaagccggctaatgggacagagttcagatctcagagcttgtccctgcgcccccgaagcttgcaccaacacgctggggacgggctgcagcttcggtctgcgggagcgtgtttaatgtccagaatcatcctggctccctatctccatacccctgctcgtctcggtaggtgtctgtctgggttcataaaagttgagcgtcagcctgaagccatcccaaatccggctgtccgccgggacttcagaggagggagggaacaggaaaaggtaacgatggcccctgtagctgccccctacttgagcgcactcacgcgcttggtgggaccttctttgagtcttgggctgcggtgaacccgctgcaggtgccgctgcgtgccagccaggacctctgaagctcaggcaggcgatggaagtggagcgctagagggtccctgggtcgacccagaacatccataaggactgtgatggggtggcatctgagtagccgtggagcacagtcaggaaaagatgaccagcacgagtggcggcgagtcccgagagctagccctgccgctgggaggacttttcccaactctcctaggagacgcctccccggaggcttcctctgttggatctctgtctggtacagggatgcttcctgagtctgggtgcgggtgctagtctggttgcactctcggtcagtacctcggacagcgcactgaacccaccagccccaagctccac

SEQ ID NO: 29619 - DNA, 1109 bp, Mus musculus
gcttttctatgtctttggcatcatcctggcaccagcaggcagcctgcccagactctgaggagaccagcaactcccaccacagcacagcccctcctcaggcagtgcagaagccagagactgagaaggggtgccactggccagggtgggtgcacagcataggctgcaaactcctgaacttgtgtgttgggattatcttcctaaagataacctgctcgtgatttgtgttccatgttacagggaaaccctgaagccactctagtgtcgttcctgtgttatttataatctccactagagggtgtcatcaggccactttaggatggaaagtccatctcccccttgtcctagacagaatgccctgacagtttgtgaaggagctgtgtcccaaaagagccatagtaactaggcatggtactgacccgttaccttggcacgtaggaaattgtactaattggtgccaggccccatttatacagagcgcttgtcccctgaatgtgctgcctgctagagaagggccctcattagcaaggagtgctcctggctttttgtgtagttggtggttcagatgtttctgtcctttatgtctcccttcgatcctcgccactgtggaggaaagtgtcagatcaccctgtagcaagacagttaagcctggggcggctgagaaaagcactctgctttcagtaaaacatggcatggtggctgagggagctgcttccctctgtagactccactaggaaggcagtgattctgggacctgaagtggcagtgggatgggcgtttaaagcccaaagggctttgtcccctcccagctgcctcccctggtattcctcttgcctacccaggatctctgtccctccgtctgtttccagtgccagactgtgggcaacagcaacacatgagtcaaggacacttacccctctccacagagccacaagatgggcaaatcagggaccttctgaatgtatgagtcagtggacagcagtcctggccacactcagctggaatgtgaggccctgccagagaaagaactatgagcacgggtccttcatctctctgtgctctgatgccttgttcagaatgtggcttcagtgaggtcacacccaaaggaccag

SEQ ID NO: 29620 - DNA, 1196 bp, Mus musculus
atgcgtacagtagattaggtgaaaaagatctttcagggttctcccacgagtttcacagtagttctcgacctgtgggtcacaatccccccttttggagtcaaacaaccctttcacaggggtcacctaagaccaacagaaagcataggtatttacattacattttataacagtaacaaaattacagttatgaaatagcatcagaaatagttttatgctgggcagtggtagcacacacctttaatcccagcacttgggaggcagagacagatggatctctgagtttgaggccagcctggtctacagagtgagttctaggacagccggggctacacagagaaaacctgtctcaaaaaaaaagaaaaaagaaaaacaaagttttatgtttgggggtcaccacaacatgagtgttgaagtgttggggtgttaggagggttgagacaccacacaagggcaatagctgtggaggtagaaacagagaagaggctggagggatgggaccctgaagaggtgttcaaagccctgtttgctcttgcagaccctgatatccgctactgtgtcttggcatccctggacgagcgctttgatgcccacctggcccaggcagaaaacttacaagctctgtttgtggctctgaatgaccaggtctttgagatccgcgagctggccatctgcactgtgggccgactaagcagcatgaacccagccttcgtcatgcctttcctgcgcaagatgctcatccaggtaatggctggccggcagggaggagcagacctccacagcgaggggcgccctggggacagggagggaagaaggagggagaccctttaccacgtcatgtttgcaccaagagtctgggtttcccagctctgggttacagtccgagtgtgagcctgtcatccgcaggatgtgaggtgctttttgggtccagactcacctctcaggcagctcctctgtctctgtggcaagttttcagcaacccagtgtcttggcactcactgcttttgcagagtaggactcgggcctcccactcttctctaattgcttctgtcattcttttctaatagtagacaagcacaggggctggctgtcttaacatggtgtgattaccacatgatcctgtggtcactgcacttggttggggctcattgacattcatttttaagtgatgtgaaatgtgtatgttctctagagagatc

SEQ ID NO: 29621 - DNA, 1219 bp, Mus musculus
cttactggtagctaaggtctgagagattaaacagggctaggtaggggagagactaaatttgaagcaaagagtccccaaatgtgaccttgagataagcaccatcagcatccttgttctggaagcgttttgggaatgcaggatcttgggctcaagctgcagattcaggaacgtaggctgtgtcctaagcctctgggtaccagtgtccaacaagtgaagtcactgtgggcagcatcgtgaggactttgtcttttatgctgagcaagactagaaggcttgggagactttgatcacaggacaaatagaattgatattttaacatgatgattgtcagtgatatattcagaatggactgcagagaaagaaacctgggcattgaggaaagccagtggagggtgatggggaattggcctggaattacatctggagtgggaaaggagttgtagggacttttacagggaagtggctgccctccagtgcacagcagtgtgttctgccatctgctctccagaataagagtccttgctgtcttactccctcctcttgtagtaccagatcttcattccaatggtgaataaagtcctcgtgcgacaccggatcaaccaccagcgctatgatgtgcttatctgcagaatcgtcaaggtgagcaggcacccttctgccctgaggtcttcagcatctttccttcttggcattttgtcatagcaaagggcaggccatgtccagcttttcagccctggctaggactggcagacaggctgctggagaagtagtgtttttcagcactataggctgtatggcttctctgtatggtttctgttgaagccatccacataacacaaaactaatgagtctggcctcagtccagttagattttatttgtggacactgaaatttgagtttctcacaattttcataaattgtaaaggattaaattttattttgactacttgagattgaaatgaattgtttttagctcctaggctgtatggaaacaggcagcaagctgtgtgccattggtgccctaaatagctgatcgtttatttgtgctcacagtttgcctttgtctggcttttttatgacttacccattaaaggtttgtccgtgaccccagcagggagttcaggcacatggttattttgtgtataggtgccatgcatactgcttgttgaaatcctggctcttgcaggtagggatctcctgaggttcgtgcatgttttat

SEQ ID NO: 29622 - DNA, 1139 bp, Mus musculus
cctgggctgtcaggagtttgccgtggacttagaggtaccttcaagtcacctgtgctgaaatcttcattgttttaccagttatctacttgggagtctaaagttagcactaactgtaatgtctgttggtctttatatgtgggggcctgagacaagtattgctctttaggccagactgactttaaactgactgtgtaggccaggccggcctcaaactcaaacccatcatcctgccctaatttttttttttcttctaaaaatcagttgtgtaacttgtgtagctagccattaagaactggtaggagaagttgtgtagctctgtgaagtattcccagaataagaactgaaaggtgaaggagcccctagtaaccctctcctctcccccgccctcccccctcttctacatgggtcagcatcactcttacagaagcttcctaggactcacctgcctcatgcagatctccacccggacagaagacttcattgtcgacaccctcgagcttcgcagtgacatgtacattctcaacgagagcctcacggacccagccatcgttaaggtcagcccttctgcttcctgcctgagctgggatcacagtgctttttggcctagagctagcgcagggagaaaccctgtcatctcctaccctgccattcagcacgcctgtctgcttaactctaggtccccatgaggacattcacagtgtagcttgctggtcagagactgtttcagggaccctagtcaattgcgttgcggacacatgtggagctctagagctccttacccatcccggggcctgaaagcagggcagcccttaccagtgcacagttacagacaggctcagagcctggggccagagtaaaagcagcaccgtaaactacatccaccctgggctgggggtgccatccagcagtagcctgcttgcctagcgtatgccagtgccagggtccagttcctaccccaaaaagaagggctgattgaggaggcagatggttagcctgctgctggtttgttttcaggtcttccatggtgccgactctgacattgagtggctgcagaaagacttcggactctatgtggtgaacatgtttgacacacaccaggcagcacggcttctcaacctggctcggcactcactcgacca

SEQ ID NO: 29623 - DNA, 1120 bp, Mus musculus
agtccttggaagcctttgggagtctacaacaaagggcttggggctgggaatggagctcagttagtagcgtgcttgcctggctcgcgtggagccctggtttggtccccagcacaacgtaaagctggcgtggagatgcacacctgtgagctcagcacttgggaggagacagcagaggacccgaagctcaaaggcgtcttcagccacacagtgtattctagataacggggggtctaagaggccctgccttttaaaaaaaaaaaagaaaagaaaaagaaagagaaagaaaaagcagcaagcagcctgctctgctctgcttcacacgagtatcaaaataggatagtgtttgtctaatgtatgatagcccgggttcaaatccaaaactggaaaggaaaaaaattgttttgtgtttttctaatggagtaatttatatgtaataaagtacataaataatatagtttataacatttgtatatgtgtatattgcttcaaggctcttagagggagcagcctgagttgaggagattgccttgcactgtggacaagagcacccctcacacagggccctgtagaaaggatatgctctgatgacagccatcagcacagccctgtcactagacagcaccctcgctggcctcggtcctgtgctgaggggcttaacctgctgctcttaggaggagtcccagggccatcgaggtggctcatgggtaaggggtcctaccaccatgtctgaaaagctgaactggatcccaagaccctccgtggtggaaggagagatgtgactccaagttgtgttttaaccttcacacatgcacggtggcgtgtgtatacacaaacacacacacaatgagtgaataaaatttcatgtaaacaggtggctgggtatgacagtgcacaccttttttttgcttggttggttttggttttggttttggttttggtttttcgagacagggtttttctgtatagccctggctgtcctggaactcactttgtagaccaggctggcctcgaactcagaaatccgcctgcctctgcctcccaagtgctggtattaaaggagagtgccaccacgccgggcggtgcacacctttaaccctacacatgggacgcagaggcaggc

SEQ ID NO: 29624 - DNA, 1149 bp, Mus musculus
acctaacctcccagtgtcccaggacccacgtccccgactgtctctgcccgcagtaaaacctacggcaacgtgctggttctggatggcgtcatccagtgtactgagagggatgagttctcctaccaggagatgatcgccaacctgccgctctgcagccaccccaacccgcggaaggtaccgcattgcccctgggttcagccctgagctcggggtcctagaaaagcatgtcgggctgacactaggtgaggatgtttgggggcagatgctacccagatgactgtcagaaaatgcgggtcggtcaggatgaatagagctcctgggagagctggtctccttagaagccccgagaggggaacccaggctgccaggaaggaccccgtggcacagaagcgttctggagagtagagaatgactcagagtcctgtagctgggaagatcaggttctgtgggagtgggcctgctcagtcctgacttgtccttccctggcccaggtgctgatcatcgggggtggagatgggggcgtcctacgggaagtggtgaagcacccctctgtggagtcggtggtccagtgcgagattgatgaggtgggtgcagtccaggaggcctggatttgagtcaccagagtcagctctgtcccatcctgactctgcaccccgaggcgcaatgttcttaccatccctgccctgtttcctcagtctgaaaagagggttcagtaggaaaaccagattgttaaggcctggcacacaccacaccatggatgttaactcttagtgctttcagagcccaggcagagccagagagctcaacaacttatggcatctccccttgagacccagcatggttttagtgagcacttactgtatgctgagtgttacccaaggtgctgggttgatacggccatggacaggtgagcccctgagtgtagagctggtgtttgggttggagaagacaccataacacagcatgacatgatgaggccagacagggataaaagatatggagaacacaggctgataggaagtgtgcagccacgcatgcttacagccccagcacttgggtagaagcaggacgatcaagagtttgaggccagcgtgagttatctgagaccatctctcaaaaatgcagaagctcagatgggacttggtctgc

SEQ ID NO: 29625 - DNA, 1798 bp, Mus musculus
ccagctcaaagctgactctccacgtgggcgatggctttgagttcatgaaacagaaccaagatgcctttgacgtcatcatcaccgactcctcagaccccatgggtgagccagggcacgcgcgtcctgcagcacacagcagccccagactagagccatgtgatgatggaggcctgaggacggtgggggtctagccttggtccatagtgacctctgcttcctctttggcttcttccctgtgcttgttggccagcatccgggtgtgctatggtgcagtgggggagggtttgaatgcagggcctcccaggtgctaaggcagtagggggccacatcccacaaacatgggtccagcacctgctttgccactgagctgctgtgggtgactgtggcctggaggtctcaggcaggatggccatgctctacccctctaggccctgctgagagcctcttcaaggagtcctattaccagctcatgaagacagcactcaaagaagatggcatcctgtgctgccagggtgagtgccagtggctgcacctggacctcatcaaggagatgaggcacttctgcaaatctctcttccccgtggtggactacgcctactgtagcattcctacctatcccagcggccagatcggcttcatgctgtgtagcaaaaacccggtgagctgggggtgactgcctgcagggtggggcgagggcaggcactaagagccccatcttgatgctctttgtccctggttcccagagcaccaacttccgggagccagtgcagcagttgacacaggcccaggtggagcagatgcagctgaaatactataactcggacatgcaccgtgccgccttcgtactgcccgagttcacccggaaggtgagtggcctgccaggctccctgctgggcctcatcctgcacagcttgcacatcctcctgactgccttcatgtcccaccaggccctcaatgacataagctgaatccaggtgccactgtgacaccacccgagacctcaatcggattggaccaaggatcttccaagttgtctggggaccaccagtcctggaccagactcccagatgactcttgcccaccaaccaagtgttacaggccccacgatgctgcctggcctggcctggcctggcctgccctgctgggtggactcagtctctgtctgtctatctctgtggcgttcagccccacgcctataccagctctgtacagcaccgcctatgccctgtgacccaacaaaatacatgtgtatttataacaagctcagtcatgacctctgaccttttcatttttgttcctaccagtggtactgccggatgttgggtgttctgtgagctctagggagcctgctctagggcccagtgtaagggtccaggtagggcagcctgaagctatagcttttcaactgcccacgggcaagagtgttcctagcttatggattgaagcagggtgcatcatactttctcagtgaggcattgcttctgctgtggatataaacctgagttcaaatccttcccaggtttccaaagttacctgcatgggcctggcctctctccgaggtgctgaacctgaccctccactgcatcgcagcctcttgctggaaccaaggctccggtttctggagaggagcgagttacgggtcttcgtgtctgctctccccacaattgcatgtaaggctcgctagagcaggagtcaccaaccctttcctgccctcgccaaggggcacggaggggaaatgatgggaaaattgtgggttagcagggtctccaaggcagttggccccctactggagtgacac

SEQ ID NO: 29626 - DNA, 1873 bp, Mus musculus
cagtgttgatcagccttttaacatgtttatggatgacatagctgtagttagttacttgccgtaaatgaggttttagaaataaactacttggcaaagatttggttttgaaagtctggtcatcaaaacgcgttcattccttagaaataatgaagaacaactctttgaaccacagttgaataaaaggttttcttgccaccaacagtttagtgtctggagtcttactggaagaaaaaaaaattctatatcatgacaatgctagaaaagttaaggtgacttatgtgggaagatgcaatatagcattttcatcctttaaaatttgagtctccaggtgggtgtggtggcccatgcttttaatcccagaattggtgtaaatgagttgtaggccagctatttccccatcttgaggcaccctgtcttgccttgttggaagagccagttaaaatcaaacatgacctttaaggtcagcatcttagcagaagagcagtttatttcaggataacttactgtttttgatacataagcaaatgactgtaccttgtacagttacggttgacttccctgagcccaacgctcacctaagaaaagtgggctgggtatagtgaaacacctgttaaggtttttggaatgatttgctaaattgcccttgtaaagggtaaaatgctgtttcgtgttctttttatctgacaatttggtgaatctggtagaacatgcctatatcccaatattctggaatggacttggtgttaatttaatagctgatctaatgtgaaggtcacacacctgctttccgcttaccttccaaaaggtattctggaaccactcagaagttactcagaaagtaagagcactttctgagctcattaagaccaaatctacacactagacacaacaagccctttgttggccagaaatggaaacagccagtataaaataagtagattgtagggaatcaaatacaacttgttttttctgtgttgggggttggccaagcactgttaaacacaaatcaaagctgatattggcaagtgtttggacctgtaacaatctcacctgctctgattttggggtaggctgtcattcttaggtttgttactaagcttcccaggtacttggcgatatgaggaacaatgattggacgatgcaaattagaaattacttattatgttctcaatccagggaatatagttgatgacttttgtgtagaccccatactggtctgccgccccacaattaatggaaccccaggaaactattcctcccacaaaccatcgctgtgtctcattatctagaaacactaatgcccccccactgtcacctctgcagctgtccttgccaccagtctctaagccagcacagagcatgttagcgcttactcttactcctggatagagcttttcatacacggcggtacatttttggtggtcagcaattggtatgtccacaaacattaggtttctagcaagaagccccttctgggttaacccccagccagccacagttccagtgaagtctgttctcattaaggatgcagcttcttttcgcggtaggcaaacaggcatgatgcttccgttgattgtgactttgttcttgagtttaatcaatgctatatcattgtcaaaaccagcaccgtgagtgtagccttcatgtataaagatttcctcgggccaggcttgagtgtaatgaggtgagagccttttgaggatgcccattcggatgttcagggaggacgctgccattcttttctcatatacagcatgagcggctgttaggacccaattgtcatgtataagtgcacctgctgctgctgtagtttgacccagcaacaagacttgccaaggaaagtcaccaggctttgcaggctgccctccaacta

SEQ ID NO: 29627 - DNA, 1640 bp, Mus musculus
tatattcagcagtatttttgacatttttctttagaaaaaaagaggggaaagctaaatgaattttataagttttgttatataaagggttaaaatactgagtgggtgaaagtgaactgctgtttgcctaattggtaaaccaacactacaattgatctcagaaggtttctctgtaatattctatcattgaaattgttaatgaattctttgcatgttcagagtagaaaccattggttagaactacattcttttctccttattttaatttgaatcccaccctatgaattttttccttaggaaaatctccatttgggagatcatgatgtcatggtgtttgattcttttggttttgtttttaacacttgtcttccttcatatacgaaagtacaatatgaagccttcatttaatctctgcagttcatctcatttcaaatgtttatggaagaagcacttcattgaaagtagtgctgtaaatattctgccataggaatacttctgtctacatgctttctcatccaagaattcgtcatcacgctgcacaggctgcgtctttgacggtgggtgttccatttttatccgctactctttatttcatggagtcgtatcaacgctatgaacgcaaggctgtgatatggaaccagaaggctgtttgaacttttgaaaccttgtgtgggattgatggtggtgccgaggcatgaaaggctagtatgagcgagaaaaggagagcgcgtgcagagacttggtggtggaaaatggatattttttaacttggagagatgtgtcactcaatcctgtggctttggtgagagagtgtgcagagagcaatgatagcaaataacgtacgaatgttttacatcaaaggacatccacatcagttggaagactttgagttttgttcttaggaaacccactttagttgaatgtgttaagtgaaatacttgtacttccctccccctctgtcaactgctgtgaatgctgtatggtgtgtgttctcctctgttactgatctggaagtgtgggaacgtgaactgaagctgatgggctgcgaacatggactgagcttgtggtgtgctttgcaggagaacttggaagcagagttcaccagtgagctcaggtgtctcaaagaagggtggaagttctcatgtctgttagctattcataagaatgctgtttgctgcagttctgtgtcctgtgcttggatgcttttttataagagttgtcattgttggaaattcttaaataaaactgatttaaataatatgtgtctttgttttgcagccctgaatgcaaagaattcatagcagttaattcccctttttgacccttttgagatggaactttcataaagtttcttggcagtagtttattttgcttcaaataaacttatttgaaaagttgtctcaagtcaaatggattcatcacctgtcatgcattgacacctgatacccagacttaattgctatttgttcttgcattgtccaaagtgaaagtttttctttggtttgtttttaatttagtttttcttaagtctgggtgaccgcacctaaaatggtaagcagttaccctctggcttgttctgagtgcctctgtgcatttgattttctatttacatgctgtataaatctccactggggaatcatgcc

SEQ ID NO: 29628 - DNA, 1132 bp, Mus musculus
taccaggcagtttgttttggtttgctttcttttaatgtgggctgtggggttggagctctggttgctcttgcagaagactggggtttgagtcctagcacctacatggctgctcaccagcacctgtgactctaggcctgggagggatctgatgctttcttctggctttcacaggggttgcatgcacacaatatgaagctatgcagggcatccatccacataaaacaaaataatatatatttctttaaatgtgggctctggggatctgagctcagaccccctaagctagtacagtcatctacccgtagctccctgctctatgcctgcgaggatgagggcagctacaccaggctcctctttgtgatggatggaagctgttgggcctcagagaccatgttccacccagtatagcaagcatccagaagctgagcaggtgacctcttcagcttcagtttgcccctctgtcaaatggcaacaacagtacaattagtgacgaaggtgtataaaccaccggatgagttgggtagtgtgtctgctggagctctggctactggctgcgaacggggagccacaaggagactagatgtggcttcccctggggagagggaggttactggggcaggggcagccaccagacaccttgccctgtgtcctccagagctctgagctctgctctctgtgtccctgaagcgtggacacttcctggcccctgtcatcccctccgccctggataaacagcacctccacccgcccgccttctcagcccctcacgcttcaccagaattaaattcatcattcactttttatggtttgtacatagtgtaatttatgttttcaaatatagcgaggtcacactttaacggaaaaaaagtatttcacattgaaattgaaggcatgtgtgttccactaaatggggatgtttgggataattttaaaaggctaaaactagtagaaagtaacattaaaataaaatttgagagatgtaattacccctaatcgcaccataaaataatcaataccacattccattatttctgacttccctagttatagctttttttgttaagctcttgaatattgatgaggtgaaagggtcgtgtcttctggcggaggtctgatggaggtggaattaagg

SEQ ID NO: 29629 - DNA, 1208 bp, Mus musculus
tgcccctggcctgtgccctgtgcacctctcattgataaccgtgtgtctgcctgtgcctcgggtcagagccctttggtttgaacttgcctcatactgagaggctgagacgtgagaaaattatgagcaggggagaggagtgggaccttgtgacaactggcagctgtggagaaaggggcaggctctgtgcccagggtgagcgccatctgggcgggaggcctggcttccagctgtgggggctctggaagggcagagcctgggaggaatgattttgaagccactactatggagattaaggggatgagaatgtaaatctcaagtaaaaaggtaattgaatgtaatagcaaacactgctcgctctatgttaattttagctcttcccctggatacaagacgctgtattagtgttttattaccattttgtttgcactaataaaatagtaaaatttatttcaaggaagttgaaggatggttttacaatgcaaatttgaagaaattggacttttcatttatgcttcagctattttaaaccctgacgggtgtaaattagctacaggaaccaagcagaccccactgatggggattttggaggcgggagccctggcagaggttccagactagctgagggcagaaagtacaaagcactctttagaaaggccgaggccactgaggtgcctgactgggtggcacagggtggtgggtgagggtgtgccgggcataaatggctgtgggtgtagacaggtacatcatacactgaattggtagagagacacttgtgaccatagatttcagatctttgtctttcctcttgatcctttggccttcttcccatcctgacattggcctgtattagcctagtgaacccccaggggagctgagaaacttctgttttggctggacatgacaggtagaccagttgtccagaccacacttgccctctgaagacagagtacagattttaaggagaggaatcctcggaatttggaacctaaaagcaacacgagaaagacaggctagaagccaacaagacagaggttgacaggcacatctgtccttccttgttctttcttctatcccaggctaccttgagaaagtaaaacaggacttcctcagtgagccaacatcctttcaagtagggacaaatgactagccagacataggtgtggtagtgtctataaaccaaaaaggtttaatttttgcttttaagtcaa

SEQ ID NO: 29630 - DNA, 1154 bp, Mus musculus
accgagccaggcatggcgcagcacatttaaatattaactattattatagttaataacggttattcctgttgcattgggataaaagggtttttaattttttattaagaaaagctatttttacatcaatgagattattcctctaaacctgtcttgttcaatacaagttactctctggtcacatgtggctatttaaatgtaaattaattaaagttaaataaaattaaaaatttagttccttagtcagagtcaccctattgcaagtcctcggtagccacagagtttcttggtgtccagaggctgccatgttggacagtactggacattctgctaggcagccttcaaaacagtactagtcaaagatttccgccaaatctaaggttgtggctttggggatttgtttgattgtttgtatgtttttggttttggatttcgtttgtttgtttttgtttttttgttttgttttgtttccgagacagggttttcttttctggaactcagtctgggaagattgtcctatggcctgtgtagtcctctgtcacgtgactgaagcacactcttctgattggtttgcgctctcttcccctcccttcctctcccctcccctctctggactcggattagcacagagtcacctcttcctagcacttaccctgtgttgctctctgattggtgcaagacgctgagggattctgggaagaacaggcagcctgctgattggcttccaagtaggaagagccgggacaagagtccaagtactctcctcagtgtcccctgcttcccagggactggcttgtccactctttcacctcacagggcgggagacaggagagacaggaaggatttgctggagctaataaaaatgaacaataacgtcccacccttcactgaccagaaggtccaagatagaatttagagcctgggataaggagaggcagcctgtctcctttcttccctccctcttaatttttttcactttttaagtagtgcctgtgtgtgtatgtttatatactgtgcacatatgtgtgtgttcatgtgtgtgtgtgtgtgcacgtgtgtgttcatgtgtgtatatgtgtgtatggagactagagtgtgtcttcctctcttgctttcatcttaattttttttttcgagacagggtttctctgtatagc

SEQ ID NO: 29631 - DNA, 1195 bp, Mus musculus
cacagggttcctacttcctaacccagaggaccctcagtgaggacaagttggtaccaggtaccaactgaagctacagatcctgtgcttaatctctggagacagccactgagaggccggaagctaacacacacacacacacacacacacacacatatacacatacacacatatacacacacaaaagcacacacagacacacagacagacagatgcacatacacacacatatatatacacatacacacatatacacacacacaagcacacacagacacacagacagatacacacacacacatatacacatacacacatatacacacacacaagtacacacagacacacagacagacagatacacacacacacatatatacacatacacacatatacacacacacaagcacacacagacagacagatgcacacacagatacacagacagacagatacacacacacactgcttagcctgtcctatgtatgccctctttaggctgcctagggtctcatgggcacactggtcaggaagattaacaagggcagacacacatacacattgtaatcccatacagcaatctgtcagctgtccagtcatccatttagtgaggtcctactgtgtgccagaccttacagtatggccagacacagggtagtggccatatggaaggtctctgctcacaatacctttccatatagggatccccccacacacaccgccatctactttccgcagctcttgccagctgccagggaaattgacacgtcccatatgggtcagaaggctatgtgaggggctctgctcagaagccgtgagccacgatggtcaaatacatggaaacgcatatcctgagagcccacctgtggctatagagccctcgtgctacacaaaaataattgctttgacttgtgcacccagattgaccactccttcaaatatacaatgcccagtggccccagatccttgccttgtcacaagcggctcttcctggcccagaagggactgggtaatgacagcctagtctgctgctacagaaaggtctgctaagactggttcccagaggtcatggttttaggacctgtggtcccttaccaagccaatgcctactctagtcacgtctgtccacagtgccagacctgcgctgtccacacaaatccctgagctcccacacgtggacccatcttgaaactcagtg

SEQ ID NO: 29632 - DNA, 1672 bp, Mus musculus
tgctgccagggtgtcctgccctctgtccccttcttgactcctccctcagaattgttctcttctcttctgtcttcctctttctggcgctggcagagcctaactcgggtgtttcaggcttccctgttcttttagaaaagctctgtctttgtagatgataaaccagcctgcctccatcttgggcttaaaagacattttatagtaaaggcaactgaggttcattcctgtttaccatttaatctgtttctcaaggagtgctctatgccccacctgaaaccttaactacaaatggttactgtactgtactgcctgtaccaagaaatggcaaccatagctttgcttttaaaagttattataggctttctgcgctacccggggacgggtctatacggcgttgttcttgattcccatcgtaacttaaagggaaacttacacaatgtccggagcccttgacgtcctgcagatgaaggaggaggatgtcctcaaattccttgctgcgggaacccacttaggtggcaccaaccttgactttcagatggagcagtacatctaccaaaggaaaagtgacaatatctacatcataaacctgaagaggacctgggagaagctgttgctcgcagctcgagctagctattgttgccatcaagaaccctgctgacgtcagcgtcatctcctccaggaacacaggccagcgagctgtgctgaagtttgctgctgccacaggagccactccgattgctggccgattcacacctgggaccttcactaaccagatccaagcagccttcagggagccacggcttttagtggtgaccgatcccagggctgaccaccagccactcacagaggcctcttatgtcaacctgcccaccattgctctgtgtaacacagattctcccctgcactacgtggacattgccattccatgcaacaacaagggagctcactcagtggttctgatgtggtggatgctggccagggaagtactccgcatgcgaggtactatctcccgtgagcacccctgggagatcatgcctgatctttacttccacagagacccagaggagattgagaaggaggagcaggctgctgctgagaaggctgtgaccaaggaggaattccagggtgagtggacagcactagctcctgagttcactgctgctcagcctgaggtggccgactggtctgagggtgtgcaggttccctctgtgcccatccaacagttccccacggaagactggagtgcacagccagccactgaggattggtcagcagctcccacagcgcaggccactgagtgggttggagccaccactgagtggtcctgagcggctgtgcaggtgcctgagcaaagggaaaaaagatggaaggaaaataaagttgctaaaagctgaaagaaaaaaaaagttattatagggctggagagatggctcaatggttaagagcagtgactacatttctaagaggtcctgagttcaattcccagcaactacgtggtagcttacaaccgtttgtaatgggattcgatgccctcttctggtgtgtctgaaaacagctacagtgtagtcatataaatgaaataaatctttaaaaaaaaacgcacagaaagaagggagggagggaggaaggaaggaaggaagaaaggaaggaagaagaggttctaagtggaagcttg

SEQ ID NO: 29633 - DNA, 1569 bp, Mus musculus
atgggtggtgctgtgctctctgggtctcagtagcattgacgtccctgaagtgtgtcctgtagaccggaacctcagtgtctctagggcaaacccagctcctgaccttctgctctctgcgctcaggactcctggcggcgggtgatcagcactggggtgcaagcaggcattcccatgccctgcttcactactgccctctccttctatgatgggtacagacacgagatgctgccagcaaacctcatccaggtgagcgtggggcgggtggtaccttcacctggctggttccgtgggcctgagtatcaccctgaccctgaccaactgcattcctccctcaggctcaacgggattactttggggctcacacctatgaactcttaaccaaaccgggagaatttatccacaccaactggacgggccacgggggcagtgtgtcatcctcttcatacaatgcctagtaggcctgtggcttgccctccctcccagcaataggacagccccgtggcgctcagcaccccccctttgccctagttcctgctcttagccaagtgttggctgtgattgctgaagaagtcaccgaggtctatagtttctgaaccaccacatgctccacctccgtctctgtgctgcccaggacctgaccctgtgctgccactgcgtgacctgaccctgtgcgccactgcgtgaccactccctgactgagccgtgccatgtggaccagacaagctgcagctcttagctcacagagggggtgggtgtgtgggatcgtacaacctggacgtggaccatgcgtgtgggctctgctgtcctccagtcagtgaagtgtatatggttacactctctgggtgtgcctggcagaacgatctgcactgagttcactattgcaaattgatttgttttcctttagccttgttcacttttaactccggctttttttaaagactccaaataaaacaggacaggtagtgagtaaatctggagggaggtgcagagccgaggagtcggtgggcagaggctctcctgtcgggtatttcttactggcacagtaggtacctggatgttcacagagcatccgccccgtcccacttgtaataaacttttagactggtttggcttctttgtttcttctcctgcaccaatccttcgaggtgccaccctgctctgtgatggggctttcaatgcggtcagtctgtccctgaggcttctcatctgtcttgcttactgattgcattacctggccttgggccatcgcactgttaggccagcagggaactctgctctgtgacgctttttctggactgatttagagtcagtcccaacagtggcctgcgagcagagcagagcaaacagcgcctgtttggacagctgggacagggtctgtctctgactctagcctcagaggctctcggggaaggcagagccaacacagaaaacatcaaaccctcctgtgtttggctatttgagaaccaagacccctctgcctcaagccccctggagtagagagtgcatccctacacactgccaaattgactcttaaaccttcctagacctaagggccaccagggtttacct

SEQ ID NO: 29634 - DNA, 1186 bp, Mus musculus
atctttgtagttgaatgcctgcgtctgtgtggagaggctaacttggtctttcagttctggaatgaacagagctatgtggcccttccccataacccaggtcaaagcactcagcccttggtgcaggctggatctcttgcccctgtcctggcctctggttggatccctgatcggccctgtcttccccaccaggagaagctgtctttgctcggtgcttgtcctctctgaaggaggagcgggttcaggccagccaaaagctgaagggtcctaaggtggtccagctggaaggcagtaagaagtcattcctggaggacatccgtaaggtgactgcccctcacctcgtcgcctgtggtggggtctgtagaggtcctccaattccagcctttcccgttctgtcaccctctctcacgtctctgaggtgcgaatgaaactgggacatgggtgtggctactccaccaaccacagctctgaagtcctgtgtcactttccaggccctctatgcttccaagatcatctcctacgcccaaggctttatgctgctcagacaggcagccactgagtttggctggaccctcaattatggcggcattgccctgatgtggagagggggctgcatcatccgaaggtaggtaagaggcgaacccgggactgcagtacactgcccagcagtgcgtgccttgccctgtagccgggacagccaccctgccactcaacactgcagcgtgtggatcccattgtcaccgcttatgcagtacttttgccttatgcagtacttccttctgcataggtgtccactttaaaacaattgtggttcaaaaggttagaaaagaatgagtcggagtggcacacaccttcaattccagcacagaggcaggaggatctctgagttggaggccaatctggtccacagacttaagttccaggacagccagggctacacagagaaaccctgcctggggggcaggcacaggtggaggacacaagtaaacagtgtgtaccgcacttgctaggccctttagaaaaggcagtgaacatttggagaccacttttctcagcatggctccccaggccgtgccgggaacctgcttcacgtcccatccacatcactgtgagcattgtaggcccgccggacggtgcactgcacggcgtctgtgtgggtggtttgattgactactctgggggaggagct

SEQ ID NO: 29635 - DNA, 3290 bp, Mus musculus
cttggggagcattcacactgctgtttcctggccttgccagcctgtttcagcatcactcacgcacacaggaaggcatctgctcacctccagtctgcgaaggctcctggctacctgagggtagagaaggaatggatttccttctggtggagagcccatctccactgcagagcagccactagggaggcgagcatgcagccccttgcttctctctgaagaacaggactcccagcttcctttgttacagttgccttgcaaagaaaggaaaagtggaccatggagaaaaggaaaggaaaggaaagaaagcaaaagaaaagaaaggaaaaggcagaaatcagactgttcttatctaaaagatgctcagctctggtggatttttaaaactttctttctctccttaaagtataggttactaactgtaatgttacttgttttctaaacatatctatgagatttttaatgtagttagaagtctctgttgtctaatggacacagcatgtccttctggtgtatactcaaattcagcagactctgtctatgcctgtagacagtttcctggaccggaactaaatctaatttcagggaaacgaagatcaaaggtcgcttttaaactgaatcactgatgttgctgctgttaggaaggtaggcagaaggatccatgtctgtgccgagaggtgtgacgcctgggggagggtggcagtgtgcggcacactaaaccctgagataacttgttttcttttaactcaaacaaaactggtttagaaagtctttgctttgcaaatatcaaatgttagcatgagccaaactggaccccgccttcatcagaggccccttaaggagacctcattagaaagccagggaaagtaaggttggagcttgggcacctgtgcctctccctgctgtcactgggacccctcctactgtaaagcccaggatcaggtcagaatcggagcatttgggggctttatattctgtttccagacaaggtcacctgctccgaagctctgaaagagaaagggttttatggcaggacctgttcatgagatttttgtgattgccatagtagcaggaaagttaagagaactaatctttaaaataagtatttttaagatttttttttaaattttcaaagcactcctttaaacaaacaaacaaacaaacaaacaaaaaacctacaaggaaaacatacaaattacagaaaagtgagtgctggttaaaatgaattagtctcccccttcctttatgtctttatcctccttcctcccaagcagatatagcctcataactgtcccccgccagtgctcaggcctcgcctgcttctgggagacgaccctgggagtcagtcagctctcagtcccagactgtcagggaccaggcagtccctgcacaaggcgaggtgggagcacaggccagactgcttctgagcaggccctgatctccagtccataaatgagaaacttgatgaggtgagagctgaaggttcttcagctaagaaaccattatttttttttctcttcagctatgtggaatttgtatatctatcaatttttcaggttttttttttttttatcttgtttagatgaaggaatgaatggttgtgaaaggtgtttggggtctaaaacatgatttttcctggcacatatttcaaagcatagactttgttacctgctgcttcttgtctaatttacagggatatttaattttgtaaggtatttgtatatttatacaactgtaatgaattgcacattggactgaaaggggaaggctctgccctgtgtggctcctgctgggactctaggttgctgtgctttgactttcctgaacaataccaggggggtgtggtttgtttagcgtgggtccatcacttttcatttgggttccttttggaaaatgtaatctttaacttgctctgtgagaagaaaagaatgattgtgttgctgctcttggaaggtctgctgaatgcttttgagtgacctctggcactgtgtactgcctgtgatccaccaagagtgagtaagaccacgaccgtggagcaagtcagagatcgtcagccgagagattattgctgttactgttcaaaaggccatttatgaagtagatatttgagctctttaaaaaaaaaaatttaagagagcccctaattacttaaaaaagaaatttaagaaagaaattaagagttgatacagaaccggtgttaaaaactcacagccagaggttaggggtgttggttagtggtagggcacttggcaactatatgtgatgccattggttcagtcccggttctgagatcagacagaaagcctcacggtagatagctgctcagacaaagtccaggcagaggttggtcttgtgccaaaccctggatgttctatgttgtcatgtccttaactgattcttttcatgctgtgtattctgacatcaattcaccgaagggacccaccagcctcctcatgtttaagcattgtcgtagactttgtggctctgacatacttgtctgttgagagtggcgtctcctgtcaccatccccatgctataacagaatccatgaagcataagtggcctttttgaaccaagactttgcaaactgatctctccccagggaaggagttgagcacaagcaacaatgtacattattaattttggatttcattttcatgttttattttgtaaatatctaatgtttggagcttgagtatacaaaatgtaaatacagttcttgtatttgtactaatcctgattcttttgctgtatagccctagatgtgtaatgcagacattatctaactgtgtatggtaaccttgcatcacagaactgctagtgaacgaggtaaaaataataaaggtacaaccagtgcatcacaccatgcgtgctttagtcttttgttttggtttctggagacagggtttctctgtgtagccctggccatcctgggccttgaacttggatctcacacacacaccaccaccccacccccacccccgctgcctccagggtactgaattaaaggaatttaccaccacctccaggcttttgtactttattctttgccctttggaaagccattgcatactaattaagattcttacagagcctttaatcccagcacttgggaggcagaggcaggcggatttctgagttcgaggccagcctggtctacagagtgagttccaggacagcctgggctacacagagaaaccctgtcttggggggggaaaaatattctttttttaaaaaaatatttatttgtttgtttgtttgtttgtttatttattatatgtaagtacactgtagct

SEQ ID NO: 29636 - DNA, 1100 bp, Mus musculus
ctcagcagttaagagtactggctgctcttacagaagactcaggttcaattcccagcatccacatggcagctcacaactgtgtaactccaattccaggagatctgactccctcacacagacacatatgcaggcaaaacaccaatgcacatttaaaaaaaaaaaaaacaaaagaaagaaaaagaaaaaaggcaagctagcttcttgatgcaggtgacacttcagtcgcatatgtaggtgggggtatgcttgttcagcttggggaggctgccattagcttcctttctgttagctttacccccctccccagcactcaagtgtcacttcagtgggggatattgctgtatcggggaaactggtgggtaacataaataactcttggattgacttggtagaagcgacgagcagtttagacaggcgtagcggattgtgttgtttgacgccaagctgagcgccagagtaagcccctccccccacgcgtacttccattcagtccttgctggctttctttctgtttagcggatgaagaagcccctgattatggctctggaatccggcagtcgggaacagctaaaatatcttttgataatgaatactttaatcaggtaagaagtatttggggaagaaggaatgaacaccttgaggaaacaaaaggaagtaaatggacttttgaggaaagtatccatgcgggcaccaattctctggtctaaaactctagcaactctaaggtgttggttacaccacagttactcagtgaaatatgagatgtgtctaaaagttacaaagataaaagtgcactagcacattgccttttctcagacaactcttagtccatttcattattattttgcaaaaaatagtttgttgtacaaacagaaatcagttaggaactgggagagcgtgtcccttacctagcctgccttactttcagagtgacttctcgtcagctgcaatgactcgttctggtctgtccttggaggagctgaggattgtggaaggtcagggccagagttctgaagtcatcagtcctccagaagaagtcaatcgaatgaacgacctgggtgcgtagaccgatgactgtcactgaggagactctccctggg

SEQ ID NO: 29637 - DNA, 1191 bp, Mus musculus
tgttccacaggagtcttcgtttgtccactgaggttttagtttgtggaaaaaacaaaaacaaaccacacatacacacattgccactccaggaaaacaaagtctatataaatacccaagtttaaaattaagattgtaggctggagagatggttcagtggttaaaagcactgactgctcttccagaggtcctgagttcaattcccagcaaccacatggtggctcacaaccatccgtaatgaaatttggtgccctcttctggtctataggcatacatgcaggcagaacgttgtctacataataaatcttaaaaaaaaaaaaaattaaggttgttccctgagtttaaaatgtaggtggccagtttttcagctagtcacaagcttcttcttgttgttgttatcatcatcattattattgagtatatgctctgtatcaacctccttcccctcagccatgccatcgccttgtctctgagtcttgcctactgagagagggccgtgcacgctcgcctatcctcatcctctcattgcaggtgcagttccagtttgttctgctgactgacacgctgtactcccctgtgcctcctgaactgcttccctcggagatggagaagacgcacgaggacagacctttccctcggactgtggtggcggtggaggtccaggatctgaagaatggagcaacacattattggtctttggataaactcaagtaggaaaatattcataaaagattattttttttaaaagaaaaggcctggcttggaggcgcacgcctttaatcccagcactcaggaggcagaggcaggtggatctctatgagttcgagaccagcctggtctatagagtgagttgcaggatagctagggctacacagaaaatccctgtatcaaaaaacaataacaacaaaaagtgagttgttgaagtggattccctcatcacagctctctctgaggatggcatcagttccttctctgtggtttctaagtgctgtgaccagttaacaatattattacccattcatctttttcctaaagtcagcaaagctcacctctcagacaactttgatatttgttgatttttaaatttacctttataaatttcaatgagccagttagttctgtgtttctttctctcttggatctggcatgatccctctaactttagtcctgggctcaggatcatctttgtaataa

SEQ ID NO: 29638 - DNA, 1237 bp, Mus musculus
acctagcatattttttcaagttggaaaattatgcattgcaaatgagaagacaacacatgaatctcatatgcatggatttttaatatactgtgctttctgagagaggcagagcctacgttgttctgtaccgcatttcacatcctttccctctgggtactttgtatttctccactctgggagaaactagtgcaggtttctaagatccctagtgttctcggacacagaggtagttccagtgcggtgtgataaatggcctgcagtgatggcgttgtaggcagagccatatccagagaggatagtgggaggagtttgtggaggaaggaagccctcagctaagagcaagtcccacagtacaactgagaatttcccaaagtgaaagagcaagagaaggaaggatcagggaggaagacaatttaggatgggggagatgttaattacttgggatggtcagaaagtcacgtctgttgtggtggacaaaagacaaggagactggaggtaacaagaacagacttgtgtgagaaactacaacccagtgtctacagggagattcctttattagaaccaccttgtagaaagcttcctgcggttacagtatagagggtagattgtaggcaggcaagtgcagagccatgtggaccagttggaaagttgctacttgatccaggtgagaaagaatgcttctccaagcagtgccaagagggagatgggaactattttgatcttagaaacaatgcccatgtctggcactcctgtcatcgcagcactgaagaaactgacagggagatctcatgggctagccttagctacatgagagcctgcattttcaaaggggcaggcaagatggttcagtggttaagagcacttgctcttacagagtaactggattcaaaacccacacccacaaggtcgatcacagctccccataaccccagtcccagttctggggatccaacagacacacactgcacgtacatgcatgcaggcaaaacaaaatctaaaaaaaaaaaaaaattaaaccattgcttagaacaactgttggacccttggggagcagacatcattctgggattgtctccctggtaatgaggtaatgctaatgttgaccagaagtgaggtgtcacctgggacatggggggacatctccatccctgtgattgcttgctaattatgtcttgtcattacaagccgagtctctctcgttaaaagctgcctatccagaacactaaggatggtgact

SEQ ID NO: 29639 - DNA, 1371 bp, Mus musculus
cccagagatattccaaagaatcacctttgttcttctgctaatccaagtgcccttgtatgactgaaataccagacattaaagaaacccttgcttttctaggcaaccagaaaagaaaagaattcactgctagcagtatcttttcttgcatttgagagcacttaccttagaaaactgtgtgtacaaaatagcttgttagactcactgaacaagtataaaccaccatcatgcttttgtggggtcttattcctttattaagacggcgtctcctcgatttgcccacactggcctcgaacttggaatccttttgcatcagcttccacagttgctggagttagaggtgtgtgttagcaggctcagcttgtctttttgtttgtttactttttggttttgttttaatatagtggtatctccccctcagcttaaacaagaccaaagaaaacttgtcttcattaaagcattattttattctgaaaatattcctaggtgttatcattgtgaaatggagagaagtgttcatacgtgggaactggcattaccaggcctgtagtagagtcctactttattggataaggttttccagagcagactgttaattctatggacagttacaaaatctggttaataaattaaaaccaaagggcttttcctctactcttgcttctgatccttctagcatagcacattgtttctcctttcataggtaacacgacaaataggaattgtttattacattgaagtgacttgaactgacctttgtgctttagatgtaagatactaaaaacaaaacactgggtctgttaccgcgatgcctgactttttaaatgctatcagattataagcagttgcgtgggcttcccgtggtcactgctgtagcgggtgccttcctggtcctttgttgacttgccttaatgatttacacagaagccttcgagcagaggaagcttcctggggcctactgcagtgtgatgaagacgttttaggttcagtgtaaagcaagcttgtgttctgtactgttggagacagattcgttacaaatgattttcatacctgtctgattgatatcattttaagctctgctctaggtgtggcccactttaggttgtgaaatgtatcgttttttcctattattactgtaaagagaagttgtgaatcttcttgttgatgaactctgatttttctctcaatttcttaaaaccatgcttgaagattgtctgggtgtgagactgccttctcagaaagggagagttagtttgtaatattaaagaaataaaatcttcctgaaataagccttggcatgatctttaagtgtggtttatcactggggaggaggggtaagtgaaacaggggaattctgatttctcagtctcttcc

SEQ ID NO: 29640 - DNA, 1195 bp, Mus musculus
ggctgggcctgcacagagcccttgcccaactgtgtacattcccaggctcagtccccagcaccaccaccaggaaaagggacattggatccagaaagtacccaaaagccacagagcactccgctcactttggctgtaaatgtttccctgtccatggctgttccttctgcagtcttcagcgcccacagggagtgagcaccgtggactctgtgtccacgcagatagaactgcagtggaagagcctgtcatccgggtcattcatcccctgtgctttctccctcagtgccagagctaaaggagcagattcaggcctggatgagagagaaacagagcagtgaccactgaggccccatcgctcctccgctggaagccgccacgccagccagccaggccgcagcagcatctgcctcgaggctgcagctccagcctgtaaccagatgtggccagatcctgagagcccacccgtgtgaccaaacagtggagatctgaggggatgacgagaagaggattcctgtacatatatttaagtgacaacagtcaaagcttgagggacgagtttacgatggcttgtgtagtaaagcgcacccttcgcctgtcgctacctggggctgtggcagcggaagtgtttagtgacaagtgggtctgggcagcttcccctgagcttacgttttgttttgttttgttttttcgatgtgaatagagaactcggacattttgctgctaaacaatctcccctccctcaccctacttgcactgctgtgggttttttaaagagaaacagaaccagactcctttcccggccctccaaacatgtattctgtgcgataacttgtgcctgcgacaagtgttaatcttgggatcgtatttttatatcatattcacatacttgtttttttaattggtgttagatgacatgattaataaaaaaggcaagatattttcagaatttgaatttcagtttttttttcttttgaaatagcccttttaaatttttttattataaacaaaatgaagagaaccctgtgagcctggtccttctagcaaccctcagttaagatcctgagggacaggtgcagcagcagctggctggagtggatcaggactcctgtgactcgtggggctcgggggaggtgaggggtgtgtttggttttttgttgttttgttgttttgttttaatcctatgtgacaattccaacta

SEQ ID NO: 29641 - DNA, 1215 bp, Mus musculus
aaaacccccacttttggacagtgaagatctttttgtgaagtttcagttatggcttttgcttactttctaaaacacattgcagccaacactcaggtttgctttgaatctttgtggctccagtgtgcacattgttgaaccatgtagaggcactccagtactccccctctgctgtgtgccccagtatccccctctgctgtgtatgtactccagtacccccctctgctgtgtatgtactccagtaccccccctctgctgtgtaccccagtacccccctctgctgtgtatgtaccccagtaccccctctgctgtgtatgtaccccagtacccccctctctgctgtgtatgtaccccagtaccccctctctgctgtgtatgtaccccagtacccccctctgctgtgtatgtaccccagtaccccctctctgctgtgtatgtaccccagtacccccctctgctgtgtatgtaccccagtacccccctctgctggaccctgtctccttcccggcctagcgagctctccgagactcaccatgtgttttctcctctttacagatactctcctcaggtgctttatgagccctgcactcaggacattgtcatgttcctcgttgtgatgctgtgcaaccagaactacatccgaaacccttacctagtggccaagctggtggaggtcatgttcatgaccaacccttctgtccagccgagaactcagaagttctttgagatgattgagaaccatcctctctctaccaaactgctggtgccgtccctcatgaagttctatacaggtgggtttcagagtaggccctggggtatgtggtaatgtacttgacccaaggttgtttcagagcgaacttaaatctaaatctgtgacctagattcacaaatagataaataaataatcctgccatcaaggctttaacatctgcttatgtaaatcacttcctagccccagctcagagcacaggctgtcgcatgccttctctcccggcctctgagagctcgcactggccactgcgtgtgcggccttccgttgatttacactgttcgttgttgttagtccaagctgatgttttcatctgagttgttaacctggttcatttgctgttgagtttacagtatctgatatataacaccatcctgtggctgccttttcaaagagatggaacaggagagagtttgatatatgcattctaggtcatccttgactgccac

SEQ ID NO: 29642 - DNA, 1173 bp, Mus musculus
aaattcaatagcaaacacattcatttttccttccaacttggcattctctggcctgttgtgatgctgtgaagtctcttcaggtctgtgtagacatcttgaggatgagagtggtaccctagtagtcacttggagcatctctcctaacgtgagagactatagcactgtctgcccaagtggtgccactcgttttggctcatgaacctgtggtgactccagcctgctcaacgctcagcagcagtttctagtccttccgatttgtaagttagcatccccagcaaggccaggtcgccctgacaggctagggtgtttcccagacatcattggttggcctgggcgcagacaaagcagcaatgagctgcagtgtggctgcatggggaaattgtgcttcaccgtgggtgcaggcttctaaccggctttctgctgcaaagtggccagctgtgctctagaaagctgtgctctaggagtggtactgaagaggaaagcattgtcaatctgttttctcttctccaaagtttgggagcctctggtggagcaagtaactgggattcgtacagtgaccatttcaccattgaaacctgcaaagagacggacatgctgaactacctcatcgagtgttttgaccgagttggaatagaggaaaaaaaagcaccaaaggtactgcggagcttatttatgcctgtgctgacccctgcgcaggagcagctcttagggcctgtctgtgagaacggaatctagtcctggagaactcacagcaccttgtagaccttatgccagagctccgctgtgagtgggcgcgcctgggctctggagtctgtcctctcctctgtctgcccatgatgtccgtggtcctgataattgctgattgtgtcagttttccagtgctagcacagaatgtccaggaagctcaaagcaagaaaggtgtattacgctcacaggtccttaaatccatcaccaaatgagtccattgtttctgggatatggtgagcatctttgtagacaggtgtggtacagctaaattgctgttgtcatggtgaccaaggagcaaaggaaagcagaggaagtcctgggatgagctagctagactgctcagccacactctaattgacctgcttcctttcatgaggccttacctgccaatcctaccgtatcatcagtcagtgcattgctgaagct

SEQ ID NO: 29643 - DNA, 1187 bp, Mus musculus
tctaatgaaagtataggactttacatactctacaggccgaaagccaccagagtcagaaatgtaagggctgtgcgttctgacttgtatgtcaagccagaaaagcaagtcagctggagacaaggtgactgctggggacagaagtgactgccgcaaatcccacagatctttaaaatgagacatggcggaatagtgttctcgtcaagtgtcatcatggggggtcgtctgaatgcatgtgccggacagtcagtgctgtaaagacacttgtgttctgcactgtgtaaaaatagcttgtcctgaaaatccattctgctgatttcttcgtttttgaaagtgagcccaaggaaatgataccttgggaaaaacgactgcagcacgtaagatgaacaggacgcttatgtgctgccagtttgggaggagctgctagacttacaggaagaagggggtgggggagccagtgttactgtgctttcctgaccagtgagccttgatgctgggagttttagaaaagatgaacgacatgtttgtcttctgtacttaaagcatgtcccaggtggatgtggattcgggaattgagaatatggaggtggacgagaacgaccgaagagaaaaacggagcctgagtgacaaggtcagtgatggcaaagggcgctccgtttctcagtgctcgcttggctagcctgccctagccagagcgtctgtctgtctgtctgtctgtagctaggcttgtccttttgaagaatgcttagtctcagccttgccccggaaagttctcactcctcagtctgagctggcttggaactggcagtccacccgtgtcagcttcaggtgctggaactgaagatcccacagtccaactttagtctgcttagcagcagcagcagcagcagcagcagcagcagcagcagcagaactgggcccttttgtacagtgaaacccctccattctgcttggcttggctgcatgtttttgaggtcggtcaggtgggttgggtttttttgaggtagaaatcctcctgggtagcccggaactccttcctatctagaccaggctgctccctgatgtgtgtgcctgttcaacgtgtgtgggtattaaagacaggctgccatgactggctgggtccgcgctttcataagtaaaacttaattttgtggcagcaagtaaaaactcagggaggcctttctgtttat

SEQ ID NO: 29644 - DNA, 1105 bp, Mus musculus
tggggcgagggggtaagagtagggttggaggggtaggaggatttacgcttccagcgagggcttcgccagtcccgtccctcccctgccccccaccggggttctcgcgtggaggcggggcgagcctggcctgcttttagaggggaggggcttcccggtccggtgctgggctctgcctgggctgctgtagggtcgccgcgcctcgggggcatccagtgtgcagtggagctgttcccgcctgggcccaggggtgggacccggagcagggtctgcgggagaaaaaaacgcagctgccgcgtcaccgccacgaagacacggcgcgcagcgggcacgagccgagctggagaccgcgccgcccgccctgggtaacctgggaagctgaggggagtcagtggcgcctggagaggaccccatagcggtggccgtggccagaggcggcagctctgggcgcttgctgctggaggaggctgcggcggtgcgagcggccgaagccaaggcgattcagtgcctcgtgttcttagtttttaacctctgactatgcaattctgaaacctcccccattgggggaccagacagcccgatagataccttccactcttcctttgctcccgccctggtctcaagaactgaaggatctctctaacgcctttcaccattaagaggaaagcgatggaggagctgagcgctgacgaggtgaggaggctggggcgtgggggggggcaccttgaaaggattacttggcaactctttggcgctttggatggggacagatttttgccctggtggtgtcgggctcttgggattggggaggcaacggagatggcattttcaagaataatgaaatataatggaagtagtcattcatcatcaggttggctgtattgtaagaagcccttggctccactttgggctaccgtctcagtatgtttactcgatcactaaaattctccagagatagagaatgcaagagggtctctcgttttattctcctttattctctctcgtttcttcattcggaactccactcgcttttctttcttttagggtctgaagacgggggtggggtggtgaggagcatcttgaaggtgttcaatctttttaaaagggt

SEQ ID NO: 29645 - DNA, 1152 bp, Mus musculus
gcaactataaagctaaactaggattttacatatgcttttcgggcctagagctgagttaggaatcctcaccagaaagccattctcctagccggactgtctgtgcaggagggagatgtgggcagcagtggcactgtagggctgacacatctggttttctgttcctacctgggctgaagtgcatttgaggcaacctttttactttgtgtctttccctcaggctctggagacaaggtccttgctctggcagggttcgatgttgaaaaagccaagaaatgacggcgtggtgggtttggctctgccggccccacccctcctgcacacggtgcttccatcctgaggactcaggccacacaaagctgtagagactctcacaatgcagcaacagcccaggaacaggtgacttggaacacagtgtggcttctgcctagggtcctcgtccctctctctgtggatctcccttcttacgtgaccccaggcttgttggacagagggacattgttcactatgattcgttttgttaagatatcttggttttagtgctgataggtgtgagagctatgagctaagactgtcctgacctctgtctgcatgccttgggatggacagcagtgatgtccctggccctcctgtggctggagaatcttttcagtttttatacaaggaaaccaagacttagcacttgtgatgtctaaagtcacattagaggcagagctgaggctggggctcaggtgtcctgaatccaagttttacttctttattctgtactgttttatatatatataataattaacttgtatttgtgcaaattggtgtctatgaaaattcagtgtcctaactcagttgaatgggcactgaggggctgttcctagcctgttcatgggcagcatgaatgggccccattgtatctctgggttcctaagaagcaacaatgggagccctgttgagagcctcccgaagtaacttaaccccctgcctgtctcagtggggaagcaataggaaatggcaacccacagccctctgggtctgacctcttgccagctctgtggtggtggtaatagcaagttactatcaactgtgcagtttggggagaaacacaaaataagttatgaggaaagcgagtttctccctaggagccatggctctgcatgggca

SEQ ID NO: 29646 - DNA, 1089 bp, Mus musculus
cttaaggagcttcgcttccgtcaggggagctaggaggcctgccttttacagttactttgcatttccctccctcaatacagttagccttggtgccattcaggctagtgtaccattcctgcgctcatcttgccactgagtgacacctgcttccccagtgtcatgttcaccagtatgttctgtgcaactgcagttattaatgccagcaagccgtgtctcctgttcacattgtcatcctttctggaacttggaaggtctgccactcacagcagctagcctttaatattcttatgccacgatgttttggtgaaaatttctgcatttcaagccaggtgtggtggctggtgcccacctgtgatcctagtgcaggagggggtggggggatgggacagggccaggcaggtctctataacacgaccatgtctcaaaatacataaataaattttctcatttctccaagaattagggctaaagcaaaaatatgttccaatgagagagtgtcaaaacgggctattagttaagtctactaacttagactttgtgtttcagagatggtgttcagtcttgtaaatggcaaatcaggtattctaggcaggtggattttccaggagaaaccaaggctttggggcaaacagcatgttaactatgattgttaggtctttctctgaaggcagagcctaggaaaggcatgttcagtgaataaaagactgcgagtcttccatcgacatggtgtctgattgcagtaagtgatggacaattggaattatttctgaggaagtgagcctggccgtcacccaccgtggtcagcccccttcctgtctgctgttcagtgtggtttatttttctacatagtctttctgttacaaagacctttctattactttgcctctcgaaatgtttgtccaacattagtatgtaaattaaaactgtcagcattcccacagattcccaagaacaaattgcaacatacaattgcttccattctgtctggccctggaagtcaaaaaagaaactagaaactggaggaatgtgttcaatgtttcatcacgtttctaaaagccagctaacactgtggccctagtagataatccc

SEQ ID NO: 29647 - DNA, 1245 bp, Mus musculus
ttggcaagggtgggaagataaggagggctgctcccagtgagcacagcctttctgccttgtcctgattccagaagccattagcagttcttgtcccctggtctgcaggtgcagaggacgtggtgatggcgttttccagatcggagacggaagaccggaggcagtagctggaagcccctcggaactccctggaagctgcagatggccaagagatctgtgtggctcctctgccggttgagtggtagcaaaccaccgtcttcttaccctttgcaccccttaccccatccgaccctccccacccagccgccactcagcagggctggcatcaaggtggtttgtgattggcttaaagggatggacttgagattggctgcaggaagaaacctttttatttttaaatcttgaccaacggaaaccttttatttttatttctgactctttatttttttaaacatttgcgcctcggtatctggcttccccggaagctctccgagctctggtgctttatttaggtcatttttaggaatgtgaagaggcctgattggttgcttaaactggaaaagggttatgattggctggctagtgggacgtggtcttttctttgattggctgtaggtgttctgttcacatcaccgacttcctctgttctgaaagcagaaaacagggtttgggatattgttatatttgacttgaaaaaaaaaagaaagaaagaaatgaagtgagctttgcaatatttattacacaaagagctggctgctgccttcacgtagtgggtttgtgtttggatttgattggcagtaagatgcgggtttggtttcccattggctcacccctgactcccgttgctatggtctttcttccactctgctggttacatgaggcctgagggtacacctggagaatgcacgtgctttaatgaccacacctgcctccaccagcgaagggaccccagggacgcgagcgcgagcggggtccacagctggagaacaggcccccaaggggctttgtgttctcctgagccagcagcccagagctcaggggtgaccgggaggcaggattgatgtactcagttctaagagctggcagccagccagtttcctggagcgaatggattgtgcagagctcttcaggcctttctggccagcccatgctaagtacaggagtgttgaccggcagctccagcctctctgctgccccctgtgtctcacttccccaggtcttggcatccccagatcctgaaggttatga

SEQ ID NO: 29648 - DNA, 1225 bp, Mus musculus
acaacctagccaggcttcccagggtccattgccagtggctgtagttcccggatagcagatgtgttctacctgagcccaggcccccattacaccgtgtatcaccctgtgtgtcagcatagaagggggagtagcatggcttatttattaggaagcacccacttggaagaccagctagactttcacacagtaggccccacaggctactcagatccagcccaagggtcacattttagagcagcgactgagaagaaagatatgggtggtcgtcccatgcccaccatgccttccctgggagtgagagaaacggtgacggccctttctggtcctgggcaccatgatccggaaaacactggagcatcttttcccttcttggggcttcggcctcccgtgtggcagggagtgtgcaggatgccagtgccagcaggtcttgagttcaagccctggggcacctccctgttggtggacggttcaagcttcccagacatgtcccaggaggagaatgtgaacatctggtccctcagcacatcggccctgttagctgacagtaacatgctcgctttggccattgagctccagggagcaaggacagtggagaatcagctccgccaaccccagcctgaccagcaagagcctgagaggagagcgtcattgctggggaggagcagcgtgtgtgagcaggcacggtatgagctcacactgactgacagacgcgtgcttgttctgctggcgcagtgtggcctggagatgtggctgggcccgtgggcagagatggggtcattcagtcttcctcccctgtgagattgtatctaaagtccggtgttgccagcttcagttggttcctgtgactgcctcgaggccaagccctggtgatggtgtgtgctctgtcttagcagtggttctcggctcagcctctgagggaaaaagatgcaagtatcgatgtggcttcttattctaactgaaagtctatctaatggagaaaaaaaataacaataaagatttttcacagcttgctgggtgagctgagctggtttttctctcaaagctgatagtactgggccccttcccaggggtcattcgaggagggagggcagcatcaagcttgataagcagagtggcctgagctgggggtgtaactcaatggctagtgcatacttagcatgcctgaagccctgggttgatccccagcatctcataaaccaattgtggtgactcatacctgtaatcc

SEQ ID NO: 29649 - DNA, 1106 bp, Mus musculus
ttctgccaggttatattaagaacacagagaagctaaactatggcaaagagcatcagtataagctcacagtcacagcctacgactgtgggaagaaaagagccaccgaggacgtcctagtgaagataagcgtcaagcccacctgcagccccgggtggcaaggtgagctgccgtccctttagctcttacatccattctgaaacgaacgcgccatagaaaacgtggttgcgagcttcctttctttctctcacacccatccatgggccaacgcaggctggagcagcagaattgagtatgagcccggcacgggtgctttggctgtcttcccgagcatccacttggagacctgtgacgagcctgtcgcctctgtgcaggccacggtggagctggagaccagccacatagggaaaggctgcgaccgagatacctactctgagaagtcccttcaccggctctgtggtaaggaggtctgctgtctgaagccctctgtctcagggaggcgagttccttaggatcccagcccctgtgacttggtcagtaaactgatgggtagaacagacgcagtgttctgaagtggctttggcttccttgctgtctggttttcattccggacgggcatggggagtatacagaccctgcagaatcaattcagaattacgtatgtgtccgcactgaagagcctgtgtttcaaataaagtaacgtatattcagagtcatcagggatgggtgacataagaacaaggaaccaggtctggggatgtgctctgtaatctagctattctaaaggcaggggatcctttgagccatgagttctggttccgcctaggccacatagggcatactgttggaaaggcacgtgctttacctaatgcatgaggctgagttcaatcccagctcgagaagggaggacaaaaagtttaccctgacggtatgtcctgatggttgtaaatcttccctctgctcttttttaaattagatttttttttttaattttacgtgtgtggggggcatgtgtggcgtggtgttcatgcagaagtcagaggatgtctcgtgttagtgggttttctccttccaacactcctcaggttctggggactgtgctgagttag

SEQ ID NO: 29650 - DNA, 1099 bp, Mus musculus
ttagtgtgtgtatgagagaaagagagagagagagagagagagagagagagagagagagtgtgacttggtgttgatattttgtctcactcactctgtagccaaagactcacttgtagcccaggcaggctttgaacgtggcagccctgcctctgcctctcaagtactgaggttactatctgtgtactattaattacatttccattaagacaagaaaaatgccttacttttcaggaaaagcaaaaccaaatccgcaagcattccaaccccttagtgaggcactgaaccactcccaggctccctgttttccgtggaactcacaagtcctgtccctgtggtttcaggggctgctgccggcacctcagagctgctcccgtcccccagtagctccttcaactggactgtgggcctccccaccgacaacggccatgacagtgaccaggtctttgagttcaacggcacgcaggccgtgaggattccagacggcgttgtgacccttgaccctaaagaaccctttacaatctccgtgtggatgcggcatgggccgtttggccggaagaaggagacaattctctgcagttcggataagacaggtttgttgggtccctggactggctagtgttcttcagagtctcctcacagggactgggtcctctggctgctcttcgttctatgctggggacactttgtcctcaagagagacaagacctagcctgggggtttatcagttttactcagtagattactcagtaaagtgcccgtgtatccgtttctaacccctgtcttggcccgactggagggttcatttgtacagatcaaatctttaaatccattaaggagccagtccttactctccccttgggcctgaagttggcagtttacccacagacactgtctgtctttgcagatatgaaccgacaccattattcgctctacgtccacgggtgcaggctagttttcctcctccgtcaggacccgtctgaggagaagaaatacaggcctgcggagttccactggaagctgaaccaagtgagtagctgaacctggccaggtctcatctctctggatgtgacagcctgagggacactgtggtctgtgtatc

SEQ ID NO: 29651 - DNA, 2218 bp, Mus musculus
aagatgtccgtggtatgacaggactaagctccgcccctctgcattgagcaccccatcccatgtgagtggtatccatgttgctaatgagagcgtcacctgccgggtcactttggcgaggcgactcccagtaccactcaggcccttctgtcactgtggggttggctgtgttttcctttgtggcttttagtagatagacactgggcgatggggctacaggctagatttacgccgtcgtctctttgccagacatatgaggaccagcacagcagtgaggaggaggaagaggaggaggaggaggaggagagcgaagatggggaggaagaggaagacatcaccagtgccgagtctgagagcagtgaggaggaggaaggaggccccggagacggccagaatgccacccgacagctggaatgggatgactccacactcagctactaaacccgcactcagcgcctgctctccagactctctcccagccccacgggtccacgatgtacaaaatcattttgaccagcaggtctgcagacccttcccccactgctcaaagtcctcccgtgcttggtgtgtgggaccaccggctccaccctccccgcccatcaccattgcagttttgctagaagctggcgcttcctccccagggcaggggccccacagcacctcagaccccaagtgtgtctggagttccctgtcggccagggagaggacaccagcacctgggacctccagagaagccgcactgagcggacttgtcgacagagggtgaaaaattactcccacgcagtcagtaaccatttctcttatttttaaaagtttttttatttttttttcccaaactagtgcatgtataaagtgggagagcagagggggttaatatgtagatggccaaccgactttttaatattttgtaaataaattgggattctgtgtgtcctctgtgctagtagtccaggacaggaatgtaaagtcagaatgcggggccaggagggcctcttcctccctcttccctcccaagaaaccaggttggagaggcccaagtcactggggcccacccttgctagggtttccgtacagccacgtggccggggccatggctttcaagtgctgtctgggggggccagccccacgagcctccaaccacattagaggctgggaacagccaggatgttgccaaagcccctggcctttcctgtacacgcctgtgactggcagccacatggtttctgcttattaacgtgagcctccctgttggtgaaatggtgtagctgggaacggacagcaaaggtgcaggcggtcaggctcctcgcttggaagaccacggttctgagcaagtctgcacaacagcaccaaaaggagaccccgaggcccaaagataaactgctacaatgctccagaacaatcttttctctcctccccagaggccccatgggatgccgcgtgctgttgggtttgggctaagatctaagacccagcagataggagacagcaggtaccacccacacagcacagctcttcattcacagtcaagagtttagactgctccagctgggacatccagtcctcgctgctgttgctgctagttcgaaggatgccgccgtgctgtctgtggccgccctcccatgtcctgtcccctgtagctgctttcttagatggaaacaggctaacgaagagagggacactgtcgtgtcagtagccgcagggtcccctttaagatgtgtatatcgacactaggtcagaaagtgtatgcgttataataaagttctggttctaactccagcctgagtggggtccattctgtcatgtttgttgggtacgggttggggcaggggttgagggatttatgaagataggctgggctcaaacttaaagcaatcctcctgcctctgcctgctcagtgctgggattacagatgtccaccatgccgggcaaggattattaatttttatggtactaaggaatgtacctgaagctttgcacttcgcagacaagggctcaaccagtacactgtatccccccaagtccccttgttatttgagccaagaacttaagaacataaaaacgtttttatttcttttcacctgtctttacctgttgtgtcaaggttgcacaaactggtctcagcccccatcaatgagaggaaaaaacttaacaaaaaacccgtcttccagccaagtacacacccaacccagaaaggccgagcctgtgcagaatctgcagccac

SEQ ID NO: 29652 - DNA, 1121 bp, Mus musculus
tacagtgtagaagtgtaaactgagtaagccctttcttccctaacttggttttggtcatggtgttccattgcagcaagagaaaccatgacttttctgattagagtttatagcacgcatttaacaggttttatggtagctgtatctgcttccctttgccctgcccctgactttagtcctgtggtgctttcattctgttgctgtgacaaacgccatgaccaaaaaccacttaaggaaagaatgggcttctttcatcttagagggtgaagtctgtggtggtttgagtaagaatggcccccggaggtgcatatattttaatgattggttaccagggaagtctattagtcagggttctctagattaacagaatttatagaatatatatgtgtgtgtgtgtgtatgtgtatatatacaaacatatatacatatgtgtgtatgtgtgtgtatatatatatatttgtgtgtgtgtgtgtgtatatatatatatatatatatatatatatatatatatatgatttattaaagtgatttatgggctgtactccagctaacccaacaatggttggctgtgaacagaaagtctaacaatccagtagttgttgctcagtccacaaggctgatgtctagctagttttcagcatatgctggaatcccaaagaagtaggctctgatttagtggatctcaacctgtaggttgtaaccctttgggtgatcaaatgaccctttcacaggggtcacctaagaccattggaaaacaaatacttacattactattcataacagtagcaaaatttcatttatgaagtagcaacaaagacaaaaataaattttacggttgagggtcagcacaacatgagaaactgtgttagggaggttgagaatctccgctctaacttgaagcgaatggactatgaaggaatggactttctagcaagacaagaacaaatgggcaaagaaacttctttcttccatgtccttacataggcttccagcagaaggtgtaccccagattaaaggagtgtcttcagctgaagatgcagtcaagctgacatccaagaatagtcatcacatagtccctccctgaggggaggtcagggcaggaagtaaggcaagaaccatgggaa

SEQ ID NO: 29653 - DNA, 1155 bp, Mus musculus
ggcagggaccaaccaggctgcctgtgcccgtctgctgcctccgagacaccagaggtctgctgcagagccccaccaagaaccaagatgaagaaagcccctgagagatgcacatggagcctggatcacttcatcctcacacctgttccctccagagggcccggctccctgcatcaggcagcagccgcccatctcgccccaactgttggctccaggcagggctgggcagcagggagcctgggactgaacaataaacccatgatctcctgcctcacacacctgtttgtgactttcccagcaagtagctctgttaccctgagaacaccagagctccccttgtctccctctctctctcatccagggtccctgcctgacccaccagttgctcgtgagctgcacagttcagatgagactggaccctcccttacttactcctgagccctgctctcctctcctccatcctgtcccaatctgtgtcccccttgacctgtggctccaggccatcggcattggtgcctacgtgtccagccactgcctgctgagggcactgcaggcttgctggagcacgctggagcacatcctgtcccatgagggaggaggaggagcgttggcctaacactggctgtttcgatagtgtgggggctacatgtgcctgtaggggtcaggccttggccctgtgtgcgtgtgagcctgtgtgtgtatgagtgtgtgtgtgagtgtgtgtgtgtgtgtgtgtgtgtgtatgtgtatttgtattatacccctggggattcttgtgggggaggggcatggggaagggaagggtcttcactgtcattcagggataaaatttaactttatttttctacacatctgttgccaggtgaggcacgtgctttgaagcagatgccttcagccctccctgctgggaggtggtctctcaagctctgggtgcttttagtacttttttttttttttaactgtagggaagcagccctgaccttacctctccactcctgtcccgggagctctcaatgctatcctggattgcctcgtaccagtcagaggtcaggactccatgagtccagctgccacaaagggttcagcttggaggtgacacctctttggtctacatttgtacaatggatgcatcaagtttctaaattttatttcctgcct

SEQ ID NO: 29654 - DNA, 2498 bp, Mus musculus
caggggggaggacaggtggcagatgggccgggctcggccccgccccctgaagctggcaacaacttgtcttagccatcccactcccaccctcttagcacagctttgagttcatgctcatcccctccgctcgctgtcttagccatcccgctcccccagtctcggtgctccccaggtggcctgtactggctcaccactgccaccgcttctggcctgagaccctgtcatagccccatagcttcctgccagctctaggcacccagtcttgtcattgcttccccctggctcctagtccacaggcgagggtgtagactgctgctgtacccttgtaatttgcttgacaccggccagtttacaagccatggcctctgagcatggtgagctaggactagagcagcccgctcatcccccgaacctcctggtccctctttcctgagactcatggtccctcagggtccttccctggagtagcaagggtcgtccttgggtccagcctgccctggctgtgtctgtgaggcaggctcctctcgggtgggcagtagaaagccccgcagttccttatggtcagcaagttccaatggtctgccaggtaggaggaggatggatcatcctagatcagtagccgctccgcacaaacaggacccaacagactgttggtgacaccgggtcattgtcccttgtacctctctagcattggtggcttccttgaaataatttttggagggtgccaaggcttctgccctcggtttctctgggggcagctgctggccccatgtggtctcagcctcaccctcctcccaggcacagcttcccccaaaatttgactcagctcaggcccctgctaactgatgggtttttgacaaatccctgttgtctcagccatccggagtgggaagtgctgggtcctcttataaggctctgaggtgctggcctcagtggatttgaggaccacgagaggtgacacactggcagtgaaggtaatggccatgggaagaagtcattcattgtctaaggatccatctggaccataggcccatgctccgcccacctggcatgctgccctctggtggctcccggttgactcacactggtggtgttgctactgccgcttgtctgctaacttaaatccctctaagtgcggctctttcaccctctgcactggagcccagggagggcagaggaagatttcacacgagtgagtgtcacatcagacctgaccatccactggggtctttgtgaggtggctggtcagtcctccttggaaccccatagggagcttgagaggcaagcaggccccactgtggtaaagctgtttgaggcctctatcctctgaccctccgttatcagatagcaacccgggattactcagcgtccatgtggtggcctgccagtgtcaggagagcaggcgttgcttcaggcatcgcagggctcagcttgctctgggtgagggtgtggaaggtctctgacgtgtaggtgaggccctggttgatgtgggctagttgctgctgaccttgtggggtacagctgtctgagaggacgaggaacgccttcctgtctctttcctccaaggaactggcctacgggaaaaaagatgtaacaggcggtggggctgttgtctgcgcgtcctctcctgtgtattgtggatctcaaagaagctgacaatatggtgttaatttctgcatttttggcattagatagaagccggtgtgtgcgtgcgtgcgtgtgtgcatgtgtgtgtttaaattatttatgatacacagagccagctctgagcagccagaatccctgctgagcctgtcaccctgcctgttggtgggagtagacagcatgatgggtcgggattgctggccttttaaagcgttcctgctactttttaacattaatggtcctttaacgttttgttagttggagaaagcgtgttctggggtcgctggcagaagctgaggaaactcaggcacccttgggttgtggctcattgactgggacaaccactgggccgtccccgttcagagtgggatcatcccaggtacatagaggtggtgtccctgagaaaggagggagggagactgctcacgtctgcgtctggggcccacgctggcccgagcagagcagactccagtaacccttgccctggagcaggccaccctccatccccaggcagcctgtccatcccgcccgccgtgccctctgtctgcgcccagtgcaagcccgtgtcatgtagtagattgtgattgtccagcgaccctaacaactgtaaccaccactggccatagctgccatgttttgaatgctgtgttttcaataaatgcctcctgggtcctgctcattccggttggcaccaggtaccgcgtctttttttctttcatgttcttcagaagggcttctgttccacaagggaggtgggttggtttggggtactgcatttggggttgggagcaggatggggatctggcgatgaggaggagtgcttacgggcccagctgctcctctgtcctgtgggt

SEQ ID NO: 29655 - DNA, 1147 bp, Mus musculus
gaccagcactgggccactgtgctgggagggagcccaggtggcttttcagctagacagagtagggggagccgagggactcatgggagacgaacacagtctaagaagaacttacctttattttcttttgcttttctcaagacaggtctcactatatagccctggctgtcctggtctgtagctcaggctggcttcaaactcccagagctctgcctgcctgagattaaaggcattaagggccattgtgccctgccagaacttaaccttccgttgtccttcttgcatatgactgcgccgtcaggttagagccaagatgcccagtagacttggtgccttgacttcttccccctgtctctcctgcagaggtcatcaggacgcggctccgcgaggaaggcagcaagtacaggtcgttcgtgcagaccgcgcgcctggtgttccgggaggaaggctacctcgccttctaccgaggactgtttgctcagctcatccggcagatccccaacactgccattgtcctgtccacctacgagttcatcgtgtacctgctgggagagcgtgcttagtgacagggccacatggttgtgctctagaagaataaaactgaaaaccctagagattttcttttccgttgatgtttagtgttcaaaactgaaacagcgaaggccatagaatacctggctcatgtcacctgttggacatttccttttggattcttgtttctggaaggttgaaattcattaacgttaatagttaattataactttcttttttaacttaagaggactgaggattgaggagcaagtaaattaaatcatgctatttaatgtaagttcgtgctgggctgtgttctcctttgtgcttactgggctgccctaagccggccacggggtctggctgggcgtggggaagtgagaagcgtgacttgtggggactgagtggtggacaggaaagagcggtcacgcttggtgacaactgtgagcaaatggtccacagctttccctctgtacatctccatctcccccctccatggtggtaggtttatctgtaatctgtttccagacactgaatgggggtgggggtgggggtggagtgtaacttccttaaccaccccaccccccaccctttctgagtcagggtcttggtgctgtag

SEQ ID NO: 29656 - DNA, 1166 bp, Mus musculus
cagagctcgttaaacagtgcacctgtaaaatgacagtcctcactcccactcagatgattagcatccatccagaataaagaatgtgaaaagagctaggcagtggtggcctacaccttcatcccagcactctggaggcagaggctatgagtttgaggccagcctggtctacagagtgagttctaggacagccagggctacacagagaaactctgtctcaataaacaaacagacagagtgtgaaaggacttttatgtgtgttaccaaaaatcttatttctcctctgttatcctggccatggctgtcagcactttctggaatttctggaaggcatgaacatccaggtgcagtggcagcctgggtgtgagccagcctcttgtttccttgctggctaagatcattactctcttctgtggtctcctctttgggatagatggtgcagagggacctgtgtactttaaagtgcagtaatgctttaatggttttctctttttgtcctaccagggctgtgtactttgcatgttattccaaagccaaagagcaattcaatggcatcttcgtgcctaatagcaatactgtgcacattctctcagctggctctgcaggtatgttccctagcaagtgttgtttcgttttgctttcttttttttttttttctttccaggaattagatgttaactccctgcctcttttgaccctaaaaccatttttaaagctttgtattggagtttgtagaacatgactattagcagtttataaacaaattttacttttctgttcttcatcttcctgatttccctattgagttgtaatgtggagtgagagctgctttctttctgattccccaaggtatctggggtgcatctgccctgcacagctcacttgcacagcaagaatcagggttttatgtgttgtgtggtacttgaggctgtacctaaggccttatgcctccagatggtctgttttcttctgaggaagtccgcactgcagagctcagggcagggcttgccccagggagtgtttgtgagaaagcactggctcctaaattgctaggagaagcctctgcccttcttcatagaggcttctgtccatttgaatctaacagaatttttagagaatttagattagcattttagaatttcttccttctgttaacagcctgcaacgtg

SEQ ID NO: 29657 - DNA, 1195 bp, Mus musculus
gcacgctttccacgtggacccgggtgggtttctggctgtaagaagccgttggaccaggggcagtcctaggtaccaggttctcagcctcagacatctcagacactgctgggcacctcagaagagccgagaacaaatgggggccctaggggcagcttggtcatccctggggccgaagagaggagagggcaggggaagaggggggagctgggtggtcctcacgcccacgtgggcaagagtccttggtccagtccgtggctggagcgcaggaaggcctcctggcgggaggttagacatggctcgatagcagaaaacctatcccatcgttcaagcacagcgggccttgatgagcagagacagtctggttttagagctttattgtagaaaggcagggagaaagagagaaggtagaaaaagggagaccggccatgaccacgtggagagagggggaagggagagagagagagaaggagagctagagaggagagtaggaaaggtgaaagcttaaagagccaggagggtccaagcaaccccttttatagtgggctgggctatatgctgttaccaggtaactatggggcggagcatacctggctatagtcaggtaactgtgggggtggagtctagccagaatgccaggagcttgggacatgtctgcatgactgatagtcacacatctctccttccggggctgtgagggtgataacttcgacagaagccaggggtccaggagccatgatggaacaccttctgtcccatgtaggtggaaatcaccacccatcaggtccccggggttctaaatctttgctcgactggagaccaggctgtctgtgcgtagcccactgccccacagcagaggaagagatggagagaaggggagagtactaaagatagaaagagaaaccttgtgtcagtacagccatggcttggacttcccatctcttccctggttccaactccgagtccttctcagtagggaggctagatgcactagtctgattatatctgggtcttatcccctggccacagacacagggagagggggcagcagcaggcagcttaggtcgtctgtaggtgtcctgcccagtagcttcccctccatcctgtctcaacgtgatccgagggaagttcatcacacaaagtgcccttggccctgaccaaggtttgaggtatcagtgggcttccatcccgcgcagcc

SEQ ID NO: 29658 - DNA, 1114 bp, Mus musculus
tgggggaagatggcgggcaggagttagaacccaacctgaactggcagtgagttgggaggctctgcgctgttctgcctgggctcattttaactgtagtatttgggggtacccggctgaagatgagattcgttcctggcacagccctgcctaagcgtaccttgagcccgtcagcagccacagtagcttagctgcgcagtctgcaggtgcaggagagtcagctcatacctcatgctgcatcccatgtggagcagaactggcctccaggcatcaaaggatttcttgcaagggtttggcccctggaagggagcaggcatcaaaccagaacatgttcctggaagatgcacggggcagatgtcttccaggaacatcgaatcctgccttctgcaagctcctcacacccactgtaggctcctcacacctagaggtgggtgtgaggaaccccaaggatctttcagcttctagctgagcaaggtgtcaattcaccacttctgtcacaagcacaagacagcctgccaagggatccgaagagacttcactgtgatctagcaagccatgtgggtagtgatggcttggatgttttgtacctccggccgatcaaggttgggagtatatttatttgcaggtcccagaggatgtccacgtctctgtgtgaccatggacaggacctctgaataatgacccctgtgttcattctttgacctcaagggtgagtttgttaaagtcctacgttgctttgatggcttggtgttttaaacgaactctatgcatctttttctgtccctttctattgagtggcaatgtttgtatttgctagatgctgttgagacaatttgaacagccgagagtttgcaccgagagtgtgggtgtacacggacaccacatgtgtcaggatgcaggtgtacatagacacggtgtttgtcagggtggtccttggcctcacagaggtctggaggagctgtttattgttgcgttttgtaaaaagagaaaccagagatatgtttggtggggacgaggtatggtgtgggggaaggggtgcctctgtgggcctgtgctgaggcatcccttccccttgaggtaccagccacacgacataggtatagtatagaggagagtt

SEQ ID NO: 29659 - DNA, 1104 bp, Mus musculus
acaggcctggatggtgatcagctggtggtgctgacggagagcccgttcaggccacaccaacgcatgagcctcagcctgcccctcatcaaccgagccaagaaggtagctgtcctggtcatgggcaggacaaaacgtgagatcacaacgttggtgagccgcgtgggccatgaacccaagaagtggcccatctcaggtgtggtgcctctttctgggcagctggtttggtacatggattacgaggcctttctgggatgacagtaccatcctggtcttagtcactctcagccttcctctttagctgcccactgtgcctcagctgtgtggagcctggtaccagagtcaggccccagagaagggaggacaaaactctgtgccgacttcctggacccactggttctcgggaatttcggtgcctgcacatggaaacaaggtagagctctggcctcaaaacccagataggagagggactaaggcctccagcagttacacaccagtagctacaacacacagtaagactgggcgaaggctccacgctaaagaaccaaagtggcctgccaagactggcctgcgatcttcaaactggtttctgtggaaagaggggccagtgttgatggggagcagggtgcagagactcctggtgaatgtcttgctctgagccaggccagcagagtagacacaatcctgagcctgcaccgggcgccttgcctcttctggtatcccatcatccctctgtgcacctagctgagatccagcgctcctccgggcagcttctgtctactctgggaggacacccactgtcctcagtattccccattacccctcagcctctccctctctacagacacagacactgccacgtcagaagttcccccagatctagagaccggggctccctttcccactaagaactgttatgctgtcattgggctgtcgggcatctctgatctatctagacgggagggctctgtctgctcctgggtcgggggtgactccagatcacagcctctttctagggcttatgtggccaattgccagcatcagggcagactgcagctagccctcctcacactacctctctctggcttcaagtctggcagcagcccc

SEQ ID NO: 29660 - DNA, 1150 bp, Mus musculus
tttgttgtaccttggctaggtatactcttgcactgggccatggggtggtgtttttagctctgtttagcggtaggacatccaagccagtcaacaaagtagccctcattaggaggtggctgtcagagccagcacccagcctctccgggctgtcctacccgattctcaccttgatcaggtagctttccctgctggcctgtgcccagggagggagaaggcagggcaaggaagctggccaaggtccagatatgtttcttcctaggcctgagactaggacctccccaagcacattcctgtaaggcctgacgggatgatcaatcccttctcctagaatacttgtagatgaagggcggtcggtccaaccgtcccctttcctgtgtcatgtgaggcttgctgtggcacaccttgtcataggttcgttagatggaagaatgaggatgccagggcagtgatggggtagcatcccggggaccctctgacggccctcgtgtcactcaggtcgggccagtttctatgaggagtatggcgtcatccgtgacacgctgcagaaccacctgactgagatcctcacgctggtggccatggaactgcctctcaacatcagcagctcagccgccgtgctccagcataagctctgggccttccaggccctgcgggggctgcagaagagcagtgccatcctgggccagtaccaggcctacagcggacaggtgcgccgagagctgcagaagccagacggcttccagagcctgacaccaaccttcgcaggtaggcaccggagctggtgtctgtggggccaccagcagctggaggccactggtccaccaagtgccctttgcagtgtgggactccgggagatcttttcacctcctaggcctgttgccagcttaaagctgcaggtcacctacctcaggctccatgcagtcccaggaaatctgtgggactcggataggaaccaccttcgtggtgggctgtgtttgtcacttctatgatgaggcacagagttctacccagccacagccaaggaatggtcctgtggagagacaccacattggccatcagatacctgctagagctacctggaaggtcccaggaggatttagggagaatggctggctgttagaaggcagagacagggcatggccatctagag

SEQ ID NO: 29661 - DNA, 1224 bp, Mus musculus
ccatggacctccctggtgattcatgccattctccaatgctcagagtggcagactgcgctggttccactcagtggcctaggactttcccaggcacaattcctgtttgcagagcaagctcccgacatacttttggcacggaagacagactgctcaggagggaggggattgctgtgggactgtaacattttcctgagaaacaagtgaccgtttcttgccaggcaggaaatgtttgatgtcctagctatgttccttctacatcatagcctcctgacccatgtctgattcttccttgttccttgtctgctcttcccaggcacacaggcatttggaagatgctcctagcggcaatgtgcttggcccttctgggctgcctacaggcgcaggaactcaagggtcatgtttccataatcctgctgggagcaaccggggacctagctaaaaagtacctgtggcagggactgtttcagctatacctggatgaggctgggaagggccacagtttcagcttccacggtgctgccctgacagccccccagcaaggccagaagctcatggacaaggtcttggaatccctctcctgtcccaaggacttggtacccagtcgctgtgatgaactcaagggtcagtttctacagctgagccaataccgccagctgaagacagtggaggactatcagaccctcaacaaggatattgagacccaggtccagcaggatgggctctgggaggcaggcaggatcttctacttcagtgtgccgccctttgcctacgcagacattgcccgtaacatcaacagcagctgccgaccacacccaggtgcctggctacgggttgtttttgaaaaaccctttggccatgaccacctctcagcccagcagctggcttcagaacttgggagctttttccaggaggaggagatgtaccgtgtggatcattacctcggcaagcaggtgagctgcagcttggagcctggcatggctgtgctaggtggtgtaccatggctcagtcacgaggaactcactgccgaatggaaaactgagctggagagtgttaggaaccctcggcctccatggtcttcctgaaggaagaccggaaaggtagaagttgaggaaatgggtggaatagcaggcaggaccagtctctatatcctcatctgggcttcccagtgagagggtatgtactctgagtcctccatgttgatctgccttctccacagaagtggtc

SEQ ID NO: 29662 - DNA, 1101 bp, Mus musculus
attgaagctagtagacacccctcactacacacacacacacacacacacacacacacacacacacactttagcctagcctggtaagtgctttcttagcccattacgagcctgcagcactgcaccttgccctgaggttttctgcagccagccagcgtcttgctggtttgggctccagccccagggtctggtggatgatgtaagagccagggaagttggttgtgtttgtgggatttttttttttaggccttctatccaaggcctggtgtgggggaaagacagaagcccgactatgtgaacagaggggtcagaatcctaggtggactactggagcctgcccagggtactgaccccgtgtggaggaccggctcctggaacgaggcctggcgtgtcagtcggttcctcttggggtagctgagcgaaggtgctggctttgagttgaggcttcataaagtgttcctcgcagacaggcacaccctgcgtgaggcccgagacctgccgggccactcccagccgcgggcagctgcctcctgttgctgtgtgaattccatcagggcgactctctgctccttcctctgcctctctactaccttaggaaatctggggtctgtttttccggtttgagtcttacagttgggaacccaccctgcatctattgggaaactctctgtgtgtctccagcttccccattgggctctcactgggtctcttctgctgtgactctccaagactccccttctttggacagctcagaagcacatggtccgaacccaagggtcagacatccatccggcttcgttgtaaacactgtgtctgtgaccttctacccagacggggctgtgtgtgtagacgctacccccgtgccaggcacggggtcaaagggaagagaagcgaaatctgcctgctcaggcctcttgatcctgggtaacagggaaattgccaatgatgctcgcagcccagagcccctgtcccccaccccagctatgccaatcagcacctcggtgagtccagcaaaccaagccatcccctaacaaaccagcagcacccaagaactcagggattctttttgaagtttaggagcaagagggacagatgggccctgtg

SEQ ID NO: 29663 - DNA, 1209 bp, Mus musculus
gtgcgtgtgagactcggagtacgtgcggcgggctcaagccctcatgcccgccgcgcagcccagccccgccccgccccgcatccgggctccgtagaccctcggccgggccccaggttcccagccggaggctcgccaggcattccagctatgccccaagcaggctaggcccagaaaggcaggacaacccccgcccccgtgccctcgcccctagtctgggcaggccgagcggccgcctcggtcacgctcttctattggagtgatggcacgctgagccaatggggaggcggcgcggagggagggcgggcccgaaaggggagaactgggcggggcttaacgagcaggaaaggaagacagagtgggaggcgcttagtgctgctccggtacagggtcgcgctcgcgtctgtccttaaggctctcctcggtgtccacggcaccctctttccttgctttgcagcgatcctactgccaggtatggtccttgtctccaccggggtcagctctcctactagcttcgcttggggacccggtgggcacgtgcacccactagcctgggcgggagccgctatccggggagcactcgggtcagcctcgtggaaggacgcaggctcttggagggtggaggtgtgagccccaccagtgatcaccgagtttcagggttgcaatgtaaccgggttcccaagcagacaacagcaaatgcagaccacggatgatcgcggccgtggagaatagaaaagtactttctgtgtagttaagtggaaggtttcagagggagggagagcaacttaaacccccgatgctcattaaatcctttctcagaatggaagggccagaaataaggatgcccaagaggcagagcgccacaccctagtagatcctgctggggctgtagctcctggaccgcaatcgagcgtcactgggcgggagtggtccagcccatctctgctgtggaatattcctgacctgtgagtgtcggttaggtactaagagtagaggaaattgcagcagtcccgttggataattgggaagccctcaggagacctcgacgcaattaggcaagagctacaggtttcctgggtggctactagccggccgtgaactgacttaagatgcatttaagaaaacttcctgttcgttctggcctaggcagtgtggttccttggctgactcgctttcgggatagaccacagctagtctgctgattagcctgac

SEQ ID NO: 29664 - DNA, 1209 bp, Mus musculus; identical to SEQ ID NO: 29663

SEQ ID NO: 29665 - DNA, 1397 bp, Mus musculus
cctgtgtataatatactttatagagaattcccctagctggtggggtctttggcaggaagcaggaggcaacttaacttgaggtggcccttgccgaggtttcccttctgggtccctgcctgcgttctatttaaagccagtcctcaggacagctgatctcagctcagctggtcactgtaattgtatcttggctagcacagctgccctggcactaaatttggtgggaccattgaccacaagaaaggctgtgttaaacttgatatggctttggcacttagtggccccagtgtccctcatcagtggctttgacttacagtaggaataggaaccccccaggcagggcctggagagatggctcagatggttaaagaggactgactgctcttctgaaggtcctgatttcaaatcccagcaaccacatggtggctcttaaccatccctaatgaaatctgataccctcatctcgggtgtctgaagacagctacagtgcttacgtatgattgatagattgatagatagattgatagatagatagatagatagatagatagatagatagatagatagatagatagataaaatatttttttaaaaaaatgagccccaaggcggcaggacagagtgcagtctgctctgggacagtctcggcagctgtcacagtggagcctgacttctgttacccaccttggcctcatctctccagcactggagctgctcaagactgcaatcgcaaaggccggctacactgaccaggttgtcattggcatggatgtggctgcctccgagttctacaggtctggcaagtatgacctggacttcaagtctccggatgaccccagcaggtacatcactcccgaccagctggctgatctgtacaagtccttcgtccagaactacccaggtgggtatctgaggcagtctgtggctccctaggcagcttctgggccacggggcttcacaccagtccttctgtagagatggattcagtttggtcagggttaggccaagagccctgcacactcctcattcctgcctgccccgttctttcgttctttcattctttccgtgacagtcttgattaacatagctcatgcagaccttgagcaaaggatttgattcgtgctttcatgttaatgttaggttggagactggtacacgcccttccttaatcagcagatgggcagatctctgagtggggttccatataacaagtttcaagcgagttagtgctatagtgagacaccatcaaataagatttaaattttaaagcacattttagttgggtgaggcagtaacacatgatgtcatcatgcagagattgaagaaggaaaattctaagttcaaggtgaccttgtgctgcaccatgagttcacagccaaactctgtactacaaagaccct

SEQ ID NO: 29666 - DNA, 1397 bp, Mus musculus; identical to SEQ ID NO: 29665

SEQ ID NO: 29667 - DNA, 1142 bp, Mus musculus
aatttttttatttttaaattggtggaatctggaattcaaatgagaaacatggatgggagacgtgcaactgggtgtccttgacagatgtcattaaaactggaaaactggaagatattagttatgccttgtgtatagagatgtcaaaaaacaagtccttggaatgttaaaatcaacaacagaagttaagataggattggcaaaaggagaaaaccaaaatattgtagactctcatctttcaaagtcatacaaagactgctaaatcagggcagattgttactgagaattggattaatgcattggatacaatgctttgtgggattcagggagaatctttcaagagtaatctcagtagagtgcttggattagcaactttataagggcagggcagtggtggcgcacacctttaatctcagcactcaggaggcagagtttgaagctagcctggtctagagagtgttccaggacaaccaaggctacacagagaaaccctgtcttagaaaacaacataacacttgcaggcaagcatggatccctgaggctgaacctctaactcacctagagctggtgtaatgcaagcacatttacagtgaaatgggaggcagaaaccaccacagctcttcagccatctgtctggtctgtgtgtgcagtgctgagcaaccaaccagcaccccacagtgctgctcagggctctaccatttgtataccctctgaaaagtctccagatttccaaatgtcacacactcgcagacactatttgcacctgacaaaatcatgcccctgctagagcaggaggcaaataatagtcagctgctgtggacagtctgaagcagccccacatcccacacctgggattaaaacgaaaccatattcttacattatttctgtggttttttttttttaaagaaaccaaaattccagaattctcattatactgctaggcatggggcctgccataaagagtggtttgtatgtacactgaacctcataggagaaaacgaaattttctttttttttaagatttatttatttatttatttatttattatatgtaagtacactgtagctgtcttcagacactccagaagagggagtcagatctcgttacggatggttgtgagccaccatgtggttgctgggatttg

SEQ ID NO: 29668 - DNA, 1164 bp, Mus musculus
gattaaaggtgtgcaccatcactgccccctaagaatagactttatacagcgctttctggtgtcctagagaatatgcctccacggtcttcacatggtctcggatttctgtaaggatagagctagattcatgcttcagaaccgtggcctgcgctgaccacggctcacacttagctcttgcttacagtgctctgacccagggggttgcctaggaaaccgttcagtgactgatgactccctgcagggtatgatcaagtgattatgaacagcacatgagaatgcgatatagtcttgtttatgttatctggagaaattgtggctttccccaagcattggcatgtggtggattccaaatgttaaacacagttttttaaaaagtggggcatcaggtcccattacagatggttgtgagccaccatgtggttgctgggaattgaactcaggacctctggaagaacagtcagagctcctgacttttttttttaaatgccagaaaggaagaagccgacgacaattgccaggactcagattcagagccctgcatatgccaggtgcaagatccctaccacagaactctaccccaaccttagcatctctgctgattcttgtgtttgcttgtcacttactagtcagtcagtcatctcttcaagtgtgtgcacatgcttgtgggcaagtgtgtcacagtgtgattatggaagttggaggaaaacttgtgaaatcagttttctccttccacttagctgtgcatgggcctgaggatgcaactcaggtcaccaggtttgcccaacagtcagccacctttgctgatgaaccatatcatgcccctcccccccccccattagactgggtcttacagtgtagcctggctagcatgaaacgcaggaacaccaggcttgctttgaactcacagggatccatccacctgcttcttcctccttgtgacaggttggtaagtgggtcagaacttggagactgagtgtgcctgagaaaggtgggttggtttcctgcttgtctaattgttacccaggttatgtttccacagccattttttttccgctcctgggttttagatggctcttacttaacgtagcctgctttgaaacctctgtctaccaaggaagagtgacaaggagctcttggttctcctccctccagcttccaggttgc

SEQ ID NO: 29669 - DNA, 2784 bp, Mus musculus
aggaatatcgtctaaagatttctctatatatttaaaacccacaactaaaacacatctgcataatagtgtttgtttgttgagaggatttcctgagactggtttgggtctccctgcatgacagtcccccagaaacttggtgtgtcctgggctggactgacacccagaaagcttacctgcgagcttggggtttggcttgagttctcttttccttgatttctcagtaggtgctagagtccgttcacacccttcactgtgcgcgcagacactgaggcacgtgggctctggaacccgcagggtttgcagagaggcggcatatgagtttgaaatccaagagctataatttttaaaaaatcttttattttaatacattgtaggaaatcttcataatttgagacagttctgcagcatggctttttacatctgtaaataaataattttagaagtctttttttctttccacagacgactattctgatctattttttccagccatgtcacaaagtgtgaattcctaccagctattgacagagtacagagttgattttttaataaaaagttatatataattatccctttaattaaagggaacagatgggcgtttctagttttaagcaggcaggagcttgggactaggtttggtcacagcagcgagcatccaagggttggcagggacagtgttacaggctctttattttgctgctttgattttgcttctgtctgcccctcacatgtgcagtggcaggcgtgtttgagcgagcctccttccttattcatagggattcagtgttgactgttccctggtgtccccgctgtcctgtgtcgtctggtatagaaagcgcatgtttctgtatcggtgtctgatgataagtttccttggagttttatgcacatgtttgattgttctagataaattgtcataaacattctaggaagttcaagaaaatgatgcagtacccagcacatgaaagacctacaacatgtgcttgccaaaggaatgttagaatctgctcatgtgtgtgtcaccatgccaagccatgccagccacagactgaggcttccgggtgaggaacaccctggggctactatgtttgtaggtctcatgtgctcagggctatgaagtaggctgtgcaggtgacagcaccctgctaggaagctgtgtgtgtcctgcctttcctcctggaatatgtacggatggaagtcttggttgaagcaggttcccctgggaagtgctctcagcaggccttgcggagcagagcagagctgggcagagctgactcctgccccgctgtccctgatggaaccttccttccagagctgtggaagagatgtttgtgacccctcccttggactcttgggggccaatcccactcttgagtgcaatggttgcatttagaatcagctagctagccaggggccatcctgtgggtcagtagatgaggtgtgtcctggccctgcggagagaagaggcctgtggttcagctggcacgctctgctccaggctctgactcaggggtggctgagcctcatgctcccagaaccatgcatggggcagctaggatccatttgtctgttggaaatgtttgtagcttttttgttttgttttttaactttctttttctcattccatttctgccttaactttggttcttcataggaggcaagctcaaattaaccttttgccatcaaaccttgtagccgtcttggcatgaaggcatgttttccttctgggggtggtgacatgccctccagacggcctgccatccagccctctggcctgaggaagacccccataggctccggacaggcaggtcctttctatcccatgccaccacttccttccccctttaactgagtctgctgttcagttaagcctttatttcctctccagtacccatttccaaagagaaagagtgaagtactttgaagtctgtacttgaaatctgtctggaagtgtttccttgttagttttgggtttctcccctgtcccaaggctcagagtcttcatctcctacgtgactgactacagttggtttggaggccctggacctctgtggcgtctttgaagcctggcctcttggcttccttttggactttgcttgctttcatttgaagtttgggtttgctttctgtgttctgtgcgtatcttgttcagtgtcgtcaaggttgggcttcacgtctcactgcagtggagcgagcggacattctgatcgctgcatttctttagatctcggagctaagtgtatatatgagtagtttgccaatggataacacagtgtaaacagtagacacccagaaaatcgtgacttctgtgttctctccatttgagtattttgtaatttttttgaaatatttgtggacataaataaaaccaagctacactacagcaccctgtgtgttggccagtgcactgtctcattctggagtgtgggtggggcactggagacagactgggagtgtgggcggcattctagagatgggccctagaaagagtgggtaagggcactgcagatggccccggggaagagagcttgatattccttgctctggacgcttaacctcttggaacttctagagacaggcctgtgctgtctgggagaagctgccatagccaatccccttgatctgtgaaactaagatattgccacccatgcctgccactcagcctgtaccattagggtgtgcagggagggatccctgcctgcctgcctgcctgcctgcctgcctgcctgccgaagagagattggagccgcctccagaattttccagataccacagatcctacag

SEQ ID NO: 29670 - DNA, 1201 bp, Mus musculus
cttggtggagcccaccacattgtttcagaggaacagggagaggcagaggaagagacctcatgtgctggtcttgtgtggtctgggactgcagaggaccaggcagtctctgtcctcaccgctgccctgcctctgccacagcagccctgtggcaaacaaagtaggcagtggagaagtccatcaccagtgcccacagagctctcccacgtgcgctgttggtcccttccagccacccttgcagtcactttaccatcgtccccacagtacccggtagtctggagggcagaggagacagacctcgggaatggcggcagcagtgtgtgtagagtgactgtctgctccctgtaggtcactacagctactcagagagccgcgtggagaaggacggcctgatcctcaccagccgcgggccggggaccagctttgagtttgcactagccattgtggaggcactcgtggggaaagacatggccaaccaagtgaaggcaccgcttgttctcaaagactagagcccaagccctgggccccacgcttgagcaggcattggaagcccactggtgtgtccagagcccagggaacctcagcagtagtatgtgaagcagccgccacacggggctctcatcccgggtctgtatgtttctgaaccttgctagtagaataaacagtttaccaagctcctgccagctacctttgtgtctggggtcttttgtggctggctacatttgcaggtggttgctgttggtgcagctgcagactgacggagcagctcggcccctcctgctgcggagacggacggcctctgatggcgggcgcttcctgggctcctcaggcgctctgagagtcactgggctctcactgaggagtaaaatgtgctggggctgggcctcatctgccctgaccatgtagcccaggctaggctggtcagtggacaaggctcagcttgggtattctctttctctgctgggatagccacgaaggaacttaaagatggagtactggcagccatcttgtcactgtgaagaaagaacacacctgcagtcctcaggagggacctggcagctcctgtcaagaaagcaaagctggaaactgcacattgttttgagacggggactcactatgtagctctggaactaagtatgtagagcaagctggcctcacacagcagaggcgcgcctgcctctgcctcttgagcactggggataag

SEQ ID NO: 29671 - DNA, 2037 bp, Mus musculus
gcgaggttcctgcggactagcggtggcttcgcgtgggtggaggaggcgcggctgcaggtcagcgccctggggctagaggccgggctgtgatccgcccgctgccccggagggtcccggctgggcgggctgggggcagcggccgcagtgcatgccgggccaggctctgcacagcatcctccgggttggagcgagcgcagttactggaaggcttgaccaaagttgtgatgcgtggggagcgtgcagggaaagcacgcggaaagtgcctccgagtggcggctagctgttcccggccgcagcagggctgacctcctaaagagatagtccatctttattaatcattagcagtgtggtcagagatttagcacctttggactcccccaacccggtcctgacattttagcagtttattggaacatcaacaacaagaacaaaaccttcgaaatttacaagttggttttttaccagtgaaattgtggatttggggttttttgttttgctttgcttttttgttttggtttgggttttttgagacagggtttctctgtaaccctggctatcatggaactcacgctgtagaccaggctggcctcgaactcacagatagatactcctgtctctgtctcttcctcccaagcgctgagactaaaggtgtgcgctcgactcgctccccctcccctccccttctctctttctcttatttctcttattcttttccttccctccctccctccttcagagtattttaagaaaaccagcctctccacagtgtgactgatatgcagggcccgttatgtgacctgtcttcgttagagattggtcctaagaaagcacagtaagggaaaatgcaaagaatactagcacacattggcaatcccacatttattattttttttaaaggatttagattttggttggttggtgtttgtttgtttgtttgtttgtttttcgagacaggatttctctgtatagccctggctgtcctggaactcactttgtagaccaggctggcctcgaactcagaactccacctgcctctgcctcccgagtgctgggattaaaggcatgcaaggatttaattttgatgtatcagcattctgcttgcatatatgtatgtgcagaggccagaagagggcgctgtatcccctggacctggagatgcagacaattgggagcagccctgtgggtgctgggaactaaaccttgatccagtgctcttagccacagactacccaccccagccaccctgttttcatcccgggattagagtgctgaaactctgccatgtgaaccagttttaatctaagctgcttgcttccatggatcccaacctgtcacacagaagttatttactctgcgtgaacagatggttgttacagaggcaacattttgaacacttttttttcctgtttttttaagtctttaagaaatagaaatggcttccaaaagagctctggtcatcctggccaaaggagcagaggagatggagacagtgattcctgtggatgtcatgcggcgagccggggtgagttcccctcatgggctagctctccctgttttaaaaacgaggggactccaagtcacttttatttgtttaatgttgtgtgtgagctgcatcccgtggtgcagatgtggcggtcaggggctgtgcgctgtcttccgtgttagcctgggctccccactctgtgtttatgtgacacggtgagcatgggatgcactcaggtttgccaggctcaccctgagcatttcctcactcagacctggcagcagcatggtcagctctctgcctcttttcacaaaccccaggcagagacgctcagcagcgctgatttccagttagagcagggctcagacccggtttcttcatttcacatcgctgcacagttgggacagcataggaaagccaccacccctcccctccagtgacaaccttatgacactggagtaaatacttcgaggcgttcattcatcttttgtgtatatatgaatgtttgcccacatgtttgtctgtgcaccacatgagagcctgatcccctggaa

SEQ ID NO: 29672 - DNA, 2455 bp, Mus musculus
ctttattttcattccagtctatgcgaacatcctagcaaagcatgccttcctttgctagttcttgttagtatttccttttccacttttgagtttagtcttccccagagccctgtagcatgtaaagaagctgccagtggaaaactggccaagtcagtttctctctgtccctctttagacagtagaagtccatccctactgagtatttgcacacacaaagactaacatgcccttttcattgtttctaaatcttccctgcctcttagtgtggtgtgtctcttaatgaagaaccgatgaaactgaagcccgatattcaggatcttcttcaagactttctacttagaacctgccgtgttatcgagcttacctattgttttttttccaaatgattatttttgttagtttacatacagtttagtgcctagaaaatgtgcctttgtttttcatatacactccaaactggaggtgtgacctaccctccccacattttgcacagtgcctttacagatttctggactgggaaagaggacttgtgtagttctgagtgctgaatggaggtggatgttgtcactcaagatgacttgttgtggattccaggaagggggttttgttcaaggcagctgtccccacatctgacatcatcttcaaaaccacattttaaacttttgggtaattagattcctaacttggaccttccaagaagaacactactgcctaacagcaatgggtgacaatagcagggtgtgccttattttgatagctaggaaactgttctttaagattattctccgtttgtaagcactactgactcccgctgtatttaagatgctggtgaagagctcatgctcttatgttagatatgactatgtttactttcttgttcttgttgtatatcactcctaaaatagtattttaaccagaaataaccctttaagaagtttttatagaactatgaccaaagtttctattttgccaaaagttaagtacaaataaattgccccaatagatacattcaaataagtgccaaatgtaactcaaggtgtcctttaagaaaaatgttaatactgtgagagcgagccttcaacatgtcggcagtccatcctgtgaaatgctatagagaaggctagtcattctgatttggtttcttctttagagctatggaggtgggctcagatcacacctgtagacaagatacttagccagcagtttgtagactgagctaggctgtggtctctagtgcgatgtgagcagtagccgtgcagcctcaccaaggcatcagtctgcacagagttccagaagactgtgtactgcttgtactcatctctgtcttatgcttgaggtaagccaccggtcactcgtagaggatagctaaccagagatgcctggtgctcttagaatgtagccattgctgtctgggacagtttcattgtttatatgagactttcatcaaggcttggttcaaagacaggagttcaggcatgggtggaattgaggaagtggtgaagggaaagctgcttgcctatggcagtgccactagaatgtcctgaaatctgtgtttgtgtgtaaagcagcattactcaagatgtcatagaatctggttctagttttttgtttttgttttgttttttgagacagggtttctctgtatagcccttgctgtcctggaactcactttgtagaccaggctggctcgaactcaaaaatccgcctgcctctgcctcccaagtgcagggattaaaggcgtgtgccaccaacgcccaactggttctagttttttatctgttcccctaacattactgaaacaatacagatgttgaagatatgccttgccgcatcagcctagggcttctgtcctggtctgacctcacaactttggtgctgtctcctcatattctgtcccatgtaactcagtggctcctgtattaacacagtgatacctcgcttctctgtgcatttagctgggaatgttcccggtatggtgaccagaataaagttgtttattaacatgatcctgtgtcgtgtttcttggagtggagttgggaatacacctgatgcatgtcctaaacttctgacccttgatgctccccctccctccctgacaaactatgtttttttcttattcattatcctaggagcacatattcctgtgagaagatgtagatctcaccctgtgttaggggactctagagcaacagaactaataaggtgaacatatatttttaaaagatttttattatgtggtatggtctacctcacactgaagatgctgagaacctgatagctgcttagtccatgaggctgagttcctcagaagtttccatctggtactgtgggcctggaggactcctggaaaatctctggtgttaagcccatgtggaagcccatgtggaagcccatgaaaacatactgagttctgataacatcagagtgcagcaacagcagggtagattaactcgcc

SEQ ID NO: 29673 - DNA, 1293 bp, Mus musculus
cccggtggagattggtgttgacggaagggtgccacggtacagtactttccaggtaatgaggagccaaagaaatctgatgctttcaaagctaacttatgagagaaccaattttgcatttgctaatgccagtttaaaactcccaggttaagtgtgagaattggttggtatgagattttctttttttaaaaaacaaaaaacaaaaaacaaaccaacatggttctggctgccaaccgtgagttaaaactcgaggcttgttgtgaagcctaaaaatattcacaaatgagctttaagctggtgtcttcagaaggaaggtagaaacaaaaggattgtggttaaaaataataataataataaaaactggggtcagtgctctcggtgccttttctataattgtacttgttttttaattacttcctttcactgccaacctcaaattactgtacagtacatgtctttctgcttgtgatcagcttggaacagcgacagccccacagctaggagccacctgtacatttgtaagctgacccgacccaattttgtttttacatgtgtgggttatgttgcagctgttgcaatcctcgacccccctacccccgcccccaccacacctattattttacacaatttgacctgtctgaggacactgagtaatttacataaacaattgtattcataacagggaatagaatgtaaagccagctcttttcagaatatcctatctcaatcatggatctggatacatttactccattgcttatggttcagatgaccaatcatttgaccagagcaatgacctcagtggatttgcttcaaccctcacatttattttttagtgtttcacatgccacattagctgaatatgttagaaaactctggaagataaagacttacatagaattaggaagttcttatggaggagatagaagtagggtcaaaacctaccagtacaactgtgaattctaggtgaggtcgaagcatacttccactgacacaaagcatttatgaccaccttttttgattgtaactcttaattttgaatataaggtgataggcgcagctttcttggataatctgaattcccaagtgccaggagtaggatttcatgataaaattaatagctaatcttattctgtctcctgaagatttaattgctatccttgttacccattcaaaatcagctgtactgtgtgaatgaaataaagacattaagatgaacccctttctggctgcacggtcgcttatggcagttccacacagtagttggcgcccaacggggggtccctgagacttgca

SEQ ID NO: 29674 - DNA, 1161 bp, Mus musculus
ctgagacagtgggaccattcaagctatacctgcctttagccgttctgttccaaggagggacggtatctctcactccacggtaccgcctctgcctttctgaccgtggcatttgatttgtgagatacggctctccactcccctgcctgccttcattagatgcttccatcaatcagctgagtcagtgttctgtggaagaattcaccattagagacgtactattgaaagggcaagcccttcactgcctcccacccaaataaaagagccggtcgaacgccttctccctgtttcccacctatcttccaaaaatgcggaggagtatcaacttagtgttattttcacatcgttcagtcaaacttagccagagttccaacgccctacttaaaattcaactagaaagttacctaccaagtactaattagcattataaagtcagagcctacagctccaggcttttcagttagttgttcactaagataagaaaggacagtcttaagccagatacagtttaccataagaaaagttaaagaatcccagtgaagcaagttttttctttagccctagattccaggcagaactattgagcgtagataatttttcccccctcaggccagctttttctttttttaaattttgttaataaaagggaggagatgtagtctcccctcccccagcctgaaacctgcttgctcggggtggagcttcctgctcattcgttctgccatgcccactgctggaacctgcggagccacacccgtgcacctttctactggaccagagattattcggcgggaatcgggtcccctcccccttccttcataactagttatcaagaacaggatgaccctgatctgatggaatggaatggatcctcaaagacatgaagggccaaagagttacggacagaccctggcctaactgaatggtggagagggtcatctcagaaatctccttattgggacagcaagatggctcagtaggtgaaagagcttgcaatcaagccagataagccgagtttgtaatttacatgaaaggacccaactcctgtatcttgtcctctgacttccagtaccatggcacacacgtccctctcctcacacacacacacaaatagtggaatagaaataaatacttccacacccctagggcagagtctagaatgct

SEQ ID NO: 29675 - DNA, 1175 bp, Mus musculus
ttcagtggcaggtaccctctgcctcctcaggtaaaccctactctatatgcagctatgtgttccttagattcctactcccaagctcttgctgggaccccctctgtcctgaatggcatacccacatgccctgcttttagaatattctgctcccttagagctttgagacctgattctgtaagcctagctagggacaccctggctacccattgccctgctccaagatccctgtactatatgcacacacacacacacacacacacacacacacacacacacacacacacaaaggtatatagtagttatggtgctaatgctgccattagactctgagacccttgaaggtcgtggctgtggccacccaccctcctttcatcatgggatgaatgacagtgcccaatgcaactggatgcttagaaagtgtgctaatgatggcatcagggcaagaagcgctttgaaccacgcaacagcaagcctggcattcagtaagctgccttcatatctggagaacaagacccagacatgagaggcatatgacttcccaaggccaaggccaccctgaagcaggcaccctggcggccacaggatgggaactactgtgcgctgtgtggatgattcgtgccaagagtggctgctctttttgtctctgctttctgagctgatggggggcatctctactctacaaacaaaagcctggtccaaagagggcatatgacttccctgaggtcacacagccagaatgcacggagtcggagtctgtactcaggtcagcatcctcaaggagcccggtttgtgggtgtgtccatagtgttccagagaatcggcagaaaccactctccatactgaggaggactgatggggaggcagtgcatgctgtgagaattggaggcctctggcatggcccacagtagggcaaggcacgggaggggccatggcagtgatccacccccattcttgcctgcccagggggaggccggtttgggatcccccgcagagtgaggccctggagattcagctgctctttcctgtctggtatccgcctctcagctgtctctgttccactgagtggaacaaaatttgctggcccccttgtggcccttgcatcttccgctatctctatccagggcccttctgtctttcagcctcacagggaaaggattatttacagccttgtttat

SEQ ID NO: 29676 - DNA, 1115 bp, Mus musculus
taaggggaaacccttcttggatgctggggcagaaggcacttttcaaaatgcaggggtagaaaggggatttctgccttcccctatccatcgcagcccaacacgcggcatcacaaaactggagccaggcagcttctgggcccaggccacacataactttcagcaatgctcctctcaagcctcccctggcacccccaggtgagccccaattaaagctacagatgtgatttaaaaataccctcaccagatgttaacttaaagtgacccgtgactggcagtggagctggaggaggctgcttccggcgcccagtgccttttcctagactgccattgggatgcaaatgaggctgagcggttcctcagagccagccataaaacccactgttctgaaagccacgctcagtaaccctctcacctggcatctggcaggggagcgctcagtttctaactagagcatgcctgcctgccgcagcgtggggtgggagaggcaggctttgcgcccgcagacaaattaaagccgcgagccccttggctgaagctccgcctgcaaactttagaactgaccctttatttaaactgacttccggctctgagaagcacctgccgaatccgaacggattcatataccatgcaagagaaagaccacccatgcccacagccaccagagccaggaaaactggatctccctcagagatccctcctggggactctttacggttttcttgtgcgagtctccattaagttctaagcaagtggaacttccggtgcttcccgcaaagctcagggatggaatatagtgctcagccttccgcatcctccgtgcaaaaagattccttctttgtccagagactgacgttgacacacagcactgcctttttttaatggtgcctttattaaagtaaacaagtgggtcaatcaacagtttacccagcagccacctgtcaggatttgggatgtcaacagactcccggtgacagccttcagaacagctgagccatctcagctctgcatgtccccagcctccttgaagcccttggcttcctgtggctctggatgaaagatctcccccccacacacacacccccacccctatccccaccccctgagagtctcacaca

SEQ ID NO: 29677 - DNA, 1191 bp, Mus musculus
tctaagacctcccacctttcccctccactgcccattcataggctccagcctttattggccagtcaaaacggggagaaggttcacacgagatcacctgagtacgtggtcgactgctcgtcgggggcagcccctcttgaggaagcagaattgacatcagaatacaaacagcatcgggcaacccacagcatttccccctttctgtccaacgacgatgagtttgacagatgctcgcaggcgtgatgtaggtgctgccattactggaataagaaaggcacccaagtcaagggtgtgtgctcctccatcatccgtccatcttgccccgcccccacctctaaacgagcatttgttttatgtcactaccaacaggtttgcattctttaaacctctctctaaatgttgtggcttgtgcttttaaccctgagccctgtgctcacctgaccatttttgagatccatccacattcctgcacgtgttaaaatccagagcttttaacagccaagtagtgttacctcacccctgatattcgcctacctaccctgtgatgcacacgtgtgctgaagggtgttttattagcaaataaaaaatttgcaagcatatttgggggggattgggctaacttttatattttttatcaaaaggtgaatgaacacgtgcatttagatttttgcagggacgtagactcttgtttcttctgggaacctctgccaagagtggcctgcctgggctgcgtctctcacgttggaggccacaggcagctctcctgagtgcttgtgtgttccctgttcccaggagctcctgcattacctcaaacacactatgcccctccccacctcactcacttaaaagcctttgcaggaggaggggcacattagctgtatttctgaagatggtgatgttgacagtttcccaggtgctcgctcaccgccgctgtggcttctgtaatgaaatgttttccaatctttgcctatttaaaacttggttcccactctgttattgaattgtgactctccaactgcagacatggcattggctccgggggctttcttttgctttgctttgtgagacagggactgtctccctgtgtagctctgactggcctggaacttgctctccatgtggaccaggctggcctcaaattcgcagagatatttctgcctctgccacccaagttctgggattaaagatgtgcac

SEQ ID NO: 29678 - DNA, 1181 bp, Mus musculus
tggtttgggtggcgatgtggtgactccctggctggcagcacttgtgcctcctctctggtccactgagccagctttggacaatggagctgtgtccgtggtctctgtgctggtgggccggggggtgggggggtcgggggaacctggcaaacccgctgaggcaactctggatggatgggaggtagatttcatctgatgatgggcaggtcttcaatgcgggatgcagccatctgtctgagcgttgtagcagctgggcacgggtacagagaccctcagactctgatcactctggtaatgcctgcgtacatgctcctgccagccagagagactctaaaaagtatttcttcctgacagttttctgggttcacgtgtatggcagatactaagcccgggagggaaaaaaaatgtagagaccatggaccagcaagctgcaccacagacaccaggcagggggtgtcagcttacttgtggagctgatattaatgccagccagcctctgggtggcttagtgttggtcaaagtcagaagtcacagtgaaagcgaccaagcttattcggtctcttctttcctttaacttagtaggcctgtccagtgcaggggaccccctccctccaggtcccccattgccctctgccagtgcagtttagagtcttgcaccccacctcctaatctcaggcttcttccaaggtcttctcttctctctccggacatttctctgatcagcctatctctcagtccgccaagtggctcaggcatcttggagcacttgtctgcatgggcccacaggctcaggagccgctctgttgttcagagtcctgttctgtccctctctcttgactttgtgcttcccagtgaactaaacacacacacacaatcagatacacacaaccatatacaatcatacacacccatcacactcacacacatacacatgcacactcactcacacacatataccccccccacacaatcagatacacacaaccatatacaatcatacacacccatcacactcacacacatacactacacatacacatgcacactcactcacacacatataccacacacacacacacacacacacatacacacacacacacacacacacatacacacacacacacacacatacacacacacacacacacatacacacacacacacacatacacacacacaca

SEQ ID NO: 29679 - DNA, 1146 bp, Mus musculus
acagtgtctcatggataccgagaagggctctgtctgtccaggtgcaggggacaggaatggggagacaaacacagcgaaagatgtcgaggaagggtgggtgtggctgtctcctttcaagctgctccatgtgttctcactgtgcatagaagactaaagctaagaagagcctgggctaagactgtgtattctatctctgtctgtctgtctatctgtctctctctctcatctagctctgtatctatcatctatttctatctatcatctctatcatttagccccatttctatcttttatctatgtatatatcattggtttatcatctgcatatgtatgtatgtgtatatatatatatatatatatcacccctcttctcccttcctccctcctctcctccctctctcctctcctccctccctccctccctccctctgtccctggcagtgctagaaggggtcccagggccttgtacatgccaggcaagtgatccctcactgaacgtacctgtatcttcctatctctttagtttaagattaaattacagcttgagttattgcttagcatttgagtctgagagtgttggaatgtggaatggggaagaaaggaacctaggcaccattgacaccaacttccttccaaagctgctctgacaataagcatcaggaccgcatctcccagcccccagcttcttcaaacagcagcgatgagttctcactccctacaggacccagggaaagacttgcaagaaggactgtgctttttctaattttctgggatccagagaggtgggggtaggggtatgggtgggagggcaggaatcacagggcaaataggagtatatacatctgcctgcttggactgcaggtgtgggatctagggcagggggatctgcaggtttgggatctagggcagggggatcttcaggtgtgggatttagggcagggggatctgcaggtgtgagatctagggcagggatctgcaggtgtgagatctagggcagagggatctgcaggtgtgggatctagggcagggggatctgcaggtgtgagatctagggcagggggatctgcaggtgtgagatctagggcagggatctgcaggtgtgagatctagggcagggggatctgcaggtgtgagatctagggcagg

SEQ ID NO: 29680 - DNA, 1235 bp, Mus musculus
gatgctataattaaaagatttgctcaaatgtattttctccctttttgaagagtttaaagaaatccatccatcctttcctaaattgattctttctccaatgtcattgctgtctggcagtcagtgtgctgccatggtgctgatttgatggccgctttctgtcaaatgtaaagtagtttgttttttaatcctctgatttagacatttaatagaaagcaaatgtttggcttactttggtttctgctgaacctgtatttaaacccgcaaacagtttgaataaagcgaaggcaccactggactagctattttaaacatctcaggatgtaagaatgctaaatggggttcccttttaaaaatagaaatggctgcttgcatttacataattactgctaactagcacaacgttttaaacagtgataaactcaagctagagaaagtacctgtttttaaaagcccggtgataggaagttgttctgtgagtggtgctgctgatggagggcctcagagccaggctcttcaggaaggaggggggctgggaagagaggggtggctccggcaggtcctggtttgatgcgctgcagtctgcatccgagttagaagctgctgagggctgaagtcagtgtgggcgaaagagcatggaagagagtgaagatgaagggtaagctgggccgggccacacctgcagtccctgcactggggagactgaggccagcctgggctgagtacgccccgtctcatagaacataaacagtttatacaaactcgttggttaaagccagagctctgagtgtccatggttttgcctttccccatcccaaacatctgatccatctgtctgtttccttctaacctggatcagactggatgtctccacccagcaccaggtctcctccttttttgctggacagctgttcccatttcctccttggacgccctgcctctctttgcctccctgttcagtagccatggtatctgcccagaagtgagagtggcagttgccttgtcatcctccccattcccctcccccctccaggttgtttacttgtttacaggttgtttacttggcctctggttactgaagctgtccacacctggagcacatcagacatggttctcttaggctcctctgttttgtctacctagcaagctttcccgtcagcccattcccacttgtatgtactggctcctctgtaccagccagggctccttccgaggatcatctcctcagacgatgccac

SEQ ID NO: 29681 - DNA, 1125 bp, Mus musculus
atactgaacatatatttttacattttgtgtatgatatcaagtactatcttgaggaagggctggaaagttatttaattgaatttagaacagttggtttatcccttaaaactattaagtcattgtttcatatcttatgacaagataaatcttaaaaattaaatgtaaaagttagagtgctaaaaatactaggagaaaatgagtcaatatttacatgttgttgacatgctaaaggccattctagtcatgatgctagaaccagaaagaaaaagctgatcaatttgactagcaaaaaaaaaaaaaaaaaaatcaatttgactacatgtaaatttaggttttctatgtgttataaaaagtccataaagtttaaatgtaactggagagaagattttggtacatacttggaagagggttactatttcttttttatctcatagtgcaaagaaaggaaagactcattgaatattgagaattgtgtgtgtgtgtgtgtgtgtgtgtggttagagagacacttttagcaagttggtgtgtgtggtgtgtggttagacactcttagcaagttgtgtgtgtgtgtggttagagagacaagacacctttagcaagttggtgtgtgtgtgtgtgggggggggagttaagagagacacttttagcaagttggttcacttcctctacctcatggattccagggatctcctcaggctgtgatgcttgcaggataacctgctgagccatttcactggcctgaagatgttcttgtttcctcttgcttccaaaaaattgataaaatgccagaagggaaacctgcagagtttaaacaaaagaatgggaatggggtggattttgttttgctggtggaaggccacgtgcttgggtccttgttcctggtgtacttgtagaaaactttacagaggcgagtggtcagaagacaggggaatggaggttcaaattgatacagagcaggtaaactaccatgggataattctgctcaacaaaaccatggtttaaaagaggggacaaaatgagaacctttacagataaatggaagtttgttattgggtagtgactgagcctgtaaggatgcagagattctgagttagataatgaaggtttgtgactaactaggtctca

SEQ ID NO: 29682 - DNA, 1480 bp, Mus musculus
actggcaatgagtttagaggcagggaatggattaggaagagattgctttacaggagtagacaagtaagcaatgtgtaaatgaataatggaggtaaatataaagaaaggatctgggaaggaagcttcaggaagtcagacctgctgtgttgtctaatgcagtgaattcgcaggctcacttagcaggagctacatttgatgaactgcatgacttctgcagatgtgttcatggaaatcaacttaaagtgatcagaagagcttccatgttacctgttagtcaactctacaggcttaaattcttcatgagagtttgtgatttcctttgcaaagggtaaatctgatttgtattctaggggacggaggaacatttagtttatgaataaaagtcacatgtaattatatttctttgaacttcaaaaccatgaaactttaaacttggttaacacacagtttctagattttatgagattaagtcattttgtaattctgaggttttttttttaaagaaaccctggaagagtctttgaagtagcttctggtgtgggtgctgctggggtgcttcccctctgcttgcttgtgatgggtgaagctcaggctgtttgtgatgctcacaggcaggcgcttgctgctgtccaccggagagtgtaggtgaggaacttagaggagcgaggctctctgtgctcttggtttaagccccacagtagagctgttgcttctgcccttgacagtatacttaaaaggaggcgttctctttctttctctgaatttattgtttttttctttatagatgatcatgggaacagcaatagtagtcatgtaaaaatctttttaccgaaaaagctgcttgaatgtctgccgaaatgttcaagtttacccaaagagaggcaccgctggaacactaatgaggtagatacatttcaatttttaagagtatattatcttatggttggactcgttagaatgttttacatagaagtactttatgctagctttaaattcaacagatggaacaaagaacctgtcaatgaaaacaattcctgatcttgagttggcacaaattagcttgtgtcttggccagtctggtgtgcttggcttgcactggcagtacagtgtgaacgtgactccactaacgcagcatgagggtcggttgtgttttcttgcccttagcatcttgcatttggtggtttctttccctctatctcagggcagcatgggttctacagtcccagtgtgagacagagaacagtgctctggaaattccaagtctgtagagttgggaatgagcttatcaggccgttggtgatgaaagagtttgcttcaaatactgactgctttgccttactaataggagtttattagcactgcaggctggattgtaggccacatacttgatacccagataggtaggtttggagtagatggaaaggaagtttgtcctgggcagactttcctctttgatcaattgtaatgtggggatcttaat

SEQ ID NO: 29683 - DNA, 1109 bp, Mus musculus
acgcacagtgtcccccgtatccgtggataagcacagggatggacctgggatggggataatggaggacgacttgtacagatacagacagtgctgcgtacagctgttcatatagcatgtatattagtcatgtctgcagtcctgtccacgccagcaagcctgggagatgactgtctggaaagtgcttgcaggggaacatggtttgatccccagcacccatgtcaacagtccagtgcaacggctatactgctgtctcagtgttggggcagtagatagacccaccagtgccacacacacagttttgagtactaaattctataattcaagttctaatgaatcaaactcccccttctggcctctgcaggtactgcatgcacatggtgcagacataatgcaagcaaaactcctcacatgcatcagatggtttttaaagtatacttactggtgaggatgcggaggttttactgccattttgcatctctgagctgaggtcctcgtgccccattggtcaggttatatgtgccttcttcctctgaattaaaagctctggcaagccacgggcatagctcaggcactgaattcagagctgggcttggtctgagcacttttgcaaattcccagaaagagcctgtcgctctgtgtttcctgtgatgatattaactgcccaaactgaatttgtttaaaagatttattggttttttattttaaagatttatttatttacttttatttatatgagtgcactgtagctgtacagatggttgtgagccaccatgtggttgctgggaattgaactcgggacctttggaagagcagtcagtgatcttacctgctgatctttccagcagatttattgtttttaattatgtgtatgagtacagctttatacctgtaaatgcaaggcttcttggaggccagaggtgtcagatcccctggagctgggctgctacaggcctctacgcccatcttaactgctaagttgcctcctgccattaacgagttatttgagtcgaatgtccttcacccttgacctaagaatgttagagctcagatttccaaatatttgtgtacatagtaggaaccttgtggctagggcccaaatctaaatgcat

SEQ ID NO: 29684 - DNA, 1444 bp, Mus musculus
gcgctaaatggtagctcacaaccatctgtaacgtgtttctggatctgacgccatcatctgaccacagcatgaagcatgcgtgtggtttgatcagacagaacatcatacacaaaaaactttaaaaggaggttgggagatacggcgcctggctgcagctgcgagtggctatgtagaagtgtttttcctgggaacagaagcagttgcttaaagtggagtgtggtgggacttggggcatggtccagtgatctctgagctccaggccagccagggctaaaacttgagcagcagcagcaggtgcccctagccaggccaggggatgcagaagggagcttgcttggccagttgctaacctgacgtgttcttttctttcgcagctcacagaatcgacacagacgggtaaaccgcttgggaacctcgaggaaaaagaggctacgaaaaccttttcctaagaggctacaaatttggaagcagggaaaacccagacatgagatgtttttagtttatttctccagaagggggcactgtatcaattatgtgaagggacatgcagacagcctagctccatggtgctgtggggtaggactgaggagccctctggccagaccccagcacggccatgtctctcccaaggatcatgttcctggaggtcacgcccctggtccttctcataagtggctgtgcacagcagctctctggaggtatttggaacattctgctgtcacacatgggactgctcttcctgaagcccatgctgttcgtgggaaacatgggaagaaaggaagacgtgtcgtgtgctgctcagtagacttcccacaagccacctctctcttctgaaacgtcactgaatggactggagaggactgcgggtttataaaactgctttttatctgagaacaatgggtttggaaactagtctcttttcttcccacttttacagagcttctcaaatcattcctccaggccctgacttggacaggtaggggggcagaccctgggtcccaaggtgcactgtccaggcacactgcccacattgctaagagaagaggccctgctgccagtggacccttcaccccacacgagacacctgtcttgcctttaggacaccctcctctagagagtggtgttggaaggaggggacctatgtaaggagttggggcaggcatgaatctgccaaatactggatatggatccaaggctggcccaggcacctgcacctccagtgagtggtcagcaggtggcgctgctgcccgccaggcttcacagagtccctttagggagtctgctcccagatcccttctggtgcacacttactggatgtcactgcaagctctaccctctgagcaggtgttgcaccacagtggcgctgaccctggccccgcaactgcaactgctgaaggcaggcattgcctcagccattctcaagacccttcaatttttaaaagca

SEQ ID NO: 29685 - DNA, 1420 bp, Mus musculus
tgccttccatacaggttcctggggcaaggcaaggtctgagtgctagagcaccagcttgcagagtttcagaggtgtgaaccagagccctggtctgagtgagggctggctcagctcctggacactggtggtcctggggcagagggaaaggaggaagagggcgttggctctcaaaccagcatctccagtgctcattctttctccgtagtgtttcctacccagttgtcacgcgtattctttgttagcctgagacagagcagagtggccagtgtgtcacctttcttccccttcctggagtacctttgtaaggtcacaggcattctcccacattgtcttaagcaccaaaggagctcagagtgtagactgtaacttggcaaatcagagcctttttttaaaaaaaaaaataatagcatctttctcactcacccagtttaactttctttctttttttaaatcctgttgctcatattaaagtagaagtactgctgagctctgtagattgtgcagacctcaaggggagagctcttctaaagagaagctgtgatagaaacagtcttgcccccaggctattgtgtggctctgatgggacaaatacccaggacaagttagaggaatttgccaaagacctgccccatgacagttgttgtccagtgtcttcaccctgagaataaccaaagttgcagtagtttttttttctttttaagtgcatttaagaatatgtgtggttttgttgtggaacagtggagctggccattattacatgtgctcagagatcaatgcctctggaatacatttgacatctgtttgtgtttgcttgctttgtttttaaggggatctttccctgtgggtggtgtcagaatttggacaccttggtttgggggtaggttgagctgggcagctgcaatcagcttgtttatgcaaactgggcgtgagcctctctgggctcctggttgatggctaatgctgggagggaagggtcagccccaagtagacccttcccgtgggctttggccaggccagacacaacatcgtttacatgttctgtgtaattataaagtttatgtgtataaagcaagctgtttctgtgaaactgtatattttgtaaataaagatattgctactttgaggtctgtgcctccttaggtgtcctgtgctgaaaaaggctgtgggtctccccagttgcttgtcagatggcggatctggcagagctgaactgatgatgaaaagggaccatgacccctgctccacttatccagttagctctcaaacccagtgtgcacttttgaaaggcttccctttccctcaattcctgtcacacttgtctgttcaggtgtgccggccacccctaccctctaccccgcacttgtctgagctttcaaagccacagccattagggccctttgaagttcggactggtgaggtg

SEQ ID NO: 29686 - DNA, 1990 bp, Mus musculus
tgggactctcctggaggacagggagcaaagctcacagagctggcttgctgtggtggctcctcgggggcctcactgacacttagctaagggcctgggagcagagacccctgcttctaaagagagccgagtggggcggccccagcacttggccgtaggtttgaaaagctagctgacctaggatttctagggtcatagggccagggacacaagtactagggcacctggaccacagcttaggggatccctgggtttctttgtgactttgagtggtttcatgagtttgggagctgagacccccttgtaaccggtgggtttgcctggggtttgttatcttttggggggaagaggccattaggactttttgttatagacaaagccaaagttcagagttgcctttttctagtgaactcaagggcagatgaggctctaggaacagaagtttctatcccatcacatgcctactgctgccttcttgtccagctggcagagggggctgccttaatttcctcctgttttgaaagccatgttctagaatgctctgctgggcacctgactctgggaaagatggtaggtagagggcagtgctctcccaaccgatgcccgctggtgacctagggttcccttggggatgtgtgggttagggttaggcttgtttcattttctggtgccaccaacccatccttccagcgagtgctttcttttctctgaaccttaaaaagagctgcctcccagggccaccagagttgtcgctctgctatggagtgccttgccacagcagggtggggtcctgtgtgtgtgtgtgtgtgtgtgtgtgtgtgtgtgtgtgtgtgtgtgtgtgtgtgttgtgtatggagtgccttgccacagcagggtggggtcctgtgtatgtgtgtgtgtgtgtgtgtgtgtgtgtgtgtgtgtgttcagtaccgaggacagtgttgttcagtcctcttggggacaggctaggaggctttccagaggaaggacacgacctgcagcaattaactgcaggatagtgcacacttgcacagggcccctctgccctgctccagagctactcaggtttccacatcagggcccctccaaaactaaggatagtaagaattgtaagcactttgtgtgcccaccgggagtccaggactgtccctccctgggcgtcacctctgccactggctctgggctgtaacccactgcttatcacatgtctctacactaacagggattgaagctgggccacctgggtatgggattgtccctgtcacatgtacaaagcttttatatgttaggacaaaacttaagttatgagagaagttctgtgcctagtattgatctataagggatttttcttatatttatgacttgagagacttaggaagactgcctgcctgccttaggaaggcggcactcagtcaccagtggctgggcagatttgtatatttatttttgtctgttctgtagcttctgtgtccagcatcctgaggtcttagggtgcttccctaatttttgaaataaaatgtttcctatatgctgggtgtcatggccttcatcttttgatagggtagtcttggctcgcctggaactcactttgtagaccaggctggcctcaaacttagatcctcctgcctctgcctcccaagtgctgagattaaaggtgtgcaccactaacacctgacgagaggtcaacctcctgctgctctgtcttctgggaatccttggtgtgagaggcaggtgtggtgggaaggatctagctagggatgcggtgtcggcagatgtaagtttggggagcccagcatctgagggagcttgcctcacagcctttgaggccctttcttacgtcagtggtgaaacatggcatgctacccaaaggcaggctcctgcccataaagatggactctgtgctgggagggtacctaggtggtgaaccccaaaagactgaaaaccacagacatttacatttacagttcataacagaagcaaaattacagct

SEQ ID NO: 29687 - DNA, 1169 bp, Mus musculus
ctgtagagatggctcagagtttaagactgctctgtatggaggtgttagacaccatgaaaaatgttttaaatgaggctggagagggctcagcggttaggagcactgagagctcttccagaggtccagagttcaaatctaagcaacatgtggctcacgaccatctgtaatgagatctgacgccctctcctggtgtgtctgatgacagctacagtatacttagatataataaataaatcttaaaaaaaaaaaaaagctggacctggtggcgcacgcctttaatcccaacacttgggaggcagaggcaggcggatttctgagttcgaggccagcctggtctacaaagtgagttccaggacagccagggctatacagagaaaccctgcccccccaaaaagagagagagagagagagagagaaagtttgtaactcatgactatatgatgcttattaatgtagaagcaaataaatgtatattcattagaaactttccttacagtttcagttgttatatttcagaacgctcctgttcgggtcaattctgagtttacaactttgaagaaaattggcatcagaagacagaagaggaagaaagccatttgcttgagtgagagtggcctttgtgccctggaagagttagtcagcgtgtcctgtggtgagttttgcctgttgtagatgcctgtgtccccgaagcctcagtcactgctcaggactagagtcctgaggactggctcacaccagggctcactgtttgttttacctgcaaaagtagatggctgccctgtcatcctgttgtgtggcgcttgtgacattggaaagtcaacgttcaatagaatactgattaaccagttattaaataggtaagctcgcttgtgttttcattggtcatctgggcatgaagtgagattcaaatggagaaacttgcttttgtttgatcttctaaggtgtggcctcactctctagaccaatttggccttggtgattctcctgcctcagcctccccagtgctatgattataggcataagccaccatgcccagcttgatggacagactgaagttggggatttgtttaactcactgctgtcagctgggccatggcattctgcagggcagtcccctgcctcactcccatgctgatgctgatctgcagcagaggcacctgctctccgtc

SEQ ID NO: 29688 - DNA, 1188 bp, Mus musculus
ttgatggtttgagaattcctgatgtctttggcaggtttggcagggacacagaatcctggccactgccttgtggccatgacacagctacttttgcttggcagtgctgtagatggaacccctaagagtagtggttctcaacccgtggatagtgatcgcccacaatgctgcatattagatacttacatcatgattaatgacaatagcagtattgcagttataaagaagcaacaaaaatagttttatggccgggcagtggtggcgcatacctttaatcccagcacttgagaggcagaggcaggtggatttctgagttcaaggccagcctggtctacagagtgagttccaggacagccagggctacacagagaaaccctgtcttgaaaaaacaaaaacgaaaaagttttgtggttgagggtcccttccaaggtgaactgtaataaagggtcgtagcactgggcagatgaagaacacggccctcgagcgttgctctgtcttaggcgagtgcttggggactcactgctcctgtgttcatttcctaggaccgccgtacactcaccagaggaaaccacagaggatggtgtactatgggaagatgaactgttacaatgactacgagaattacattgacatagtaaaatacgtgttcagagattacaagagagagtttccacttatcatcaacacgatgggctgggtgtcaggtaagacctgcacacatgtgcagctgccatgagcactgcacccacacacgatgacatggggtgctcgggtgagggggagcatgggtagcttgtagctgagaacagccctggatgttccaatgcagagcataccggcattcatcatggctgtccttcttatgtgctgctgagcatcaaacccaggagctccggcactcgagccacagctctgagaatctcttatataaacagtacctgttaataaacaagccagccgggcctggtagcacacacctttaatcccagcactcaggaggcagaggcaggcggatttttgagttcgaggccagcctggtctacaaagtgagttccaggacagccaaggcgaaacagagaaaccctgtctcgaaaaaaaaaaaacaacaataacaacaaaaaaaccaagccagtggccaatgagctgaggcaggacatagaaggttgaacactggcaagaagagggaattct

SEQ ID NO: 29689 - DNA, 1128 bp, Mus musculus
cgacgttgcgcctacccacatactgtatgctgtgaatgccagctgggtcggcctttgcaggatcgtggatgatatgaaaggctacactcggggccccatcctgcttgcccagaaccccatatgtgactgtttgggctttggtgagtgaacagtaaacaatgcctcctgccctgtcctcttcactggagacagcagtccctgactgtatgttgtattaacatttggtgccagacatagatggcatggttttataccaccatcacgctctgttagcctgtttcagtcctcatggctgaacatggaactttcaaatactttgaatggtacttttttttttttttcttgtttttttttcaagacagggtttctctatatagccctggctatcctggaactcactttgtagagcaggctggcctcgaactcagaaattcacctgcctctgcctcccaagtgctggaattaaaggcatgcaccaccatgcccggtggcactttcttaaaacttatttttagctaggcatcgtggctgacttcaggaggcacaggcaagtgggtctcttgtttgaggacagtattatcaagttagcaagttcttggacaagggctatgtagaccctgtctcaaaaaaaataataatttttaattctgtgggtgtgttcccgtgagttgagaagcctttagaatagaggtgttggtcccagtgctggcatagatagcgcttggttgtgagtgcctgagattggtgctgggagctgagcttgggaggaataccaagcgctctgcccctgtcgggctacctcgtcagccccacagctgcacattatattctgtgtaaaacactggaagggaaaactccttcatttattcctcctgttggggtcgcgtgcctgtctgccagctgctctcaaaggccagatgtgggcatcagacccatgggagtacagttgtgagtcagcatctgggtcctagagatggaccgtaggtcctttggagttaagcaaatgtgcttaactgctgagccccaaaattcggaattaaaactcttaatgtaggactggagagatggctcagtgattaagagcactgattgctcttccagaggtcctgagttcaattcccagcaacc

SEQ ID NO: 29690 - DNA, 2151 bp, Mus musculus
ccttggaagacatacacctttttttttttttttttctttttctttttttttttttttttttatttccattttatgtgcactggtgttttgccttttgcctgtgtgtgtgtgtgtgtgtctgtgtatgtgtctatgtctatgtaagggtgtcatgtcttggagttacagaccgacaattagttgtgagttcctatgggcatcctgggaattgaaccctggtcctctggaagagcagtcagtgccctggagacagacactttgtttattatgggacttgaatgccacactccgtttagacagggtctctatgctgcttctttgtgtttccatttcagcctgggcccgaagggtcagttccttatgtcaccacagattataatttaaatatccctggagcaacagagaaaattggagagagagagtatggaaaagcattccctagacacaaattacggcaaagaagaaaataagcctgggaatggagagactttgctcccgggatgcctcgtcccaggccgagtcagcagactgcgtgggctgtggtgagtggggctgtgtggctgccgagctcctgctcctgcccgctgttcacggaactggaaagtgtgctgtgcccctccagtgtcttccctctgagacaggagggccttgtatcctacagctctatctggcctcaaactctgggtatttcaggcctgtgttaggacaccagctctcagacttttcagctctttggtctcaaacttggccccagccctcttgacgactggttgtcccggctgtggcgtgcttcctgagagctgtgaagcagtgaagaaagccgtggtgtcctcagaacaggcagaggaaggacagccttgcagttttccaagaaaatcgggaccatgaaagtatggctagaaactgggcagcaggctgacccgcaggttctcatgtacagcgcacagactgccgggggcctgagcaggctcagtgagaggcgtgttgagccatgtggacattagcaaccaggtgccaactccttggtctgatccttgggtgccatcggatcttccagtgctgtaagcaagtcttagaagattgtatttcatctgttaatttcagggtcttttgaatcatgaggctttatgttgaagaacttgctctgacatccagaaagccccctggttaattaaggaaacccttggctccttaagtctgggtttgctctcactgccccttccttgaggcagtggatactgccatggggccctccagcctggagtggacacatacatgcctggtgtcggcaaatcttggctatcgaggatttctccgacagacccagaggccactgcaggtggatgttgtgaccaggagtgactgtgtcaggtcatttctgtggttgcagagctgaggagcttctcaggcaggcatgatggatctgtcaagactccaccttccagcaggatcatgaaagaccaaggctgtggaaggcttacaccattgcttacctccatcttgtctgtagccatgggagtgtgccagtctcctttgcttggtgccatctttgtggcagcctcagcatctgaaaatcccattaggcagagctgctgcttccccttccctgtagagcactcactaactggtccccaccgccccctcgcccagtctgtgtctcacttgagcttgtggtgagcctttctgggagggaggaggctcttagcctgctgcccaggcaggtctctgggcaccgttggctctcctgcctcgcagagagtttgaagacagccttctaagacagcctttgtcacctttgtccagttccccagatcttctggtcttcacagtactaaagatcgagtggggctggagaggtggctcagcagttaagagcactgactgctctcccagaggtcctgagttcaattcccaacaaccacatggtgactcacaaccatctgcaatgggatcggatgccctcttctggtgtgtctgaagctacagtgtactcatgtacataaaataaataaatcttttaaagaaaataataacaaagattgtgaatacagctcttcactacattttccttaaaagggtgaattttggcttttaaaagctgaccttgtccatctccaccagtaaagactcacttcagtagtagagggtgct

SEQ ID NO: 29691 - DNA, 1202 bp, Mus musculus
cccccagaggatcttctgctccatgggcaaacaagagccagtgtatctgtgctcatttaatctcgaggtcttgaagctaaattttagaatagctgtaactacccagtcctctgggcctcctggacaagttctagtccaggcctcactccgtgcgctcggtctgtctcccctgcttacccagctgggctgtaattggagacctgctctgtggtgagccagacactgctctctgagggccgtgagcagctgctctagctctttgctcagtggctttgggaaaaatcattgctgtgagtccttcaggccaggggatgcttctccctacagcacctgtggccccaggaagggaaggtgtcctctgcctgtcgctgtcccctataaagaggactgtgaagtccttagtgcttgtcatttcagccttgatggacacactatattgagtgagagccaagctgtgttggaaattcatgtccttcctgtgggagccagcgagtccctgctgtacttgcttctctccctaggagatcactgtcacagtggtgtcctcttgaagaggctcatgtcacttctcttacctgctgtaggatcatgcgtccagatgatgccaatgtggctggcaatgttcatggagggaccattctgaagatgattgaggaggccggggccatcatcagcacgcggcactgtaacagccagaatggggtaagcgctgggtgtgtgcgattcatgtgcacttgggttatgcacagactgtggattctatggccgcaaggccacagcagtgtggggtcgggaaagtagttcacatggagcccagatctacagtgttcctgccttgcccacccactgtgtcttctggaggtctgacagtcagccttgcttgggggtcccatggaataaggtttggttttcgcctcagtgtggagttgggaaatcagcagagacaagctgctggacagctgaagggctctcaccacctcccatgcctcagggccctgtcttgagccctgctagctccttggttgtggtcagaaatactctatgcctgtgtgaatctgctatcatgtttgagagctgagtcccatttccgtccctgactaggtggctgtgggctcgagctttggttttctgtgcctcagctgtgttctgagtatgaagctccacagcaggccctgcgtattgctgaggctggtgtttcacct

SEQ ID NO: 29692 - DNA, 1134 bp, Mus musculus
tgtctgggactcacagctccatgtgacttggtgccctaatttgccagatagagacagcagtacacctgtctgctggggttgctttccaggggcgctcagcatcagtctgtatttgttgagaggagtctatggggactgacccccataggcagaggccctggacttactggagcagtaagtctcctgccagttctctgagctcagccggctttgcagagtctctgggtgtatgtccacctttctttggtctgccagtgccagacttcatcttctccgtctttgtactttccctggaaccagccagctcatccttgtcagaagggttgggcttcctgaggtctgtgtcctgagaggacggctgtgctgaagtcagtgttgtgggctcagcatgaaggagtgctgtgcctggaggccagtggcctcgctccttgactcttcctcgtggccattctgtgctggactgactgatagatgtgatctaaatgcacgtctagattctgggcacatcttttcttggtattcagtgtcagtgtcctgcagctgatgctgttgatagtcatctgagccaagggaacttatgttgaccaccaaggactttgttgtgacttgctatggtatgaggatggtctgagtatgtgatggtctttatggagaaaatctacctagaagaactcagcctatgaacacacactctctgtcctctcctgagtgcacacacagatttgcggtgaagccacggccatatcaggatataatggcatggctcgggacatgcctccgtgtgagtgaggggctgactgtcttctgatcccctgagccgagtgcatgtggtcccagacctccctgaatcttccaggcgcattttacttctctctccttgtgtgttcatctccaatcctgagtctgcaaagacccacaagaaagtgaagttgagttcaacaacaggccttgcttcccaccatagagctacagcaacccttacccctcacctcatctgtttgctcctcagctgctggtgcctcctcttctgcacagattgccagggtcacctgctcactggggcacccagtcatgccccgtgtcatccatgggcatgtacaaggtttgattgtggggttgaagcatggggtcaga

SEQ ID NO: 29693 - DNA, 1192 bp, Mus musculus
tcccgtcagtccagcataaagattgtaaacctctgaactcacctgtagtgctcagaacgtcacagtatggcggctgtgtagccagtgggcaccaccctgtcctagaggacagggaagatggcaggttcaaccaacccctgaggcaggactgagcaagctcgcccagagcctggctgactgacttgtcccttctggccttgtgtttagtgggtctggacctaggggctgccagaaatgctagggcagcagtgaatgtctgctgtggagacagatgactcacactgactaataatgacacgcactaatagtctgttgtaatgtctcgtagtggccgctgcctgtgttgcctaactcagcatcttaactgtcctcagtaacatggcttctctctggcatgccctgcccacaatgtacacatgtaccgcgtgggtagagaccaagctgatgtccgataatgcagcggctccatatcctctgcaggctgtgtcatcaccatctccggacgcatgaccttcacaagcaataagtccatggagattgaggtcctggtggacgctgaccctgtggtggacaactcacaaaagcgctaccgggccgccagtgccttcttcacctacgtgtccctgaaccaggagggcaagccaatgcctgtgcctcagcttgtggtaagtgccctcatggttacatcctgtcctaaacagggcaggacccaggcctgggaccaggggctgtgctcaggtatagtcaagtctctagaaagcagccttgcaagctgcaggctgtcccatcgctggccccttgggatatgatagcacaggctgccccatcgctggctccttgggatagcacagcgcccaggttccttgggttgtgtatccgggccgggggagggggggtcttaggaacacctcaggctcctcagggggcccccggagagctgaggataggagggaggagggctgtggcgtggaccctcccaatgtgactttgggcttttgtgtcacctgatgaaaagcaggcttcagttctgtgctcctgggactcaaaggggtggcccacttgtcaactttgtgaccttaggcaggaagtgaggagaccagaaagtcctggccagagagagtcctggggtgggaagcaggaggcgccatctccggaagctgtgcgagggcagcctcagatgcaggagcagatg

SEQ ID NO: 29694 - DNA, 2022 bp, Mus musculus
attagcagctttctgagctcgccctccgagtcctcgggctacgtcacgctgcactcggactcgctgggctctgcgtcctagggctcccagagacgccatgcagagcgtggcgccatgaagaggcacagcgccaaagatgctcccacaggtgttgggcgacaataagcgccacctaagctaggggtgaatggatggtggactctgcgcttctcttacagttctttccttctggtgtcgcctggagggacgactggccaccttggatggctgcccaggacatggacctgctcctgggcaaggcatctcccaggaaggggcaggctgtgcctgtgtagcgagtggcatctgcactttttgtacagctctgaggctagaccagggcgtagggaaccctgagacccgaccaccatgagaaagtacgttcctagagaagcttaagccggaagtcacgactgcatccaacttcctgcactgccgctgcctcacctcaaggtgtagcatgtagaacgaccccaagcacaagggtcttcagagcccaaacaagttctattgagcaggcgtcccatgtggcctgcctcagtttccctatctctaagagtgaatgaccatgatacatctctcagggctgtttgaagaactctcccggtctgtgtgccctcgcacttgaatggaccaggtgtgagaggtagtgagggccctttgttagggtcagccttcagcacgtgggccccaattgaggcccctcagtcttaatgacctttgccctcttggagacttgccccactttagctaaagcacaacaccatgggtatataacagccacctggacccctgttagtgtccccatgctcaaaattccaccatattgcctgtctcccactatgtcggccgcttccgtggtcctgctgtgaaggctgctggtgcctatcgcagagaaccaaagctcgtggaagtggactttcgtgtctcagtgcccatctccagttttgcctcccacaggcaaagtccttggaaagggtgtcctgtaccccacttcccctgcaagaagggctttgctctctcctgggtctgggctgtgccagggacatgggtattcccaggagagtctgggagctgggagcagagggggagagctgtcaccagacagcggaccctctgtgttgggacctggagatagtcttaaggccagcacagaaccagcctgtgtctccttgttcttgagacgtggtggacaggcctgtctcctctccctctgcagacagatttccaaccacagctggggatgagggaggagggctggcctaccctaggcctcagaggtctctgttatccctggttaagtaaaagatcagccaccacagaagagtagagcaggggactgtggtccatgattggatttgggagaagctgcctctggccatttgctgctgtgccttcagggactgacatgtcatacaggggcagaggccaccagctagccactgtctctctcacaggtctcaaatgaccaatttaccacttgggtttcactctgtattttgtattcaatggcaatacttgtagtggggacatagtccccctcagtcactcctgatttttacaaaactttaagggcaaaccctgaactgagggccgtaggcacctagggctctttcccacactaagtccagcctccctgtttgctgacagctctagctatctctataccaccacccagcccagaggcagggattcgtttgtattttttttttttttggaaaaaacaaaacaaaacaaaacagcgtttcttttctgtacaggacccaataaaaaattcctcatggtttgcacacatccttctgaggctggtttcatggaaccgcctgctccccaagtctctctacatctagagcctgaagcctaggccagtacgttcccttggacttgccatgtctccaagcagatggtgcagtctcacctggccatcgagacagacctgagtcctcaactgtaggaagcagcatgtgggccccaaagcccatg

SEQ ID NO: 29695 - DNA, 3603 bp, Mus musculus
gaagacttctgccctcggctcctcatacatttaatcacatttacacaccaattttataaaaatagcagtgtagattccaagggactctgagcctccatgcctgggagtttctaagtccagcttttacgtggcaacaggtagcacagaccctcagggtgctctgcagcttttgagtagccattgaacctgggctgaggatgggggccctgggttcttctcaggtcctggccttggctcagctgtacccctaggaagtaatgtccgtgctcattctgagaaatgctgccctccgtgtgtttgggattgttcttatttatcatagcttgtgttttttgtttctgtgttgcaatgagtctgtcaacttagtttcctgtgttttttcaaagtaagccaccctcctgctgcagcagatgtcttccagaaggttctagcacagcccatacatctgcggcccgaggcacattaaccctcagcagtccacagcagaggggcctcgctgagtttccttagcatctttgttctgctggtctggaagaacctttggctctctctgtgttgcgcacaaaagctttgagaggtgtagctcttgattaatcctggactgggcaagagcctggtcctgctgtgaggcccttgcagatttggtgtggtttgctgtcctcagagctcctactctgagatgtagaagtcttagtctgccattcatgagcacagagtcatgggtggagaatcctgagtgtctcagctcacacccagcgcttataaaggcgtgctgtgctgcgaggctgaggatcgtgtaccgcgccttccctgccagctccagcagaatccagatcagcctacatagtgctctgtgccgcagccaggtcctctcagacttgagaaaacccttttccttctcccctgttccactgagcagaccctgctgggttgcaagtttagtgttcctggccttcagacatgtggtcacccttgagtacagctccatcttcctcagaagacctccttccttcacaagagcaccgctgcacagcagcacacttggtacatcaggtcagacaagcccaggccccaacagtggccatggtgttgctaagcacactggcagcttgctgtacataggccaggtctccagcagggtaccaaagcgggcttggtaattaatgccaagctggaattcagcagaacataagtgctcatgagttctgacttagggcttcgtgttggcagtggcagcattggcgtcttcaggaacaatgtgacagttgtgccccgatggggggtgctgactttggccactcacagttggctggctgaagcaggactgctgttctgtgccacacacagcaaactgctgctgctgctgggcatattcagctgccgggtctgcaggtctgtcccaccagtactcagaggtccctgggaaggaagccgggatggagggtgtggctctggccaagaggatggtgaaggttaatatgaaggttaatatgagtgagtgctcaatattgagatactgtaggaccttgtcaggctggagagaacaggcaagtggctggttctgtgttgtaatgcagccagagttgacagaacctcgggggctgggtaaatgaattctagcttattcttgacataatagacaggcattctatcagcagggaggtgaccccagtaccagttcctccaccaaaactgtgagattccagaagcctcaaagacgtgtgccctggtttgtagtaagccagggaaggctccaggagagcctcaggccagtccagctggaagtgttccccgggccacccggcccatcgcctctgcagccaggactccacgatcacttccaaactgcagtggtgctgaccaagggtgaaggtggggatgtggccagagcactgctaattaccacgccctcctgtgcttgggcctcccatcagggtcaggatggcctccctcacaggggtgttatgggaagatgagctgggtggcataatgaaatcttaggatgagaaccgggtttctgtgtgttagaaagcagtgtgtgctaacatgtgtccaaaaaaacattctgccagctcgcaagtaatttatttttagattttatggcttaattttgttgttgttgttgttgttctatataccaaagaggcttacgggtttgccagttacagtgtgaggccagttagttggctcggaagccgccagccttcgggacctgaggcttgcaggctccgtggcagccatggctgttgtccacaccaaactgcccaggaataagtatggtgatatgagtggagacagtccacacttcccatagccagtcccactcgctaggctgcaaacgggaggaaatggatttgtggcatcatccccagctctttatcagtgcatctaaactgagctggctccagcctcctagtccccttgagggccgtgaagttgtctttttgatggatggggagtggctaatggcagcccttggcattgcgggcagtaaggcaaaatgttggcattggatgttaccctccacctgccagaggccagagagagggagcccaggccttgggactcttggtgagatgctggattgcatcctaggagacgggaggctacgttccagggatgtgggtggaggaagatcaggccacccttctgacattcccaggatggcagtcagcatttcaccagggactatgagcatcatcccggcaggatctggcaggtggctgttctctgctgccgtggactggagattattttacctctatggatgtagccgtaaccgggggcagcagaattggcttgccgaggctttcaggtattataagggcagccatgtcctagggtttccacagatggaggagttgtcaggagattggtttgtctgcttgcaggcttcggagtggaggtttctgtgtggagagccggtaccttacagaaaataggcgacttggcagtcatggggcagggagcattcaggaggccctgtggctgctacaagccggtgtggcagggcagaaagcttaacagcggtgtccttggtgggagctgctgcttggacctagggtgtctgtcgccttaccaattcttcccacttagttgctaacttggggccactcagcctgagggctcagccaaagctcctgggttgcctcctctgcattctcccctgccttaggtatctgctgcggcaaggtagagccctcagcctcccgatgggcagggcaggcagctgcgtggctgtgaagcttgtccctcactgtcctgagaggaggcagcctgtctgacccactgcaaggaggactatggagtgatcactgtactcttctttttacatacagaaatgtttatttaaatatattaaattggattttctttcacagatactgaatattctttctaattcttaaataaaactgtacttggtttcactatgaggagtcctgtatcaggtgtcctgcatgtcgggtgtttacattattattcatagcagtagcaacattacagctatgaagtagtaatgaagtaatttcatggttgggggtccccacaccaggggaactgtattagagggtcacagaattaggaaggttgagaaccgctgtg

SEQ ID NO: 29696 - DNA, 2635 bp, Mus musculus
tgtaacagagtgtctgggtggccatgatgtgtatgggttgggtcaggggacacagaatgctggtgagcagcctggacggcttcggcccgcccccttggggaggcttgctggatatggcggtgcttggaggtggttggaaggttaatggttccagcagaggtggaaggtgtgtggagccgtcggctcacctgtgcggtctttctctagtggtctctccagaccattctctagacgtctgctgatatggtctcacttttattgccaagctagggatgtgtgatagacgcttgcttgccttgttagagcactggctctggtgtacttagcctgtgtctggaaaacatcttaaaattgttttcagtgcttcagaatgcaacaagccaccagtctggtgtagttcttgtgctctctctgcaggtatttgaaatatctcaccaaaaaatatttgaagaagaacaacctccgagactggctgcgtgttgtcgccaacagcaaagagagttacgagctgcgttacttccagattaaccaggatgaagaggaggaggaagacgaggattaggacacattggtctgcaatgttttgtattaattcataaataaaatttaggaacaaaaccggtggtttatccttgcatctctgcagtgtggattggacaggaagttggaaatgacagggactttaactgggctgctgctcctttgtatatagacacttttttcctgctcagaaacttgagttctccagtagcaatggccaaacagaagaaccaggctagggggctgcatctgacagagcaagtagacgagaggctgggtggtgggctccggccagcccgagtcttagagctggtggttggttatatctggtgcctgtctcgaggagggcttgagacacagtgtggtgctcctcagaagcagacaggtgatttctttgtgtgatttttcttttcccctgggacaatgacagtcagtaagacaggtttcagggacttttgtgtccaggtctgagcactagtcgctcacagttgtgtgtactaaccttcttccttcctattgaaatggcaggggtctttgagtctcactgctgcatgttctgccttcatagggatctgtaagtatgctgggcatctgggcttttagggggctctctatagggtgtctgagatagaggtcaacaagggcttatagacaactcaaacaaagcccatggcttgagcaagtctgcaacaagctgtttgtctagcctccagcagagggcgagggagacagcttccagatgttcccagtaggtggagcccctccaagcccagggctcaggaggcttacagggtgggaactccaatactggtggagggaggagggcgtttgatgggaagatagggaagttgctgcttcctaaactgtcacaactgggcttggataggagtcatagtctgggaccacagccctgtggtagaatgctagcctggtgtgctccaggtttaatctccatcactgcagaaatgagtccaagctgtgtgtacctccagggcactgggcatggggttcccttgccattgtgtgtgcccggagaactggcaggcgggaaatgtctttatcaagggttaccttggaagaggtcccaacactgtagggtgctcctgttgtcaaaacctatgcagaggcatctgcttgctctctaataacagtatgcaatgctaaagggctcgcttacagccggtggccacactggaggcctgcacatcaggtggccacaagttctgctgctgcgcctccgaggaaacacttggtcctccgatcgattttaacctgttgaggctttgcaatccccctgtggcaaaggctccagtgttttctatttctatgcaaatttcttgaagcagaactgttactgtctttctcctctgccctgggaggaggcgctagcgtttccttccaacttcaggtgcagcccccctcgtggttagcggtcttaagttcgtgacttgggtttgcagatcttttttgttacatcgccggaccatgtggtggtctttagctgtaaacaacattaaccctgggttgattagcatatgcttctaaaagatggtcccagattctgcgacttgtaataaaatggaaacttgctggtttttatgcctttctaactcttgtatttgaatgaatgttgatcactttttgtattaaagtggctgacacatggctactgtcactgtgcaaggctttttttcttctcatacttcacgcaacccgctaaaccttctcactggttagttgcatcgggcacagggaaaagagtctcctgtctctctgctctctcccgtctgtacagttgagcctctgtgaggttggctggagttgactgagcctggagaattgcttttcaaacaactggctttttctggtgggcaacgtggagtggacctgttagacctgccgtagcagctgtatccaggcccctcctagacctgtctcctttatgtctgtctggccttgtgccttacctgtctttatcggaaatgttggcacacaacacgggagttttaagctgtgacttcacggaagtcagtactggcacaggcttgttccctgccagctgcggttgctccaggtgccctcccctcctttgaga

SEQ ID NO: 29697 - DNA, 1181 bp, Mus musculus
tattgcagcaatctggaaggcttcttggaggagtttgctgacatatccaaggaagatcagatcaaaaagctgcatgatctattggggccgcacatgcttcggcggctcaaggccgacgtgttcaagaacatgccggctaagacagagctgattgtccgagtggagctgagccagatgcagaagtgagtgctggaggctcaccctgtcctgcagcaactggcccttctcctggtcttgtgtcctcagccaccccttcccgcaggccccaactggctttcctgaccatttcctggggttgacaggagtccttgctcagtgatttccttccccctccatcaattgcagtgactacggtcaggctgcctcagttgtagtaatgtctcccattgacgttttatccatacctggtgcctggggcaccaccaacccttctgaaagtagagcctgccccttaggaatctggtgggacctgaggaggcggagtccagctaaccttgaccgcaccctgttgcaggaagtactacaagttcatcctgactcggaactttgaggcgctcaattccaaggggggtggcaaccaggtgtctctactcaatatcatgatggatctgaagaagtgctgcaaccatccgtacctcttccctgtggctgctgtggtgggttccctgtgatcatcttggaggggtccctgtggttgctgtggtggattccctgtggccatcttggtgggtccctatggctgccatggtgggttccctgctacagtggtttctttatggccatcatataggtctctacaggtctgtaccggctcttgttgttgcctgtggtcactgtgatgggttgtccgtggccaccatggtgggtctctaatggcttctgtggtcgtggtagatccctgtggctgccatggtggcttccctgtgaccatcatacaggtccctagttgggcgccatggttgaactaccatggttggttcttcatgcttgacactcatgtgttccctgtggacagtaggtgcctccctgctgtggtggtttcttgtgatctctaaggaaggtgcccatggctaggtgccttggccccagtcctctgttcctttcccagtatgacttgtagaggtgatgtgtgtctccatcctgtccctttggaagctgcctctttacactgcttggctcca

SEQ ID NO: 29698 - DNA, 1199 bp, Mus musculus
cgagggagcttggtaggggtcagattgtccctggaaaaggagttggggggtatgcagcatctctgggcctgccaaaaatgggggcaggtctccatggcttgttttgaggacactgggcaggtggctggcctttacttagcccagatatgtacacatctgtaacatagttcctcctctgctcctggagggctggacccccacagcttcttatactttgccactcctatacttgagtgtctatccaagtcttaaggctagcaactggccgcacactgtgggtaggcggggagggggaggggactctggccatagacaggaccactgaaggcttgagtgcattatggtggctgaccccgctctccaagaagggctgtcctctgcacaggagtgtcttccctagttcgctccccaacccagacctctgtgctaatcccaagatgggcaagatggtcagccctgttggcctcagttgccacactgacatcctaagacttaggcctgcaggctcacgtgggacagaatagggtctgtgtctcttgacttcaggggtccatcccttccctgaagacttcccccaggagtcttgctctgtccatccatctctgcttcttcctgggccatacccaccctctgtggccttcccctctccacagccaccttgacctgagacccctgctggcctgggagggccttagcgcctcagttctccagggtagactgcccaggcagctgaggagaggacaaagtccttcagagtgttcgcatcttggcccttcagctgtcgcctgctagagagtgataggatagaggtggcatcttgaggtggctctcattttgctgctgatagaactgggtcctcatgcccgagctgtcagagctgcagtgacagtgatttctagctgctttggcttgcttaattctataggatctctgtggaaggtgtggggtggctctcggtgacataggggtttgggtcagagctacatcatctgagggcaccccctcacccctgttctgaattgcttactccccataccccaggggccacctgtgagccagggttccctcccccagcctctgggtgctccctagcccatgtgggctgctggctcagtgacaccggcaaccagtctaagtcttgagtcctgcagggggcacgtggagggtaggctagggggccagggctctttgtagtctca

SEQ ID NO: 29699 - DNA, 1099 bp, Mus musculus
gtgggtggggctgacagccttgtccttttcctttctcacaacctttgtgagcatggagggatgaccccgagaatggcccttcacattttacctttagattttcatgaggctctgacagactttagtgtatgtgatttctgtctgttcatgttcactctacgagaagtcagaccccagaagcatcgaaacactagttaattttaaagtggctcgagtaaacctgattatgggataataccaaaacaaaacccccaaaacaaaacaaaacaaaacaagaaaaacaaaacaaaacaaaaaccaaaaaaatccctttgaaatggctttgtgcttatggcaatgttttcacggacttagcaaaagacagtttgttctgcgagcttctgtgcctccttcgtctgctgtcttgcttggtagaagcctttgtgggaaatccaggcccactggggaagaggagggcccaatggtgggtgttctcggatggtaccctcctatcgatagcagaagttgtttttggactggccatagaccaggctggccttgaacttgccctaatcctcctgctgtctccccgctgctggtattacaggtgtgtgtgtagctctgcctagctcacacggtgcagggtgtgtgcacactaggcaagcgctgtatgggcgttttctcacagtccgttttacagtggagtctgtccaccgataggctgactacgcgccagctctcgcctcagggttttgaacttctgcggtcactgggtattggccagttggactgttcgggcgcatgagtttcacaggctgtccgtgaatttatggatataagcgtacacccctgtccatcctgtcctgtggctgtggcatccatcctgtcctgttcacagggaaggtcctgaagtaggacccagtcaggttggaggtgggggacacagatgtctccaactcagatctgtccacagccctacaacagcccatgtaccacaatttggacagctctgatctgggctgtcgcctgggtctacatagatgtcccagaatagagcagagctggccctgcccctctctggctgcagcacttgggagagcagccctcacccgagcatcac

SEQ ID NO: 29700 - DNA, 1149 bp, Mus musculus
ccggcccctgattggtgacgtggcgatgacatcagacgccgcgcgcgcgctcagagccgcgcgattgagacttggcggaggagcgttaggccggggcgctcactcatgaggagcaggaaggtgaggggcccccgcaggcggggtgcgcgccgccgagccgcactctcccaggggagccggcggggggcgggcgcctcgagccccgcccctgggaggggaacccgcactccaggcacctccacccgccccaggcgcggggctccaggctcgctccccggggtgagggccaccgggacccgagctttgccctcggccgtgcgggctactgcccgggcttcctggcctctcgcactgcccacagatgggcgtgctgcagccgagcgagctcagccaagcccctgtgtcgtgtgtaacctgggctgagggcgggcagtgggacgggagctagggtgactgggacctaaaccccggctgcaaagggtctctggccgaacgagcatggcagggacagtgagtcccttagcctgaagtgtgtctgccctgcaccgctagccaaagtccaggctgacgtccctgcctcttgcgttgcgcagacgtttgtgtgtagcgaggctgacaataactgttccccgtgtcagtggtcatggttgctgcccctcccttgcataaggagactttattaaggtttaatagttccccgctgtgttttttacttctttgcgcgcctcggttccagtgagacacagaagggtctaactcttgtgaggttctctcccactttccgttagctgtctgttgacagtgcagccttgcaatccttactttaccctttgcagccacttcctcaggccagcaagggcccctcggaccctccccctttgtttgttcctgcctgttgctagcacgtgcctcttttgcctgttcagagaagtatgtttaagataattttatgttagggactttccttgggggtcgagggtgccctttgtacctggattactgattgggtccttagcttcagctagaactcccggtggttctaaagcaacaccccctcccccctccacacacacacccatttgcatctggaaattcctttattctcaccttcatcttagaggacaggttttctgggtatggattttctta

SEQ ID NO: 29701 - DNA, 1160 bp, Mus musculus
accagactgcagctccctgctcccactctattgtgtacccatggtacacgaaaccaaggtgaacataattgatcatgttaatgcaaggggaaaaaatgaactatggtgtgtaacccacatacacacatacacacacacacaggctcacaagctgggaagcagctcagatggaaaggctgagaaggtagcgtccctggcttcagccccccctctgtgtcttggacctcacacaaggttaggaattcagatctatgatttcatgaacatgtgaccatgtctgttgtcatctcttgtttggagtatagcatctttcttaccaagggacctgtgcctagacagatttcctgggtctgtaacaggcctgctttgcagagccggagcggactggccaagtatgaatgtggatgccctggcaatctcacttaagactgaagtcatgctttcttcccctctaaggatctgccaccagcctcttcatcttatccttccatgagcagaagagaattcagaaaaatgcacttcagagccaaagatgacgaggatgacgctgaggggtagagctgcgggcgccttgcagccggtgtcaagattctgtatggcatctttcagagaacacgctctgagaacaaggtggacatcagtgtcactggctggcacagacgcccaggcgcaccatgctggcacagggggctgggcagtggaaaacaaggaaaactcctgagagctttggctgtggtaacaggcttactttccatgccagactgatcaccggggatgaattctgctggaaggactcctgtttctgagtggcgctaaccatttgacctggtagtttttgcaaagtatatatgagaaagaaataaaatatattttgaaaatacttttaaagaaatactgtgttcacaaaagtgtcatttcaaatatttgtgaatcaagggaggaagtgaactgtgtcctgggctaggagcactcttgaggcccattagcaagcaggaaaggcaaggcccttggtacagggcttgactggagttggggtgacagcccctccactgggatagaggctacccacaagggtactgggaattgaacttggctcctaagcaagagcaacaagtggtccaagcctatgaggagtttacagttctgctcctgttcagaca

SEQ ID NO: 29702 - DNA, 1248 bp, Mus musculus
cctgtggcagggtcttcacgctcaccgccccagggctgaacttggccactgtgatgtgtgtggggtgctagtttgtgctgagcttttatggcttctatttctactgcaaatggcagctctgactatacgcctctgaaagaaacggtgcttctgggataaatgtttgcattttataacgaacatgcaggacatcctctgctgcattgtttaaaatggcagaaggtgggaagccatccagatgtctcctggtgtgaacagccaactgtggcattattttgagccatgtgaaactgatgtttttaatgggttaaataatggctgtcatgaatttcatgactcaacactgatatatgtatgtacgcacgattggagcaggtttaaactttcatgtggagaaatagggaactgttaaaggcatagatggctttatctgtgcagggaatgaccttgaactcatgatcttcctgcctcatccctagagctgggaccacaggtgtgcaccaccacacctggcatttggttttgtaaatgtgtgtcagcttgtgcatggtctgaggaaatgacactctgtaaccctgggggattcagcagggctgagattgatcaccaagtacaatctcctacatcatgtattttataatacttcattctgctttttctctgagaccgggtctcactatgtagctctggctggactggagttcactatatagaccagccaacctctgcctcccgagtgctgggattaaaggtgtgtgccaccacgcccaacctgagtttatttttgaaatgggcattttatatattttgtaatgtttggatttttatatttgccatgtaatcagaaaaacaataaagtgtttctaaaatagacatgtcaaaattttttgaacatattgaggaagatggggctaagggtgagatactggcaggcagaaattgaacatttatctaggtgagttcatcttcacagaggtggcagggcagtgcccgaggcagccagccaggtggggctctctgaggacccagctgcttgtcttagtcatggatgcacactgttcacaatgtgtcttattctgcttttctgtccttctcaaacaccccaggacgtgcacaatcactgccccctacagaattgttgccaggactgggctttctgaagtttgatgtgtgtgtctgtgtgtgcgtgtgtgtgtgtctgagtgtatgctagtgcacctcgtgaatgcaggtgccaggtcggtacga

SEQ ID NO: 29703 - DNA, 1050 bp, Mus musculus
tacacagccagtgtgaagctgaggctaaaaacagagccgccccacacacccgtcccacaaaccccttgcgtccagactctctggcgagcgcgtgttctctctatggtcatttccggctcccgccggaagtgtggcgccgcactccggaagcggcgcacgggcggcgcgatggcggcggcggcgatggccgtgtccgaggcctggccggagctggagctggccgagcgcgagcggcggcgcgagctgctgctgaccgggcccgggctggaggagcgggtgaaggcggcgggcgggcggcttccgccgcggctcttcacgctgccgctgctgcactacctggaggtgagcggctgcggcagcctgcgcgcgccggggcccggcctcgcgcagggcctcccgcagctgcacagcctggtgctgcggcgcaacgcgctggggccgggcctgagccccgagctggggccgctgcccgcgctgcgcgtcctcgacctgtccggcaacgcgttggagacgctgccgcccggcgagggcctgggccccgccgagccccccggactaccgcagctgcagagcctcaacctcagcggcaaccgcctgcgcgagctgcccgccgacctggcgcgctgcgcccctcgcctgcagagcctcaatctcaccggcaaccgcctggacgcctttccccccgagctcttccggccaggagctctgcccctgctcagtgagctggcagctgccgacaactgcctgcgggagctcagcccagacatcgcgcatcttgcctcgctcaaggtcagtgggacccgaggggagggagacgcgcgccctgctgtccctccttggaggatgtctttgcccccgcaaccggtccgtctcctctcagttctcagacctgcgagctcagaggtctctggacgtgtggcagtttaaaagttgctatcaatgttagacttctcatgtgggaagaaattcaagagcagagagccaggtgtggcgcgcgtgtgtgcgtgtgcgtaactgattgggtttccaaatggcggagcgtccagacaa

SEQ ID NO: 29704 - DNA, 2210 bp, Mus musculus
ggttaccacagccgacttcctgggccacttctctctgttaaaaaggtattttcattttcagagaatggcagaactgagcaaaagcacttcagaaaataaagaggaagacatgctctcagggacggaagctgatgccggctgtgggctttctgatcccaacttgactctgagctctgggaaggatggacagtgccctctggtggtggagcaggtccgagtggtggacctggaagggagcttgaaggtggtgtacccatccaagacggacctgatcaccctccctccccacgtgactgtggtccgctgacaggctcctgtaggtgtgggtgtgctgtaggtgtctgtgtgggtgtgggtgtgctgtaggtgtctgtgtgggtgtgggtgtgctataggtatctgtgggtgtgctgtaggtgtctgtgtgggtgtgctgtaggtgtctgtgtaggtgtgggtgtgctgtaggtgtctgtgtgggtgtgctaggtgtctgtataggtgtgggtgtgctgtagatgtctgtgtaggtatgggtgtgctgtagatctttgtaggtgtaggtatgctgtaggtatctgggtgtgggtatgctgtagatgtctgtgtaggtgtggatatgctgtaggtatctgggtgtgctgtaggtgtctgtgtgggtgtgggtgtgctgtgggtgtctgtgtgggtgtgctgtaggtgtctgtaggtgtgggtatgctgcaggtgtgggtgtgctgtagatctctataggtgtgggtgtgctgtaggggtctgtgtgggtataggtgtgggtgtgctgtagattctgtgtaactggttctttgctgtttctctgggtgttttaaggtgtctgcttttgtccaggtgactgtggtaatgtgagtttgcatcatcatcatagctccaatgtgactctcctgtctcctgtcctcatggatcactcagtaactgctggggatgttctgaatcatgtggcctgtggccgtgctggagagtcaggttgaacgcaggcattctattgaacagtatttatttttctacaacatgttaatagaatttttttttaaatcagctgtgcatagacagttgagaacatcatgttgtgagtgtaatcttcttagagcttgtttccaggcaccgtgctgccgccatgctcccagggcagcatctgccttccacggctgtgcttggaactgtagtgctggtcgttgttggcacatctgcgccttggccaaggaagttatctatgtccgtgtagtcctttgtagtcagacagatgcttcgtggactgtgcctcacacatggccctgcaggctccatgtcagcgtgtcccactattcatgtcccatctctgtgcatcctgactgcgcacatcccatctccgcatgtgtacgcatctgtaccagcacacagctgccatccctcgagccacagtgcctggtcctaaggacccagcagctgcacagaggacttggtggccccgtgccttgccatctggctgagaagagaaccagaccctcagccttccccctcgacaccttctcgttggtgacctctgaccttaaaggaccatttctaccttctgtaaaagaacacctgtttggggttgcgtgcggctttcatcctaaggccgtgcgagagccgttagctgtcagaactagtgaagctccaggctcctcgtggcagaccctggacaacgctggtagctgttctccatgagacacggctgctcacaggtccctttgagtggctgtggcaagtactcacctactaagtgtttagggtggagctatcctgtgctcaccctgtctccccccagttcctgctgttccctccagcccagcccagcccaggtgtgagattcattgagatttttgaaactgtttttacagattcaagcagaacgcctctttgttctaataaaaacccttggtaacgacatctctgcatcagcagccttagcacatgcgtctcccaggacagtgttgcagttcaccagtcctcaggtgtagcagacatcatacatgggagagcagcccgaacccccaccagggtagggtgtccatgaccatggggctcactgagcagctccgcaagattactgggcagctgccaggagtgggctgggagcacctgacccagtgtggagtgcagaatgtggctggaagcccgcctcactgtcagcccgggactacaggagacgcctg

SEQ ID NO: 29705 - DNA, 1203 bp, Mus musculus
tgtataaatactacgccactgtctataaagggctttatttaagggtgtctgtggggttcctgggcctgatctctcatgaacgctgagggtcacgggtagaatgggaaccacgtatggaattctgaaggtcagtagctggtttcacatggtgaaaagagggtcagagctgtggctcagtagaggagtgtttgcctggtgtgtgtgaattgtgggttcgatccccagttctggaaagcaaaccaagaaagaaactggtgaatgtaatcaataacttactcctgccactgtaggtcatagcggtgtgcagagagtccattggggtacttttcttcccacactcaaaccctttgtagccattggtccaaccttcagttctgtgtggttcctcacagactcacggctcaattgaggcataggagctgccttccagaggagagcattatgactggtcaaggccaacagcatgcaggcgctctagctgctgtagccagggctagcccctctgagctcagcagagactgtggcaagaccaaggtagaggcttccactgggcggttgggctgttgtcagaggcccgtgggagaatgggggtgcttgaatggggggctgtgctgggccaaccggagttctgacttgatgttgctcaaattcctacctcagcagaagtgggaccatgaattcctacctggagtctgttggcagaccttggagtggggtggggtctcctcagcctagaaaccccacagagtgggaggtttacggcctgcctctttctgaagggggcagctgtcgtatcccttgttccctttgaatggccttggtgctgggagaggtaaaggttgggtgctttcctgttttagacagggttattaaggtataattcacagagcatacaatcttctcacttaaaatgtacagtttggtaggggttgtaactcgcatggcagagtgcttcttgcctagagtgtatgaggccatgggttcaattcccaacactgcacacagtgggtaccctggtgcctgcctgtaatcccagcactcgagaggcatcggcaggaggatcaggaaagagttcaaggtcagcttcctatataatgagctccaggctagcctggctgacatgagaccatgtctcagaaactaaaaataataaagcaagaaagtaaataatgaaatgtactgctcagaagcttttgtctgaac

SEQ ID NO: 29706 - DNA, 1365 bp, Mus musculus
actccatgaccaggggcaagataggcttctagacagctgcgtcccggaaaccaaggtggtggggactccctgtgccacctcatgccacccactggctggagggaaggagggcatgtatccgattagaatagtcaagtggattatgtatatttagttggatattggacatcttggcaacacaatcttacaaaggcagattcagctgcccccataccactgtgttccttctgtaacgccacgttctccctccagcatgccgagcacaatgtccacccacttgtgctgtgtagactgttgcatacagctgagtacagtgagcggcttctgcacatatttaactctccctatatattaactctcaagtgctgtattttaaaattcagcccgttttttaaaaaagctaaatacagtagcagccagcagccagtcactaagaaagacagtctgcctggcagctcctggtgaacctgcctttctgtgaatgtgtctgacttagaatcacactttataaattaatccaggttgtgttaatacagcagttttcctaggcccaaaaggttactctcataacataagctagccccttccggaagtcatggtggtgggtttctatcatcctgtctctgtttaaaagggactgaatagttgggttttaaaagtgcatgctataaacagacgagcatcctagagctcactgagcactgctgagctttgacacgccagccacacacagcttgctgctgtcgttctagccttgccagtgcactgtagatgctggcctgtcactctatacctctcgctttagttaaccggcatggatgtgaccggaatgccatggcctatccaagaggaaaggtgacctcagatgcacctgttttcagcctgtgcttttgttctagtaaagacatttaaaccaaatggagttgctcctttttgaagttattgtcacagaatcaggagtgccaaagactgtcttgaggactgaagtctggctgactgaggacccttgtgagcatggtcctctttacagaaactcagatacacaagtgtgcagtcctggtgggaaccctggtcaccagtacagacatactggtctgtctgctttcaaggcacttactagagatagagaggtttgggtgggctgagctcttccactctaccaggcagtgacccaggcctctctgcagaattcacttgtaaggccagagacctgcccaactgttgtgggatttacagctcacacggggacaggcacaggtgcggggcacttctgagtacatccagctgcaggagggctggccagtctgacattagtccaccttgttccaaagcccactgacagaaaacccctcagggaatgctgac

SEQ ID NO: 29707 - DNA, 1100 bp, Mus musculus
agggtattagaagccttgatggcctcctgcaagcccctgaccctgagtgggtttagagtcagagcctcagccttccagtccacttagctctagctactgagtgtgcttggtgacagcctgctgcttctccttgacctgttcctcggggcgatcagtagaggaaacaaaccagaggaagtgggtttacaccaaggcacctaagcttctgccacaggtacctattagcgtacacacagcatctgtgcgcacacaaacccctccccagtcaccagtgtgctgtccccttcactcacgcatacacacacacacacacacacacacacacagagcagctgcactggggtgaagatgaagatatttatcccttttaggttgaaggaggtactaggccccatctcagagtcaacccagctatgcctactgaactctggcctggccctcaggtaagtgggtgagcactcgttctgctgaggactgatgtcaggctgagcctagacttggcccttctggctgccttgggcccttgatttttggatgcacagctcttcctcaggcctgagagatatcaccgtctgtgcctgtcacatctatagcaaggtagagcccggtgggaagggaggcagattctatagtacatgttgggtgctccgtcctgatctggcgctagccaagcaaagacacaggtttcagtaccagactgaagggattgttggagagacctgaacagccagaccaaccgtgttcgctcctagcccagccctagtcagctcagaggctgcctttctggccgggaggtatacagggcctaagatcaccacaccagagcgtccccattgtgtcccagttctcagagccctgtggccaggctaagcatgcaagatccagctgctaccatccctgaccacacaagcggagccttgtgcaagaactaaggacagaacatgagaccagtctccacctacctgttatatgttatatttcactgaaacaggtggctcacatgtaaaacaaaattttaaagaaatacttttatgttatttagatctgtaatcacaatatccctgctggcacctcaggtcacctgccaccagcaccgtcct

SEQ ID NO: 29708 - DNA, 1142 bp, Mus musculus
acagagccttagacgcctccagagaggcgctggtccacctttgaagcatgcatctgtttttgctgccagactgagaaccttcttccctgggcttattccagtgcctgtgcttccctggcagcccagcaccaagcagggttagagaggggtctctgtgaaagatctacagatgtctggatccagaggcagggccagacactcattatcaggagcttaccagatgccatagctgtggggtgccatgttcagtgtatggaagccaaaagcaaagtacatttgcccagcacagacacttactcactggtaatcctggatctctaaaccctctctcatggatgaggaacaagtgtcctggggcctttgagagggggccaggaatgaatagattgaagagtagacctacgaccacagcaggaggggggagcatctgctgctggcttggtcctgggtttggggtaattcaagaaggtgctcaggtttgtgccccctcccaggagtgtggagtggctttgagcagccccggcttggcctttgtctttgtgttagctctagggacgtggccattctgtcttcagatgcccccacctggcatttattaaacttgattgaaaactccgaaagaggtaaagtaatggcaggcagcctgtacactctttctcccaagaggttgaagaaggtatgggcttgtgccctgcagtatgaaagagctgagaaactgagatgtctccacgctggctggaaaggctcaccagaaggaggacagaatgtagttgggatggaccaagagagtcagcgaatggcaacaagggggtacaggcacagcatgggcttagacagccatcaagagatgcatatagggtcactcgggtgaaaccacaaaaacctgtgtgtgtgtgtgggggggggtggttagagaactcattttggattgccaaagccatggggagcttgagatgaatatattcctctccaaagagcaggcatgactttcctcagattggaagccactaacacagattccagaggtgaagaacattggctcagggatgcctcaccttaaaccctgcacaaagtagatgctcctggatccaaataatccccaccattgtaggactgtcccttactgctgccccaaccaaaag

SEQ ID NO: 29709 - DNA, 1120 bp, Mus musculus
tagagcaggagcttccactgtttaagacgtcacctgtcccatccccttgcccccctccatgaagtgacgtcagaatgtcaggcaggtgactagatatcttgaagctaaccctcctcttggccctcacgtcttggacttcacctcccgaaggggtgtcagcggagtctctgtgacctctgtcaccacagtgattttcttctctccacctactacaacccaggggtacttcagccaaggcctcagatgtgcagagtctaccatggacgcctgaagaaaagcaatcgacactccacagagagatgcacatctacctttccagcccagaaatatcccaagaggcatcttattccttgcagcgaaatgggatccaagaacacggaaggaggtgggggagacagttctgagggtctcacaggaaaatatgatctagttctccaaggcccatgtgatactttaggacccctgtggaggacttgttcatggagggagagtggcaaccggtctacagaagcacgggcaatccatcgtcaaggctccacgctgtctgctagtttccgcagaagtaattgtggagagcatgtgggagccacacgcactgctggtgtgactcagtttccacttggagtttatagtctctattgccatctgtcctgagcaccagctctccttcaccacatgcttgcagcccacgggacgttcaacccatggatctcccggatccagcctctgtagaccgctctcctcctactcatctgcctgcaaggctctgcacacagtccctacatgggcccctgaaacatgccctgcagagccccatagtccacttctgctgccagcaggctcagctcacagactcaagccctgaaaatccgacctcctggattgggctctgaccagtgatgtaggaacggccaatccttggggccagagggacacattaaggaacctgcctacagaaaccaaagcagctgatgagctagagcctgttcatattatcacagggaaaggcaactccaaaggatgactctaaatcaaacctgaatccctcccccaaagacagatgcacctgcctagctgcccctatagctcctccctccccttcacaaccttgtctctgagc

SEQ ID NO: 29710 - DNA, 1197 bp, Mus musculus
cccatggtggggagcactaccagacaacccacactggagagcactaccagacaacccacactggagagcactaccagacaacccatggtggggagcactaccagacaacccatggtggggagcactaccagacaacccatggtggggagcacaaccagacaacccatggtggggagcactaccagacaacccacactggagagcactgccagacaacccatgttggggagcacaaccagacaacccatggtggggagcactaccagataacctatggtggggagcactaccagaccacccacactggagagcactaccagacaacccatggtggggagcacaaacaacccataatcagctcagagaaagactctagaacaagtctgtcttctaaccctgccatctgaccccaggttaactactcttggccccaacaagtcctccgtgacagacacatatacacatgcaataccctgctcacactcacaagccgaaccagccaggtctggacatgggaaggctctggacatgggaaggttctgatgactcaaattccttattaggccccaggttgggggtggtgggtgaagctgctggtcatccccaggggctctgggcctttagagacacaggcccaacacagtagacacagaacaggcaaggccagtttccagggagagtgtcaacatcccaaagctgcctggctgctcagctatgccctctagtggccagacctgctcaggcagtggggagggcaagggaaggaggcaaggtttcgctgggcttcatggggcagccttggaggagagaatctaagtctcggaggagggaggctcaggagtgtacagtgcctgggttttgggtgaactgtcccatgctttgtgctagcccctgccccacagtttcagtctttgtctctgagtcccagaactcaaccttggacagggtgatgattcttcaccccataccacgcctggtctcgctccccttcctgcagcccctgtccacgctgcgggtcctatggtcttctaatttgccccaagtccttggccccactgggcaagtaggctaggatctagttctgtgctcacagcctgtttcctgggttgccctggctctaccagccctttgatgaggatggctaggtctagactgaggagggggcatacggttcagttttagaaggaggaagtagag

SEQ ID NO: 29711 - DNA, 1804 bp, Mus musculus
ctcggcttctggccgtgagtcccagactgcaagccctctgtgagaacagaaccttcgtggaaggttgctggaagtaggaaaaccctgggtagggccaggtgggcttgggcctgcagtgcctcagtggctccttctagcgcaagcttgaggtcctgcagttgccctgctagagcgcgggtaaggcacatccccacactggtggtgtagctgtaccccttctgaactctccccagctctttgttcagaggttctgttgggctttcagacaggcctattagtgagctagaatgcctgaaccccacgctgttggcttctcgatttcagttgtgctaggcagaagcaatcgaggggtacctttggctgttcaggcctagggaaaagggttcagcagaaaactgttttgaagtaactcaagtttgtttgtgtgtttgttttcccagcacatgattaaataccggtacataccattcacacacgggaagaggagatacaaagggaaggaggacgtgggcaagacatttgctagttagaagctggactgattctcacacggactcaagaacggttttgagccattgtaacaatgcctttttcttcacataaagtagttgattatgaggaagttgaattttctttttaagaggagcctcaatgatttgtatctgaaatatcaggttcttgaagaaactggcatttaaaccaaattgcattgatttctttttcagtgatgttcatgtgtttgaaatggacagattgtagtgaaccgtaggcttgggaggcgaggtgggtggcaaccaccgagagggaggacgggagtgcggccctggagagctgccttcctgaccccgctgaggccactcctctgtgccagagggacaagccagcctgcttcctgctgtgaaaaagactgtaccgctttgagggtgatttcacagagctctgtggggttctcatgccagtgtctgaatctcatctcactagagatgtttctcgaattggcctcgatcataatgactcaaaactatgttcttaactaccatgattgcttttgagggcctggaattataaatatatattatattttaattgtttgagactattttgacactttcctttgatatataacatttgcttttgattaatttaaacttgttctcatgcaacaagctctttaaggaaagagaatgggccagagcacaccaagtctggggcttatcgcatggccttttactttctatggggaaaacagacctaccacgtgtcaaactttttaatgtgataaaaataatactctttaaacattttactaagtgacttttaaatcccagttttattaaagacagtgtcccttgcttgtgcagccttcgtctacacgagtcacctcactgaagccagcttgcttgccacagctattacaagggagccactgggccaattagcaccaggacagcagacaccacaggtacagagggacaggctgtccagtatcagcaggctcttcaatcccaggctgtgacctattcagaccccattagaggtgtttctcatccatcccatggtgttagattctgagtaagtcagccacctgggtggccactcggatgctccttttaaaggtcacatcttgtacacctaaccttagaacattttctaatgttctaagtaagtttgttttttaaccatgtgagcacttggggcaccaaccctgcatgtttttgtttacatttcccacactattttcctcatcgctgactagactcctgtgtgctggaaagaaagttgggtctacctggccagagcagtg

SEQ ID NO: 29712 - DNA, 1205 bp, Mus musculus
tttgtggtgcaacagagcttcatgggtatgggctcagtgaactggttccggctggctgggctgctgttgatgatgctttccttttcttccagggttggtacattgtgacctacgccttgggaatttaccacctaaaccttttcattgcgttcctttctcccaaagtggatccttccttgatggaagactcaggtacagcagggccaacgggtgctgtcagagtgcatcctcctggggacttggacctgggctcgtgggctctgtgtgtgatcaggaccctcactaaaccctgtgcagctgtgggaaggctcaggagaaaagtgaagctcttggtttaaacaacacatccagggtcacatgggaggacgtgtagggcgcaggggtcactgttgggcgtgctctcgtacggccagagcagttatagcagaggtacagcgcagaccgggaggaccctgcttgccaggagtcgggacaggctgaggcattgggtgtgccctggtttctcagtcgaaacgttcttgggtgtgggtttttgttgttgttgacacagggtttctctgtgtagctctggctgtcctagaactcactttgtagaccgggctcatctcaaactcagagatccacctatctctgcgtcctgtcatgggtttctcctaccatgtggcttccagggattaaactcagatcgcctggcttggctgcaggtgtcctgacctgctgaggcatttcattggcactttgtatttattgtgataatggatttctgtgtattccatactggccataaaaattcatccttctctcaggtgctaggattatagcacataccactaagtggcctacattttctgttacctgctttatgtaaatgttagtttatccttatttatttatttcattattattattattttctttttttgagacagggtttctctgtatagccctggctgtcctgacactcactttgtagaccaggctggccttgaactcagaaatccgcctgcctctgcttcctgagtgctgggattaaaggcgtgcaccaccaccgcccggccttgtccttatttatataactatatagtacaacaaatgaaaaatctgtatgggattgagttttttatataattattttatgtacattagtgttttgactgcatgtatgtttgtatgagtgagggtattgggttcctggaacagattta

SEQ ID NO: 29713 - DNA, 3338 bp, Mus musculus
gattgaggacctgcaagcgaagctgcagcatgcggaggccgaccgcgagcagcttcgagctgacctgctgcgggaacgtgaggcccgcgagcatctggagaaggtggtgagggagcttcaggagcagctgcggcctcggccacggcctgagcatcctggaggtgagagcaacgctgagctgggtccctagcctgggcagtgattgccactgccacgtggacccctatgcgtgcgcagagggcagcgggtatgtggctttgcaggcccggcccatgcctctgcagccacacagcacaacgtctctactgtgcctattaccaagcgagtgtttgtaaccacatacttttggaatccactgcaaaattttctactggccaagttcaagtgagcaagccatgcccccagctgcagtcagagttgagaccggctctgtggctcgtagctggttctctgcttgctagaacattctaacatttacacttttgttataagctatttaaaaccagtaaggagacttgatattcagagaatcaacatgttttttaatgactaactgtaaaaggcccctacacgtgacgccatctggacacccactctggcgggggtggcaccacccaccgccgtcctgggaagccatcaccgctcatctgtgcccgcggctacaagaggacagcaagggttttcttcagagtctattttttcagcaacaaggaccccagtcttcctgctgctgccaggaagagcagggagagcgccgcgtgcgagatgagccccaacactgcccgccttaccgccgctgccccgcccatcaccatcaccactaaccccgccctgcgggcaccaggaggcctgagcctcggtttgcccaggcccctgggtgcccctgcccacctacaccttgaggggctgacctgtgttaggcagtggccatggcccagtgtgatgttgtgttgctcacacacgccacccagccacccatgcgctgcctgaccacagcaaccccctcccgtgcggcagacgtcactcctcgcatcgtgagctgaggctgcagcattggaacaaaacagcattacatcacttttcctttaatttttttttccttttgttttgttgttgtttgttgttcatttaaacatgtatttagaactgcactttgtcagaaccttccagtcccttcttactccccggttaactgaggtttttaccaatttctagagcagttcaaaccctaagtgctcaagcgcttacacatcccctctggtgcttggttgaacaagggaatcacgagacaatgaaaatgcagagactgaacttgggggtcgttctgtgccttccagcatcttgtacagcaaaccctgacttgtctttatacccccaaaataccgtcttcagtagcgactgaatctgccactgtcaaaatacgttacttgcatttattccaaataatctcgtttactcttaactgtttatgcaaattgtataaggtttcttatgcccaagcttgaaaaatgatttcccagtagacaagaggcccccacccatcctccaattgtgtttatttacatgagaagatcatacaaaagccctccgctctagtcctagcagggcagccatgagccgaggggaggtggagaaggcttgtgcaggtacaaacgacctcaaggactgtggcctgcaactggagactgctaagccctgacgtctggtgccgaggtcgtctgcagggttttgcccttggtttactgaggggggctgagctgctgctggtccccccttctgacgtgcaatgcaaaagggacatcatgtatacgcagcatttatttggagtttttcctttggctttttttcctctctttttcagttatgaaacttgtatgcatggatttcacatctccatagctagacccgccatgggcattatgaccgtgtctcctaaagggtcggttttgttacgcaacacgaagaatgctgtctcagccttgtttttctagagttgtgtttttcagtcatttcttcaagaaaaactaaaatgatttagttggagcaaagctttaagtgtgttggtgtgcttctgtgtggctgtccctgttgctagcagatcacagtgatttggtcccattggagcctttggccccaggggcactcactttttctcatcagagtctctccttgccacagcccgggtcaccatcggttccctggcctccctccgtggtccagcactggccccagtatgctgtgtatgcagcagggactcttttccccacatgccaggatgacttggatctgggaagggcgtgtcatctcagtttgttcctcccgcacccctcctccccctgcttcctgtgggatcagagtaaggctcctgttggccagtagcttgtgatctgggacctctggggcctcgtgtctgcctcactcccgggccccagtcctgggtgaagttggcaaagcactgggtatcttgtgcggctgccgtggaaggcggccctgctcgatgcagggtctgcagtggcctgagggcagccaggcactgcatgcctgtctccttatgaggaaggctgcaaatttcagagaaagggaggtgaggtttccaccatgttggctgttgactctccctgtatgttaaacccttgaccagtttactcgtttctatcctggaagatttttaacaaagggaaaaaccaacagcaataagtcattggtgagcagctaactcgctcattgatgagcagctaactctcacacacatacacacacacacacacacacacacaccccgacaccctgcttttcatacagaactagccaatgtaaagatgactcacatgtaaatacttttttccatttcacaccgttgtattataagtgtatatggcgactccttttccagaaacttttcttacctgttggttgtcttgtttcctgggttgtttttaactgaagacaaaattgctcatttgccagaggggacagaagcatcttgtggcatttcccatgtggtggcctccatggcacccactctcccagttcctatgcaggttatcccctgtggtttctccccacatgcctaccctacctagggctgagggggaggggctcttgctttaagtcagaagtctcaaatgacatgctcatcaattaaaggaaaaaaaaaaccccacctcaaccttcataactgcccaacaactacccccacccccacccgcgccctccagtcctacgctgctgctaacgacaatacgacggcttactctgctactcgagaactatttttatgtaattaatgtatgctttcttgtttataaatgcctgatttaaaaaaaaaaaagaggaaa

SEQ ID NO: 29714 - DNA, 1242 bp, Mus musculus
atgtcctttttgttcctttcctgtgtttccgtttagtgctcctctgttgacctgctcagtgatgagggcttcctctttcgtgtgcgcatcttgagtctgtcctgtactctaggcatggcgaggccttgcgtttcctctgagactggtgtgacagaaatttccaagtgaacatttaaaaaattctcacaacctctgagtgagtaaatgcctcctactggaaggtgttgctgatttgacggccgtagcaggtcgtgctttacgggagtagagggggaggctggagagacagacagacagaccgggggttaggaatgcgtgccgctctatggactgggtcactgtgggcctgctagtgttgtgggtgtggagcaagcactgtgagcagagggtgctgcatccccatgatgtcctgttgttaccgtggagcgatctctggactaaaggacaccgtctgacattctgggctgtgatgcatgttaaggatcttaggagatcccagcatgttgagttgctttgcagctttactccccgccccccataacccccagtgcagcttccagacagccaggatatgatacgttattgggacagttaataacaggatgtagaattttaagaagggactattttgaaagtccagtatcttccttgttcaaagtagtatactatgaatagtttccatctgttttaccctctagatgagagaaactcacaaggtagacgacagttgcactgattttatgaagggcccccagcaagtgacagaggatgaggttgtcacaagatatgcagctgtccccagaaaccgcacacccctgatagtagtcctgaccctgtatgcctttctgctcagtagtcattacatacatttggaaaccatggtggctacgtatgtaaatgacagttctggacctttattgtgagatttagaaatctgagaatgatgggaaaaatttttccaatgaaaatttcttttaatagaacctttgggtgaataagtgcttctaatttgaagaaattactggtttgaagtctattgtgaatttgaccttatgggggaaaaggagggctggagacatggcatagaggttaaaatgcttgctgctttcacagaggacccaggtttggttcccaacaataagacattagacacttctggcttctttgggcacgtgtgcatactcacatacagatatatacataattaaaaattaatactttaaaaacaagggtttttttttg

SEQ ID NO: 29715 - DNA, 1124 bp, Mus musculus
caagcatggggtccagtaacatctgcaaaaccgggcgatgccagcggtggggctggtgatcaggaaggggggtcaccgagggccattcgacattcagctcgagcagagatgaaatagatttcttttcccaatctgtttgcagaaaattccaggcagccccagtccctttcagggtgaagcaggggtaggtacatctgtgctgtatcggctgaggtggggtggtaggaaggcccgccccgcccgtggtgtgtcgctggggatggacctcagtattcacatgctacattcattgtagaggctttttcagagtgagaggagggtaggtggctttaggatttgtcaaggcctgagggtcgtgatgaacacaggtgagttgtgaggcgtttggaggcagcaagagctttaggagcggcagccctagtgccagggtggtcatgttctaatgaggtgctgattactcggttctacttttaaactgcctttggggcccagggctcgtggttgactgtcagggaacactagagcattcagaagtgaagggttgatttgtggtcttcctgcttccagaatgttctagaacactgtgtacagtgttaatgagcttgttctccaagcacacacacacatcctaagtagcctgcaagaccttccagaggcacagtttggtgccattgcctagttgagtctggggccttctgcggtggtgggggctggggctctttgaggctctaagtcaggttctgtcaccttgggctgttagggacccttgggctacttggaccccagttgaaggccatgcagctgggtcactccatgcttctgtagtctacagtgaatgcctctcactcttaggatgtgtattgcaagaagaaggtagagacgtgtagttgacataacaaaagtgatattttcctatgcaaggcggcggggggtggggtggtggtggtggtggtggtcatcacacacagttttgacagtctaaaacccctctctccatgctgctcatctgtgtctgtgtgacatactttagctaatggctgggcccagtctctcacagaaggtagttcaagggtcaggatcctagaggagcttctagctgcagggcagatcaagatagtatcttg

SEQ ID NO: 29716 - DNA, 1145 bp, Mus musculus
atttactcgtagtcactcactggcatttaaacagacgggattcagctggaagcacgtttcagtactgtctgcctatcagtcactctgctgactttggtctttttcagacaatggaccattttcctcattaaatattagaatctcctgcttcttagatgctagtattttgaaatttacctatttgcatgaagaatatctctttcttctatacatcattttgggatgcagttccttgaaggtattggggtctttctggtttgggtttcaaaaattttattttaggtggatctgagtgtgggtttagtagtgctcctcccattaccacggagaccctccagaggaacaagaccttgtgaacttgagcagtttcctgttttctgggtagggatggacaacttttggacactgtaagccctgggcctattgaccattcctgacctccatgatgcctttacacacttagctgggttttgttgaattcaagaggacactgcaggcctgggaccccggtggctcagtgtcccatggtgccgcagatctctgggaccttcagctccagcgtgcctggtgtcctctgagccttgccagttgaatttcgtgttctagtttgtccgtccccgctgctgcccggtcgtcctgcagaccgttgaggtgagagggtgacaggccttagccctgtgctagccgccgccgccgccattcatcccagtgttgccacatccacctgtgcctttcggctctctaatcagcattctgacatcatgttgcttgacatcacgcctggtttggacatctgcagccaccaggcctctctctctgggctcatccttacaatgttttgagaaagttgccctgttactcaaggactgaagactacaaaacccagaaataaccttagagtttggagagagaggcccttggggacgttgacttgatgtggcaaaggtaggcaggccgtgctctgcggcagcaggttttggggggtgggggagcctggattgtgctgactggcacatccattctgcgtggatgttttccttttgcaataattttggctgcatcaaattcgttttgttaacatcttcattactgccttttcagtcttagtggggatgattatgaacaaagtgccgtgattttgacta

SEQ ID NO: 29717 - DNA, 1099 bp, Mus musculus
ccatcagaataaactgatccagactcagaagggacaaccccagaaccagctgcccgctagaggcttcacagggccaccggtactcagttctgcatccaagcattcagcaagccacagtatatgtatggaagtcagaggacagcttgggagttggttttctccttttaccccatagtgaactcaggtcattgaacatcagggtaaccctcccagccatcctgctggctcagggctttaaagtaattttcgtgaaggttatggttagctggtctgtagcaggattgtccccctacccctgaaatatctttggttttgatttattggtgagaagtgtcctttcttcataaatgtcaagaagtaatttttgtttcttctgagtatttggtgaaagtgagcaggaagctgtgtcagcctggtgtgcgttaggctggtttacagcttccgcagcctgtaggttgtctgctctcacgagagcgttaagtatagtagatgggactttgccacacctggacctgacacacacgtgcacacgcacgcgttgttttttgagatagtctctctgacctggagctcacagagtagactaggccacctgtccaggagtcagtcctaggtctgcacctgtccgcacctcacccaactggttctgggtcttcatgtttgtgtggtgagcactgttgtctagagggctgtgctctcagcctgattcccttctgactactatggagtggatacagccttccactcttgcgcctgtcttgccagcctgtcctaaattctattgccatcaaggttctcaaagatctttgctttcgttgactgtctttaacttttcctgcttctttggttcacatttttaactttgttatcatttctttgactgcctttgggttgaatttttgacccttttttattttttaagttgaactctgagttgtgttgttttcccaatgcagcatttggagcgctgtctcctcagtcttgttttggggcactacacaagagctcttctggttgcctctttcatgtgtgggctacttaagagcgtgtggtttagtttccagatatttgagatttccagtgatacctgttgctaatt

SEQ ID NO: 29718 - DNA, 1206 bp, Mus musculus
gaaaccctgtcttgaagaacaaaaacaaaaaacaaactaactaaccaaacaaccaaccaaacaaaaaacaacccaaaaaaactttattttcttctatcatgtggggaccagggactgatctcaggtcatttgtttggaaggaagtgcttaacatcctgagccatcttgctggccccagagaggcatgggccaggatgcgtaagccaacagacgctgtggaagcttctcaaacactggtcagggaaggagtctatggggctaagaaatctctgacctagagaagggtcctcaggtaatgggggctggggggtgactaactcagtctaagttatggtgacccctgtttactgtgccctccagctgactggccatgggagagcccagaactcttctcggggcttcagaacttggtggaggcccttcctgtgcctggtgacagtttcttctcccctgtaggctgacccagctagatgtggatagccaccttgctcagtgcttggctgagtgcaccgaagatgtggtgtggtgagcatcagggtgccttgctgtatctccttcaaacctacacaccgacattggatgtggcttctgagacatcgtcgtgtggacacctgagtattggctccttctggttttgttcatgggcattggacataatgctggtcactgacagcaggcagcactgatcctctgtggactcatcttcattgtcagcctgacaggatgtggaatcacccaggagacacatctcaggtgtgcctgtgaaaccgttcccagagattacctgggacaggaagtcccagctgaatgtgggtggcaccgtggcctggggtcccactgattgaaaagggaaaatggagaaattgagctgtttcctcactggggatgtgatgagatgcaccgctcgcctgctacggcagccatagctacttttgctactgtgccctccttgccacagggactgtaccttaactgtgagccagaataaattttaagttgctttccagtattttgtttccttcatagcaagaaggggccgggggggggggggttcacccaggaaggggcaccaggatctgtcacaaggtagaactgcagcatctgtagcttggcagcaccttttcttgaccgcaagagtgatatactgggtcacattccacagacatttttaaaaaaagagataattgtgggcagttgtatgtgtct

SEQ ID NO: 29719 - DNA, 1195 bp, Mus musculus
cctcctccaccagtcattctctggaccacttgcacagctgacccctgaactctgccagatcagatggcccaggatgcagcaacaatagactgttgtccccagcaaaaacctgatgtctgttcaaggtgtgctgaggactggccctacctactggtcctggacacggtgagagaagattcagtcttctgtccccagaactgcgagacagttcatttgtgttatcggcctgtggctacttgttagtagctgagctgcagaaaactaagacaacagacaccattgtgcaggacatttgtgaggacttcagacaggggaacctcctctcctctcccactgaggtgcaatgcgctggattctttgggaatggttccatctggagacacatcaatcaaactcacaagactccttggaggtcaacagcccttatgattagtttttgggcctgattttcagcactgtctgctctctggctaccggagaaagtctttttaaatatatcctggacaagtttctgaccttcatgcatccctgaggccatagttggctatagtatcagccttagggaaggctccaaaggttgtctggcatcaatcaccctgtgttctactagtagagatctaggttgtccttgcactaatgagcagcacaatttcttactggcttggagctcttttaaggaccaaacatgggctggagagacggcttagaggttaagagtgctggctgcttttccagaggtcctgagttcaattcccagtaaccacatggtggctcacagccatttatagtgatatctggcacccttttctggccttcgggcatatatgtagacagaacactgtatacataataaataaatcttaaaacaaacaaaacaaaattaaaaacaaaagaaaacaaacaaaggaccaaacatataagctcaagagactatagaaggaacagggttacacagagggctttaatgccaatgtgtgccacaagtgtgttcgccaaatgccattccggtctgcagaggtttgctcctgtggtatcaactcccttgctctaaggaagagatactcataggccagaaatgaggtttctggataaaacactgcccacacattgcttagggcctgtaccccagctgatcataactgtaaggatgagggatagggtacccgaacatgctaagaaaatcagcattttcagt

SEQ ID NO: 29720 - DNA, 1195 bp, Mus musculus
atcctgtggcctacaaggaggttgggcagccaagtgtgaccatgatggccaagacactgtcatatctcagaggctcattcactcattcaacaaagaatagtgttaagttccagctgtgttcagagagttaagaggcaaatagcatctctccaggtggcaaaacagacaatatagcacaaagaagaaatgtcagtctaggagctggctcagttggtgaaatacttgctacccaagagtgagaacctgcatctgaccccagcccccatgtgcagagcatgccaataatcccaacacagaagaagtagagacaagagggtccagaggtctgactggctgataagactagcaaaatctgtgagtttcagactcggtaacagaggctgtctcaaaagaataaggcggagaatgatccagtaagatatctgatgttggtgtctcagcacatgcaggtacacacgtgacagtgcatatgcatacacacacacatggacacacatggacccgtgcacacgcaagcgctcaaaggaaagaacagaaatgctagtatagaatgctgcgatcggggaagagacaaggctgcgtccatgaagctcgtgaagtggaagttgtagcgttggtcactggtggaaatggctgatttgtagagtgtttatatctgttgccttatttgtttagagacagactctaactctgaagtctatcctatccccaaattcacagtcctctgtctcacaaaccctagactcacaagactgagccaccacacctggctctctgtggggttaaaaaccccatctgattctgtggatcagcagctcagtgtccacagacgatgagtcgatgagttatggacaatgtgcccaccagcactacacacatgcaggcgcacttcatccatgtcccgtgctctcaggcctttcagctttccctgcaaacatactgctgagaggagaactctgctcaccctgcataaaggcctgcatctggcggtatgattgggcctcaacaacagtagacggcacactaagagctgtatgctaggaaagaagaggaacagagcgaagactcagagtaattctgagggagtgtgccaggcctcgggagtgtttcagggagtgtgccagtccttcctgaactcaaggcctgacaagtaggactttggcttctagtttcctaagagaaagtgagaggccaa

SEQ ID NO: 29721 - DNA, 1100 bp, Mus musculus
tggtccctgtaggcatgcatatgggacatagacatacatataggcaaaacacccacatacataaaatataatgagattttgtttttgtttttcaagcagagtttctttgtatagccctccctgtctgtcctagaactagttctgcagaccaggttggccttgaactcaagagatctgcttctgcctcctgagtgctggaattaagggcatgcgccaccaccacccaaccataaaacaaataaatataaatatacatatttatttacttattttaaccatgccgagattctggctgcgtcttttttttttaaagcactgagcactatctctctctttctttcattcgttcgttcgttctttttctttctttattttggggggggggggttcgaggcagggtttctctgtatagccctggctgtcctggaactcactctgtagaccaccactgcctggctgagcactatttcttactctgtttatttgttttactgcatgtgagtatactgttgctgacttcagacacaccagaggatggcattgagtcccattacagatgtgtgtgagccaccaaccatgtggctgctgggaataggattcagagcctctggaagagcagtctgtgctctttgccactgagccatctctccagccccataaaatatttttttcccctctgggcattggtggcgcatgcctttgtttaatcccagcacttgggaggcagaggcaggcagatttctgagttcaaggccagtctggtctacagagtgagttccaggacagccagggctgtacagagaaaccctgtctcgaaaaacaaaaaacaaaaaaatagttttcaaacaaaaattgggatttttgtttctgctatcattgacacagtatccggtattttaatggatggtgtgtgagtgcacgcacgtgcattttacagggatgaaaccccaggcctcatgtatgctaggcaaataagtgttgttccactaaggcacacatccttagaccggaggataatgtactttgcttatgagattagaggatagtacaagtgaaatggttttgttaattataaaatgacctgtacatgatgccatgat

SEQ ID NO: 29722 - DNA, 1184 bp, Mus musculus
ggtttcacagattcagctctttaaatggacatgatacttagctttgaatcctctccattcttgggctggtgagcaggaagccggccttttcactatagctcactctgccccatagcaggtacttcagtcagtgtgcgggagggaaggaaattgtttgtagaggagaattttaaaaataaggcattgctgaatttttaaaaagaagcattacctttctcaggactcagccctgacaattagctccattaacacacaaatacctgtctccactgcaaaagggtagaaaaacttcccatgctatttggtgaaaattgagttgtgcccagaaacgatatctttgtttctaagcacaagttgtacttacagttccttccctttggagagggcatgctgccactttcatctgacttcaggtgagtttccagaggatcatacctagaacagtgtttaagagtttcgaagaagccaggtgtggtggcgcacgcctttaatcccagcactcgggaggcagaggcaggcggatttcagagttcgcggccagcctggtctacaaagtgagttccaggatagccagggctatcagagaaaccctgtctcggaaaaaaaaaagagttacgttgttgctgataggtacatatgccatgtacataaaactttctttcacccacttttcgagtcatgctgatacctggccatggccttcatgtagtgtgagaaagtggagagaaagagtgggcagcaagccaggatgttaaactgttttggggtgtggggtggtgtagtaaaataaacgggaagtttgacaagagaattaaaagacaattcctgaatattagtttttttcacttctgaaacatggatatataagccccaagatccgccatttagatgtttaaacaaatttggataagtaccgaggttgcatcattatgaaactaaccagaagtggctgtgcgctccagttgtaccggaacaaaaagatgctggcacagcaagcttcatgtcctttagaactttattataaagttggagatgttttttagatacattggtatatttgcattatagacttaatgaatgtatgtaatgccaaacaatgctaaaatactgactttttaaaaaaaatattagtaagttaggagtgttggtgggtagttcaaggtaatcctaaactacctagtgag

SEQ ID NO: 29723 - DNA, 1186 bp, Mus musculus
ggcatcggatctcattacggatggctgtgagccaccatgtggttgctgggatttgaactcaggaccttcggaagagcagtcagcgttcttaaccactaagcaatctctccagaccctgttcttgatttctgagagactcagaatctttccatgagaaggacctgtgctgttttaatattgattgattgattgattgattgattggagattgggtctctgtggtacagattggcattgaaattaagatcttccttcttggccacctaagtagtggaatgcaccacctctattggcattaattttctttttcagtccaccacaatattttcagcagtatattagtacagttaataaaagtgaagattgtgtttttaatccagttctagatagagtttcaaaagttctgatgagtgctgcagaaaaggtctctgcattgtgtgattgtagctgtgacgttttcagttaatcataccgtatcttatgcatttcttgccatgtttctgttgcagagcttggattctgaagtgtggaaagcactgagacgtgaagatgagtgaacttgaccagctgcggcaggaggccgagcaactgaagaaccaaattagagtatgtagtcatgcgggtttgatatgtttcatatcagaaacatatctattgtgtgtggataacagagtgagatgaaattgatctattatatgctagttatatatctgaataacttatgttgtttcagaaattttgttttcttattagctacaagttgttgcttgaatgtacatggcccatgtctgtaatacttaccaaagcttttgaacgtcttcctcccagggaactaggttttggaccctctgtgtggccactgtggccgctgtgtcagttctgaagcagctctgaagagcacggctactaaactgagagcagaaatagatactttaaatgaagggatccgtaaagtggcattttagatgtctctgtcttatttttcatagtttcgcaatggtttgtgctccaggaagaccattggaatgtatgtaacagctcttaggccaccatagagagcagacttgtctacctgggtacaaaactaaatggaagataattccatgtattctgagttgttctttctgtgctggggactagtgttagaaatggagctaagagcccacacatcccaggcaaatgtgag

SEQ ID NO: 29724 - DNA, 1098 bp, Mus musculus
gttaatagtgctacttaagggagcaatgtgcagccgggcagtggtggcgcactcctttaatcccagcacttgggaggcagaggcaggcggatttctgagttcgaggccagcctggtctatagagtgagttccaggacagccagggctatacagagaaaccctgtcttgtgggggaaaaagggggggggaagcaatgtgcaatttaaagtttatgaattggctgctggagagatggctcagcagtttagagcacttgctgctcttctagaggactgggattctgtttccagcactctgtagtggttcacaactgtctataaatcttctggtctcctagggcttctgcatgccaaaaatattctctcacataaatataggattttccatttaatatatttttggttcttggttgatattatattacagagcccacagaacgcaaaccaagagtctatttgctaaaattaatcttcactaattttattttttaagatcacaaacaatattgatccagtgggaagaatccaaatgcggaccaggagaacactgagggggcatctggcaaagatttatgccatgcactggggcacagactcaaggtatgaatggggccttcctaaagcagtacttgaaatgttgcctatctgctggatttctaaaaggtaatggttagaaagttgaattggtgtgggtgtgatagcacactttgaatctctgtactcaggagacagaagcagacaaatctttgtgagtttaaaggccagcctgatttacatattgagttccaggctagccaaggctacaatgaaatccatctcaaaaccagtaggatggggtggggtaggaagtttgtggtaccagttatctgtatccaggtctcatgttcacaggtcatactcagatttccgtttagctggctgactgcactgctgtcccttgcatagcagcacctgcttttcttcaccctataccttttagctgttgggtctctgttgtcttggctactctgtgggctgtgttttaagagttgggcaatggaaggtaaaaggtactgagtttacaacagcagactgtggtcccaaaaactaaatgtagact

SEQ ID NO: 29725 - DNA, 1194 bp, Mus musculus
cttcatgtggggttttcagccagctcagcctcaatgctcactgtctgcatgacattttttcttgttgattgtttttctaataagttgtctcatacacagcatagagttaagtcttcacttctgtttaaagtctctgcctttaggagctgggaacgtagctcctttaggagctgggaaaatagagtgcttacctaccatgaatgaagctctaggtttgatcttcagcccagcataaaaccagatctggtgatgtagccctgtagttcaagcacttagatagatggaagctgggagttgaaggtaatcctttactgtgtagtgagtttgaaactgcctgaagtacacgagaggtagcttttaaaataaatggttggggcaagtcctgtaccttgtaaatactttacatatagtttcttcttgacttataatgaggttatatccagaaatatcaatcaatcaatcaatcaatcaatcaatcagtctctctgtctatctatctgtctgtctgtctatctatctatctatctatctatctatctatctatctatctatctatctatctatctagggtttctctatatagccctggctatcctagaactcactctgtaaaccaggctggccttgaactcagaaatctgcctcccaagtgctgggtatccagaaatctctttaatgtttaaaatattagccactgaattatgttgactctgtctagcctgccatcccacatcttcctcatcttatattgaccaggctggcctgaaatctgcctgcctctgcttcctgggtgctcagattgaagtgtgtgctgcttcgatgggtgtataaactctttgtagcctaggacatttgaggctgctgtgttacattcttacagtcctgacagagagcttcagttcattgctgataaccagtaccctgggcagattatacataccacttattgataggttgaaagaattgcatttaaaatttgaagttcatttgcactaaaaaaatcctaagtgttgctttggatgtggttggagttggtacttagggtggttctctctccctctgctttcttttctgctgtctttctttctttctttctttctttctttctttctttctttctttctttctttctttctttctctctctctttctttctttctttctttcctcctttccctccctccctccctccc

SEQ ID NO: 29726 - DNA, 2315 bp, Mus musculus
ctgttcacagcagcaggtggatggatgccatggcgactggaagaccattccaaccttgaatcgttacagcgatagcatatcctatccaaccatactaacgtggacacccacacctcccctcagaacttcaaaagggcaagatcttttttccttcacttattgctgaaaccaagagcacaattcccattaagagaaggatctctgtgctgtaaactaaacaaattgtgcattttttctggggccattgtttttggtttattttgttattttgttttgtttttgtttttttggtttcattttgttttgggttggtccaattttaaaaggaaatactacaataaaaatgttaaccagaaggtaaccctgagtgtgattgtgagagagacacgcctttttactagttcatttgcatttaaatcagtgatcctgttctgtggcattcatgaaaaacaagttgaagaatttgtttatctggaattgtttctaaatataagtcatttgtagcaagactttggaagcattctttcttaaacatattcctttatgttcagtagttaagagaaccagggcccacggcggtctctgacttgtcactgatgttttttttttttttgtccctggcttgcttttttttttttttttttttttttttttgtctcatgtcacagatgactgtttcgcacaaacacagcatagtggaagaaaaaatttcagaagcaaagtagccaagcacatgttaggatggccacgaatgcttggtcagagtccttccttcccttgctcagcagcggacttactcccagcgccttccctccctcctgtccctcctgtcccctcactgtccactttctgttctttccttgggtttcctgtgaagttggagggacgtttgtagtcatgtgacactagccgtcctgcccctgctgtcagagatttttttctccagagaggtgcctgtcctgtgcttggatagtcagttggttatttgtgtatgaaacaatgtacaaatcaatgttttgaaaataatgatctcagactttctaagttaaattttaaacaatttgattgtttgccatattgggtggggttactcttagaatcgcatgctgtagaaatgctctaaagtgcatataggactcagtccttagatgttctttttattttaagaaataacctcttcaagttgtaaccgtggcggctttgtccattactgttgctattctgcacacatatcggaagcagcaagcgctttacacacttgagtagtgggataagtcactgttttctttacaaaacaaaacagtcctgttgggaatgattgctgttggattctggaagggaggggaaagctgctctgctgcctctttgccacttcctggaagccttcctccctggaagaacagccttttgcatctgaggcgaccatttttacaccatgcagatcttcgtggttatcatctcaaagccatgttcagcagcagcgtttggacagcagtgttctgtgggccctcccctcccccatatcctgcaccccctcatagcagtagtggcttcgccattctgttttctgcagtgtcctgtacaaaactgtgctgtgactgtgcggtaggcctggacatggcaaagagaatacagcgaagccccttctcttcctaccaaacaactctgtagagctctctgcaccctgtacccttttcaccttttgtatttaattttaaagtcagtgtactgcaaggaggctggatgcaagatagatactatattaaactgtactgttatttaagatgtaataaagcagtttgacatgagggactctggtgtgatggttatttgagggtcatcttcagtgtgtgggggtttgccccaactgctgactcaacagttatataacgtcatgagagacccttataaaagtgtcagctcgggctgaatgtagtagtacacacctttaatcacaacactcaggaggcagggccagatggatctctgaggttagggccagcctggtctactttgcaaattttaggactgccaagcaatatagacactgtctcaagggacgtggggagatgggctcctgggaggtttctggtatatatctcaggtctgcagagccacatgtttatcacgacaagtggcctttcaccctcagcacctgggccctgtctgccgtctcctgctggaccagccagctgcttcgacttcctcttcctgcactaaaatgtctgaggacctgcccctccagagatactttcctgttgactaagcaccatttccttctctgtcgataaaggtcactgcatcttgaaggagcg

SEQ ID NO: 29727 - DNA, 1775 bp, Mus musculus
gagagcttgggtctgccttttgcagaacagatcagctttttaatgtttttaaaacctctttttcatttctaaaaaagcaaaatgagaactgggctgggtgtcctacatctctcccatgggcccccgtatccccctgagattcccaggtcaggaattcccataaatcagtctgttgaaattctgagggggtcagaatgaattgatcttccttttgatactgaaataaatgtctcagccagaaatcttcttttaactgcagtgcttttccacagggcctgtacctttccccctggcagctttgctatgggtgggcaaggcaagcttgctttttgtgtttctggagatggctaggtccctctcagtctggcccccagacctctgactccttccagagcagacagaggcaacacttggcacagccatccaacaacctcacattcctcacacaacagggcagcagcccctggggacagtttcaatcctgtatacactttttagaggttattttaaactttctgaagtgattatgtacatattttcttgtacacactttgtgaagatttagaggggactgcctgttgtccagtgtttacattgtgtccaggacagggctctgtgcttccactcctcccttacacagtggccacaagggttttgagaccagctcactattgacatcaggctcgtgggcccgctctccttccataagaatcttaggtttgattccatctgaacagcagccatatggagcctgtgtgcgagatgcatggagccatgtaatgcaagtaacattagcacgtgagtgccacacaggccgtgagtgccacacacgccctagagcctttgtggagtcagtggtcagccacgtcgtctcagctcgctagctactttcagttttgtcctcacctcttgcagcaggagtcggaaggaaggactgcctgtcctttgactggcttttgtctcctgcttctaggaaaggtttgtcagtcagctgctgtagaaccaaacccactgagctttcctacctgttaaagtcaggacctactgagcacccatggagccctaagtggtctgggttcagtgctgttatcatggtgactcgtccccacggtctgtgctgttcatctgtgactgagcacagcaggcctctgctatgatccagaggagagcagggtctgaagtgtgtgccacgcatctcaaaagcaagtgttgacaaatctagaagcagctgccaccagactgatctagaacacatggagttttcacgtaaattcttaatgtttcatattgttaatatcttaaaattttgttaattgttaatgaaggccttattactattttcagattctttcaataaataaacttgtttaaaaaaaattgagttaagtaacagctttcttctggctcaactccagggtatctccagaggtcaccttatctacaagagatactgttaccctgattgatagcaccatggccctggcgtgggcacctggctcactcttaacgaaatatagtatggtatcgtaagagtcgggggcacagtcacctctgcaaagaggtcacatgtagtgcccaaagctggtatagactggtgactaccaaggccaaagactctgagaggcttggcagcctctcaggggagtgtcctcaagtcagtctgtactgtcatcaggaagatcctgagaccaaagtggaagtcccaagagtcccattgctgcaagggggtgaggaaagccatttgtccctcacccttcattcattcaactaggtca

SEQ ID NO: 29728 - DNA, 1926 bp, Mus musculus
ctgcctgagccaccaggtctccagagcttaaggtggagtggaggacaacagtgggccttgggttaacacgctgaggttctacattattcggcattttgtgagttgtgtgtggggtgcagtctgttgctagccagtctctaagactccattacttacaagctgcagccactggcactccttgtccaggtctcactggtcctccctgctctaagtctttcgtgcacatggtggttcaaaaagataatggggtgaaaaagagcaataattatgtctacattttatttacttgaaaaagccatctgccatgatgatggatcaaaatgaggccttttaatccataagccaacttttaaaagaagctgatgtgtgctggacatcagctaggtgtatctttactatgctatgtaaagatattgtgaagatgttctctcatttgactttgcccaggtttctagttccttcctctttgctcttctcaaaataaagatccagtggaggacagatggcagacgttggattaatctgtgtagacctgtctgctcaagatctggctgtggagctgctgacaccgaagagcacgtgcttgtgggtattggttggcagagctcttctggccttcccgcagacctgtctaagtatgctcagagctctacatgcctggcttcttactattatttggaatttctgcctgtgtcctatgtttaattaggaaatgacctattgtgacttgctctggccatccctcccccatgtcacaagactcagcttgttttgattttcttaaggtttgggctagaaacaaaaacaaagatttttcttaaagcaattttctctaaagctgctttgagacttttcctcataggtggaaagatcatggaatcagctgcttccttcaggtcttccaggacagggctgggttgagaatcgtggaacggccctgcttgaccatttgttatgactataccataacaatacatttttaattgactttgttagtactttcatagaatactatgttcttcatgaattgttactgatgtaaatgtacaaatattgacaccacgtgtcattccttgtcctggataattcctcctgagtttatgtcattgtctggtctgttgtaaacagaacactggattgaccttctgagccagctagctgcttactcactgcacgcatagttaaaagatatacacatttctaatttcaaaaatagttctaggagctacagagatggccgagtggttatgtttcttgctgaggacccaagttcagttcccagaactcatgtagagtgtttcaccaacttcctataacttcagcattagggattctaatgcctctggcttctctgggcatctgcacactggcttgtgtatgaacacacacacatatacacacacacatatatcttaaaaataagtacatttgctaggggaggtggtgcaagcctttaatcccagcacttgggaatcagaggcatgtggatctctgagtttgagggcagtctggactacagaacaagttccaggacagccagggcaacacagagaaaagcctgtcttgaaaaaccagataaatagataaataaaatttaaaaacgtccatgatttggggtataccttagtggcacatcactggcatgtattgtgaagctcttgggttgatcaccagcagcagatgtgggacagaaagataaaggggagacaacaaaaataaccccaaaacttctaatactaaaagacaaggaaacgtttttgttttttgggtttttttgttttttttttgtttggttggttttttttttttttttttggtttttcaagacagggtttctctgtatagtcctggctgtcctggaactcactttgtagaccaggctggcctcgaactcagaaatccgcctgtctctgcctcccaagtgct

SEQ ID NO: 29729 - DNA, 1433 bp, Mus musculus
gtctcaagaaaagtaaaaatgatgagtcagaggagattaaagagaattaaagctgttcaagggattcggccaagtaaactttactttgtgccttaaaaacagcacaaaacaagtggctttgtgatcctgctctcagatgatcactttgctcagtgataataacagatgctcagcacagcctcctgtcacatctgtccaagtgatgtcttctttttttttttgttgtttttttttgttttttttttttgtttttggagacagggtttctctgtgtagccatggctgtcctggaactcactttgtagaccaggctggcctcgaactcagaaatccacctgcctctgtctcccgagtgctaggattaaaggcgtgcgccaccaccgcccagcaagtgatgtcttcttaacattggaaaggggtaaagaaagatgttagtacagatgggaaacaatgccggctcctcctgagattgcatttacctatgtaacccatagtgtccttgaactctagattcttctaagtcatcgttctcaggactgagattacaagtacgtgtcaccacttctgactcctgcctttgaacatcaatcttttgttttttcttaacacgtaaatattgatctccctgtgaggcggcctcttcatctcttcattctcccacccttcgtttattatgctaggcatagtactcagggcttcaggaatgctaggctgctattctttctctgagacatggcctccagcctgtttttcttagtttatcaatgcctttgctctccccatgaattagaacaggacatgctgattgtggacaaatagtatccaccacaattagagtgtagtaggttttaacttcagtgtctctgaagtacgttttcctgggtactctgatcctgactttgccagctgctggacccttcctaatatgtccaagtttagtttgaattaaatcaagttggctagttgtgtgtttgtggggtttttgtttgtttttacttttcatttctgggactcaagctgcatactaaattcatttgtaatgtctggacttaataataatgtaattgtgagtatgttcgttcaatgttcgttcaatgttggcactttggaaaaggccacagtttagggtggacaattgtctgcatcaaagccaagtcatatttgctttataccaaacaatactagagaattaaaacacatcataaaatgtacactgttttgtatttcacctctttcagtatttaaataattatattaatgcctcctagaaaagaattctgttagataattcagtgattcctgaaataaattggtattgtgtaattaatcctgcagtagcctcctcattctttttatccaagctgccaatggttcttgtatgaatatgaaaacatgtaactattttgttcgtttggtttccttttttttgatac

SEQ ID NO: 29730 - DNA, 2237 bp, Mus musculus
gtttggggtgggcaggttgcttcctgaggcctagcctgccaccctccccccaggcaagccagcagagctgcagcgcagggtgagtgctgatggccagcccttccagcgtggggacaaggtcaagtgtctgctggacacagatgtcctaagggatatgcaagaaggccatggtggctggaaccctaggatggcagaggtgagccacctcttctgctgactccccatgtgttccccttcccaagtcctttggaccccatccctcttcctgccccaagcgtccagcctgacccagccatagcctccgtgacccgccacagtttatcggacagatgggcaccgtgcaccgcatcacagaccgtggggacgtgcgtgtgcagttcaaccacgagacccgctggaccttccaccctggggctctcaccaaggtgcctagggggctgggctgagccccacttattgcttctctgattccctccatgtacttgttcagtcttgggagtggttaggcatgaataggcaccagtctccccatgagtttgcacacctgaaggaaggggagaacctggtgggtggaggaaagaccagaaggcaacgcaggtgtgaaggacacggaggagactgaaacgtaggcatctgagaccagaacctgtggactctgtcctgagaacaagggcgtatggtagaccagatgtggggttgcttgccatactctcttgagatgctgtttgcaccaacgagacagatggaatctctgtaaggagactgaagtgggggctcgcatgccaaaggcagtgaaggctaggctgagtatggtctgtggaagctgtgtggaacactggactgtggagatgagacatgtgccagatagatgggcacgtccaatgggaacctagaggaggatactttagagcaggttctctgtgcacagatgtgtgcatagatccctgcaggaaccccacaacccaaccagccctaccctccttcccagcctctcacccggctccacccgtaacttctttcctgtatctatactgcattttctgtgctgccctgtgtctggtcagtggatagggagccttgcaacagctcttcttgacctcacgcgtcccagatcccagagctggatctcggtctctgcttctgagactgtgatcccctacggctcagagtgaccacccaggcctgtttcggtcaactgaggccctcgaccggcagccagaccattgggttgtacttgaggcaggaactggggccaaggttgtcttcttgccctgtggagcaggatgtgcccttccacatgaccctgagtagacacagatagctggagaaagtccccttattggcttctctgtcatccagcacaacagcttctgggtgggtgatgtggtccgggtcatcggtgaccttgacactgtgaagcgacttcaggccggacatggtgaatggaccgacgacatggctcccgtgagtcttaatgtctgttgtcagcacgttgaccctgcccccaccgctgtctacgccacccctgacctgttgtgaccccacctcttctcctcaggccctgggccgagtggggaaagtggtgaaggtgtttggagatggaaacttgcgtgtggcggttggcggtcagcggtggaccttcagcccctcttgcctagtggcctaccggcctgaggaagacgccaacctggatgtggctgagcgtgccagagagaacaaaagtgcggcatcagtctcagtggctggtgggaggcagggcagcccctggccagcacttacctcaaccctgcccccaggctcactgagtgtggccctggacaagcttcggacccagaagagtgacccagagcacccggggaggctggtagtagaggccgcactaggaaatgtagcccgggctctagatcttctgcggaggcatccagagcaggcaagttaccaccctgcccttgtggtagccaccaaggagagtgcccagagttcatgtgttggctttcttcacaggtggacaccaagaaccagggtagaactgccctgcaggtggctgcttacctgggccaggtagagctggtgcggctgctgctgcaggcaagagcaagtatggacctgccggatgatgagggcaacactgtgctgcactacacagccatggggtgaggcctgggcaggctggcgggtcctgtggggaatgaactttagagccggtgtgcaaatggactgtccccaaaccttcccgc

SEQ ID NO: 29731 - DNA, 1466 bp, Mus musculus
agaggcctttatagagccggccagaatatacattcccttctggcaaaaaccactggcacccaggatcatgaacctgaactttcatcctgtgccaggttgtcaaagcttggccgtgattgttgcttggtcactttgtactttgcagattgggaggagtgacctctggagcctgtacccaccccaccttaccccagtgggcttaggttagctttgtgccttagtatctctgacccactgcaggagccacccatcatccctcagctgtccatggggactgtggccctgtggctgtctggcttatgcatgcttcaggtcagagtcccattgaggacacaccatctttgagacttccaggagcctggggcaagggttcacaggccctgttttgtcttcctttgtgggtgtccgagaagccaagagccatgatgtagctcagcaggctgggcccagtgtccagctgctgcacccaggggtgagtgtcctccacctcaggaggctggggattcaccctttcctcttgcttgtactgccttgattaggatttttttccagggtggggtgggggttgggaagacgggacgctgagggaccctgaggggctgaaggaaagctgccagccttgccccgccaaacctttaactgtgctctgggtcccaagcctagaaacctcagtggccacagtgctactttacgagcccaggtcttctcacacctgagctctgaccccagtgatagtgcccctccttctgcatggccagaggctggtcttgcctacctcctgatacacacacaggcacctggttgaggtcactcagccaccttgtgatattgggaagaataaggcattgcccctgtgtctctgagcctgggctctgaccactgaacttaaccttggcgatttttcctcccattctcaccccagcgaccgtgatgacctgagccctggctggcagcacccgtgtcctacctctctgtctttgctctgcccgttccctgtgaggcactggtcagttgccaacatctaaatgtccatcactctcagaccaaaaccactgtcttgtgtgtttatttggaatgctggaggggaggctatgggtgagggacgggaaggtggattcagttcccccaagggcctcgggcattagtccagtggctggccttaaagctttccactgggatggaagatcagccccagacagtattcactggaatgctgacttacagttcaggcaggaggacagtcagggcgtccataacttgcttgtccaccttgagatagtatctttctttctagaccagctgtgttgtgcgggggttggggaggtggaactagcagtggttagaaatagcctcgacacacagtaatgacccatttgagctgtgacaagcaacagttaggcagctttaagagggggtcctctccccagtgtggcttccctctgcagtgttaaagttgggggtaggac

SEQ ID NO: 29732 - DNA, 1200 bp, Mus musculus
ctcctttgggggtgtcaaacagcccttttacagggattgtctaaaaccattggaaaacacagatatttacattttgactcataacaatagcaaaattacagtaataaaatagcaagaaaataatgtttggtcggtagtcaccagaacataaggaaccatattaaaggcagcatcaggaaggttgcggttgaagcgctgctctagaggcagccacacacgtaaagcctgctggatgtgatagtcagaaggccctgctctgttgttacacggcagtgcatggctgagtaaatagaaactgcatcacacggtaggccgcctagctgctccctttacaaaggtgcgtgcacatggaaccattggtaaggcggtttgacattactgcagctcctggaaatatattagctgggttagtggctcatgcctataatctcagcctttgggtggctgaggcagggagattgctgcaagtttgatgccagcctgggctgcaagtttgaggctagcttgggctatagaccaagaccctgtcacaaaacgttgctgtgtttaccaaacagaagcatgaaaaaacagtattctgagagaacttcaagaagaagtaaaacaggctgaattttgtactggacacttgtggggaaagacaggggtattttaacgtcagttctccataccacacatcgtataatggttaagctaatcagtgcttcaggtttaatgagcaggtcatctcacttgaaatttcccatgttcataagcttagcctgtgcatagaggccaaatgtgtgcatcaaacaacttggacttttagagatcagacctctgggttttgttttgtttttttgagacagggtttctctgtgtagccccggctgtcctggaactcactctgtagaccaggctggtggcctcgaactcagaaatctgcctgcctctggttttatacatcctcttttttttgtttgtttgtttttgatttttttcgagacagggtttctctgtatagcccttgctgtcccggaactcacaggctagccttgagcctgcctctgcctcccgagtgctgggattaaaggcgtgcaccaccacacccggccattgagtcatttcttatacaaactttctgtttttagagacatgttcccactatgtatccctggctggcttgtaacaatatgtatagacaaagctagcctccatttt

SEQ ID NO: 29733 - DNA, 2177 bp, Mus musculus
gctttcaacaagccctgttaatagtttagcatactgtgagcagagcatgccatacccttgccaaggtacatgctctgtatgaaagggaaaaggtaaaaaactgattttaattttagaatttgaatctgagggtttttttgttttgttttgttttgttttgttttgttttgttttttgagacagggtttctctgtgtagccctggctgtcctggaactcactctgtagaccaggcaggcctcgaactcagaaatccacctgcctctgcctcccaagtgctgggattaaaggcatgcgccaccactgcccatcttgagggggtttttgtttgtttgcgtgtttatatttttatgtacagaggttattttgcctgtgtgtgtatctgtgtgttacatctgtgcctggtatccttggatgccagaagagggcattgggtccctaagttacagatggttgtgagctgccatgtaggtctgggagtaagcctaagtcctctggaagaggagtacatgctcttagctgctgagcagtctctctagctgcccatggtttttcttttaaaagagtccagtggtaggcattccacttccacctcgtcacagacattgttctagagctttataagggtcgtctgggtgacctgaggcaatattatgtcccctctcttttcttgctttctgaaatcacctgttaacttttatcatcattgctggggttaaaacccacgaccttgtacatgacttctgccattcagttacactcccaggcttatagcctctctcttctgagccagaaatacctgcatctgtcaacccctgtagtcttacttgataggaatcacagcttaatgagtttatatttctctaaagtacagtaaatagttagcccaggccagaagttttagtgtccaggtgaccattgaccctaaccatgggacctgggcctccgctggctctttcatgccacagcctctagtggctcccttctttgtcctcactcacatctatacgacagaatcctgctatgttctccatgcaagatgtccttgctgttcctttcccacagttcccaagtgttccacactagtagaatgttggctggctactctagactcagtagatgtcttgtggctgtatcctcctgtctgttccaacatagcatctgctgtattctattgaagtagtttctttttgttggttattgttactttttgaaacagggtattttttagcaggcctggaacttacaggttctatggtgctggaaataaaggcatgtaccaccacacctagtgttctcaagtggtttctgatgcttattataggctgtggttctttgtctttccagtgccaggtggagctcaacaggaaagttcttgtggacctggccatctatgaaccaaagacgtttaaatctttggctgcattggctaagcggaggcagcaggagggatttgctgcagctttgggggatggaaaggagcctgaaggtatcttttccagagtggtgcagtaccactgaaggctgcagtgctatagactgttataaacaagataggaccaaaaggactgtcaccagtaagtctgatttgtatttatttacattttagcaacaggcctgagacgacaggtctttattcagtgacacggccccaaactgtcctgtaaagattgtataaataaagcctttgcagtgttgaacttgtgagttatttcctggcatcaagtaatccccctttagggatataaagcttgttactgcccatagacttgccatcactggctgcctgtggcaggaaaggctgagtgggggtagcaggcttcagctctcatgttgcttttccttttaaggtaggggtcctatatcaaccctcctccaagttgtctggtctgccttaagtactgtaaacatttaacctcttttggtcttttccttgtgtgtggcatgggcccagggaatcagcagttgagccactagctgctttccttctctttccatgcttccagttgggtacacatcagaagaatatgtctcattatcagaaacatgatgctcttggtctcagttgaaaggatggccagcttcagagtgggctggggggcacttttaaacttatgttatgtagctaggccttttcacaagactgctctgtaaggttaaggaatgaattctggacag

SEQ ID NO: 29734 - DNA, 1141 bp, Mus musculus
cctagtgcagaacccttaggaacaaccaaccacctttgatgacacatggtggcacaattgcccatggcattacagtcttcctggttttggtttcaggaactacatgaatgacagccttcgcacagatgtctttgtccggttccagcctgaaagcattgcttgtgcctgtatctaccttgctgcccggacactggaggtaagtatgtggctgcctgggttttagtctagattgtagacattttcccagcctgtaggaaatgttaatatttatcaaactagattcatttgcagcagagattctttgtaactggcgggccattttcaggtgtttccctaagaatcttattggcctcgaagtgctttggtggtggtggtggtggtggtggtatttttttgagaaaaggtctgtattatgtagctctgactgtactcagactcggaaaggcccacctgcttctgttttctgagtgccgagatgataaggtttgcaccactacaccaggccttgaagtttttaaggaaagtaacatgagaatattttgtgttcccagatccctttacccaatcgtccacattggtttcttttgtttggagcaactgaagaagaaattcaagaaatttgctttaaaatcttgcagctttatacacggaaaaaggttcctctgtatgtttttgtgtttgttctatacttgtgtttgtttagaagcacttggttctgaacgggtgattctggttctcaggttgatttgacgcatctggagagtgaagtggagaagagaaagcacgccattgaagaagcaaaggcccgagcaaagggcctgctcccagggactgcgccaggcctggacagtgctgcggggttctcgcctgctcccaagctgggtgagtgtccagagtttatttcccacaaagggatagcagcttgtgaccgtcttttttttttttttttttttaagatttatttatttattatatgtaagtactgtcctcagacactccagaagagggcgccagatcttgttagtatggttgtgagccaccatgtgtttgctgggaattgaactcaggacctctggaagagcagtcagtgctcctacctgctgagccatctcgccagccccagcttgtgaccttctaactt

SEQ ID NO: 29735 - DNA, 1133 bp, Mus musculus
ctggtaagaggacccagtcagagcttgaggagttcctggtccccaggaagatggccatcagtcctctagagagctggctgactgctcaatacttattgcccagacggaatgtcgaggtcccagtgactctggctccctcccagttctacgaatgtccacctaggcagggggaggaggaagcccagcagggagtcagggaagcctgggatgccactccagtgcagtgcaaaaacgtgctgaagatccgaaggcgaaagatgaaccaccacaagtaccgtaaactggtcaaaaggacccggtttctacgtcgcaaggtccgggaaggacgtttgaagaagaagcaggtgaatatgggcactcccttggacctagactgacagtggttaaaagaggctttgctcgttataataagttggttgtctcctctgcccttgcagatcaaatttgagaaagacttgaagcgcatctggcttaaggcaggcctgaaggaagcccctgagaactggcagaccccgaagatctacctgaagaacaaataatctgggttcctgtccctctggctctcttgctgcttctgacccactataataaatattggaaggactcaattattctaggccgacctagagtttctttggcttggtgtgagatctcttcgggtaaaaaaagactctgtcataggaacccagggcccaagtgtgcctaattgtccttgacctccagcctgactaatctgcctcatttagagatgtgtgctctgggaccactgaacagctccaggaaggtggacatcaatgtgaatactgggtgtcctggtgtcctggagctgaggggtacctgggttaaggggagtgctgattatggagtaagagatgatctgtgaggactcaggagggaagcagaaaagggaagctcagatgtctcaagagatggcacgtggtcctctgtagttgatgagccatttaagttgccctgttggctgggatggactcgtcttgccacagggacagggtattggggtgggtcgccagtgttcccagatgtcccagcttctgcttggctcctcagccgtgtgggtgggagcattaatcaggaaggttgcctggatggtgtgttttgctaggttcagtgtt

SEQ ID NO: 29736 - DNA, 1169 bp, Mus musculus
tgccttccttccttccttccttccttccttccttccttccttccttccttccttccttccttccttccttcctttcctttccttccttccttccttccttccttcttttccttttcctcctcctcttcctccttccttctcctcctttttttttttttggcttttgtttttttgagacagggtttcttctaggctgtcctggaaccaggctgggctcaaactcaccgagatctgtctgcctctgcctcctgagtgatgagattaaaggcatgtaccaccatcacctggcttgcagaggttttctgatgcttgctacttacatctagatcccaccctgacccgaggccacagcatcatcaatgtcattgtcccagaggaccacacacatttcttccagcaactgggctatgtgttggccacgctgctgctcttcatcttgctgctcatcactgtagtcctggctacacgatatcgtcacagcggaggtgaggctgggcccttggaacagaggggcccagattaaccgagaacagtgagagcaacccaataactctcttcacaggatgcaagacgtcggacaaaaaagctgggaagtcaaaggggtgagtttgcctgcccaactctcctcccagacctgtcctgccctggcctcctaaactgctatctccctttaggaaggatgtgaacatggtggagtttgctgtagccacaagggatcaggctccatataggactgaggacatccagctaggtaggggtgagagccacaagggtccaggggaagtacgttttggagtggcacttattattatttttttccccaaccagattacaaaaacaacatcctgaaggagagggctgagctggcccatagtcctctgcctgccaaggatgtggatctggataaaggtgagcacttttacctcctcatcccatatgagactctacccattccagggactccctgccattttcctgagaaggtcttgggaagtcatgccaaatgtctccattgactttcccactgggactaagggacagagagcagacattagccattttcttggcttccagagttcaggaaggagtactgcaaataaatggaccctgagcttctggctgggccagcagctctgtatcaaaggacatctccctgaccctcctgcggt

SEQ ID NO: 29737 - DNA, 1125 bp, Mus musculus
gagcggacagtgcctccacattctgagcacctagaaggagaatcaggaccggcctaacctaaggacactcctctgctccctggcagaccttattggctcaaggggagcgatctttccagggtttctctgtctttctggggtccagcgtgcccacctgcccagaaacctcagacccaaacgcctcaaggatcgcagcctgttgggaatctgggctccaccccaagacagcgctcggagagacccgaccggccaggccttctgagcccgcccagtcccaccccggttgccccgcccgtgcgcaagccgtagccccgccccgccggacccgctctgcgcgtgcgcagtcccgccccgcccgcgctgcgggcgactagtgacgtcaccggccccgaagcgccctccggcggcggcgcgctccaccccagcaggcggttcgtgaacagcccgagggggcggcgggccgcgggagccctcagagccgctttccctggcgcccgctccggggccgcggcggatgggcggccgcgggccgcggggcgacaggcggggaacgggtgcgagccgggaccgggaggggcggccgcgccaaggggccgcggggcggccgggcggggcgcgggccggcggtttgggagggcgccccgcgtccgagaggcgagccgggccctgacgccgcgcgggttccgcgtcgcccctgccgcgccatggcggagaccaaaatcatctaccacatggacgaggaggagacgccgtacctggtcaagctgcccgtagctcccgagcgcgtcacgctggccgacttcaagaacgtgctcagcaaccggccggtgcacgcctacaaattcttcttcaagtccatggaccaggacttcgggtcagtgggccgcgcggcctgggcaggggcgctggcctcctcccgcgcctgtgtgcacgagctggcacctgtccgcgccggctgggctttcgggtctggggacgtcagagagcgcccccgtcgccggcaaccctgctgcgcatctacagcaggtgtaggtagagtttctgcgcccagtgaccctgagtgtggcaagctggggttccgagccactgactaccctctgggtaggccagacagttctttctgac

SEQ ID NO: 29738 - DNA, 1102 bp, Mus musculus
tctagctttgagctttggtgctcatcagagctattacaggggcccattacatatgaaggttttgtttgcttccaacaccttcacaaatgtgtacacaaagatacatgtacatatccctccaggcctggccatactggtcatctgcatgaattgagggtcctgccaggcctgtgcggaggggggaattgggaggacatggcagcctctgctttgcttttctgctacctaacatagctaacagcttgttctctccggggaggggaggggggctgccttgcctacgtggacttgcactgtgggacggggaagaatctcccggtcttagctcaagtttcgatgaggggcatctcccaaggatgggagataagaggtttgaccctggcccctgctctcaaccccatggaggttcacgctgtgagcctgggctcagggaagtgtgctctgcagagcttgaggaggcaccgctgactgtgaagagtgacatgagtgccattgtccgcgtcatgcagttgccagactcaggactggagatccgggaccgcatgtggcttaagatcaccattgccaatgctgtcattggtgagtccctggctgtgtgggaagggccccgtctgttcctcattctggcgtagcttcccagggctcagctaccctgactttgatggacctgtggccaggggcggatgtggtggactggctgtacacacacgtggagggcttcaaggagcgaagggaggcaagaaagtatgccagcagtatgctgaagcacggtttcctgaggcacaccgtgaacaagatcaccttttctgagcagtgctactatgtctttggcgacctgtgcagtagtgagtaggggtgcggttgggtagggttgctgtggcctcattcatttgccttcacttacccctccctccctccctccctgccagacctcgcatccctgaacctcaacagtggctccagtggagcctcagatcaggacacactggccccactgccccacccatcagtaccctggcccttgggtcaaggctacccctaccagtacccaggacccccgccctgcttcccgcctgcttaccaggaccctggcttcagctgc

SEQ ID NO: 29739 - DNA, 1322 bp, Mus musculus
cccctgtgagttctttgtggacatcatgtgatgatcaaccaatgtcttcagcgctgcctgtggctgagtctgtgctcctgctgtgccaggagctctgcgctggccgtggtggtggccagccaggatagatcagctgtgggctctgggccagggcagagggagcaggctacagaggagggcctgagggcagccataccaccaggatattggcttgacattttgtctgctcttggggctgctgatggtggtacagctcaagtatctatagagtcttgtaaggagacatctctgactttaagtcctcagcacaagtctcagggaccacctcctggttcccttctttggaagtgacctccatttagaacaagaaaggctctcttgggctcttggtaccccttgccccaaagcctcacagaactgtgcacagggacacaggctgactgtcgctaagttcatgggcctcacctgtcaggccaaggtgggatttttgaggggttagacagagccttcaaacctctctggctgcccaggtggggtctaacttatttatttattgctagcctgcctgctctaagggtggcagctagttacccaaaggggcagtttgcatgcccctttccccacctgctacttggcacatgacaacacagtttgtactgaaggtatgtgaagggtagctagtaggagagacaggagagagacctggcacctagccactgtctcagtctcagtggtgggtgacagtgaacacaagagctgcagagctgggccctgttctgtttctgttctggtggctgcccatcatcatgtgccactgccatcccggcacagcggccccacacatctacactagacactgtgtcaaagtctgagtgactgggtagttgacatagagctgcttctgtgtaaatgctgcttctgtgtaaatgctattttaaacactaaaaaaagcgtttaattttatgggactgatgtgtggcttgtttctcttttctccagctgagctgctccgggattcaggtgtgggggccagtccagaactgacccgggtctgatcctgcctgcagatggacgatgctcttgtcccttgccgcttaggcatgtggctctgtccctggtgctggccagtaaggggccttgcggcaacttttctgtccttggtactagaagctgattccaggggtcccgcgtggctggcgctggccgtggtgctgacccgcaccctgtgtgtgatctgtccaaggtgctggcggcgacctggttctctcctacaggctagggctcagctagggatggagaaggctggatgttgcctacctcct

SEQ ID NO: 29740 - DNA, 1190 bp, Mus musculus
actaaaattccttttgtgcttaaaattcagctgagagcaacagctctcaaagctgttctccagctactctctgagccagctcccgacaggaggccagagactagcctcagctttacaatttgcatttgaataaagtacctagacttccccgaaagaagttctgctttcctactttctcactgtctttcaagattttgtctttcaagcaggtaaatcaacattctcgaggcggaccagtggatgtgcatccccgccccccctagagcacacaggtggcagctgttatccccagtctcaggacatttccagcacgtggttttcagtctgagttaaaaatttaggtttacctagagggctagaagagtagatatttctatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttagccacaaatcgtggtgttactaacgacataattcttgcttaggctttgctaattctaaggttgataattctcctttaggagctgcacagcactcagaactgtgcatactggtttgtgattgtacaaattcagtatgggcatcgcttggtgcagaggtactgcaagggaagctccggcttgaccatttctgagtttcctgtgagataaacccggtttaaaagaggttggtatcatattttggttaaaaataaaaaatatttttcggctctacctcgcctccccaaaagatacccagagccacatgtgtgggtcttaccagtacccacgggaggaatcgggtccatgtccacccaagccaaggttaaaagcccactcatctacggatgagaaaatcatttgatcacctcagttaagcgttgccttattttaacttaattaataggggggagagagattggagacgtactattgaaagggcaagcccttcactgcctcccacccaaataaaagagccggtcgaacgccttctccctgtttcccacctatcatccaaaaatgcggaggaatatcaacttagtgttattttcccatttgttaagtcaaacttagccagagttccaacgccctacttaaaattcaactagaaagttacctaccaag

SEQ ID NO: 29741 - DNA, 1193 bp, Mus musculus
ttttttttgactagatgagcaataacagcaataagagagctccaacaacagcaacacaaaggttgaagcaggactaccttcgaattaagaaagacccagtgccttacatctgtgcagagcccctcccttcaaatattcttgaatggtaagactactgtagtcactctgtcgcaggtcctgtagtggtccagctgctaggcctgctcatggtagaggcagtcttgtaactcctcagctgtggatggacactcgagaggcctgtcaatactctgggctttgcagggagtgctatgtcaagaatattatagagtcctgcttggcttaggctagggctaaaaggagaaatcttctaccctgaggtagtacttacgtggactttgagtttataaatctctcacgtgttgctcaggagcattagggttggactgcattttgctttctgacattgggaattcactctatagcctgggaacattagtgcaacattgatacgatgaacccttgactctggcctaagccaagcgctcctaactcttgcactgaccgtgatagaggtcataaaaaacatttggtgcatggtagctcttttgctccattaaaagtgtggagtcattgggtatggtggcacacattaacccaggacttgggaggcagaggcaggtagatctctgaatctctgagttcaagactagcctggcctacagagtgagttctaagacagccagagctacaccgagaaaccttgtcttgaacaaccaaaccaaaccaaacaaaaaggatagagtcacgaggtttcatgttctctgtggaaggagtcacgaggtttcgtgttctctgtggaagtgctcattaccagctttgagaaatgaaatacaagatttgactcaccagaaagcattttttactgggtgtggcacatacctttaatctcagcattcaggagacagagacccgtaactctcttgagttctgggccagccaatacagtgtactgaggtcctgttttttgtttgtttgtatttaagacattttttaatacttttataattttccaaatccagaggaaaatttttcctgaattaaaaagaaatgttttgcgtttgtatgttgatagaagaaatgcatgaggggcctcttcagtggcattagaactaaccctgttccagagatgagagttagatgtagtccctagg

SEQ ID NO: 29742 - DNA, 1193 bp, Mus musculus; identical to SEQ ID NO: 29741

SEQ ID NO: 29743 - DNA, 1156 bp, Mus musculus
tgtctgtgtggctgacttcaatagaggccacctgcaaagtagtacctcatacctttctagcatcacagaaatcctggagacatactgaccatgatgacccatgtgaagtacagtgatgaccagtattttagttctgtacttttcttttcttctctagttttttttttttcttttttctaccaggctggcctcaaactcagagaccgatctgcctgactcctgagtgctgggagtcgaggcatgtgcaccaccgtctagctttttttttttttttttttgacaagatttcacactgtaggtgaggttggccttgaatttgctgaagtttcccttcctcagcttctccagtgctgggattgttggtgagaggaaccctaaatggccaagttctattcattcttaaatttcttcaaatttctcctcctaaagcaatgtctgcctttcccccaccttactgtgttttgtgtttccattagttgcgcttcatttcctgctgcttactggagggcccttgtcctgttcctctggtgagaccagtatatgcctgtccaggttgtaggaagttttgaagatgcttttcagagcttcagggagtctggtgccctcacagcaatccatctgtgactcctttgggatgtagtctcactgtggccattttactctggtgatgaacagtgatgtgggaataaaccctttcattcctaacttgctttttggtcatggtgtttcattgcagcaatagaaaccctaagacttgggctggagagatgacttagcagttaagagcattgactgcttttccagaggtcccgagttcaatccccagcactcacgtggtgtcttgcaactatctataatgggatccaatgccctcttctggagtgtctaagatagcaacaacagtgtactcatatatataaaagaaataaataaatctttaaaaagaaaagaaaccctaagacaactatctaaggtctttacgcctgaggtcccaactcaaccacatctgatcttcttgagtattggttagttttctctgtgataaaacattattaaaggcaacttagaaagactttatttgagctatggttccagagagtttgagtccataatggcaacaggcggtaagcatggtggcagcaacagttaagttggg

SEQ ID NO: 29744 - DNA, 2815 bp, Mus musculus
ctgggtgaaagacagaaagaaggagtttgaggaactgattgactctaaccatgatgggattgtgaccatggaggagctagaggtgagcaagggaactcatgagtgttgttgtgtcccaggaaggaccctgggtttggaggctcggctaatcctacagctcggtaccaaaggaaagggggcttgcctacatgatgccccgagacagtgcgcatcagcgttaatgtccaggttgacgagatggaaaggtcctatgaagcctgttgtctgtggaaggcatctggggatttgtttgttagtgcttaggatgaaacccagggcctccaaacatgctaagcaattgttctatcacagagctacatcccagccctgtgttaagagattcttaagtccccttatgggaccagaaaagaaaacacatattagccccgcttctcaagtgacccttgggctgccgtgtaagtatggcagctgtgggctcagggcctcgttgacactgtagcagggcgaggtccctgatttgtgccttggtctcacagaactacatggaccccatgaatgaatacaatgccctcaacgaagccaaacagatgattgccattgctgatgagaaccagaaccaccacctggagcccgaggagatcctcaagtacagtgagttcttcaccggcagcaagctcatggactatgcccgcaacgtgcatgaagagttctgagcatgcccctcagctggggccaggtcgccagtgtcctgtctgacccttcccatgcttcgaggaggctatggtccagtgagacctgtggatggctgggtccagattgggtctaaaatgctatctaccctgagtccggaggcttccataggccccaagaaagtgctgttccagaacctcctccttctgttgtgtccatatgctctggcttagctcctgccatggcatggcccaggtttattaaagatatgcttaataggctatgtgtcctctccagcatgtgtctgaggcagtagcccttctgtaccagtcatgagctgagctgcatttgcttgaccaaatctcttttcagttgttaaattctgtttctgagaactgcttgggatggttggttcaggtgagggtgctgcacacatgagggccaggagctctgggctgggcccctctgtgtgcttaccacactgggaaataatgcaactcttgcagtttccttgaaaactgaaagattacgataaagttagatcatatttctctggaaatgatcagccccacagccctggaggtgctgcctcgttggtcttggaggccatgggagtcgtccccaaactcctcagaaacccgcagagtcactgtctaccctgtgagaaagtgcgggtgcttgttgtaacaagaatcattactttagccagcagtagtgggtggtggtgccacacaccttagtcacagcactcaggaagcagaggcaggcagctctcttgaatttgagaccagcctggtctacagagctagctccaggacataacatacatctctgctacacagagaatcccttattttgaaaaacaaagcatatcattattttaaaatagaattgcctttttctcacattgtctctctctctgtttctgtctgtctctttctctccctctcaccttctctctctctctctttctttctttctttctttctttctttctttctttctttctttctttctttctttctttctttctttcttgttgttttttgtttcttttttttttttttccagacaaggtttctttatgtagccctggctattctggaactcagttatctacctgcctctgcctctgcttctaaagtgctgggattaaagatatgcactgccactgcccagcaatacattgtcattctttagatggggaaaaaaaggaaaaagaaacactgtgggctagctagtttacactagaaatttttgaggtgaacactggttaaaggggttagtagctttcaataaacattgattttcctcatgatagaagtgaaaataggacccaaaggccagacaggaaagagtacgatgggatttcatgcacgagaaaaggttatgtgggatgaggttgggccttgagtgtgggagcagcagcagagtctgagctaggcaaggtctctgggccagtgctcttgaaggtttgttttggcactcaggtcccctgccttggtgttaaaaggggatagagtagctgttaggacagctgagacctcatcacgatcccaggcctctagatacctgtgtgacccagttttcccacaggaagctacttctgtgtgtggtgttaggtgtgtggggtgcaaagcatggcagctcattagtcattagagtggaggcaccgagctgattcctaggcaaagatgagacttgaaaactcagaatggtaatgtggacaggaaggtttcagcaggtcccagagtggtcggacacacagcttttgagtatggttctctcagtagacttttagactttgccaccatccctatcctgctctgctcgtgccttggcctggagatggcatccaggaccatgtctccaggaaaggtgcagagcatccttagaagcccgctagatacctgacaggtagcttatatagtagcgcctggtctttcagaggttctcattacttcctgtctggtactcaaggggcagcaccctgtgggagttgctttagatcccttgaactgaagggatgagtggggcctaggattgctatcttccctgcagtttttaggggcagcagctcagtggatacagtaaggccggctgctgctagtgatctttccagtac

SEQ ID NO: 29745 - DNA, 2378 bp, Mus musculus
tggggatccctgttctctaggcaagacatgcaatgtactttagaggtgtcccactggggtttgggcattggtgttgtattctagctcagcggtgggcaacgtcctcttgatatagacttgcaaggcaactccgattctgaagtgcagactgttaattagctccatggcttccaggagatacaatgctcctgtactaaccacacaaggaccacaaagatcaaaagatacaggctctatacctgaggagatgttttcaggctgatgacatcagcaaatgtcagcacctatgtcagacttcctgtcccacccacttctaggtacctactgccagcgactactaccaagaacaagcagctccaaaactggatggtgggcagagagattttcatctgctcgccgttatctcctcgatttgacgagcagctccctgggtttcctcgtggtttgtttcacaggattcagtgaacgtgttccaagcagcagagggtcctggcagtccgaccctgtggggaatccccagactgacatggggcctcagtaaagggagtttttgagataaggtgggggtatagagaatgtactgtgggacagcaccagaatgaaaaggaagtaaacccaggcatagacattgggtgttcaattcggggagaggttcagcagccccaaaatgaggcagctggaagactggaggcctgagcccagtaggaggaggcggaggtgtgacctgcctagtgtggaggtgacacttctttcctacaatcccaccttccaccctccccgcttcctgttggcctctgtaggcatgacttccttacgggctgggggctgccgactggtctttcactccagccccagacttaaggtgtggctgtacacaggcacccaacgacgggcatttaggagttcagtgggtgtctcctttggctgggggctgctgaatgcagaagtggtggctcaagttcatcatatctggccacaggtaggccaagtaaaaaaagatggggagggtgaccaaatgttcctataacaccaggccagtgacctccagtggcaagagacaggaaacagccatctttacatcttcttatgcttcaaagtacagctgacgcagcacagcactccacaccccaccaggatgtctagtgactttttttggtttttgttttggtgttcatttgtttgttttgagacagggtctcactatgtagtcctggccaacctgaaacttactatgtggatccaactgcctctgtcttcccagtatgtgccaccacatttggccatatagtgactcttttttaaagttacatatttattgttaattttatgtgcattggtgttgtctgtgtgtatctctgaggctgttggctcctttgcagctggagttacagatagtggtgagctgccatgtgggtgctgggaattgaaccagggtcctctggaagagcaacaagtgctcttaattgctgagccatctttccagtcctacatctagttgactcttaacatgtactacatgacaccaatctttgcccttttggcttctggtttcatttgattatgaataactgttgttgtgggttggttctaatgctatttgtgttcatttgactctcaaaatcccacaggatcctgctcatctacactgagggtccctgaccccagttggctccgattgggaaataaagttgccagtggccaatggcttggcaggggacagaggtgggactttcaggattccagagcaagaaatgcagaggaaagaggaagagaggattcagccacgacaagggtataggagacagatcacacagggaaggtggaggagggagagatgggcaagatgtacatgcaaagggaaaagtggtcccagggctgcccagaagggttcagagcagcaaagacaaatttagtaagtattaccttgtaatatcagagggtctgtgttaaccatgtggaggttcaagagtgacccagccactgtggtagttaaggcatattaaaatacaaaggttgagggctggagagatggatcagcagctaatagcactaactgctctttcagaagtcctgcgttcaaatcccagcaaccacatggtggctcacaaccatctgtaaagggatctgatgccttctagttgtcggaagacagctacagtatactcatatacataaaataaataaaatcttttttaaaaaatacaaaggttgtgtgtgcgcgtgtgggtgcgtttcactcactcatgaatccaaaacatttgagcaggcatagaggacgagcatacccgccaggagcatagagcagatttaacaatttactgctacaaactagaactttaatttttttcaaatcttatttttaatgatgattcttcaac

SEQ ID NO: 29746 - DNA, 1156 bp, Mus musculus
gataagaagatatgatttaaatcaaataatccataaacaaatgaatgaaaaacttgagctatttttatggaaactaagtgaaattatttgaaaagaccaggtgaaagtcagatgtggtggcttgtgcctttaatcccagcactcaagaggcagagggtgatggatctctgtgagtttgaggccagcctaggctacataatgagttccaggacagctagggctatgtagataaactgtctcaaaagaagaaagaaaggaaagaaggaaagaaggaaggaaggaaggaaggaaggaaggaaggaagaaaaagaaagaaagaaagaaagaaagaaagaaagaaagaaagaaagaaagaaagaaagaaaagagagagaaagagaaaggaagaaagaaagaaagaaaaaaagaaagaaagaaagaaagaaaaagaaagagaaggagaggaaggaaggaaggaaagaaggaaggaacgaaggaacaaaggaacgaaggaacgaaggaaggaaggtgatgaagacaacatgtgacactatttgaagtaggtctctgtcagctctcaaggccccttaacaggcgggtatatactgtgtatttctatacttaagttaaaacaaaatgggggtcttttcaaaacttctctgactttatactgtcaaccacacaattgctagtccatcagcaaacacagacaagcccacaagtaggatgactggcttccaggacaaaagccaaagcaagcaaagctactgagccaggatcctgaatccaggacagctaagtgtggcaacacccctggaccctccctccccatgctcccactttacccagtgcctccctgaatatacttgatggcttgcttttggacaatacaaaggcgacaagcagcacactcaagattggatgatagggagcctgtagcttcatcttgagttccctgtgtgtgtgtgtgtgtgtgtgtgtatgtgtgtgtgtgtgtgtgtgtgtgtgtgtgtgtgtgtgtgtgtgttttactggagattgtctgacgatctcaggcaagctaggtaatcattctaccactaaggaatatctctaccttactgttttggttttggttttggttttggtttttttttgagacagggtgtctctgtgtagccctggctgtcctggaact

SEQ ID NO: 29747 - DNA, 1688 bp, Mus musculus
agtaccttcaggctgggcactcagagcaaaatgtttacccgtggggcctccatctctgaacacttaggtcacttgtccccttgggcttgtgagctcatgctggttagcagtcctgtctttgctctcctaagactccagaagcctgtgagctgctagtgtggctggtggtgttggccatgtgtccctatagaaggaggtggcctgatgaccagtgccatcctccgtctagcatcttctttgacgtcaagcacacatctgatgttatgcacagtgttaggagtttgctttcccagagttgagccagtgactcaggtagcagcagcaattccaagctggaccaattcaattagactagatcttctctcctcaagctttgttgtcccaaggtctcgtattcagtgtggtgtgtgggagcgaactaccccattgccatgtccaggggacaagtagggaggggaagaagaagccctcagccggactcagagcctactgttgtctggtggaactggcagtgcagcacaacccatcccctcatctttccctggccatgtagcccctcccatttcaggacaccatcttgcatgaagaggtgaccccgctccttaggacttgaggtagaaagtgccagtcaagcacggcatggttttcagataagactacatgcatcactaggctttgagggggccactggcagtttatggatctaattgacccttggggaaagcagaaccctcgacctggccacctgagttcattttagtggtccccctcaaagcccatgtgtagacgtacagatgtgtgtctgctgactagaggcagaaccggataaagagagccaaatgagagcttagggattctagaagtcctgccaggtagtttgataagaatgcctacccagtgcccccaggcttacatacttgaattgctgagtcatcagggattacgggagaggcttaggaggtgtggctttattggaggaagtgtgtctctggggatgggcattgggtctcaaaagctcaagccaggcccagtggctttcatttcctgctgcctgtggatttggatgtagagctctcagctcctcgtccagcaccatgtccgcctatgctaccatgcttcctgccgttccgataatggactaaacctctgaaacagtagacaagccccaattaaatactttgttttataagagttgttgaggtcatgatgtctcttcgcagcagtcggatacttactaagacactgccctagctttataatttctatagatctccctatgcactggttaaaaggctgtggccagagacatctgttgaaacctcaaatgagtttatggcccttggccatatttcagaaaagtgctggggaggctaagatgtaggtttccaggcccagatcatttgttctgagaccagtgaccttgccctggggacaggatagaatctgacccagcatccttgtgttcagcagctagggcctagagtagcattggatgccctaaggtttggggttccccgggatggtttctgatgaaaagtggaaagggacattgacagcatgatgaagtgaggcccagcctggctccctggggtcacagccgattccttgcccagctcatcctgagttcccagacactccaaaggggaaacctcggattattccagccacctccatgggtcgcgccaccc

SEQ ID NO: 29748 - DNA, 1323 bp, Mus musculus
gaaaattctgttagaggctagaaaaatagcctgggagccaacgggcggtctacacagctacaaaatgagatcgacatgggattccttttgactcgccccagttgcgactgcaacatggctgaaggtaaggagagcttaaaaatctatcgccaggctcaggtctccaaggttcctcaagacgggcccactaatttggctaaggtaagaggtaatgcaggggcggatcgaacctccctcggtgttccttgaaaggcttatggaagccttcaggcggttcactccctctgatcttacctcggaagcccagaaggcctcagtggcctggccttcataaggcagtcagctcccgatatcagaaagaaacttcagagattaaaaagtgtattatgagagggagacagtcattcgatctagtaaaagaggcagagaaagtgtgtgtgtgagagagagagaggcaagaggcagaagaaagagaaaacaggagagatcttagacaagagagaaagttgactagaatcttggccacagtgataggaaaaaaaaaaaaaaagacaggatccagacaggaaacctgggcaactgaagaccgagcctcagctaaagaggctcagctgtgtcagactgaagtgacttatttgggatacacccttcgaggtggaaagcagtggctaaaagaagccagaaaaagactgtaactcagatccccaccccaactacaccaaggcaagtaagagaattcttgggcactgctggcttctacagactctagatacctgggttggcgactttagctgcccgttgtaccccctaaccaaagaagaagtgtctgtgtggaccccagatcaccagaaagcctttaagaaaatgaaaaaggccctactgatggccagcctatgcctgacctaaccaagcctttcactctttatgtgaaagagagagcaggggtcgccagaggaatccttactcagactttgggactttgaaaaaggccagtggcttacctatccaagaagttacgccctgttgccagcgggtggttttcttgcctgatggatgatgaccaacgctcctgtgacacatcagaactttttgttgactaaacgagtgacctttgcttcattccacctcctgtcccactgcgtgagactgcacctactcatcactgcactgacattctggcaaaagagctggtacactgatggcagtagcctcgtggttaaaggtaagcagaaggcggggacagcagtacggtggtggacagaaagcaagtgatctaggccagcagcctccctgcagggaagtcggcgcagaaagctgaacttg

SEQ ID NO: 29749 - DNA, 1223 bp, Mus musculus
agatggcagatctaaccgccaaacaggtggcccaaggagcaatgaccctggcagtcagggaacctaaagattattatgacatcagggggaccagctttagatacaccgctgagcactatcaagctatggacagtatttgacttggcctgggggccaagaaattcaaaggtgtggttaggtcctttgactactatgttacaggactctctgacttggcagaagaaagagtcaaaagctgcaaggcctatgctatgacgaggtagaatttctaaaagaaaccttcccaaggtaattgggtccaataaaggacctgtctttgttgcccaggtaaatcagggactggccaagatattggggattaattagaagttacattgtgcatgcaggccccaaagctcaggacaggtagagagaataaatagaaccattaagagaccctgaccaaattgacagcggagactggcgctatgattagatagctctcctaccctttatgctcttcagggatagaaacacccctggacagtttagactgacccccctataaattactctacagggggccccctccactggtaaaaatagcctctgtacatggtgctgacatgctgctttcccagcctttgttctctaggctcaaggtgctccagtgagtgagacagcgagcgaaaaagcagctccaggaggcctactcaagagaagaagacctgctacattagacgtctccacgcagaaaaccttaagactccggtagaaaggcccttatcttgtactcttgacgaccctactttctacctttatgggaccccttttgattttgcttctgcttttaattataggtccatgtgtgttaaatagacaagtcacctttattagaacaaaaattagtgcagtttggcttttagttttaagacaacagtaccatgccctaaaggatcaagtatgtcagagaaaagatagtgtctagttctaagattagaactactaacaagaagaagggggaaatgaaagagtagtaaactcagtgctccaaggtatgctaatcataaaacagatagcggcattcctccacccacccgcttcctgggttcaaggagtgttcatgcaaagaaagtcaccctgaccattgctggaacctgcaatgcaaatgtgctatcgttaggggctctgagaaactgtcttgagagttaacaattaccaggtattccttgtgacacctgtga

SEQ ID NO: 29750 - DNA, 2078 bp, Mus musculus
cgggcatacccaaggctctcaaactatatgatgggtagattgtcctggagctgacatctggagtggctcatctggataacagatgggctatccggggcagggcagcacccctcttcttcattaaccttgcagatcttagtttgtacacatgtatagcaccccactggcagtcaggtgctggcgggccccgtgtgtcagcatcactgcctgctaatctgtttccgtcctgtaggaggcctacagaagcttcctgtggggcaggctctccccaaggcctatggcacgggttttgtgggctgtctgcgggacgtggtagtgggccatcgccagctgcatctgctggaggacgctgtcaccaaaccagagctaagaccctgccccactctctgagctgccactagagctgccaccttccctcctgtaattattttctatttttgtaaacttgttgcatttttatatgattttcttgactgcacgttggccagaaggactgctggcctggcctcctttccgtccgggcagctgtgctgcagagacaaaaagtggtgctgagggactcctaagtcggccgtagcacctcgagccctgggctttgaaggcagccttaggacaaactcctctgcctaaggcatcatgcctcagccccttgcactgtatgttcctatatgtctacttgtattgatcctttgggtctcctggcccattgctaggcactgtttgtgtgttattaatgtgtaattgggtgagaactgtgtccctgagcaggaggggctgttggggttgagggggccttcattaaaccaagtaacattgggtcctttttaggtcccacttaagctgctctcctgtgtgtgctgagggccagcctcaccccaggctagcctggacccccagtgctccctgtgacaatactgtgatatcaaaaaactgataataattgggacatcatcttacttcccaaaatgtgtttgcctgtccccggaggctggaagtagaagccaggctacatctaagttgccctgactggccttcagctggccttacccacttcttcagttaccctgaacatggggagtgcatcacgatagggtgtggctgacctccattgcttacctgcctgagtagccagctgcatccatctctcaaagatacctagccaggctcctaaccatgttcttcaaccattgattttgtttgatttctgatgtggaagtgcggtcattcctggtttaactcacagcaacttttaattggtctaagatgagggcatccctcagttggtccattgtaatgatgatcgtcctcatctgagtgacagttactgcccagggtccagccaaggacaggtacaggaaggcagagatcactatagagccaaaaatgactgaaactgaagcatccatctgcttctccattccctgtcttttaagtccagcacattgggagacaaactaagcaaatctgggatgggggcagtctgaccttcttcctgcttcggtgatccgaggctagagggagctgcatggtatcttgttactaactcagtatgtgtcaatgtcaaataccatgaaataaagtctgaaaaccttaaaatagggactgtgtttgtacttgacagccgggtggcttcttgctcagattcgtgaggcacagacttcaagctctcctgtcccttggtggagaaagtagaacctgaactgggaatgcactattactgggtaacaaggctacagtgtgtgtgtgtgtgtgtgtgtgtgtgtgtgtgtgtgtgtgtgtgtgtgtgtgtgtgtgtgtgtacaaatctgcatataaggaagagagctagtggttgcactgaggataaaaccagacaaataggatgagaatgcctttgtggaaatatatgagctagaagagtagccaggcagcgctttatctggctcagatgtatatggtaggagacattaactagaaagccctgagaaggaattctgatcactggcacctctaaaatatctaagtaggaagtcttcaagacactgaagctccccctaagagcaggaagaaaaagaggtagtagagttggctcagtggct

SEQ ID NO: 29751 - DNA, 1174 bp, Mus musculus
ttcttggccttccccaccctccgagcctaccacacgctgcgtctggcactagaattccgggcgctggagacagagggactgctgctctacaatggcaatgcacgtggcaaagatttcctggctctggctctgttggatggtcatgtacagttcaggtgggcgtgtgcacaggcgtggcttctgtaggtcaggtggcctgtgtggtggcagggaccaccccagaccttctgaatctaggaagtttggtggactatgggtgagatgaggtaggccgggcttctgggaggcctgaaccgacatcctaagcaggggctcccgtgtttaggttcgacacgggctcagggccggcggtgctaacaagcttagtgccagtggaaccgggacggtggcaccgcctcgagttgtcacggcattggcggcagggcacactttctgtggatggcgaggctcctgttgtaggtgaaagtccgagtggcactgatggcctcaacttggacacgaagctctatgtgggtggtctcccagaagaacaagttgccacgtgagcagaaatcggctgggactgactgggcccctggtctctgactctgtaacaaatgatgggtaatagaggaatgggtgcggatggatggtagctgtaactttggcctcaaccgatctcctgaccctctctcagttcctgcaatgctatccatggcagcatgcctttggtgggacctgtgaaccatcagccctgacccttgaccctcatacccacctcctgattctgtcttgttactgagctggccaccctgtgaacacagtcaagagtaggcacaggggcatcctcatccctagccgtggtttatgggctgtgttagaattgtagctgaatgtgagaggatgcctctgactgacccctcctggtatcagggtgcttgatcggacctctgtgggcatcggcctgaaaggatgcattcgtatgttggacatcaacaaccagcagctggagctgagcgattggcagagggctgtggttcaaagctctggtgtgggggaatgcggagaccatccctgctcacctaacccctgccatggcggggccctctgccaggccctggaggctggcgtgttcctctgtcagtgcccacctggccgctttggtgagaactagcctggtgcccgggaaggaatc

SEQ ID NO: 29752 - DNA, 1156 bp, Mus musculus
tggctccactgctacctatggcctccccacactgtgcccaaaccccctatggctgctgccaggacaatgtcactgctgcccagggtgtgggcttggctggctgtcccagtgagtatttgagcccagccctgaccgtggtctcgcagagctgtgcagttccagtgaccagtgctttctccccttgtaggcacctgccattgcaacccacacggctcctatagcggcacttgtgacccagtcacagggcagtgctcctgccgaccaggtgtaggaggcctcaggtgtgatcgctgtgagcctggcttctggaacttccgtggcattgtcaccgatggacatagtggttgcactcgtgagtaatggaactacatgcattcctgcctgtccacccatcactgatcatggcttggcccgacccgtatctggtagggctggggcaggttgggaaacgtatccaggtccaaaccataaattcttccctcccactccccagcctgcagctgtgaccctcggggtgctgtaagagatgactgtgagcagatgactggattgtgttcctgtagacctggtgtggctggtcccaagtgtgggcagtgtccagatggtcaagccctgggccatcttggctgtgaagcaggtgagggccggaactggtgctgaccccaggactccctatgctgagagtgggagtagttgagttaacaggaattttttatccctatctcagatcccacaacaccagtgacttgtgtggaaatgcactgtgagtttggcgcctcctgcgtagaggaggctggttttgcccagtgtgtctgcccaactctcacatgtccagaggctaactctaccaaggtaaggagggaaatctgtagagagcgacggggataaggaggcctttcccaagcatgctttccctggcctccaggtctgtggatcagatggtgtcacatacggcaatgaatgccagctgaagaccattgcctgccgccagcgtctggacatctccattcagagtcttggtccatgccggggtaaggacctagagcaaccgcctaaagcaaaccagaaggacccgaccctgttctgactcgagcccctaacatccgtctttttgcagagagtgttgctcctggggtttcccctacatctgcatcta

SEQ ID NO: 29753 - DNA, 1153 bp, Mus musculus
cgtatgtggctctgacggacacacatatgctagtgaatgtgagctgcatgtccacgcctgtacacaccagatcagcctatacgtggcctcagccggacactgccgtgagtaggaccagaagggataggcttccatgagtctctctctccatcggggaagctccatgagtctctctctccatcggggaagctccatgcttactctgcttcttaccatctcctgtagagacctgtggagaaacagtttgtacctttggggctgtgtgctcagctggacagtgtgtatgtccccgttgtgagcaccccccacctggccctgtgtgcggcagtgatggcgtcacctacctcagtgcctgtgagctccgagaggctgcctgtcagcagcaggtacaaattgaggaggcccgtgcagggccgtgtgagccgggtaagctcgggtaaccggtgcgcacccctagattccagtctctgaaggagacctcatggtgaccgctctgttttcctgcagctgagtgtggctcagggggctctgggtctggggaagacaatgcgtgtgagcaggagctgtgtcggcagcatggtggtgtctgggatgaggactcagaagacgggccgtgtgtctgtgactttagttgccagagtgtccttaaaagcccagtgagtaccccaactttcccatggttccagggtgggtgcgctgagggccaaggttgctgaggttgaccccactcctcaggtgtgtggctcagatggagtcacctatagcacggagtgccatctgaagaaggccagatgtgaagcgcggcaagagctgtacgtcgctgctcagggagcctgccggggtgagtggcacatcccgcgtgttctgtgtggcgtgtcctctgtatttgtgcctctctttctctgtgcgtgtatgttctgtggtgcatggcatagagatagaaggctgtgggtatgtgcacacgctatggtgacttttatcattattgatgataatggctttttatttatttatttatttatttatttaggctttctttttgttattttacttattttgagggaaggtttctctacatagtcgtggatgttctagacctagctacgtagatcaggatcaggctggccttgaattcatgtctgcttatgttcct

SEQ ID NO: 29754 - DNA, 1082 bp, Mus musculus
tgtctggtcctgactggacccttagagttggacttgggctggatagacctgaggtgggacaattgttagatggttagatgattgttagccttcttatgtcatcctgaatccagtaggtgtctactgcactgcagccttggaacatctctgcccaaggctggggttcactgtgcacattggcttgagctagtgagaccagagagggggaagggtccaggtgtccagcctgcaaccctgtcctcataggaccaatacacttttacttccatgtccgctcaggttcgagtgtggcggtacttgaaaggcaaagatgtggtggcccaagagagcctgctggatggtggcaacaaggtggtaattggtggctttggagaccccctcatctgcgacaaccaggtgtccaccggggacactagaatcttctttgtgaacccagcaccaccctacctgtggccagcccacaagaatgagttgatgctcaactccagccttatgcggatcactttgcggaacctggaagaggtggagttctgtgtagaaggtgcgtggtgagagtgttcctttaagggccagtggcttgctgatagtgacagaaatttatgggatcagggtggggtgcagaggagagcttgccgtgggcaggagagtaaaccatcaccccgccgcctacctgtgatgcgttattgctcctagctccttctctagccacacagattgaaaaaccccaagctctgatgttagctctttgtttggtcttggagccataaacaaaaaggctgctgtcctgaaaacagacaggtgtctctgctttgtcttcctttttccctcagcactctacactcccccttcaaagatccttttctatggaaactgggagcaggtaaatgcataccacttattcctacagacctctaaacatctggttggattggctaggcacaggggattggaaggtggagaactctcctgtgtgttccagaggcacacagtttgtgggattatactgccatcctcttgaaggtgaacagaattaccttgccatccaggtctcccctctctcttcttcagtacacccccagttg

SEQ ID NO: 29755 - DNA, 1122 bp, Mus musculus
aggagtgtagccccaggggttgtgcacacagcacctcaacagtacggcaggtccttgggttccccccgggcatagggggctcctttcgttgccctgtccctatggttactccctctgtgccccactcatttggcctgtctcttggcttgccccttgggcttactcttgcctatccaactccccaggagcacacatgacctggtggccatggacggctggctctacgccgtggggggcaatgacggcagctccagcctcaactccatagagaagtacaacccgaggaccaacaagtgggtggcggcatcctgcatgttcacaagacgcagcagtgtgggcgtggcggtgctggagctgctcaacttcccaccaccttcctcacccacgctgtctgtgtcctctaccagcctctgacacgcgccagactgcacagaggccctgcagccccccacatgccttaaaccctacggggtggccctaccgactctgtcttctctaccaagtgttagggcagatcacgtagcccaccagagatttcctgtccttcggtcttggtctcggtgttcatttgtcctcgttcatttatgtgtgcgctgtttgtctactcacgtatttattgactcactatttactgatggatgagaagtgctgcagctacaggttcacacatttactctcgattgtcagctctcctgcattgaggggaccaaggaccccttcggagtgttctcttgcctgtctccctctgtgggacaatagagaatgctgggtagacactcactgaaggaggatgagcaacacagctgggccttgcaagcaggaaggggcagagcaactgtggcaacaggagcagcggcaagggctttctaagaagatgatgcagacccctagccagcgctttgcacacagcacttatctgtctctgccaggcactatccctgaaggacacaaagcagccttatttcctatgtcccgtgtacacagtgtgatgtcttttctgggtcttctatggagctgggcacacaacatgcacttagatcctacacagcaatatgagccaacttgaacaataaacatgtttcttgggctccatgggcctgaggctgaatgtccatctttggc

SEQ ID NO: 29756 - DNA, 1168 bp, Mus musculus
cgtgtaggagttgctgccgtcgggaaccgactgtatgctgtgggcgggtaagcatagaagctggccatgtaggctgaaaggtttgtcacaagcctgccgggccatccttggtcagtagcggactcttctcctagctacgatggaacctcagacctggctacggtggagtcctatgaccctgtgacaaacacatggcagcccgaggtctccatgggcacaaggcggagctgcctaggtgtagctgctctgcatgggctcctgtatgcagctggtggctacgatggggcttcctgcctcaacaggtagtagtttgggttagggccccagtggctttgcagggtcggctcagcagcagcagctaaggctggcttaactatgaagtcacatctggctaagagaatgagggcctaatccaggctactgggtcctcaaggcttccttacctcagggcacagcatccgcagggccttggcaccattctcctcctggaggggccctccctccagtccaagcagccagcagccagtatccgcccagcacaccttgctctctattcatagagtctgtgatgcccgggatttcagccgtagctttggggggagtgaggggacagagcctgggcaaggatgacttaactgttgtaactgaacgtcggcatcattctggtgtccacagtgctgaacgatatgacccactgacgggaacatggacatccattgctgccatgagcacccggaggcgatatgtgcgtgtggccacacttggtgggtgacaggcttcccgtggtacccgctttcctgcctctccccttcccacccacccccaaaactcctacaccctgcaggagcttcgtgggtatattgccttcccacagatgggaacctgtacgccgtgggtggttatgacagctcgtcacacctggccaccgtggagaagtatgagccccaggtgcatagcgcaccccatcacaatgtcctcctctaaagtgctgggggggatggggcataatcccagattctggccatctgtgccacccaaggggtctgctttctatatcccacccctgaccctcagatacccaaccaagagtagagtctatgtggtggcagggttggggggcccttggtgggtctgcctccagcctgtcctattgtctctacaggtgaat

SEQ ID NO: 29757 - DNA, 1197 bp, Mus musculus
aaaaaaaaaagaaagaaagaaaaaaaaagaaaggaagaaaaagaaaaaagaaaggattgttttccttagctttgctcaagaaaaatacagctatcctaaactggaatcttcccgtattctttagagtcttaagtatagagtttaacttcacttttgtcagctgtcttgagcttatttctaagtagttttgttttggcttttggtgagtgaggtagtgggaggttaattttggggtcttttttttttttggctttgtttgtgtgtgtgtgtgtgtgtgtgtgtttatgtgtttggcttttgggtttggttggttagttgtttagtttgtttttttgttgttgtttaatttgctttttctaggcagggtttctctatgtggccctggctgtcctagaacttgctctgtagaccaggctagcctcaaactcagagatccacttgcctctgtctcgagtgtgcttgaactaaaggcatgagctaccctcctcagcccactccaaactttgagtaatatttttaaatcatagacatgttggtattagaaacatggcgtattgtggtggatggtagagaaagggcgccgcaacctctcaggacatcatatgtctggccagctcttcattcatataggtgctctctggatatgtctttacatcagactcacacctctgaaacccggttttcacacaaggagacttgccattggggtctttagtagcccagggaaacatagagtaaactgaagagcttactgtgtgccgcttatccttagatggcctcatccagtcacaggtctttgtcagaatctaaccattgattcactgaggagaccctactgccctgaggttccactgaagcagcttttagtgagactagggcaagaatataccgaatagcttctgttcaaggtttggttccagagactctaccatttacaggactggctggagttacaacaacctcttaaagagggtagggcgggttctccagttagaccccctaacctcacaggtgagtagtcctaacctgacagccttagaaacacagttgccgagtacctgagagcacccagtggcccgccgcctcctattcagcccctctttaaagacgacagacggttaagccatggagaagctgttcaggtagcacggggccatttctgcccccagcttgtcatgttttttctctcaggaccca

SEQ ID NO: 29758 - DNA, 1111 bp, Mus musculus
atctcacaagctttaattgttttgtgcttggtcaagtattcatcttcttcttcatcgagctctgattcttccagcagttcttcagattccgaagatgaggtaaggcttgctgtgatgcttttcacgtaattgctgtctacttgagtgtcagagggactcctgttgtgaaattgctgctagacatgttgacatttttatttcaaataattattcataacttagagtaccatagatgaataatgagatgagagcttaaatattggtgttttctttttttaaagtttgctttgttcacttaaaataatagattcttttaaattctaaaatgcttttgactcattgggtggaattataagcatataattcagatcacttgactctttaaatagaaaagtattatgttacattacaaatatgaatcgaggaaaatatgttcataagctggtcctttcattatgctctggtcattactacattcatattagttaaacggataaattatattctgaaacagaaagcaaatgcttctaaaatgttttatgtaggataaaaaacaaacaaaaagaaggaagaaaaagaagagccgttgccataagtctcctgagagctcggggtcggattcggcttcagacagcaaggtgaggctgcactgggctgctgagagcggaaacgtgcccgctttctgtctgctcttctgtctagcatcacttgagttcgaaggagcacatttgatttgagttttggtttttttgagacagggttttttcctgtaatagacctagatcaggatggcctcaaactcaccgagacccccccacttccactgcgtcccgagtgctgggattaacggggtgccccaccgcgcccagcgacatttgacttttgtactttgaggttctgcaccagttgactggtgtatttaatactgaacatgtagcatctttgtatctgcaggtaccttcttcatatgcatgtttctatgttcccaagtctccatgatagtgtttcaaaataatatttataatcctaggcaaaacaaaacaaaacaaaaagcacattggaagttgagctaattactttttgatgcctagcccagtatgctttctttttt

SEQ ID NO: 29759 - DNA, 1156 bp, Mus musculus
tcctcttccagtgcttggtgactctgggagatagtactttgcagtcatactagtgattaagatatctggaataaagctaatattttttactagaagtacttaagaataaatcaacagaaactgaatctggattcatcttttaagatgtaaccagaaaaaatgagatgactctagtaaaaattttcaaagtagggattacattaatatttcagaatccttactctgtagataagtatattttaattttccccatgtatactttgatttacttggggaaggagcttttaaagggggtggtttgctatctctttagctaccagaacagtgtgcctttgatctcacacatcctacttttatggacacagtagccatgcttcctgggaggacagagctgggcaccgtcattcctgcccgactgaggttatgacatccttagactttgttgtatgctgcttcgaatgaaccagagatacccggccctttgcagcatgagaaagcccccaaagctctggaatttacctccacatcaataataagtgaatgttttcagggttacattgtgttgtgtcatttgaattcaatttgactacgcttgggctttggagagggactgttgagtagacgcaggtactttctgagcttgatagctgacaattctaaagcgcatgtgttacacaagttttaaccagtcaggagatttttacatagccagtgatagatactttatgttttgtataaattttgtttaggctgcaatgtttagcttttaactaactcttgctgtcttaagttcataactatgtttaatggcacacttacaagatatttagcatgtaaaaagcaagacttttgtttttttgtttttaacggcttcatattgaagctgagactttaccacaaacaagttgagtggcaggcctggtatgctgtatcttgttacataaagctcttgccagaatcttagtaaacacatgttttaaaagtttgttgtctttgtgtatcagtaacagatgatgacactgttgatgatgatgatgttaacttgtgtgagagctacagtgctgctcttctgtgctgtgtcctctaagactttgtgcttcgaagctgctgagtgatttggaagggtcaaaggacttgataactcactttcatttta

SEQ ID NO: 29760 - DNA, 1110 bp, Mus musculus
ccagtatagtaaccttgctacgaaggagagaggctatcagtaaatgttgacactaagtcctaagtgcatattacaattccttttttaggtaatgggataatacagggtttcacatatcccaggcagttctgtcgctcatttacagccccattttaaccatatatatttttaaattagcttctaatttaaaaaacaaaacaaaacaatgtaatcacttcagaactgaagtgaacaatgtgtttcttaaggttacttacagctcagcaaattccttcccttcatcttcactaatagacggtcttgtgtgggcaagtgcagtcattaaatgtgcctggctaatagcaaaagtggttttgattggtccaggctggttaagggattcatcctccttaaatacaaagcagattaagcagatgttaacttaggaattcaagagataaagtggcagtccctgtgttatttcttgtcaagttctttcctgagaagcgaacattctctttctcacgagacagtcacggaacaaggaccgtcagtgggcagagtccctgtgcttcagcacttggcttgtaaataaacatttaaaacgcaaagaaacacatgtcaaacaaagaaaagcaacttgtctaagttctaagaagaagggaaaaggccatactccactttggctccggtatctgcctttgatgatgctgatctctgccctcagctgatctctctgctcctgggtgaggtcttggcagccttcttgggaaggtgtcctgaacacaggatgttgtgtaaataacgggtctttcccaggagctgcaggtaaatcctgagtcacggagcttggtgcagacagacagtgtgagctctgcatgatgagtaaagaccaaagacacagatgggagagaagagagggagacagtcatgttcactggagataagaaatgaaaactttgtttccttttaaaaattcattgcttgagaatttcgcacgtgcatatgtgattttcatcaaatccatcccactttcttgcccccctcccctgccatagtccctcccactttcccttctaaactcatgagtgcttggtgccccttggtctacttggtaggaatatagccaga

SEQ ID NO: 29761 - DNA, 1767 bp, Mus musculus
ctagaacacacacatcccaaaataaagccaggtttccagtttccttctatttataatataacaagatatgccacactcatttctctttataaacctttttctctaagttcttgagatagggtctcatgtatagcccaggttcaggttggcttggccttgagatccctgcctcgtctgccttgtgtgacaggtgtgttatgtaggtagttaacgccagaacttcttcatgaagttcttacctggaaacaggacttgagaaaaatgttacctactacccagtagttgtattacctgcttagtgcctgttgcttagaaaatcacagggtgaaaaaagaatgaattgaagtgaaataataaatttaatatgtattttcccaggcaaagtggcagattccagggaaatcattataaacatgtagtgtctatttttctttataatttatttctatgaactcataaaatgaattacatttttattggtgtaaaacactaagttttagatttctctcttttattctctctcttctctctgcctctgtctctctctacttttcttttctgtttttttttttttttttttttttaacctagaatctcactctgtactcctggctgtcctactcattctgtagaccagactggcattgaactcaagagatctgcttgcttctgcttcccaagtactgggactaaaggtgtgcgccgccatgccaggcttaagttttagatttctgatcaagaactaaaccaaaatgtgagcagtatgtcttacaaagccacagtcttctctctcgaagcagaccttggctgctttagtcctgtagaaagcagctgctgggtgatgggttagctctggctcttcacactgatctcacaccagagcggtcagccacttctgtagacctgcctttgcctgtcagcatcagctgcttcagccagatctttgatctgcatgcagcatcccctcctcttactgaggcagcagcctctgtgagagtggcctgacgattgctaaggcagggactgaaaggtcattagttttgatagtcaaaaaactcaaacccagaccatgtgctggaaatttggatggtgtgctttggttgtatgatgggggagtgggcaggtacccacttgctgcctctgtcctcatctatccagacagaccgttttaactataggaatttatgagaatttgacttgatcttaatgattttcatcaaaactcttttaccctttttctttagtcccaaagttggaaaaaagcaccttcgtgcttacataaggtataataaagttcattggaaatactattgaaaatgattttctaaatgctaatattccagtttttgattaaaaaatatttctacagtgggtttattttggatttttaaatacttaaaaaggaaatgggatgcttcccccaagatggtatgaaatagaaatatccatcttttggttacatggctcatcgtacagtgaagagtcacacagtgctaccgaggggcacaggctttaaattaaccggttgacctttaggggagatttgctgtcctcaaggcacagcatatttcccgtgtgctgtgggaggctgtgctgctcgggtttctgttttaggctggaggacagtttttttagagtttagaaagagaaactgcatattagttccctatcagatttaggataggtaaagatcctttcccaatttgttggtggcctttttgtcttattgacagtgttttttgccttccagaagctttgcaattttat

SEQ ID NO: 29762 - DNA, 1183 bp, Mus musculus
agctggactgtacacactgctgccgcttgtctctaatctcaaagacatttttctaaaagctgggcacatagctcagaggtaagagtgcttgcctgatggctcaaggccttcaattcaatccccattaccacaggtaatgataaaaataataataaaatccttacatgcttagccccaacaccatgcctgcttctcaagggacctgtgccaccgacaaggcagcacttccctcattttgagtacttcatgaaggtttcaaaatggtagtcacttaggccagcagcctccctgaagggatgtcggcccaaaaagctaaacttgtgactttgatacaaagagggctgttgacatctgcagagaaggacctaagatgctgtggctaaaagaaatcagatggcaaatctaaccgccaaacatgtggcccaaagagcaatgatcctggcagtcaaggagcctaaagattattatgatgtcagagagaccagctttagatacacccctgagcactatcaagttatggacattatttgacccacctgggggccaagaaattaaaaggtgtggttaggtcctttgactgctatgttacaggactctctgacttagcagaagaaatagtcaaaagctgcaaggactgtgctatgatgaggtagaatttacagaaattaagccagctagatatggcaacaagtacatattagtgtttatagacaccgtttcaagatggatagaaacttttcctaccaggactgagacgaccaatgtgatagccaagaagatcttcccgaggtaatggacctgcctttgttgcccaggtaaatcagggactggccaagatattagagattggttagaagttacattgtatatacaagctccaaagctcaggacaggtagaaaagaagaatagaattctaaaagagactggtgcagacttggtgctccttccccatgcccatcactgtcttaaatgatgtgtctagacctacatgttgttgtaataataatctgtaaactaagttaaaaggcttgcaggtggtgaagaaagaaggctggtcacaattggctacagcgaacgagccggtaccccaaaagacatctcaccagttccagccagagatctgatccaagtacacctacatcatgcccagaccttcaagcttcactagaagggtccctgcct

SEQ ID NO: 29763 - DNA, 2182 bp, Mus musculus
ccaccagaagactcagtgtccaaagatactggtgttcatgaaggtgaaagagcccagatggaagaaaatcctctggaagagaatattctggccagggaagagttgtctcaagctggtgacagtagtaacgaggcagtgggcaggggggacaggccagatgctgccagtcaaacccctcagacctcaagcgactggctcgagcaagtacattcagtatgaactgcacacatttgctctctgggtgaatcacagtacaggggtctgggaggtggcgtatgctttagagagactttaatgcacttaatttgaacttggttatgaaccactgatgttaggattgaatgcaaaggagttcccttcacatgataactgcagtgctgactttaaccttacagggaatttcttttgtgtctatccccctttttagtgacaaaaaggagcaggagaacacaatggaataaatgggctgccacccacattccgagagaacgcagctctgtctagcctgcagtcggcagtacttaggttgaccttttaaatcaaaagcttactccttgatccttagatggcttcctcttttttatagaagtgaagaggtttcttcattgtagaagttgggccagacagttctgtcctcggtgtctgtctcctctccaggggcctccttccctcctgttgtccaagcagtttgagctgaggcgtccgtgctgcttgtagtgctgcgtctaccacagtgagcaaccggtttcctttcacatcatcaaagattccttctcatgtctcttcacagtccaattgtgccaaactctgactcgtgcgtgcgctggctgacagggcagggaggtgtgctgcaccctggggtgctccagggcagttgtcagcgtgctcgggagtaaaaggtgccactcgctagcagtgactgtccagaaattagtgggcttttgttgccatggagactgcatttaaataaatgtagcctgtagcttaagtaaactaaagctaatgctgctgttaaaacagtttattttaatattaaaatacagttgattagcaacagcggtgctgtatttaagagacactttattggaagtgcaatcatagttctttgttttcacagttttacagtgcattctaattactaacgggtgcaattacttttaatggtgttttataacatagaaaaactggagttttcatgagttacagtaaatcccacagttattagcaaattcaatacaacatcctacgcaacatgttaccgtgcctttgcctaacctaaatggatagatgccagttaagtaagtcagtaattccaatctcaatgtcttttctgaagtaactatgctatgaattgcgaagacctccatgaaaccacccatggccttgcctttacagtaactatgacaactaagtgttcaattggtttgcctagatagcaaatgctgctgtgtttgttctcttgcgcaatactcatttgctgtttgatcactgtttagtattgaaaactcaacctcctagttatcagtgtcctactgtgaagaaatactggtcttagttgtaattacgatgcaatggtccagtgtgtaattaaactagagtaaactgttggaatgactcttgtacttacattattgaagctagcataacataagcaacatagatacaaggggcactcctggagtgctttgccacattgttaccagaaaccaaaatctctctactaagtgtgtacagggaagtcctaggccaagtgaacgattgtccttattattgatatccacgattatcatttttcattacctctttttcaaattttgcttttgaaatattcatgtactttgatttcatatggccaagaagacattgtacttgagtatttaattggtaattgttcatagatatcaagagtcctaatggttttttttcttccagttaccacaacattggtatgaatccctattgaagttagtggggggaaatgttaactttgtctacagtgtattactgtatattaaactgaaatagtccattaaaggattttttatttggattaaaaataggaacaaccataaaatttctagaccaagctgtaacttttccagtagaaagctcttgtaatccctagaggcatcttgcacatccatggtgaggagagggtgtacccagaggataggaggggtgc

SEQ ID NO: 29764 - DNA, 1195 bp, Mus musculus
tcatggaggtcttcgcaattcatagcatagttacttcagaaaagacattgagattggaattactgacttacttaactggcatctatccatttaggttaggcaaaggcacggtaacatgttgcgtaggatgttgtattgaatttgctaataactgtgggatttactgtaactcatgaaaactccagtttttctatgttataaaacaccattaaaagtaattgcacccgttagtaattagaatgcactgtaaaactgtgaaaacaaagaactatgattgcacttccaataaagtgtctcttaaatacagcaccgctgttgctaatcaactgtattttaatattaaaataaactgttttaacagcagcattagctttagtttacttaagctacaggctacatttatttaaatgcagtctccatggcaacaaaagcccactaatttctggacagtcactgctagcgagtggcaccttttactcccgagcacgctgacaactgccctggagcaccccagggtgcagcacacctccctgccctgtcagccagcgcacgcacgagtcagagtttggcacaattggactgtgaagagacatgagaaggaatctttgatgatgtgaaaggaaaccggttgctcactgtggtagacgcagcactacaagcagcacggacgcctcagctcaaactgcttggacaacaggagggaaggaggcccctggagaggagacagacaccgaggacagaactgtctggcccaacttctacaatgaagaaacctcttcacttctataaaaaagaggaagccatctaaggatcaaggagtaagcttttgatttaaaaggtcaacctaagtactgccgactgcaggctagacagagctgcgttctctcggaatgtgggtggcagcccatttattccattgtgttctcctgctcctttttgtcactaaaaagggggatagacacaaaagaaattccctgtaaggttaaagtcagcactgcagttatcatgtgaagggaactcctttgcattcaatcctaacatcagtggttcataaccaagttcaaattaagtgcattaaagtctctctaaagcatacgccacctcccagacccctgtactgtgattcacccagagagcaaatgtgtgcagttcatactgaatgtacttgctcgagccagtcgcttgaggtctgagg

SEQ ID NO: 29765 - DNA, 1134 bp, Mus musculus
ttttttttttatcttttttttaagtatttttttaattaggtattttcctcatttacattttcaatgctatcccaaaggtctcccatacccacccccccagtcccctacccacccactccccctttttggccctggcgttcccctgtactggggcatataaagtttgcaagagaggacaactttaaagagtcatttctgtcctgctacatgagtgctatgaatgaaactgagattgtccaccttttatcacaagctctttgccttctaagctattttgctggctctccatcttaattaagtgaattagtcagtgacacacctcaatagaaattggactttagctttgaagtagacttaacccttaaaattgttatattctttgtatttttagataggaaaaagttgtttttatccttcctttccattttaggacttttctttttggtagagatggaaacccaaataaacggaatgtgcacaatgaaacatctatgcatttgttgtgtatgggacctcaaatcatgatatctgaaggaacccttcatcctcgcttagcacggcctgtggaagatgatttcagaagggcagattgtctgcagatgatcttacagtggaaaggagcaaaacttgaccaaggcgaatatgagagagcggctattgatgccgttgataacaaaaagaacacaccccttcactatgctgcagcctcggggatgaaagcctgtgtagaggtaaaacctgcttgcttttccatattctgtgctagcagattgtatgttgatagtatgtggtagtcagggtttgctttgtctcagcagttctcacctctagtcattctaaaagaaccaaagccctttataagtgcctttataagcccttacattgctttagggaacagcaaccagctttccagcttttcagaatataatgtaataaaaatcaagaataattgttaatatctcttaagatattaataggtcagtagtatcatactgaaaatagtaggggtttttatctgtgtttgctgaaaatttaatagccaatttctaaaacttccatatcttggatatgggggaaagatgacaactattacttattgatatattatctttacttgatttgtttattaataga

SEQ ID NO: 29766 - DNA, 1169 bp, Mus musculus
tcaatgtatatttatccttccaagtttactgtaagtacttgcaaaatataattaattgtatggtaattatctttgaatatatgtttagcaccaaataatcgtaattatttataattaagtaagccacaatggaatcaaggatttagtgtacattaatgcatttgatttgtgttaagaattatctgcaaaattttctacaatttttttctagtcctatttatgaaaccaggtctttgcaaatactaccagattctatactattgatcacatcctaagcccaagaaatattctttactttttaaaaattattttattattgtatgtgtattttccctgcatatatgtctgtgcaccatgggcatgcctggttcctgcagaggttggagaggtgttggatcccttggactagagttgtagatggttttgagccaccatgtgtatgcttaaaattaaacctaagttctttggaagaacatccaatgctcttaaccacagaaccatctctccagcccatagtctacttttgttttatttttttgagacaggatttcacatgactcaggctggcctcatacttgctatttggctgaggataaacttgaacttgtggtggtgttcttaatattcacctccaagtactgggattatagtcttgtgccctcatacgtagctcccaagaaatgctcgtataattatgtcattaaaaacagggacgtaccgggcgtggtggtacacacctttaatcctagcactcgggaggcaggcagatttctgagttcgaggccagcctggtgtacagagtgagttccaggacagccagggctatacagaaaaaccttgtctcaaaaaaccaaaaccaaaaccaaaaaaaaaacaaaaacaaaaaacaaacaaaaaaacagggacgtatccacaatttgggtagtaataattgttgaactttgatttaaatttagatctataaactgtttgatacttagatgcatatagtttaatgtaaggtttctatgcattgatatagtggatttattttacagtattattcataaagaacagctctttttcaggtcttcagttcaagccttatcataaacccttgcaacaagttcatgactggccagaaatacttgctgaattgactaatttggatccacaaagagaaacaccac

SEQ ID NO: 29767 - DNA, 1212 bp, Mus musculus
ggggggggggctttgaagctccacccagtgtggaagagccagtttttctcctggttgcactctgtcaagatacagacttctcagctccttctacagcactgtgcctgcctagatactgctatgcttcctgccatgatgtcaatgactgaacctcttaaactgtaagctaaccccaatcaaatattgtcccttggcaacatggggtcatttcacagcaatggaaaccttaactaagacaaccaccaacattgaaataacaggaattaataatcattggtcattaatatctctcaaaatcaatggactcaattccccaataaaaagatacaggctgctctttctgtacccagcgcagccagggctcgtggtcccaagaaacacctgaagcgcgtagctgctccaaaacattggatgctggataagttgactggcatgtttgctcctcatccatccactggtcctcacaagctgagggaatgcctgcctctcatcattttcctaaggaacagacttaagtatgccctgactggagatgaagtaaaagagatttgcatgcagcgattcattaagattgatgggaaagtcaggaccgatatagcctaccctgctgggtttatggatgtcatcagcattgacaagaacagagagaacttccgtctgatctaagacaccaagggtcgctttgctgttcatcgtattacaccggaggaggccaagtacaagttgtgcaaagtgagaaagatctttgtgggcacaaaaggaatcccgcacctggtgacccatgatgctcgtactattcggtaccctgattccctcatcaaggtgaatgacaccattcagattgatttggagacaggcaaaataactgacttcatcaagttcgacactgggaacctgtgtatggtgactggaggtgctaacttgggaagaattgttgtaatcaccaacagagagagacatcccggctcttttgatgtggttcatgtgaaagatgccagtggcaacagctttgccactcggctgtccaacatttttgttattggcaagggtaacaaaccatggatctctcttccccgaggaaaaggaatccgcctcacctttgctgaagagagagacaagaggctagcggccaaacagagcagtgggtgaaatggtctctaggagacatgctggaaaagtgtttgtacaagcctttctaggcaacatacatgc

SEQ ID NO: 29768 - DNA, 1193 bp, Mus musculus
aggaccttcaacaacaatgcctttatctaaatgaagagatcgagaagcaaaggaatacgtttgcgtttgctgaaaagaactttgaagttaactatcaagagttacagagggagtatacttgtctgctcaagataagagatgatttagaggccacacagaccaagcaggcattggaatatgagagcaagctgagagcgctggaggaagagctcctttcgaaaagaggaaatccagccgcgccaaaggggaagagttctggaattttcccatctgagacgctggaaattggggaagttgtagaaaaagatacaacagagcttatggagaagctagaagtaaccaagcgagaaaagttggagctctcagagaaagtctctggcctttctgaacaactaaagcagacccattgtaccatcaattctctaagtgcagaggtcagagccttaaagcaagagaaggaacagcttttattgagatgtggagaacttgaactcctcgctaaccctagtggaacagaaaatgcagctgtctgccctgtgcagatgagttcttaccaagctgggcttgtgatgggcaaggtcggggattctgggggatctatttctaaaattagtaaagatttggctgaagaatcaaaaccaatgatagaagataaaattccctttaaagaaagtgggagagaacagttgctcttgccaacaagagcacaaaaaccgtctcatgcgacagttgaaccatgtgaaagtgaaaaactccagcaagagcttcatgccctcaaagccgagcaggtatgtccacatgctctcgggacatcacagggcacatagagtcacactgaagccgagcaggtgtgtccacatgctctcaggacatcacagggcacacagagtcacactgaagccgagcaggtgtgtccacatgatctcgggacatcacagggcacatagagtcacactgaagccgagcaggtgtgtccacatgatctcaggacatcacagggcacatagagtcacactgaagccgagcaggtgtgtccacatgatctcaggacatcacagggcacatagagtcacactgaagccgagcaggtgtgtccacatgatctcaggacatcacaggacacacagagtcacactgaagccgagcaggtgtgtccacatgctctcaggacatcacagggcacacagagtcac

SEQ ID NO: 29769 - DNA, 1143 bp, Mus musculus
tccgccacgacttgtgcaccagaagattgtgcaagaggtaatggctccgtgtgcttttgaaataatgcacatcttcctcctcgcacagttcagggcactcccaggatacagaaatgtgcgtaagggaacatgctgggctttatgggccacgcacagtgtcacacatattcatggcctgtcagacacgaagaccttaaagctgcttttctcagccgccatgattgtatagcatttgcaaatgggtgcctcagggctgtcgtcgtctgtagccagggttactacctgcctgctttccttgtctacggataaagaataaccccgtgtcactactcggggatcccatccatgtgtaaactaaaaaggttaaagtgaagaggctaaaacaagtctctgtaacactgaagtgttttctctttgctctgtcctctgataggtcttcctgcctctttaagtgtgaagtgtagcagaatgtgtcttgtctgaggttgggactcagtttggactttccttccctgttcttttggctccttgccgtcaccttgctgatagatagggtctggaatccgggattagaaggttaaatctagttttcgtccaacatccctgacccctgtccctgctggctcgaggcagttcttccacagtgctgctctgtaactctggagaacacgcagcctgctgagcttcctgtggagaaatgagaagaaaatagccagttatagatggtttgcttagttacaggttggctagcagtgtgtttcttacctcaaaggaaagcttgatttaaaattttaaataaacttaacttaaaaacatttcagttgagtttaaaataatctctaaaatgcttttagtaaaataagaactgaaatactaacaattcttttcttttcaatttcggtcttttcacacttggccgattgacgttttagaccagctctcctgcacaagctgtagacaaagggtatttactatgtatggatcttaatgtgtgtacaacaggattctatgtaaaacctgtggaagcaaaattaaaaacaaagatcttgttttacttaaccatctagggaggagttttcctgttctagtcaaactgatgccatgctgacttccacagtcaaacactgactgaggaaacggcct

SEQ ID NO: 29770 - DNA, 1146 bp, Mus musculus
ctagtctgtgcaggcttgccgggcaaaacattctctaaaagaaagtaataataatgggatcattggagtcattttcccatgggtaacttctgtaaatctagagtgtggctatcagaaatcactgggaattttccatgtgaatggttggttttacagatatacaaatatgcaagttcctatctaaaatatcttaaagcatctgatgttgcttatttaaagtcttgcattttgtcctccgctctgtttttagttctgaagcatttgccccactctgagaaagagcaacactgtagattatcagtctaggggactgggagcagttgaagatgtctttgtagtaatcacctgaattacaaatgagttcttaggagtaaaatactaatcacacgtgagttgccaagctatcttttaactccagtctggcttctttctagaactcctggactgcagtatgcagcagaagcagtcgctggaaatgcaactggaactcagcagcctgagagacagagcagccgagctgcaggaacagctgagttcggaaaagatggtggttgcggaactaaaaagtgaacttgcacaggcaaaactggaattgggaacaacactcaaggcccagcataagcgcctaaaggaattagaagcattcaggtatgctgagtgctttagtttaaggggcagtggaggaattgtactggtgtgtcataccattatgcagaaagcgcacggaatttaaacaacagaagaatggctgcagaaggaaacctcctggtgtttccacatttaaaatgtgattgttttggcagaacctctgctatgaccaccctgcgctctgacttctgttccagtcaacagttactagatatagttttgggctctatcttaccacagactagctttaagtgatgcttaatcttgggttttagttgactagtatttgccaagtatgagaatcaagactgcataggaaaaggtgtgaatactgacgtattctgcttgccagaggcatgctgcagctacacacatttttattttggacattgatttcacacacacaaattcacatgatttctatgtgcagtaaaagacaaaaaaagttaattagtattatctttctggcaattaaattatactattagagacagtagt

SEQ ID NO: 29771 - DNA, 2978 bp, Mus musculus
ttttgactgacaggttcacagtgatataagagacctttggacctatatctcacactttcccaagctagaatcccgtgtcatgatttgaaccttctaaaaatagcatcctagtcacccatgttatcctctaacactggacatacctggacttttaaataatttagattctcaccttatgtgcaggcgtcaccttttatactgttacagatttccttcatttaagatgagtactgttccaggctgaaagaaggaatgaagattttaaaacttattctgatgaaaatttattttaaaacagggcgtcatcgttgtgttggagaaaattttgcctatgttcaaattaagacaatttggtcgactatgcttcgtttatatgaatttgacctcatcaatggatattttcccactgtgaattatacaacaatgatccacaccccagaaaacccagtaatccgttacaaacgacgatcaaaatgagaagaggaacaagaagccagtgtggagagaggaccgcaagccgcagctggcaaagaatgaagcctctgagaagctctcgtgctgtactgggttgaagagtgtggttctgagagccagtttatgattttaatgttttattaactcggtgatttttgtcagaccgaatggcatttgaaacagtttatagtagttttgataggatttcagggaagccaagtttatgttagaaatcatttgggggggtgtgtcttggaattaagaagatatagaatgcagcatccaggtaattaactccacacattgccacagggagatttggaactggtgtttgaagtttcaaagccttgtcaaatgctacaaaggtaatggggtcgtgtagttgggccacttctgtgcgtaaagatatgaaaggataaaggttaagtttactgcgaagcttgaggtggaagtaaacgctacttagatggtgtggtgtgtcctttgaaatgttaactggagcaccgctcctggaagatggcagcgatcttgaaccttgccttgataaccttaattcctaaaagtaataaaatctaaagagtgcttatgtatgttactggtcccaaatggtcacagttttgtgaaaaatccaaaatcaaatccttgtaagacttttttattttaatttggcttaaggttttttgttgttgttgggaagtttaaatttaccaggcttttaaaagtgtctgattttgagattagtgagttctggccttgagactggggaatgggagatggtatcattgcccgtattctgtgctcaggagacaacctaacagattgtaaccacggacccaactctgtgacatgcccttaatctgtgttaggagtaagaatagctctgttgctggagtggtgctgcacacctgtaatgctgttattcaggacctgcggcaggattgagaatttgaggccaacctaggctacggagcaagactaacacactccccaaaataaaacctcttttctctaaaagtatgtgtactggctggtcttaggcacttgacacaagctagggtcatcagagagaaaaggaagcctcagttgaggaaatgcctccatgagatccagctgtaaggcattttcttaataagtgatcaatgggagaggctccagcccactgtggtggttccatccctacgctagtgatcctatgaaaggctgaccgtgacatgaggagcaaaacagtaagcagcactcatttatggcctctgcatcagctcctgcctccaggttcctgacctgcttgagttcctgtcctcacttgatgataaacagtgatatggaagtgtaagccaaataacccaccttcaccctcgggatttgctttttggtcatggtgtttccttgtagcaagaggaactgaaactccgttacagttttaagaggcttttgaagactcccagtgaaggcctaaatctctgctgttaaaggctccacattaaaattctctgagaaagttttactggtttgtattcatgaatttgaacttgtgcttcagtaagtacagttcatgaaatctgggcatatggaagcttacatcctatttgcctgaaataggttccttttagtattatctttggttatttaggtaagtcactcttgttatcaatgccccatgagaaatcaggtattttcataacaagttacaaaagttgctcacctctcaaaagtgtgcttgtctcttactgagtggttgttagacttttaggtcatagatgttacatttgacgtgttaggttaaaaccttgattaaagtttgaagactgtttgtttctaagtaacagattttctttgccagtgtagatgttttgtgtttattattcctagaggggttctagactttgatcaagtccctccttttactgtgtggttgttaagacttttaagtcatagacgtgttaggttaaaaccttgattaaagtttgatgattgtttctaagtaacagattttctttgccaatgtagatgttttgtctttattattcctagaggggttctagactttgatcagattggtagattcctggcagagttgtgacttgagtaaggctgtcctgtttactgtctagttttagactttgacatattttcagtgctgagatttaaaagggctcaagcactagaattccagattgagatactgaccacagacgagctattaagttattgtgaacaacacagcagaggctgagggccatagggtgttagtagggtagactagcagtagggtagattggctggcaagcacctgtccatctgccttttcccgactgaactgtcttgacttggcaactgtattagttttttaaagagtttaatgcacaactttcctgctcaactagttgctttagaatagttttgatatttttagaaagcctagttgaaatttgggaaataaaattagaaattcccagcaatgcacagctttgtgattgtcttcatgtagtgcagagaccattaat

SEQ ID NO: 29772 - DNA, 1164 bp, Mus musculus
ggaactcactttgaagagcaagctggcttcaaagtcagggttctgcctgcctttgtctctgtctccctagtgctggggtcagaggtgtgctggctgaggcataggctttaagtgacttgtttttatattattgacttgcggtctatcattgattatggatgctagtttcacatcagaaacatgagctgcaaagttgcctcaattttccggcttgtcttttgatctcatattgatatgccgagaagcactaacatttttgattgggtccagctgcccattgtcgtctttgcttttcatggaaatgattcatatctaagaagccattgccgagtttgtgatcttgtatacctacacttttgcttttttctagttctagcttttacatttcagacagtgatccattttgagttaatctgggtatatgatgcaagggaaggccacactattaagaatcaagtttgacttcagtttctaggatgacctctctcaaatcctccatatcctagacatagaacctaggggaggacagagtttcctttaaaagtgtgattacatttaattaaacaaatacctaagttagagtggcatctgccattgggcctctctgtcccttgtggaactccttccttacaatttggtttataaattgtctttgccccaagagtggggaactcagagatggacacagacaaaggataatgagagataatcatagttagtgtaaaagaaaaccaatgtagattggaagttcagctgtcttacactctcagtgcacatctgtttgcttataaagccaacatggagagacatgggctgagaggtggagagatgtggatcttcccaggacactgcttgggcttgggaaagcacagtcagaggtgcaagacagctggagctgagttggtggtccaacggcctgtgatgtggcctgggatgggctgtctggttcttaggctcttggacatccaggcgctgctgggagctgtggaatagctgagaacagaatctgggcctgtggctggatctagctcagggccaggggaaaatcaaggaactctgactggtcccaccatgattgtccttggcttgacagcaggctgcaggcttggcttagacttggtagttgtggctgggagcgtagagcagccttctaagggagactag

SEQ ID NO: 29773 - DNA, 1326 bp, Mus musculus
ctatggttttttaaaattacaacttctagccttttccacctctggttcttctcactcataaatggagctgagtgttggtcattccaagacagtggcagctcgaattctgagactaataatagtgttttccctttgttaattaatcttagttcttctctcactaaactgtttccagatggaattctaccatgccttggtgttagtatacagagataaaagtagggccaggtgtagtggcttttgactttaataccagcactcaggaggcagtgacaggtgcatttctggaaattctggtctccatagcaagttccaggccagtcagagctacacagtgagaacctgtctttaaaaacaattagaaaaagtggactcagcaatgagaatactagacagttttcagctcacaggattgtaactacaaacatttaagctttcttatgagaatctttcggcattatcatctatagcctcaaattactgttatgaattcactcaggaagagaaacagctgtttctgtattatctttttagtgttccagattgggcataaatagctgttttttaaagccatcaaaggaaagcacgtatttacaatgcttttgagtcactggggctgttattgagatggggtggataacttcttttgttgctaaaaagctgttgattttaaaggccttctaaggagccagttaggcaaagaaccttgaatgtgagacggtgcatagaatttctgttacccagctttgggagaagaataaacctgagattctgagttcactctgcttgtacatacgccctatgacggatagtgtgtgctgtaaaccacaaggtagaatcctcagtgggtgtgctgtgctgcctcatgtttattaaaagatgtatttttacaagtttgtctctgtccttttctcagctctaaggttaaatattttggaaaacatttgtcatgtgtatgtcaacgaaaataaagcactcctaaagaccatggctgcgtgccctggtctccgcggagacacgaacgacacggacaccaagtcgggttcacgcagcaacttctttacttgtggctttttttcctacagctctcttccccagcagcttcttcttctactccttcttgcagcttttcttacactacctcacttatagcagcttctcttacaacagctcgcttcaactcagggcaagggctaaacaacaaccaaactcctatactcacaccaactgacctcatctagctccaccccacctcatccaatcagaattcacacgctccaggcacgagctcaggtcaatcaccaataggctgacaggtcctggtca

SEQ ID NO: 29774 - DNA, 1175 bp, Mus musculus
gggactaattgaataggcatcagtatactgaagattgctatcttctacctcattccagggaaaagtaaaacgcattttacatgacagagtaaagctaatatttaagcatggttaacatttggcttcttcattggtttcagatggggtcttgctgtgtagctctggctggcctagagatcactgcagaccagtgtgtactcagactttctacccgcttgcctcctgagcactaactacaaggcacacccaattacactaacaatgcgtcaggagacagtcagtatgttgcttcatttgaagcaagaatccctttccagatccccttatcaggtagtgctcatgcgctggccaagctcttagtgcctaggacaaaattgtttttcagggcgcgggagtctgttctttagtgtcagcgccaaagattcatttggtggctactatttgagtagtggctttagtctgttcagttcctgcttcagaactgatttcttgcttctgacactgcttaacgtttgagtaagtacttcagaggatacacaaataggagaaatagccatgtctatgtaggaatgttgatctaattcacctgataaccagtgggaagtctgacattatggtagctggtaagcttgtcaagcattgacccaggagtgtatttcatctgaaagatgtctttgtgacacagacagcctgtggtccaccaccagcaatagcctggacgctggaaattccctttaatcaggtctcctcccatagccgtaataatggtctcagatcatgagaatggtaagataggagagagattaaattatacctattctacctctgaagctaagatgataaattaaagaggggcaaattttaaaaatatctcttctgatgtgatatcaaatggataaaaccatgttagtactaacatgacattgaggggtgttgggtcttagcttagggatttgagctgctcatttagataatgtccacgtactagcattgtttgtaaggactgtagtacattgtgcttatagatttttacaagcagctgattttatgataacagtttctgatgcctcttttgcaaatctgagtctttctgtagagatatgtagtacttttccctaagtccaacactactgtatgtaggccaacactactgtatgtaggcaagttaatccaat

SEQ ID NO: 29775 - DNA, 1205 bp, Mus musculus
atgttggccatttgaagtctctaggaagaataaattatataatcagcggggaagcccaccttccaagaagaaacagaattttttttcctttaggtgaaatgtgaaatgtacatgcttacttctaaaaaatacatccaagcagcacacaggagcaggaggcaacagaccttagctagagaaagttacagtcagcggcttaaggttttatgaaaattttacattttttccacaaatgagttcactgtaattttctttctttctttttttttttctttttgcaaagtagcagcaagttaatgagctttaaaaaattgcttactaagcgcggtagtgtgggcctctggtggtgtggtaagctctggtaagcgtggtggtgtgggcctctcccacaccccttgggaaggagaagctaggagttttgagtaaaacacagcccctcctgggtgacatagcgggttgtaggttgctctggatttcataatggaaccaggtttaaaaatactggtttttaacagtatgtgttttgattattgtatgtggtttgttgttttgtcctcaagtaagtctgtgtgactgtgtgaatgaagtgtccatgacagccagaagagggggtcagatatcctggaactgaaattctctacagtggaaagccaccaagcaagtgtcggaaatcagaaccaggtcctctgcaagagcagccagggttcttaacttccaagccttcttctccagcccctttctttaatacttttttaatttgttaaaaattatttaataatttattgtttagtaaaagttatggttattgacccctttttaaaaatcctttttttaattatatgttgattgtacttaaatttcttctgacttaataatgtgtatagtttgataaaatattatttgaattttaatctagtttctgttcctaatgtttccttctcgttctagtgcatggactagtttttcttggatctcttttttcttcattacaggggaatttattgagcactgtgcagggctctgtgatacaaagaacaggtagaactcttatcctgcttgtactgcacagcagaagctgtggggagctggcatggcctacttcataacaaagaagtgaagctgaggaaaagcatgccgagcttatactggccagcctacatgattgaagctggccttgttagatgctgtatcctatcagttccctt

SEQ ID NO: 29776 - DNA, 1137 bp, Mus musculus
gaccttgaaaagttataaatagtctaaataatataatctactcctgaaaataattttccacttaatacagcatcacaggtggtccaaaatcccaaagtacttggaatattttccagcaacctaactgttgtttttaacttgtttttctcttttgttggacaaggtacaagttggaggtataatcttctagaagtgaatttagagctcattaggaacaatggagaatatgacgtcctgtttgtcctgcgtaagatatgtgaagccaagactggattaggctctatgaaagctgttaaggaataattttctttgtttggggaaattttttaacaagctcctctccacggggttgactaagaaagtgggctggtcagtgactgaacacaactccataccccattggaaatagatgagcagccatttttaccaacaaaacacgcccaagagatactctggcaatgcagccttttggcccttgaagcaactattgggactcaccttaataattgtacctcttctgattactgtcttgaggaacgtttcaacatacaaagcagttaattattgttccagattccatcagcatccctggaagcctaggaaacatcttcctgaagttctctatccgctgcctcaagccttgctgttagcatcctttcccaaaactgaaaaatgcattcctaattccatttacctttaagggcagcaggcctttgtccaactgagaactggagtaaaatcttcctgaagagcagagtaatggctaattcttaagtttcatgtaaatggtaggtcatccattgggcaagtagttgacattaagtttcatgtaaatgattggtaggtcatccattggacaaatagtaccagacattagtgaactgattggaggcttgctaaatatgtagttattcactatttgaatcttaattggatttttctgctctggttctcaagagaataaatactttatattgttccatcaaacaaaagtattgtagccagacaaacggtggcacatgcctttaatcccagccctggaaaggcagaggcaggcagatgtctgagcttgaagacagcctggtctacagagcaaaatccgggacagccagggctacacagagaagaaaagccctg

SEQ ID NO: 29777 - DNA, 1136 bp, Mus musculus
tagtaaaatttaagataagatttaaagcaatgcctctttattaaagcattaaagtttgctttaataggtattcataggtattaattgacatccaaacttcgtaatatgatagtaatgcttctaatattgattttaaagataataaattgttttaaacttgggttttgctttcccaaggttgtaggtattatcctaaccttgcacaagaaacttaaaaattttgattaaaactgccattgttccattgactgcagcttgcagtttgatttcaaatttaagatctttaattcacctgtatactgtaattaagataattacaagagtaatcatcttatgagagcgctcatacagctcacttcatacgaaactgtgacagagttatctagttatgtttgtctttgtgaatagattagacaaatagtttggctatagttgctgcctggcaggaaactgcagtacgggcaattttttcacaacactaaagttgtgaagaacgttttaactgtaaggcatcttaagaaagagcatcaaaatttagaggcgtagacagttatattgtttctctagaattggtccttattacaagagggccaagatgctcagattaaaaagtattttacgtttgagtcaatacatggctctgggcaaccccagagcggcttgtggcctttcttttgttttgcaaacagtgcctgagaaagttttttccctgtgttcaagagaatttctttttaacagtgttgcagatctattcagatgtttaaaataatgcttaaattcaaagagttttgcttctagtgaactggtaattactagaaaattttgcctctaggtatggctaatgtaactttacattatgtaagaaaaatttttattgtttctgcttctatacaagaagccaagagttttaatctttcagtgtatattgtttcctaagtaaaaagtattttattaactaatgcttcttgaagtttaccttaaatccttgctgtcacccaagagattcaaagacaatatcctttttttacttagggttttagtttactacaaaagtttttacaaaaaataaagaaagcttttataattggtattaattggtaattaaaaattggttgtgcccaaaacaattctttggc

SEQ ID NO: 29778 - DNA, 1876 bp, Mus musculus
gggagggggtttcgccattctctctcttgctctcttgctcctgaagatgtaagcaataaagcttttgccgcagaagattccggtttgttgcgttcttcctggccggtcgcgagaacgcgtgtaagatgtgtgtgtgtgtgtgtgtgtgtgtgtgtgtgtgtgtgtgtacagagagacagacagacagacagacagaatagataaataaatgtaattttttaattaaaggattatcttggctctttttggtttctcaccaagttacattaaactgagttgaaagtagacccaaaatggttactgtgcataagttttgaagtttttctaacttgtaccaagacacaaaagaaaatgtattggtctcattgaacgcagaggcagctgccgggcattcgtgtggtctcgtcgtcagcgcagctgggcctacacgcaagcaaccatgtctaagggacctgcagttggcattgatctcggcaccacctactcctgtgtgggtgtcttccagcatggaaaggtggaaattattgccaatgaccagggtaaccgcaccacaccaagctatgttgctttcacggacacagagagattaattggggatgcggccaagaatcaggttgcaatgaaccccaccaacacagtttttgatgccaaacgtctgatcgggcgtaggtttgatgatgctgttgttcagtctgatatgaagcactggcccttcatggtggtgaatgatgcaggcaggcccaaggtccaagtggaatacaaaggggagacaaaaagtttctacccagaggaagtgtcctccatggttctgacaaagatgaaggaaattgcagaagcgtacctcggaaagactgttaccaacgctgtggtcacagtgcccgcttacttcaatgactctcagcgacaggcaacaaaagatgctggaactattgctggcctcaatgtacttcgaatcatcaatgaaccaactgctgctgctattgcttatggcttagataagaaggtcggagctgaaaggaatgtgctcatttttgacttgggaggtggcacttttgatgtgtcaatcctcactattgaggatggaatttttgaggtcaaatcaacagctggagacacccacttaggtggagaagattttgacaaccgaatggtcaatcatttcattgctgagttcaagcgaaagcacaagaaagacatcagtgagaacaagagagctgtccgccgtctccgcacggcctgcgagcgggccaagcgcaccctctcctccagcacccaggccagtattgagattgattctctctatgagggaattgacttctatacctccattacccgggctcgatttgaggagttgaatgctgacctgttccgtggcacactggaccctgtagagaaggcccttcgagatgccaagctggacaagtcacagatccatgatattgtcttggtgggtggttctaccagaatccccaagattcagaaacttctgcaagacttcttcaatggaaaagagctgaacaagagcattaaccccgatgaagctgttgcctatggtgcagctgtccaggcagccattctatctggagacaagtctgagaacgttcaggatttgctgctcttggatgtcactcctctttcccttggtattgaaactgctggcagagtcatgactgtcctcatcaagcgcaataccaccatccccaccaagcagacacagactttcaccacctactctgacaaccagcctggtgtactcattcaggtgtatgaaggtgaaagggccatgaccaaggacaacaacctgcttggaaagttcgagctcacaggcatccctccagcaccccgtggggtccctcagattgaggttacttttgac

SEQ ID NO: 29779 - DNA, 1195 bp, Mus musculus
ttacattacaagagcaagttagtgtgtgaaggggaaaaaaaccagtatgtcctgaagacattttctaggcaaatccagtttaggaaataaacaaaagcaacctccccattgagtaatttattcatacaagtaacagatttaaaaataaccaagtctgacattattcagcaggagaattaatccaaattaattcattaaaataagataaaataaagaaaacatgccctctaagtaaatgtggtactgattaagctttgtctcctttaagaagtatttacatctcattacaaactcaaaattttacatccagaaaatttggatgttctataaaatatgagctatgtaaatggtactttgattaagaaaggttgataaagtcactcagtattagtgaatgttaccaaaagtgaaaatatcttgccttagggttaacaggtccatttgagacaaaatgaataggtatgaatactcagaacttcattgactgtagaaatcatatctgaatgccttaaaattataagtaaggaaaataatgattcggggtgacgcccgagtcctcactgcttatgtgagaagaatttttgagcgggtataggttgcaatctgaggcgacccacctactttgcgggatgcctgggtaacgcgatctgccagacccctaatacgataaaaaaatagaaaaaaaaaaagaaaaaagaagtcatatctgaaatttttattttgggtagaaatatttttaatattttattatatattgtcttcatttacatttcaaatattatcccgaaagtcccctacaccctcccacacccacactgctccccaatccacccactcccattctggttctggcattctcctatactggggcatagaacattcccaggaactagggcctctcctcccagtgatgagtaactaggacttcctctgctacatatacagtaagagtcacaagttccatcatgtgttttctttgattggtggtttagttcaaagtagctctgggggtactggttagttcatattgatgttcttcctatggggcttccgaacccttcagctccttgggtattttctctagctctttcattggggaccttatgctccatccaatggataattgtgagcatccacttctgtatttgccaggcactggcagagcccctcaggaaacagctatatcaagctcctt

SEQ ID NO: 29780 - DNA, 2260 bp, Mus musculus
cttggctagaaactggggtatggggctgtagagttcaatggatatgatttcaatgaagaaaagaacctgaggaagtcaagtctatgtaatagagtgtcaaggtaaaataggatgcctaaagaagaagttataaaaatcctttctgtgctcttctgtttatctgtggaaacatgtgtacctcacatcagattttcctagagtggttgcaaagagagatgaggttagcactatcctcagaaagttcctgtgtggcaattttcttgatgtatcatggttgttttcttccaatatgtcttagcatgcagaatagaatgcacaaatactgtttaagatataagtactactctgtgcgcctcctcctcccgaagtgctcctcttctacagctgttccgcagtcgccgctgccatgagggagatcgtgcacctgcaggctgggcagtgcggcaaccagattggcgccaagttctgggaggtaatcagtgacgagcatggcattgataccactggcacttaccacggagatagcgacctccagctggagcgcatcaatgtgtattacaacgaagccaccggtggcaagtatgtgccccgcgccgtgctcgtggacttggagccctgcaccatggactcggttcgttcagggcccttcgggcagatcttcagacctgataacttcgtctttggtcagagtggggctgggaacaactgggccaaggggcactacacagaaggtgcagagctggttgactcggtgttggacgttgtgagaaaggaagctgagagctgtgactgcctgcagggcttccagctgacccactccctgggtggggggactgggtctgggatgggtaccctcatcagcaagatccgggaggagtacccagacagaatcatgaacaccttcagtgtggtaccttcccccaaggtgtcggacacagtggttgagccctacaatgccaccctttcagtccatcagctggttgaaaacacagatgagacctattgtattgatgatgaagcactctatgacatctgcttcagaaccctaaagctgaccacacccacttacggtgacctgaaccatctagtgtccgccaccatgagtggggtaaccacttgcctgcgattccctggccagctaaatgctgacctgcggaaactggctgtaaatatggtgcccttccctcgcctgcacttcttcatgcctggctttgcccccttgaccagccggggaagccagcagtaccgtgccctgacagttcctgagctcacccagcagatgtttgatgccaagaacatgatggctgcctgtgatccaagacatgggcgctacttgactgtggctgccgtgttcaggggccgcatgtctatgaaggaggtggacgaacagatgcttaatgtccaaaacaagaacagcagctactttgttgagtggatccccaacaatgtgaagacagctgtctgtgacattccacctcggggcctgaaaatgtccaccaccttcattggcaacagcaccgctatccaggagctgttcaaacgcatctcagagcagttcacagccatgttcccacgcaagaccttcctacattggtacacgggtgagggcatggatgagatggagttcactgaggctgagagcaacatgaacgacctggtgtccgagtaccagcagtaccaggatgctacagctgaggaagagggagagtatgaggaggaggctgaggaggaggtggcttagagctgtcttagtcactaaagcatgggagcagtgtgtactctttattcatttacagcctgtctgctagccatgtccactgtgcacttgctgtcctgtgtcctgacatcacttgtacagataccaccattaaagcaattcatagtgaaaaaaaaagatataagtactatctatgaaaaaaccagaaattctgggaatcttttagtattttaaaaatgagtttgtgtcagcaagatggctcaatgaacacatgtaagatactgaaagggagaaccaatggcataaagttgtccactgagctccacatggtgttgttggtaagtgcatgtgtgtgcatgcataggattcacattcttaacaaattggggcttagagatatgtatctgagcactttattgattagaagggctggatcagttggttctggcataatttctctaagactccaagcttccaggactcacatcactctgtcttacatgtgcagttctgggaacagcagagcatgatgaggtaagccag

SEQ ID NO: 29781 - DNA, 1194 bp, Mus musculus
cagctccaagattggtactgagccccattggcccgagttaaaagtagacatctgtgtcctcacattgggtgcagatgccgcctggggcacccctgattattaaatgcctcaattaacagcagttaacacaggtgaatttgagccccctccccaaaagacgtttttttctcatcatcggccgagtgtccagacttttacaaggcctaatggtgactcctacagtggttaacaccgactaccatggggagataaaaatcttagtctccgccatgcagggaccacttacccttaaggctggagagcgcatagcccaagccttaccactcccactattcggccatttcccttatatgaaagaggagcgaggaccttcctccctgggatcctcagaagtctactgggcacagaaaataactgattcatggcccatgccaactttgtttctagaggacaaacagtttcaagggctcctggataccggggcagatgtgacagtaattttctcaacacattggcctgcagcctggcccttacagcccactaagggatggtgtaatccactgatcataaaatttactgctaagaggaggaacttagaggcttgagaaagttctcaccctctcacctggggcctaagattgtatcaagataactatgacaatggcctgacttttaaggttccgcttctaacaatcataaagcatccataggactaccaggtacccgcccccctgttcctgccccagggtgtgctacaaccctgtttcagcccactctccctgtggggaggtccccctcttccactgatttactgtggtctatattgaatgcttctgctttagccttgttgcataagacacaaagagataatgcgtcagaatctgaagattgttggatgtgcttttctgcttccccgcacttttatgagggcatagccttatttgaaaattttaccctgctttcagacactaggcagcttccccttgagtcagttcagcttaccttgacagaactctctggggtaagaagttgtgtgttgggcccaggcatgcttcgaggcccttgctagagatttgcaataacatgtttagagtaaataaaaatgggttttaaagagacttcgtaaaggtcaaaaaattcatagattaggttttattggaagttaagaaatcatttcctaaaactatataattc

SEQ ID NO: 29782 - DNA, 1527 bp, Mus musculus
ggacagatccacatgcttctcttctgggtaccttgaatctctgctgacttcatcctgcctgttgccctaggctttctgcagctactttacctgttgcccttttcatgctttgtcccccttttttgggggggaggggggtacctttaatccaggaaaagtgggatacctctgcctgcgttttttctttcagagtcaagtttgttcacttcactgtgtgagttttctattgccatagttccatcttaacctttgatctgtacagtgctttagagaagccctgctctgaaggcaagattactttttagtcttacttaaatgtaaaggaaagaaaggctgtttggtagcttgcaccatataaagagaaggggacagagtttggaactgatgggagtaaggagaagcaagacacctagctgcacagccaggggtggtgcagctggctgctgctactggctgccgtgtttggggcattctctaaagatctcagcagcagcaagttggcttgagcactgagacacctggactcctgttggcagcacattttctactttttatgttcctaattgtctcttttgtttgttttcttctatagctatcatctgcttccctctcctcccccaaaaggcagtcaaattgaatttttcattcttattccacgagctttatatgaccagctgacatttctgtggaagagggcttagttggggccttgaatacttagtttcctctggtgggagagttaagactactctggcttcagagacagggtcctttctctggccactggagagctggggactgggttccagatcctcctttatcgtattgtaaagaattgagctggcatttgtgagaaccagctgaggccacagcccatctggctgtgtgagagcagcatgctgtaaaagtggcttggccgttcgctgttggcacctgcttatagcatatgctctgcagggcagacactttcagctcaaagacgtttcctaccacacctgcagggacagaacaaagttgccccggacttggagagcagaaggtagtatttccatcccagttttattcatggttttgccagttctcaacatggagcacctaaagtcaggcagcagaaaatgaaaacttacaagacgattgttggttgtacctctgcccttcaaattcatggccttatgggacagtatcatttctgttggatttgatggctgcatttagaaccttcctacttgcaaagttccgtgttcagtatctgtgcggcacttttcctcttgatcagtggcatcccctattcggggccttctttggttcaaatgagaattaggaatacagagtggtaatgttagttttcatttccttctgacatgctggtttgattgtgcaccatggaaagtcgctaagacatgggtctcagggtataaatctcaggaagtgaataagcaagcggcacagagatttgagagatcctgggtcacttagtcccagcctaggagcacagtggacatccacataaaccatgtagcagagctc

SEQ ID NO: 29783 - DNA, 2536 bp, Mus musculus
acagaaatatgtagaatatcaataaaattaactcccatgacccaagtttagcaggttttcctgagggacagaagtggattcagaacggagcattctgaaacacatcctcattgcaaacagtaacgccatatgcatgacgcttctgtttattgttttccatatataaggaaacaacatctcataatagaaactagcatgcagaggctaaggcatataggattcttctgcaggactgtaaggctttgagaggccaatatcccatacgctatctttaaacatgtatttttattttattttttacttttcatatttatattagcatccaaggacaactgtacatatgtaaacatttttaaaatttaaaaagtaactgttccacataagtgtatttttgccaaatgcctacagtcagtcacagttctgtcaccgtcctccatcctgcgtcttcagcgtacaagtggacgagattgtaaatagagtggtcagtgctgtaaacgtatctctccataactggtgtttgtctgaaacatgtgatttccgtttaaagtgtgtccagtctggaagaggttttattgagtaagagaacaaaatgctcaaacgtctagcctctgcttctcaccgaaggaggagtccagatgtgcggcagccgtggagcttcagggtaccctggagctcacaggctctctgggagtctgccagcctatccactccacagctaagacacatgacgcctgtcacagtagctgttctcagtaccagggcatatcaattaatcttaaccgggggccatggagtcccctcctctctagaaagtgtcttctatgattggccagatgcactaaagacatggaccccagagcgcagagctccctcttgaccaatgcctgagccttgtctgatctgaagtttgggttcctggacagaatcctttcagccattctcatctgtggaagaaataatgactcggttcaactcggttcaatttgaacacgtttcatcaccaggatgtgagtcccagtaggtcattctgtctggctttgaaccagatggtggatggaagcctgagcaagacatgaaagattaaataaagcccatggctacacaggtgcagtaactgcaagaggaaccataagcctgcaagggaaagagccttgggtgttgagccaacctttgatccacttttttttttttttaaagaatgttctatgtgaaatcttgtcatttaaaaagaaacattaatagctgtttcaatgcaatgttgtcatgcaaagagaaagcccctctagtgagatctgaagttggtaggctcaatcatgtggtccactgtgaaccacacttgtgatttcccccttctccttgctgttttatgtgaggaatgcagtcatcagacaagaactcagaaatggactctaagtttgacttctttgagaggcatccagggacacagtttgttgcatctctgtgtagttgtcttagatacccaaattgaagaggcagactagaaggcaaaggtatgctcagctcatgtcttttgcaatggtccactcttctaaaacgctctgaaggtgttagaaaacaaatttaatcaggcaaaattatacagtgaaaaacatttttcctgacaggcaaggatatagtttgctgatgactcaataaagcagtctcagacaaaggcatagatgagtgttgaacaatatctccacatagcttaaggtatggcagacaggtgacagatgaaagagatgtagcaaacgaagtgacttttgaacaagaacactttagatgtgcactgaatgtttcttggtattgagtatataaaggctaatgtaatataaggtttattttgactacggaagagagagtttatagtttgactgagaggtgcctcctgtaaatatgctttgtagttatagttagttacctaagccctaacgtgaaagaattcacaaaaggttagctagtaaactcattatctgtctacctactgatctttccttaccttctcaattatttttacctggggttattattgagaattaaaatcattatcgcgtgccttttgggagaatcagttgctctggcttgtaatcatcttcagatgaaatgagaggaaaaggttttgcttaacttgcaaagtgattttagaaatataatagctttaatgttctagtctgggtctctatctctcatgtttaagcattcttagaattgtttttggaattaacagactttagtcttgatggataacttcaagaagtatgtatcattccactgaactctgtatgacttcattcactgaggtacacagaagagactcgtggaatcaaacccaagcacagtgattatttcattcttaaatgtctattttgaagaggaactttgcagctccatgtggtttgaatcatgcaactagtattcatacttcccagtgtgctgtgggatcattgctacaaagaggagggcagcgatgtgtttgttcattggatgctatttctcgttctcataatcttggcatcgatagggcttcagataccca

SEQ ID NO: 29784 - DNA, 1187 bp, Mus musculus
gtataaatcaaatccaattctgatacttatttgagatacatttaaaatcttgaagcctacttagtgaaaccaactggacttgcacatagtttccaagggaaaataatgagactagttctgttctggccttactgtaataattttgtaaaaattctaaatattataattatctcatagaagaattagatcataagtttctattgcttcctatacttaaagatacttctgggtgtggtgatatatgcctttgacaccagcatatgggagagggaggccagagcaaccaaagttagagccagttttgtttatagtaagaattcgatgctcatctgggctacttaacatcctatccccgtgaaacaaaagaacaagaatgtaaacgtcctttggctattgtttttgttttgtttgtttgtttgttttgtttttatatcaaataataagcagaagtccagagaagcgatattgtctccttttagttttaaactcagatgagagtgaattaacggagtcctgttttctctctgcacacaatgtgtttgtagtggcgcgcatgttaaacttgaagaagatgtggatcttggctatgtggaagatgggacgccctgtggccctcagatgatgtgcttggaacacaggtgtcttcctgtggcttccttcaacttcagtacttgctccagcagtaaagcaggcaccgtgtgctcaggaaatggagtaagtgtcagagcctcacccgggaaaaccatttcttcatgttacaaaagtagatacaatcctgaaatgtttcctaaatcatagaccatgtgattatccatgtttctggttgagatgtgaacactaacttgatcaaagctacttgagtatttttgttgtataatcaagaaaatctgagaatacgaaaactagtaattttcctattcaaattcgtttttcttcttttcttatgctaataggatgccttacagtataatgataggtttcctgcgtgtgatttagaagaattttagcaacctacaggggaatttttttttaaatggggagtgaagaaggaacagtgagccattgtttctttatttaaatatatagttaaatgtagcatttaactacttaggtcatctggatacacatgaatcagcaatggccacaaataaatacttgttgaagccataccagagatgacagctgag

SEQ ID NO: 29785 - DNA, 1146 bp, Mus musculus
ggagactggctttcatgcaactcctgagtagagcaatttgacagttagatcctgtctcatttatttttctttttaacccacaaacctttttatgggctgttttagatttccttcctttccagctagtcttagggatggcccctaggattgggttaggaccacatttgtaccacgtgggggtggggtgggggctgttaatgcgaagctgtctcatttgctctctaactgagccctctgatcttgtttttgcccaaacctgcccagcttacagtgggttgttactttatctgcctcgttttatgaattcagagatcttaaaaaaatggcaaatatgaatgttggtgtccaattggccatgtgtttcatttcacatgcatgatgataaatcactgtaataggcccccagatcctagctcaactgatggaaatatcatttagcctgtaaaaactaagcaagtaaacagtactagtagctgaaaagacctaatctatcaaaatcagagttctgggaaagtctcaatgtactaaccttgcttttttggtttctgtagttaactgaaacatgtcaaccaggatacagggtttgtgcttaaaagctcaccctgagaaagacttggatcctgcacacccacccaatgtagttgtcagctggctgatactgggttaaatctgtgtctgcgtagtactcttcggtggatgccccacaataattgcagaaaataactttatctctcagaaagtatgtaactacattgaagatggtttgatcttattctaaatctcccagggactcagttatgactttactactggaacttgccataacttttaaaattttttttaaatatttaaaatcttttaaagcttgtatgtatactttctgtaatatctgtatatacatatatgtcattatatatgcatataatatataatgaatattgatgttgtaatatatattgaacagttttttctccctctacttccctcagtccctccctcctgctacacataactctcctgtctcccagatcccttcctcttcccctaagaggagcaagccacccaggaacagcaaacaagcttataaaacatacatacatacatacatgtgtgtatacatacatacatgttacagccataacaagc

SEQ ID NO: 29786 - DNA, 1409 bp, Mus musculus
atttccagaaggacgtgggcgaaagcagtgggcacctgctcaagccgaactctcagtatgaagaaacccagaaacctgaagaaaagcatgggtttgcttcagagcccacaacctattcttcagctggattgaaaggatgtgacaggaaaccagtgagcatgttcaatgcaagtgagcctgacccagagcaggagtatgcacagctacctctgcgtgacagcacaccggaacaccaagtgaccgagggtagaaatgacggagaacagagagtagaccctgctccaggcgtgtcgcagtcatgtggacaagtttctcatctcagtacagaaagtaatctaccccaaccacagttagctgcagacattacacagctttcagcaaaagatctgcaagaaaagggctttcatgttgtgataggtcatgcttctgacctggtggcattaaatacatcaaaagagcagctaacaatgaaggcgagaactccaccctgtagtccccaggagcctcatgagtgtgacactgagaacatggagaatttgccttgtggtaaaatccagcggaaagtgagaatgctattagggcaacagaaagcaaatgctgaaccgagtgctgaattggataaaaagagaactgagtatcttcctgcacatgaagacagaacttgtgggtcaccagtacagtctctattggacctttttcagacaagcgaggagaaatcagaatttttgggttttacaggctacactgaaaacagtggaatatgtgatgttttagatatttgggaggaagaaaattcaagtaccctgttgtcaacgtttttttcttccccttcaacttctgcattcgttggattttagtattaaatgtgcttttcagaagtgacagctatattcctgaagtttttataaatacatatataattagtggtgggggtttgttttgttttcgccaacttttttatggagccatctgtaaatattaattaaggtggtgtttgtaattttttacaggattgactagctgttacaaattatacaataaaaacttaatgacttattttatattcctgagaataaaaatgaatatcatttgctttatcactgaaaataatttcaagtgagatttgaaacctatcaaaaatgtatgcactatatattacacactattaactgttacctattagcatagatttcttttttttttctttttttttttctttttggggttttgtttttgtttttgtttttccgagacagggtttctctgtagccctggctgtcctggaactcactttgtagaccaggggacctcaaactcaaaaattcacctgcttctgcctcccgagtgctgggattaaaggcgtgcgccaccactcccgactttagcataaatttctatgaccaacatgt

SEQ ID NO: 29787 - DNA, 1200 bp, Mus musculus
gctttgctgctgggactccagcaagtcacttccactttcatctccagtgtatgtaggtaagtgcaggagagtgtgtggactgcattaattaggataaagtacttaagaatagtatataacacatggtattattaatgaaactcccattatatttcctcagaactatgggctcaaaaatgcagcatgaaaagcaccaatttgtaaaacattagattatagccgggcatggtggcacacacctttaatcccagcacttgggagactgaggcaggtggatttctgagttttgaggccagcctggtctacaaagtgagttccaggacagccagggctacagagaaacccagtcttgaaaaaccaaaaaacaaacaaaacaaatctcacaagacattagagtatatgaaattggaatttgttcacagtgtctttaaagagctttggaaaagtttatatataaattctttgttttttttctagcgagttgaagaatttctcagcaaagatatcagttattttgtttcaaataaaaaggaagcaaagtatgcacagacattgggtcgcgtttctcctgtaccaagtccagaatctgcatatactgcagaaaccacctctcctcatcccagccatgatggaagttcctttaagtctcaagacagagtaagtgtgtcctatatgctttgagcctaggggaaagtggatatcatagttttctttttgttttaagacaaatccctttcagactggtttgaactccctcagaattcttattctttctgccttagtgtctcccaggtcctggagttacagatgtttgtctgacacctgactctgggcttccagtagcagggttacagtgcatcgatagagtggttataaagccaaagatctgtggctttctcacctaatgtttctgtctttttgaaaggtgattaagttttcctcaataatacagtagtcaagttgtaccctgatttcctaaagcatgcacttgcactttagacaggtagcttttgtttcttagaataatttacaactaaagttaatagccagccattcttttgaagaaaaaaaaaaaaacttgtaaaactttcaaagtagataaactgaccatctatagcatactgactgtgcacaacatataagttaggcatatttttacatatccagaagttggtgggaaaaacaaaataatattttgtg

SEQ ID NO: 29788 - DNA, 1153 bp, Mus musculus
gtgtgaaccaaagtataatcatttacatgatgcaaatgtacaagcaggaatgggctgctggtaactagcttgccttccaagtgtcattgtttgtagaggtctttaggtcagttctacaactttttctactacaatcaatattccctagtctaaaaggccaaattataaaatgctccaaaaatttcaactctatttgatgtcccaaaatgatgttgttataatcccacaccttcactcaggtgacagcatacagaacgcaggcacatagaaacatttaaattgcctttaggctatttgtattaattgtatatgatacacatgaatatatttatcactttaagtaggaatgaggtttttaaaaatgacctttgtttattttttgtatatgtctacatatacatgaaggtgagaggaaaccttgaagagttagttctcccattccaccttgtggactttgggatttgaactcaggtggtcaggcttagcagcacgtgccctttcccacactgagctcaggaatgagattttaagtatgatgagaatgcaggggtagaaaacggtggctttggaatgtgtaactcggagtctgatctctggcacagatgataaataatttaaaagtaagtaagatgccaatgcaagaaatgctatttattattatttacttatctctataaagcaaaaagcactttatcacgttttatgtgtattctatgaaatatgacgtataccctccctgcctaatgtatttcggtgacaatgatctctagggttggtaggtgaacaaatgcattttgtatcatagtggaaagtgtttgtatgtttcatcagaaataaatgatacatggtttattgtaccatgttgttttacattacaatcctgtgttggtttacattaaaatattaatatatacagatgtgtatttgtgatttgtagtagtaaaaattttaaaatcctgacccaggccttcttttctgtcttagacagtttatgttgtcagatgaaatacaatgaaagatgcacataatctttattcttttaatatgccttaggcatataacagctgcacagtagctgggcagctgcctaccctccatgctgttagaatctactttcctattgataaccctgagttatcacatactgtttact

SEQ ID NO: 29789 - DNA, 1914 bp, Mus musculus
cagtggctcgttaagctttccttttaccagttggtaccaacttttagcatttcataaagtttgtagaattgtgcctttttaggcggttgctgacttaatttgtcaggtatggaggaaaagcatcttttcccaggtatgcctaagacattggaaacatttcaaacttcagaactaatgttggcaaggggttactaacctcagaagtttccagtttaatgaatgacttgataatgatttttaaagagctgcagagtaaccaggatgtctgactgtggatatacattggagctacaatgctattttccctgtgtgcaacaatgacttacatactgggtgtttcatagccattaccactatgccatgatttctcatttttcaaattgatcttagtgtttaaaaaaaaacaaaactatacttctgtaggaaaacaggttttttaaaaagagctgtgtttcaatttttttttttacaatttttaaaacagctacatgtgtccctaaaaattccaccctattgaaaataaacacgtatgaagtgtgtattctatagtgagtcctaggaggaaaacaagtgtgccaaagacatttcctatactgtttcatgaaggggccacagtgctcactcttgtctgttgatttttatatttaaacttagcagctgtgacaagtaggaagtgcatccctcctaaagcttcctggggagtgctgaactcacaggttcactccttctatccaaagtgtaggggtgggaggttctgggaagtgcttggagcgcagtctcatggtgtggaatcaatcaatagtaacatgaccagtgtcacatgtgaggcagtgcagacactaatctctggggcaaaggaggcctgcaagctcatgacagacattgcatcgggtgactcagaacaaactgagcaatttcttcctgaggctgatgcattaaaacagagcacctccatcttctctgatctgtgtgcaccatattaagtgtacagtggccaaagccacgtttaagtagtgtcaggaatagcaaataaagacagcaggcctgcagcaggctgcatgaggacttagatggtcatgagaacattgggaatttaggctggccgtgggcgcacctctactttcctaagaaagtcaaagtgtttactgctttatcaccacggcctgctctcacctgtcatttatgatttttcagatataaaaccttggtaagatcttttcatacatttttataaagtagaagggaatacaagattccccagttggtacactttttcagatctgtccgatagaagcactagtttgtgacatatccctgctgcgaactgcggactgagacatgacacctgaggatcatggctttccctccattattggagctcttgatataaagttcatctgctactgtggaacccaagtttctgcagttggtttcgagctacaggcagtttgtaacgcttgcatgagtgaacagtgtctcagtctttaattttcagtggtactgtttatttttcagaactccacaaagaatgctggctatgtctatctttccatctgtattttgttgcctcgatgtactatatttgttgcatgtatattaaagatttttttaaccatacagtactggtctttttccttgacaaatatagttacctggttcaagtgtttactgaacttccatttcagcacatagaataaatattgaggactaattaaatccaacacactaatggatatgattggagaaaacccttctgttgagattgaatattatacatacttttaaaatattccttatatagcacatgacattttgagagttactgactacatataggacaatggtcccaagtaactgagagaagttgaaaaattcctatcccttagtgacatcacaactctctaatataaaact

SEQ ID NO: 29790 - DNA, 1205 bp, Mus musculus
gactagattaactgctggtttcgagttaggaatcattgcaaaggagtgagagcaatgtgtcatgaatccttcagaattttatccaaagcctctgcttactgtaaaccatattccaaaacttctgaatctgcatttttccaagaaaataagtgtttcaaataggcccaggtatattgacacctatcttccttaaattgtaagcagtttcatggctagatgaccaccatcctcaatttaatataattgtctgatccttacattctgatttgctttggtgcatgggtttttggtgttgaaagattatggaaatacaaacttgcactttgggttattattctacacttgtaaatcatgggaaatctttgttttagaaaccaaaagctttgtataaaggcatctttccttttacttcataggtgagaagctttttgtgaaaattagttattattcttaaatatatacttaaacatattttagactataaaccatgtctcttctttttcaggctacagggtctaggcttgctgtgattttccagaacatagcaaatcttgggacaggaatcatcatatccctaatctatggctggcaactaacacttttactcttagcaattgtacccatcattgcgatagcaggagtggttgaaatgaaaatgttgtctggacaagcactgaaagataagaaggaactagaaggttctggaaaggtgagttgaactaaatatgactggtcactaagtaaaaggacagtctttccagttatgctttcttactctcttttactatgtcctggcaatgctggtgtgtgtgtttgtgtgtgtgtgttccttcgggtgtacacgtatgtatgtgcaagtgcacatgcatgctgtgtggaggtcagaatacaccctgggcgatatttctcaggtatagtccagtatgcctcttgagatatggctgttctctgtttgagatatgacctctccacccatccctgtaccttcagaactaggattacaggcacatgccaccaagcgtagctgagatgtttttccctgaatactagaggtcaaacttgggtccttgtgcttgcaaggcaaatcctttaccaacagagtcatctcctcaatctacaggaattttgtttggttttgtttatttgtttgtttgttttttgttttttgagacaaatatggccttgactgtcctgaaactgactct

SEQ ID NO: 29791 - DNA, 1175 bp, Mus musculus
agccaatttcatgattgcttcctctccccaccaagcgtcatttcagagtagttattgtaacccggtgatctaaaatatttttctgcccaggagccaagcattgacagcttctcaacaaagggctacaaaccagacagtataatgggaaacttagagtttaaaaatgttcacttcaactacccatcgagaagcgaagttcaggtatggtgctactatggttcagtaatctgctgggtagagatactcttttacatatgataaaagaaaggaaaacaatatacataaatcatatattcacctttcagctcatagaactcatgtgcatccatctgtcctggaaaccggcctaacattgacttctcacgtgtcttggtagatcttgaagggcctcaatctgaaggtgaagagcggacagacggtggccctggttggcaacagtggctgtggaaaaagcacaactgtccagctgatgcagaggctctacgaccccctggagggcgtggtgagtgagcatgtagccagcaccagttaatgctgctcaccattctgcgtctgtgattccaaagtgtgaacaccacatgctttgttccaggtcagtatcgacggacaagacatcagaaccatcaatgtgaggtatctgagggagatcattggtgtggtgagtcaggaacctgtgctgtttgccaccacgatcgccgagaacattcgctatggccgagaagatgtcaccatggatgagattgagaaagctgtcaaggaagccaatgcctatgacttcatcatgaaactgccccacgtgagttgtgcctgagctctgtcatgccaggctcagagagtagagctctgattaatgcggttcatgggaacccaggaaccttctctgaggtagaacaagtgccttagctgggaaatccatttaccttggattttacagcccacaccccatcaaatagtggtagatatgtttatttatttgctatatcttcctattttttgtttgtttgttctaattatagcaatttgacaccctggttggtgagagaggggcgcagctgagtgggggacagaaacagagaatcgccattgcccgggccctggtccgcaatcccaagatccttttgttggacgaggccacctcagccctggatacagaaagtgaagctgtggtgcaggcc

SEQ ID NO: 29792 - DNA, 1129 bp, Mus musculus
ttaaaaagaacaggtacagttgcatatccctataacctcagcattgggagacagagatgtgtggaccctaggagttcatgagcaagcttgtggttcgggagcagcaaacaatagaaaaagacacgcagatctgttctagcctccacatgggtgaatacgccaacctcctcatgtacacggaccacataaacacacatgtatgtatatacagcaatacaaacagcctgaaaaaaagaaattggaacagagagaaaagctagctaaatgctgaatattgatctactttcatatttacgtagaagtcagggaagtcctggtcttagaaacacaataaacttagaagtcaaccactttagtaactgggaagataattagtatatttggatgaaagtaaatagccccaattcataaacatgcattttatggttaattttaaaatatgtctctaatttgttgtatttttcaggcgatgggcgccaggcttgctgtagttacccagaatgtagcaaacctcgggacaggagtcatcctctccttagtctatggctggcagctgacacttctacttgtagtaattataccgctcattgtattgggcggaattattgaaatgaagctgttgtctggccaagccttgaaggacaagaaacagcttgagatctctgggaaggtgagtcaaactaaacgcagtgcttacctggcacaaaacaaaacaaaacaaaacaaaacaaaacaaaacaaaacaaaacaaaaacgacccttggtggtgatatttagcaattccctgtctgctctggggagggccttcaaacaattctttgagaagaaacgttagctccctgcagagcatagctgaggggaagtgggcaatgcatctgtgtctcagagactgactgacagctgcttttgacagcttttctggtttcagtcattgtctccactttctcctgggtccccatccaacctgctccttctttctctccttctgtcttttctctccccctttccttctctcccccatcttctctgttgttctttctctaaaccattcctttctcaggaatgtagacctgctttgttatgaatgacgcgggacactcattatgggaccgtccacctagtgttattc

SEQ ID NO: 29793 - DNA, 1188 bp, Mus musculus
gaattaaaagttgttggctgctttagaaattggggctaagcacggaggagtcggttcagctcccactaagctccgagcagtctagtcagtccttaaagactccgtcagacatggccaccattgagcaataattcctgttgtgaggacttttatttcctaatctgtacggcaacctaggaatccacacaactggaaaagtacatcttaaaagttaagtgacttatccaaacttagcagtcagtacatggcagaagaggtttgtgagtcaggtctgtcatgcccctgcctcagcatttgtccagtctgctgttgtgaagcttcagtgcacgtcattgtgtactgatgagagttgtttttctccccttaaacatgtagactgtgtttgtgctctatttttactttagtttccataaatggtgcttcagtgaacacaatctatttcaggtacatttttatctgtgaagagaatctggtaggatgaatgtacaaaaatattcataacctgaagatgcttcagactgtgaatatggtaaaataacaggaaattaacaaatgtctgaattaagttgatcaaaaagaagagggaattttgtattcaggttcatgtgtggcgatggaaaatgtgtcaaattgtcaggaggcagggtctctctacatagccctggctattgtcaaactatgtagaccaggctggcctctaactctgcctcctgtgtactgggattaaaggaatgtgccaccatgctggccacctgcagttgtgagactcctctccataaattgtctctgtttatagttctgttcagtgttcactgttaccttgggcgttgtaccagtgggcagagttcacagttcactagagtcggccagtgaggcaagaagtctcactttccacccttgtcccgctggttgtttctggtgaccatataaggggaagatcccagttaggcagagccatacagctcagaagaaacaacgccaccgacagggtgtgagttttcttacttcattaagcaaaaggaaacctcccatgcttcatttcttctcagggtcttttcctctcagggccatttacctagccatttctagagcttggatgacctgaagttttcctctgtgacgggaagaaaagccaagtcatttttgaaaatctatctctaacgtatagcatgaaaatccttaagtttg

SEQ ID NO: 29794 - DNA, 1148 bp, Mus musculus
atgtacctatcagacctttagcttattttatggaccagaatgagacctgagtgtgtatgaaaaactgcacttttatattcaatgtcatgtaacaaaggctgcctagagccagaagtgtgcctcatttgatgatccaggtttcatactttgatgagcgagaatctgccacatatctcagaagtgtcctctgtcttcaagagacacctaaagttatgtatagtaacatgtcttttccttagctaaggactagccatatactgtggctgtaccttcccttttgaggagtaacagtaaaatgagtatgaaccctcccttttgcagaacttcacagagatgtgtttgtacagtagatgttattaaaccccagcaactccctcctccgcaacgtgagtccaaaggcagcgctcagtggcttatcgtaattgacactcactctgttatgcacaagattcactgaacacaaatgctcttgagatcggacagctgagttggctacaccaacgagcatgggtactgtgtaatgtcagtgctgtgaaaaggatgattcagatcttaggtgggctggagctagacatgattttattatgctactcagaataatgtagtttaaaacacatacactgtttattttgggaatttctcttttggatttctgacccacaggtaacttgaagccatggacagcaaagcctcattgaagagacaggagtttaaatcagaaattatttcataggcaatttcacccataaattctcttacctcttcctactttttaagtgttctggaaactcttttagagtttcaccttcatctttttattgttactgtttcacacaaaatctgttttgggaataaggacaacattagttgctgtggaaatagaagactggacatgatgcttgtgagcattctaaactctatagcaacagagtgtttcccaagagtggatgatagctgcttggctcctggatggtcctgtctatatcctgttaaggcctttactacctgagtttgagtcaatgtgtaccttctaacagtgtgctggacaattaaatgactggccagacaagaccggggcctttgtaagttacaagtgtagtctgaagcagaatcagaattataaattgttgagactatcagtttatttt

SEQ ID NO: 29795 - DNA, 1142 bp, Mus musculus
tttctcatctcgtgtgttctacagccctgagtgaccaaggttgagatagttaaactatgtatttacttacgtaagccctcttaacagacctaatctgagtgccttcccttctagtaactcaaatatactaaaaatgtatccagatatatattctcatctaacttgattagtatactactttgacattagaacccagtaaataacaaaaccaggagtacatagggaaacgcttattagcgctacttgaatcataggggattaaactgaagactatctcaggacagtaatctctaatgctatccatatgaaagaagcattagttgtattttacactgtaacagctggtcatacttaaatttgtatttgattcttcttttagatctactggtatcgacaaggagacttagaaccgaaatttagaaatctaatttactatatcttattttctatcatcatgttatgtatatgtgcaaacttgtacttccatgatgtgggaaggtgaggctgcagagacgaaatacttaccaggactcttggaaatctatgtgaatttaactgctgcaaaaaagtatgctgaagactcatcgacagacgtgtggtacatgatgtttccatgttaactgtaaatctcaatcccccctgcgagggggctgcagcatagatctctgctctcctttaaaacgcccacacattccagccctcaaatagcaaggaattctcacttttgaaagaattttttttttttgtttttgttttttttttttttaacaatttaattgcatggctcaaaatcttgcattttaagacaaatactcttttatttctgttaaactgaatatacaattattgttcccctaggcaaccaacttttgcttattactacagttttacattaataaacagatggtgaaaagacagctttgattgtgaagatctaattacaataataaataaaataatttatacaagtttcctttttttttcctcctttttttggacttttctataaggatcatatcattaaagccctacaggctagttttggctttaccttaggaatgactcttgatttgttttcttttgatacagaagcaaattttgttttttaaaagtgcctgagggagaagctatagtgtaccccc

SEQ ID NO: 29796 - DNA, 1184 bp, Mus musculus
gcaccaagttcatcagacaattgatgatgaaacaatacttatcgttccttcacctcatggctttatccaggcatctgatgttatagatactgaatctgtcttgcctttgacaacactaacaggtactctactgagacttaatcatgagcctgatacatagtaaggggatggggggaatcgggctgttgttttatgcatccatgctaacttttctcttgatctatcagtgttcttttattgggtaaatcctacactttggtaaactattggactgaatggagaatcagaaacacacatttaatactaactttatttaaacttgactcattacagatccaatattccagcatcatcaggaagcatcaaatataattggatcatctttgggcagtcctgtttctgaagactcaaaggatgttgaggacttagtaaactgtcactagattattagaaacaggtacttcaagaagccacattgtgactacattgtctccaaagaaaggagccatcccaggagttgtggtttgccattcctctggcttgtacttagctgccatgcttaagccatgcacattgttgctgctgttacttttacctccttctcagtagatcatctgaggtccaattttataacagttgttatgatggaggataggaagtgtgaattgcccagacttgttaggttttatgtcaagagggagttgcagtcactgcagctacttatatcaccagagcttaactactctggtttaaatataagtagtaatactcatctctgcagttagacacagctctgtccagactcaagctgggctggttgtaattcagcttatgttagcagtgactttcagaaagattaacttaggagttgatgacatgaccatgaccagcatccagataccacattatggggggtggttgtgctggttaacccattgctggcagtgggagctgactgaggcagggtaaagaagcaaagcattacagagttaagaaaattcactacaggtctttgatttttaacttttaaagggaacgtggttaaagtggtaacaaaacagttatcaactctcatcagaaaccagtcattagtttacagctagcactttgaagtgaaattaaatgaggggagaggtcatattgcctgtgtctgataaccatgactttttttatgacatgtttta

SEQ ID NO: 29797 - DNA, 1177 bp, Mus musculus
tcctggtgcacatttgttgttcagtgtctggagcatctctgtttaggccttttgtgtgtgtgtgtgtgtgtgtgtgtgtgtgtgtgtgtgtgtgtgtgtgtcatagttgttgttcatttctagtatttgtgtccctttttttgccaggaatgtaacatttcaaaatttattcttaattcacccttttaaagaacaagtttctaaacttatctttccatttatttgattggttattttgcttttttgattttcttgtacctgtttcaagtatacttttaaatttttaatgatttctaaatgagttaaacagaaattgagttgtttgagttggatagtttatttttgtgcccttaagtatcataagaataattaatgcagcattaagtttatatctgacttattagcattagagtctctcaatgtcattgttgacctttaacattaaactaatttaaagcatgctatatccatatacattgtatcagccatccctaaatcaaagaaatgtaacccatttaggctcgcggaataaaagatgctacagaaatcatctttgagatgtcaaaagacgaaagaaaagatttctacaggactatagcgtgggggctgaaccggcctttgtttgcagtttatagaagagtgctgcgcatgtatgatgacaggaaccatgtgggaaagtatgagaacctgtactgtgcatgttttcatgtaacagggggagtggttaaggaactatcaatttttaaagttaatttctgaattggaggcagctatgaatcattactgataattttgtgattttgtaagtatttgatatgtggagaaacctgataataaggacttctttaagagttagaatctgaactaccttacttaggttaacttgattgaattgactgtcagagtttgctttgtaggttaaacattggtgtggttaaaaatctaggaagtgttaataagagaattccaaattcattctttatttcctgatttgggaatataatagtaataataggatagtgacgtcgtttgactttaaatgaaaccagagtagaaagtaaattagctagtaacaggttgtgtggaaaggcggccagccttcctggagagttgtcagggatgctccatacaggtactccatgggtggccgtggccttggctgttcttgcctctgaga

SEQ ID NO: 29798 - DNA, 1200 bp, Mus musculus
taaagccctgaagccatttttggccactctccaactgtctgcctttgcctctatgtcttttctcattttcctttaacattctttaatttcaccctgatctcccaggtctccagacaccttgtgctaaacctagtattctttttttctttcctcctctctttgtgtttgtcttttatgtccatcttttagtttgacttgtgcacatcaaaccagcctctaagtatggaatgccccaagactaagactccgctcttagagtgcctcctctgttcttacttgctacctaggggatcttaatttgtgttttttctttttggtgatgatggtcctacttatttcagccagacttggtatagtagatagagccttttccctcaatttttgatgtttaatagttatcttagtcatgtatttaaaagtgacttactgaaaattcacgaatgcttaatagtagtctattcttattgtgtaaatttaaaaagggggcagggcacctgtcatccttgtctttccagttttgtatacatctcatctgtcttggaagcatattggctctattactgacatgcgttcacaatttgaactgtttatgcttccccctagtcgaaacccctggcctctctgctcattctagcccttctgcccttccgattgctttcctgacagcagccagcatgatcctgttaacgaacgatgcgtatgtcaattatctgctcagagtcatccagggctttcttgtcccgtctttgttatggcctatgaggtctcactcagtctccttctgctcttacttcatctgctatgacaacagtgaattggttacacttgtacgcatgccctatcacagagcctttgtgcttatctttcctgaaaatgccttactgcgagactagcttccttccttaccccaagtcgtatcaccctagttcatacctaaaatttgagacacactgcttcactctatccgttccttttcctgccttattttgtccttggcttatatgagtgtcacccaacataatgtcttgtccatttgtagactgtaagccccatgaaaggagtttcctacctggtattcatgtgtattgaacaattaacgtgcattataatgattggtaaaagtggcttaggaaactagatgatcgctctatggacgtttgttagggtaattaattagagctacggttatggatgtttgtt

SEQ ID NO: 29799 - DNA, 1186 bp, Mus musculus
ccgcgcgccacccccgacgtcacttccgtctgcgtcggcaagctgatgggttgctgcggaatcgagcgccattctcagcgagcgatagggtcggacggtcgccgtcgagctgtggcgggtgatagacgtaaaggagggtctttcccttggcaggcgtctgcaccatctgtcttttagtttccgcaatctccgaagcgaagagggagcggtgtgtctctataattcttgtgaaaggtgacctccgtgagtgtgacctcgcttttaggagactacagttctttatgcatttaaagttcagtgctggtagctatgccgagtgcagctctattttctggattcttagagatgaacaaaatagaagccctgttcccatgccaatctttaagaatcaggttcatacatgaatagatgcattttgaccatatttactccttcctatccactccaactcctccccgtgttttccctgacatgcccccgactcaaattcatgtcctattgtaggggtgtatttctgggtacacacatgtagcccagatgtacttcagtgtagggctgcgccccgcttggacgtgggaaaacaatctgatctcttcaggaaggaagttgactcttcctcagcagtcttgactgcttgtagctccctagccagagatggaaccttgttcgccatccatgctggaatgtggagtggagtggtggtatgcatgggaccacagctgctgagtggtgggtgttaaaacagaagtcttcccattcccctgactctttcaagttttctgccccccatcttcagcaacgctcctatacctttggtgtaaggattgcattataaaaacccacttagggataggcattctacagtcacttaactgcacactggtcagatgtggttttctgccataaacactgctacaaaaagtgcagactctatgatgagaacatcaaaaaagttgccttttgccccatgctgggcacaattgttcgaacctattaatttcagcagagaagaggttgaggcagaaagaagactggattttgaggcagtgttggctacatagaacacatctcaaccaaaccaaaccaacccaaaagttctaagatacacaattctgagcattggggttcctattggtgttgcttttatgattcagcagatacacgttatactttgctttcctttcac

SEQ ID NO: 29800 - DNA, 1231 bp, Mus musculus
tagaccaggctggcctcgaactcagaaatccgcctacctctgccttccaagtgctgggattaaaggcgtgcacctccacgcccggctgaggagcaagcgtcttgttcctggacttttctgcggtggtctagtgatatgcccagcagggactatggcagagtccaacccttttcagccagagctacacagcgaaggttagtagccttcaatacattgagcattgttgtattaccaagtgttgggcaacaaaaggtctttccagcagcaaagtactgaaggaaaaagaaattggcttaacttcatctccattgttccgggaacaacaaatggaagcttgactttgccaagacttgaattccttcgggaatgacactaataaaagaccaagacctccggattgaattggatgtgaggtgctctgtaggctgcactttttttttttttttccttttttggctttgtagttttcctttctcagttaacatctcacactctaacattccacgttccccagcagtgcggggccaactcaagtttacagtcccgactgaaagtcaccctgcttctagcttatctgaaccctgcgcctcactcctatttattaagcatcacactaccagggagatgaactttgagcaaactgtgcaattgataaaatatactctgttctttacgttcttgctattgtatcatacataatagtatcactttttctacatcttggtcaaataaatttttgcatattaaaaaaaaagaaacaaaaagaactaaatctacaagccttgctagattttctgactcaagagttttagcctctgatcatacccttttgcacaatcacacatttgaatatggcctccataaacccagggtagggttctgaatcgcttctggatatcttaagatatatacactttcggaatgtgacacatctaaagatggcatggaagctctataccctgtcctccatacgtctccctccgtatcttgtatgtcagtagagtgcaagcttacctaagattctgtggataagaataagctggaagtctgaaatttaagtgtgactactactttggcttagtgaagatatttataaatatatatatatatatatatatatatatattaagagcagtcagtaatcttaaccactaagccatctctccagctcctggctatgttttgttttcatcatgaggtgacacttgccaaagtatatttttgaaataga

SEQ ID NO: 29801 - DNA, 1154 bp, Mus musculus
tgacatacctcaaaaggaatatggtgaattttataagtccctcaccaatgactgggatactacttggcagtcacacacttctctgtaggtcagatagaatttggaccattgctctttattccttggcaagcttcctttgaccttttgagaacaaccagaagaacaacatcaaactgtttatcagttgtgtgttcatcatggacagctgtgatgagctgataactgagtccctcaactttatctatgacatggtttgctttgaggacctgtccctgtaaatttcctgagttgtgcagcaacagaacaagatcctgaaagtcatctgtgaaaagacggtgaggaagctccttgagctcctgagttgtctgaagagaaagagaactacaagaaactttatgaggtattctccaagaatttaaatcttgaaatcccccaaaattccagcaaccattcctgcctgtctgagctacttcactaacatactgctcagtcttgaggtgagatgatgtccctgtcaaaatatgtgtctcacatgaaggagaagcagaagtccatctaatatatcactggtgagagcaaagagctggtggccaactctgctgaagtggggctttgagttggtgtatataactgagcctaatggcaagcactgcatgcagaagctcaaggaatttgatgtaaagaacctgttctcagtgactaagaagggccaggagctaccagaggatgatgaagaaaacaaactggagtagatcaaggcaaagttgaaaaatcttcgcaagctcatgaaggagatattggataagatgtttgaaaaagtcaccatcttcaatagccatgtgtcttcatgctgctacattgtgtcaagcacttatggctggacatggaacatggaagggcttgtgaaggcccaagcactttgagacaactctacaataggctacatgatggccaaaaacacctagagaaatattctgaccaccccattgtggagaccctgtggcagaaggctggggcagacaaaaatgacaaaactgtcaaggacctggtagacttgctgataggaactactgtgctcttctggcttctcacaagaggatcctggaacccactccaattacatctaccacatgcctaaactaagcctgggcatt

SEQ ID NO: 29802 - DNA, 1143 bp, Mus musculus
taattaatgtgcctaggaagcacagacaagaagaccagcagatctcactgttcatccactctagttgggtctgagtcccagggagagaacttgtctcaggtagcaatgaaaaggatggtgatgatgatgatgatgcaaaaaaagacaagaagaaataagatacacaaggagaaccacccaaacttgacctctgacttctacatactggcaaacacatttgcagcctagtgtatgccaacacgcatgcataggtatgtatacaagtgtaagaagaagaagaagaaaaatgggtatctctcaagcatcgtcttttctgtgttgattttcagtgccagctgcagttctgggcacgcagcaaggggatcatttaaccgttctaaaagcagttcctattcccagagatatgctgtgactattggcatctttgccagaggcattcatctgggacagatcaggacagcgacgggcctcctgggctcgcggatgcacagggattatagtctgtggttctgagaaggaagagcgttcaaagtcccctacctcctaggtgatgatagcatttctgcggtccagccataccctcaggtgtcagaaaagaatcttgttctctcctcctaaactaccgtcaatgtcttcatttctttctctgaaaacacattgtgatgtttcaaggtcccacataaacttaaataattcccaggaccttgcttcaaatccgctgctgctcctcgtgctgcagtcactcgtgctgctgactgtagataaatcctgagctctttttaccagtctcctctgactcagctacaaactcaccgtattggatgattgtagatactgcttcgacagacttcgtacttatcgtattaaaatccttgtaaactcatattaaatcctcagatttggtataagaagcactcgaattaactgaatcacacgtcatccccatacaacgatcacaataaaacagttggtatcgaggttgaaaaagttagccaaaataagaatagcggagacagcgtcaccaaataggtgtcagcattcaccagtgtcccccagcgcttttctcttaacactgagtgctgcgttttcagttcagaaagaaatggctcccaggatacacagcgaagaggccagcgcctctct

SEQ ID NO: 29803 - DNA, 1193 bp, Mus musculus
ccatgagttaaaatacaaacaaaattattttatttaaatctatttacagcattcatctcctttgaagtttgaagcaaataaagcaaaggtgatccatactttctgcgtgtaggcatctgctatctactacctatcctgcatgtaggcatctgctatctactacctatcctgctgcagatggctctctttcctcagttttcacctacctattgaaaacagctgtacaatcaactctctaaaatgtcacattttgtgtgctgtgtcacaaaagtttgcgtgcttccagtttcctcagaaagagcaattgtgcacaggcatcagaagtttccacagtctagactgaacttctttttccaacctttgttcccttgatactggatcatgctgaaagcattaagtaagactaagctgcacagtcacttgtgtactgggttggtttggcactgctatgaagaaggaagttgccatggggtagcatggatggtggaggcttggccatgaaggctggcctgatggaacagcctaggaggaacatggcaagtgatatctcggggatcacgagagattggagatgtactattgaaagggcaagcccttcactgcctcccacccaaataaaaaagccaattggccttgtactacaagagccagtcgaactccttctccctgtttcccacctatcatccaaaaatgcggaggaatatcaacttagtgttatagtgtatttcacatttgttcagtcaaacttagccagagttccaatgccctacttaaaattcaactagaaagttacctaggaagtactaattagcattataaagtcagagcctacagctccaggcttttcagttagttgtttactaagataagaagggacagtcttagccttatacagtttaccataagaaaagttaaggaatcccatgaaagcaagttttttctttagccctagattccaggcagaactattgagcatagataattttcccccctcaggccagctttttctttttttaaattttgttaataaaagggaggagatgtagtctcccctcccctagcctgaaacctgcttgctcggggtggagcttcctgctcattcgttctgccacgcccactgctggaacctgcggagccacacacgtgcacctttctactggaccagagattattcggcggaaatcgggtcccct

SEQ ID NO: 29804 - DNA, 1183 bp, Mus musculus
cctggcgataggatttcaagctctccttacctttagccatgttgtagtcccaaccggggtgagtaaaagggaatcccatgttgatctcattttgtagctgtgtaggccgcccgtcagttaccggggtattttttctagcctctaacagaattctctctcactctttggttgtgaagagtgtctgcagcatctgctgacaatcaccccaagtaggctgatgagataacataagggactccaccaacactgtgaggcattgaggatcctctgagaaaagggggtggttagtttcccagttataaaaatcagcagaggaaaatgacagtactgaaggtgttataggttgggcgggtccactggagtccatagggactctgcactctccagctcagtgttcccacagtgggtcagactcctcccaccccaggggttctgcagcctgaacactgcggggaggggagtaccggggaggggagtaccgggacctctgtgtcagtgttccccactacccccaccccccgccacggttttccactcggagcctcgcctcaatgggcacctagcagctgacttagaactggtgcagaccaggggaatgcaactgtttaattaaaacaatgcatatcaaaggccctctggtgggtgttgaggctgtggataagggggaggtagtggaaccaatggattagctggtggctccaatttgggagaagtcttcacttttgatttctcttgtaacaccagagcacaaccacaattttaggaagcaaaacccaattttaactgtgtaaacaatctgatctctttaataatcaacaccaaaaacattacttgctacgaagtttggctgcctgttcctgcacacaaacgcaagaaggtgcaggcccccaacacttcaaagagacactgccctaaatcctatcttctataagtctggctgctaggataagaattacatagagtattacccaatttaggcgtatctttagagacctatttccttgggttgtctcatgctgcatgttgtagttctaaattactccaacccagagttaccagttttaagccaactttctgttaccaatggtataaatttttaatcataaccaataacttatgagccaataatctatgaccaagacatataaaatatatttatacctttaaagctattcagaaacaa

SEQ ID NO: 29805 - DNA, 1118 bp, Mus musculus
agcactggatcatctattcataaactgttgaagttgttatatatcttttttatatatttttattaggtatttttctcaattacatttccaatgctatccccaaagtcccccatgccctccccctgtcccctacccacccactcccactttttggccctggcgttcccctgtactggggcatataaagtttgcatgtccaatgggcctctctttccggtgatggctgactaggccatcttttgatacatatgcagttagagtcaagagctccgggtactggttagttcataatgttgttctacctatagggttgcagatccctttagctccttgggtactttctctagctcctccattggaggccctgtgatccatccaatagctgactgtgagcatccacttatgtgtttgctaggccccggcataatctctcaagagacagctatatcagggtcctttcagtaaaatcttgctagtgtatgcaatggtgtcagcgtttggaggctgattatatacggccataccaccctgaacgcgcccaatctggtctgatctctgaagttgttatatatcttaaagaacaaacaaatgtcctctgcattgaaagtcgaacatgtcttcctatgtttagcctagaaaaaaaaatcattactgggtttcactacaataaaatttagatcccaaatcctcaatttatgtataaatctactttctacaggcatgaaagtcctcttcaaggcccagtgtcttcccagtcttgtggaagctgctaatttatagggcagcttaatgcacgcacgcgcgcacacacacacacacacacatacacacatacacacatacacacatacacacacacacacacacatacacacacacacacacacacacacacacacacacacacacacacacacagaacagtacccagtatttctttgaaatattgtccacagatgcagtcagctcccctgacaggctattgtctctttccattctcactgttctgcctccacccttgcctctgagccaaccttcatccagctgttgaagtgtgaatgcctccaagggtcaaggtttgttttctatgatgccaattggggtaaatgaagaatact

SEQ ID NO: 29806 - DNA, 2841 bp, Mus musculus
ataatggagttgcatggcctgcaagtggagtgtagggataactgtagtaagcgccatgtcaataacaatcttgacttgtaattctttatagctgtggaagatcaaatcgtgacagttgagagaaatggaggtgtagccgggatgccagagcacgagcgctgatggagctggctggaagcagtgggtggctctgctccaggagtctactgggaaagaagtgtttacatcagaatgtattgtgcaattcttatatttattttacttgtccactggttttgttttgttttgtgtgtgtgtgtgtgtgtatgtttgttttctttctttttttccttttaaacatttagtttgttttaagcattgaagtttttcattgttgaaagggtggcagagcggatccagatacctgagatcctggtaattgttgacgtaattgacaagcagattgtgaaaacagaagccattgctaagcactgtttcttcattaatgccgtgaacttgccttacttgaggaatacgtctttaactctgaaatagtgcgttgtctcagctaaacacatgtcctctggtaaaccagggtccgctcaggatcgctcttgaaatacttcagaacagtactgggatctagactgactaagctgcagttgaagcacccttcagtattaatagatggtgttgtataacaggtcaacaagtgctctttgataataaaactcttaatggagcaataattgtaaatggttaccatactgtaaaatattttgataaaaattaattagtaataaatgtatttatttaaaacactgagctgtttgcacagctccaactgtgcatgctcaaaatgtgcactttttaaaatggtttcttttggtgtatatctctatgtggatatgttacagtgtactagggcataatatggtatccttttgagtgaggtctatcctcatctcacaagtgaagtgcctattgttattactaaataaagtgcgttacgtttactcaaaagaatttcccatggtacactatagcgtatgctgttcctaccacacttaaataaagcttaagaataaagttgtctgattgctagttataaaatttccaaattttccagaaggacagctccagcctaccagttctagcttccagatttaatctggtgcacccctcccctggctccattacataagggctatttttagatgcttttaacgtggaaagctagctgctctccccttcagtaacttgtccgtgtccggtgggagcttatcatgtttccctttggcaaatagggcagatatgatagtccctacatcgggccttgattctaagttgttacctttgtacaatcagtagtgttttaagaattacatgaaacaatgtttttgtgattgtcttgtttaagccaaccatttggtttttaaaacaaagaaattatttgaaacaatctaggattttcttggtgcaaagtcatattgaatatattcatatttttagcatattttaaggtctttaaaataattaattgtaaataatttatttgattggtgcagttctaattcgcaaatcactcttaaaatcaggatgtgtagagaccagagccatgtgttaaatgttgcccttcccattcctctgagcaacctcagctaagcctcactggagagtgctctctgtataggaaacggcagacagcattgtgttccgtctgcctgcgctctaatatgtccaataatgaccaaagtgcattctgggtatttttcgaggaatgtattactggagctttaagaacatacttagtttctcatgtgaagaattaggctttgtctgatatgttccttcctatattgtctaatttgaggttgtttttaggcactatattttataaactttttcaaaataaggtacatacctatacagaacttaccattttgcacagagtatatcaaatatattttgagaataaaaaagtacagcatgagttctgttaggaataaagtgagattgttgtatcttaaaaaacttatttcagattggaggtatttttgagaaaagtagctgagtatactgacttaggaaaatgcttgctttaggttgcagctgtgtttaacgtagagttggggtggattgtacagtatcggccgtgccgttaacgtgggcagcagtagagttctaggaggaaaatgtgctaagcagcttcatagttcacagagccatttcagagtagtaagtgacatccctgcctttaagtataccatgaatgtaagaagtagaagttgtaacatatcacatcatagagaaaaagcaacccagaggtagaattatggcaaatgctgtgtgctgtttctttgccgtgtgtttttaaaagtttgaacagcaagtttaaaataaaacattataagactgacttgtgtgtgtttttttaagtgtgggttggtttttgtgcttactgtaatataagctgtacttactgccctttagacaaggacggtgaaaataaagttttaactgtacctcagcacttcatagtttgtttaagtcctgataacatgataggctaactctgtgtacaccaggaagcttggacctggggacacttgtattggaatgtaaaaaatgactgtggcctgggatgctgaagttcagtagcgggactaatgggaaaattgatgctggctagctggagctaaggaattagcggtgattaagaagagaccagcaggctggtgagatggctcagcaggtaagaggactgactgtgctttcaaaggtcctgagttcaaatcccagcaaccacatggtggctcacaaaccacccggccaacagagggagcggaggttctaaattca

SEQ ID NO: 29807 - DNA, 1170 bp, Mus musculus
taaataccatgaaagtatttagaaaagataaaatgccccccttttttatatattattgactttttagacaacttcagttgaagtctattaattcacctttatccccccttatgaaatattatatttcttaactttatggaaatattttgaaatagtatatgtcaacaatctattgattgtattccttaggtcactatgaatgccaaacatatcctttatataaaatgtgggaaatatatcaatccttgagttgtgagttagaaatgctgtagtgtaaactaaatagtcctattccagctccactgtaagttctacatttttataactgcataatttttatgttatctgtttaattataactaattttaaattgaggtttttatgtagctaaaattgtatgtgtataaatataactaatatacagataaatgtattccatttataaagtatatatttaccaattttatttagtatagctatatatagttttgtaaaactttgatttgtgaaatgcagtaatgtgttcaattctttttttttgtagagtcatttgccctggcttcatagttcccacccaggattagaaaaaatcagtgctatagtgtgggaaggtaacgactgtaagaaagcagacatgtctgtacttgaaatcagtgggatgataatgaacagagtgagttctcaattttcactctctgggtaaagggtaaatacattggctattgatacatgaactaaatgttaataacctgtgtacctccctctttttttcctcactgaaaaattgttacttttcttttaaccccatctaaaaagtgatttgccaacagacccttccaccatttgaagggacagtgaggtgtgtggtatgcatgtgtcacaacttacttgtggaagacaggtgacagctttgtgcattctgttcttttttttccacttttgagtgcgtcctggggatcacactcagttcaccaggcttatgtagctagtgtttctattgacgtgaaatagataccacaatgtcatttttctcctttcttcttttttcttcaatgggtaagattttgtgtgtgtgtgtgtgtgtgtgtgtgtgtgtgtgtgtgtgtgtgtgtgtgtgtgaatttattagcatctaaaagtcaagcaggaaacctgtattgtgcgtccttg

SEQ ID NO: 29808 - DNA, 1217 bp, Mus musculus
ctagcctggtctacagagtgagttccaggacatccagggctatatagagaggaacttatgtgtgtgtgtacctaaggtaaagtatttgggatagtattaagtcattaattataacttagctgatgaaacttcaaagataaacttcttaaaataaaagcttaaaatacgttaaccctcacaaattgggaaaaatttttattctagacacttcccacagcccaggtaattaagactaagaattatactgtaaattagggcttttctttgtgagttgttatttgtaagaccttaaaacctaccataagtctaactaagattttaatttgaacgaccatttttttctgatattctttttcatttagtgtaaaatgtaagagtagccattaaaattctgagaaatactgctttttgaaataatactggattttaatttctattgacccatccagaatgagctgagtccacatgaacatgtttctaactattcttggttctaggtcaaagaaggcaaagaattcaattgataagtcaaccgagactgacaatggctatgtgtccctcgatgggaagaggactgtaaaaagcagtgaggatggagcacagtaccatgagcctcagtgtgaaactgttggaccagaagacgcagcctgggccacacgaacgccaaggagtgttcctgccaaagtcagtgcatctgcagcatctgtttgagtttttatctgccagcgtggagtgatggagtagctgctctgaaagcaaatgttttctctggaatggtgctgtgaccttctatgaataatagtcatgacgctagagatcaggtcgatgtcgctaaacatgactgcacgtgtaactctgtgcgttccaaattgattatccagtacaggtgtttaacatacattgggaacactgaaaaatcttcttccctttctgtgtttaaatgtgcagtaatttgtcaaccataattacagaaaataagttattcctcctatccacaggtacccctgtgttccttaggcactgtctattcatccgctgatcctcatcttcctagactctctctctctctctctctctctctcacacacacacacatctgtgtataatactgtcagtataactgtacagtagatgaaataagtcctatgcagaaagactcatactgtgactttgacttactaccagttctgtttctgctgctttacaacaaaatgttg

SEQ ID NO: 29809 - DNA, 1238 bp, Mus musculus
gtttaagattattgatgagtagaacttgataactcagacttgtcaaaacactagattctcatgggcatgctctttaaaagttgtacttacttttgggctaaagttttcaatatgaaaattataatactttaacaattcatttacagtagaatcacttgaattttaaaggaagtaaaaatagtgtattcaactagtgtatttttaaggttcttttccctggagtagctttgactcaggacttcttcatcttgagtaccaatcagaatgcattgtagaaaactctacaaatgtctcaccacccaaaaattaaaaaggcagaactgttaacgttggctataacagtgaggatttttaatctgtagtttttttttttctattcaaattccagttcataaaataactgatttttttcttagtaaacatcatatttattaagtacttttcagactaggcattatgctacttgctggcaacaaaacataaaactaacctagtagagatgagttgcatataatctaccaaatagtatatggatgccagcagtgccttcgtgaaggatgcatccttatttcagggagatcttcaaagtgagttttgttgttgtttgtttgtttgtttgttctgagtttttgtttttgtttgtttgtttgtttgtttgtttggggattttcaaggcaggatttcctctgtgtatcactggctattttgggactcactctgtagaccaggatggctttgaactcagatctgcctgcctctgcctccccagtgctgggattaaggcatgtgccaccactgcaaagcttaaggtgagttttaccaagtagttggatacaataagttcttggaaaatggataaagccatttcttttaagttgttttaaggatcattatatgaaatcacacaaaattaaagtttctgtgtgctaggggaaactgttagcagagcaaacagacagtccacagacttggagaaactttttctagttactcatcacaggggggttgatgtaagtaaagatttacaaaaataaacaccaaaaaacacaaaaccgctagtcagtaaatccacgaagtgatcagtcagttctcaaaagaaaccaaatagccagtagtttttatttttacgttcagcatccttagcacctaggggaaggcaaactaaaaccactggagttcccatctcacctattcagaaaggccatcatcaagaaaacaaaccacaacaaatgcttcca

SEQ ID NO: 29810 - DNA, 3487 bp, Mus musculus
aaacacgaacctggtgcagctctaagaatcaaggaagagcctgggatggctcccatacctgaaaagatcagaacaccaaataacacggaaggcaagaacagtaaggcgagactggatcgcgctcagttttcagattttcacattgacatggattctgcatttgagaacaccaacaaagacttaaaggaagactcgtgtcctggcagtgtcagtaatacagttgatacacagcagcatagttctgtacgttcaagtcaagacagaagtgaggatgacagtttgtgctaaatttgtacattacgtatagccttttctttaaaaaataatttgtaatgattcatgaaatctgaaagcaagcctaggaattgctctcaagtctgttacaaaatatagttgatgtagcgttgtcacattcctcagtgcctgtccataactgtgaagtatcaagcacttagggccagatgcactgtaaacattgcaggcggaaacacacaggagtctttagaaaagtcattgagttggagttgtaggctttagaatagagctgacaaaatcatataaatatattttttgtaatatgagccagaatttttttgacaatataaagtttttccatagagcttatttataccaactttttttttcattttaaatgtcagcactgtagtgtaaatagctttacaaaacctttttagtgtgatttatattgaaatgtgagccacttaataaaggttcataataataaatgctttctgttgagcttgcaaaaacatactgacaattcagtttgtttgatatattatgttcccgttaatatacatgaggtgaagtgatggagggaaaatgtgtgttccaatctagtaaatatttaaaatttccatactgtacaagcattcagaaagccacaattctgttattaaaacatatacatatggattgtgtgtgtatgtgtgtgtatgtgtgtacacgtatgtacatgtgtgcttgggaatgtatatatgtacattgttttgcacaatttcttaaattgatgaatatataaaagttcttagtgctacttcctggattgtattctaaaatatttctgttcagcagtaagaaaataatttaattaatagagttttagaagttgggagaacctgtgttgatggttttatccttctaactaatgaagtcaatgtggctggagtctttagccctagtgtaattcttttgtgcaaataataagtttagaaaattttctaataagcacctatatgtttagtaatagttgacttaaaaattgacatacagaaagtttaattaggagtaattaaaagtcttttacattttttcatatcacaaaaatgaacttttaaaccaagggcagtgacagtgacccagccatcattcacagatgtgactagcaaacactgtcagatcatcttcctcaggacccttcgccagcctgcagggcaaacctaaggtgtacctcctctagagatgctctaggggttcattgtgtaggagacagggtggccagtgcctgcacggtgagtagacatctgcacccatggacttgagcatggttccagtctgcttccactccgtcctagtgattgcaaatgccgtggtgtttgttttagtctgggtccctgccttgattggcgactttgagttggctctccttgtgctgcgtggccttttgggagaccgctgttcccacctcagtgggctccactttcacctcagttttggtaagccatcaaagctcatgcttctagctggggagaaaccacttagagaaatgtatttcactagaactgatgaaaatcagcaccagcagcagtgtcttgtgtccttacttgaggtgggcacataaagtagaaaatgctggtggcttataggaggatctcaggatgtttgcaggtggcgtggaggtgggggtggggattcatggagcagagaaattaaaaatcgtggcagtgtaaatagggtttggttttctatgtaactagctgtctttcactgccctcatttaatctattctaagctaaatttagggttcttcatctttcttaaggtgggatagcaaaaattcttaacatatgagtattaagaaatagggagggatattgttaaaatttagtttttaaattgacggtgatatatttatcacagtatgttttatttccagttgcacatatgtaggcccactgagatcatactgtaagaaaacactgttagggtatttccaaaacatatgagccttaagttttagcttaaaggaaggtacacctgagatagcatcgccactgcttttaggtatagtttcttatgtgacccttagttcacatagttatccatacagattaattgctctgtcaaatgcatacatctctgaaggtgaagtatgtgtaaaccagcaggctcaagatttcaagataaagccttacagacttgaatcatgcttacgccccaggcttacgggttattttttaaaatcctcttcagatgccatctgagaacttgttaactacttttgttacagacaaattcctattttaatattgcataataatggttttctagttagtatactcccattctccatgtgaatataagatttttatttccagtatcttggaccagaacataaagcagtcaaggtatagttttaataaggtcatatgctatatagagtgaatattatataagttattaagtgatatactacagacctttacatcaaaacgtaggtacatcagtggtatttgatatatatactttttccccctttttctaattttatttatattttcttagatgtagtatatatcccatgctcaggttagctatcaaaagaatgaaacatttttgatatttagttgcaaatttacataaagccatatattatcttccttatgactgacgaaactattgaccttaatgatcaggttggtttagcacaacactgtgtattgtatttatgtgtgtatttctgaataagtttgtttgaaatatgtttccaaaataggaggggtaggaaattaaggatgggaaagactttcttaggtttaacttttaaggaatgtacttaatgtattcaaagtaggatttcattttttcaaaattcagttctatgtaaggttttttgttggtttgttttttctttttttgtaaataataaattagcattgtttggtaactttgcttttttgagggtattggaagggacaatttatttatatgtaaagtgattatttccagttagccaaggtacagatttggttttggcatttgagaggctattttccttgtcttccacctttcaataaatactaagattgataaccacaatctttttacctttgttttgtaattattttcttggatttgacattatattttagtctcagacttcctatttctgtctgtacctactgtcttctgaaatagcaaggaccgaggtgggggtgggagtctagtcttatatttcaggttatct

SEQ ID NO: 29811 - DNA, 1199 bp, Mus musculus
gacctgtaggaggtgtccgctttgtacatatatgtacagacctgtaggaggtgtccgctttgtacatatatgtacagacctgtaggaggtgtccgctttgtacatatatgtacagacctgtaggaggtgtccgctttgtacatatatgtacagacctgtaggaggtgtccgctttgtacatatatgtacagacctgtaggaggtgtccgctttgtacatatatggagtctgttccatctttgctccgtgagatgctttactcgtctccattgtgaattgagcggtaacgatgttttcagtgttggacggttggggtttgttttttgtttttgtttttttcaagacagggtttctctgtgtagccctggctgtcctggaactcactttgcagaccaggttggcctggaactcagaaatccgcctgcctctgcctcccgagtgctgggattaaaggcgtggtttatttttttaagacatcaaggaagttagttctccgtttaggtggtattttactaattttaattgtctgaattttgtgtgtttaattcagatgctgatgttagtgaggagtcgcctcctcctttacctgaacgaactcctgagtcttttgtattagcaggtgagcgtaatgagtatttcttccatattgctgggtttatttaatttgccaactattatactgagtaattaaaatcaaaatgtaagttgtaattgatgctgacagtttttattactcacttgaaagctctttaagtagtatttttccatacctaaagttgctaagtgactatatttgtggtagtcattggaaactactagaatgaagaaggcaaatgcaatttcaaatgtattcacagcgagcgcagttgctgtttcattcactaatccagacaacttctgctgcttcactttctagtgaatgtaagttaacattcaacttgagttgtgaatgggcatgtttatgaagatagtttctaaaatttataggatttttttctaatgactttaataaaaaaaatcaaggattaaagacagaagtttcaatattgagatttcttttcttgttccccagatatgcctgtaagacctgagtggcatgaacttccaaatcaggagtggtctgaacaaagggaatctgaagtgagtcgtgtggggactggaatagctctacgttagctccaccttagagctgttatcct

SEQ ID NO: 29812 - DNA, 1211 bp, Mus musculus
ggtggtcagaggttgactttctggctcttttacaccatagtttctgtgttaatgtctcttggtaaactagcactggggtttcaggccccagcgccacaccagcatttatgtcagttctgtggaactgcagccaggtcctcatacttatttacatgagcacttccctgacttgagccgtctttctcaccccttcagaactgtgtaatttttcccccacctatcagttttttgtggtctctgtgtttcctgcatgggctagtcacattctgctgcgtgattctgaggaccggatacgtgcatctgcagcactgtctgtctttgtctgatagctagagcgcagtaaatacttgcagttatccagcctgtatctaaggtctgtgtgaaaacttggagggtattttactattttctgataatgttatattctttgttttagaaaattccagaggaatttaatgtatttaatttaatacaagaaatgagaacacagaggcactcggcagtacaaacaaaggtagagttggtttttctctttgtaagttatatttttgtaagtgtttctccttggatgctcctcactgtctcgtactttatcatttctctttataataggagcagtatgaacttgttcatagggctattgctcaactgtttgaaaaacagctacaactgtatgaaattcatggagcacagaagatcgctgatggtgtaagtgttcttggctcactagccttggcagacttgcgatcttgtgctgtaggtgggtgaggtggtctgaaaaaggagtttcggtttggggtttttggggaggtggagctgggggttcaagacagggtttctctgtatagccttgactatcctggaactcaactctgaagacaaggctgatcttgaattgagagatccccacctctgcctcccaagcgctgggattaggcgtatgcaatgactgcctggctcacaggagttaacttttatctgatgtgggtcactaactcactttactttttatcagttacggtccagagttagtgattcaaactgaataagtaaaatttaaaaggatcttatgtcaaagtctacattcactattgtttcaagtacaaactacctttaaaaacttaactgcgttactgctctcacccttaactacgtaattgtacgttgagtttaactgaaatttattttggcgtggcagtataacattttgt

SEQ ID NO: 29813 - DNA, 1210 bp, Mus musculus
agggatttgagaagttaaataatttgcctatttagtaattgacaaatatagaacttgcatattggaactgaaacccaagctctgttctttctactgacatctagaataatcaatcttaaaagttattgaggggactaaggagactgctccaaggttaaatgcccttgcagagctcccaggttagtttctagcacagcgctgatggctagccactcacattccactcagatctaaaactctctttgaccatggggcatgaggcacacacagcatacatatgtccgtggactcataaatgaaaataaatagtttttagagttactgaggcatctttggatgtttaatttatgcgggctatcactttcaatatttactataaggttaaaattggggaaaaaatttaaagacgtggaatacatagcttacaagtttgtaaatacattcttctaattactgaatttctgcttttcttttttttaatatttatttattatttatatgtaagtacactgtaggtgtcttcagacacaccggtagagggcatcagatgtcattatggatggttgtaagctaccatgtggttgctgggatttgaactcaggacctttggaaggacagtcagtgctcttaactgctgagtcatctctccagcccctgaatttctgcttttcatgtaggaatcccgtcggctctatcagtttcattacgtgaactggccagaccatgatgttccttcgtcatttgattctattctggacatgataagcttaatgaggaaataccaagaacatgaagatgtgcctatttgtattcattgcaggtacaaaataattttctaaatgtagagaagtacagtgtttatgttttgtgagataaggttttatttctacattaatatgatgttttattatatcttgagcttttcctagccctgttatggtgtgtttgagaataagaccctgtgaattgatataatctaatctggttaatagactgtctaaatgttgctgtaaaacatcatatttcctcatatgatcagtgtcaggcaaattttcatgagtgatgaagtctcagactttaaaaactgtatatagatataaaggccttactgatctgagatcccgtggtctgcagagaagtgctgggtgtagggacacgcttataaccccaaaccaaggaggctgatgtgagctttagccgctcagggcta

SEQ ID NO: 29814 - DNA, 1231 bp, Mus musculus
tatccagtaaattagcaaaagctgaaatgaattggatatatttttgccatgttttatactctaaaagaaaaatgactcttgatgaaaacattactaataaaatttgaaaccttaatgaaatattcttgataactatagtaaatgtaaagtttacctttcactctttcagggtgtgtatgggccaaaagcatatgtggcaacccaagggcctttggcgaatacagtcatagacttctggaggatgatatgggagtataatgttgtggtgagtgacttgtcatagattttgagatctatatgtttaatgaccttatgtgtcttactgagaaagaagtaaggcaaccttttttttgtataatttatttttattttatgtgcattggtattctgtccgcatgtatgtgtgtataagagtctaaagcccaggaacagagttacaggcagttgtgagcttgcatgtgcctgctgggaattgaacccaggtcttctggaagagtagccagtgctcttcactactgagccactccagcccctaagaatcttctgggtaacctttgtgttgtttttaatgattgtattcatttttatttattgtgaattggtattaggtttgtagatatgtctttgtgagggtgtgagatcctctggaactgcagttacagacagctgccatgtgggtgctgggaatttgctgccatgtgggtgctgggaattgaacccatgtctctgaaagagcagtcagtactcttaacctctgagccatctctccagcccctgtaaaggcctagctttttaggtataatgacctaagtgtaattacatttctagaaaagacaaaagctacttttgaagatggctcattaaattctcacaaagtagttcacatattttaagaaaagcgtgactaagtcgggtgtggtggcgcacacctttaattccagcacttgggaggcagaggcagacagatttctgagttcgaggccagcctggtctacagagtgagatccaggacagccagggctatacagagaaaccctgtctcaaaaaacaaaaaaacaaaaaagaaagaaagaaagaaaaccatgactatagtttaaattttgtcctaagccaaccaatgatatagctagtaaataactttaaaatcatttttcaaagaagatgaatgcttgcatagaccaacgaaatgattgatagtataggtatgctcttttaaaaaaaataatatttt

SEQ ID NO: 29815 - DNA, 1224 bp, Mus musculus
atcctcaatgtcctaggcactggatcaccactacacccagatcaggaaccaagttctgaaaaattcacttcatggacagggagaaaaagagatcattggagttggaatttacttaggagaatcagtaaacattggttgcattgttcagtgaacagaggcattagatagaaagaagatgctggtaatagaggtgagcctgccccgtgacttgaacaaacgcatttctgtccattactttataaaatacatctttcttttttaggtaatgttgtttaataaaactaatatatatggcaaaattatattagatttgtttactgtttgtggagtgtgagtgtacatcacagtgtcacatggagatcagcaggcaactttcaggagtcagttcttctgtcacatgggtcctggggttcaaactcagttcatcagacttggtgggaagcacctttatctgctgagcaatctcactggcccaaaaggcacaattttattaccctgctgatttaaatagtcttttatttctataaaatactttcatagtatggaaaggataaacttagattaaaagtttgtgtttctagctgggactggtagaacatattcgaggtaccaggacttcagaggcagaggctgaagaatgtctcctatgagttttggtgataggagctgccgttaataaaatgtgatgccctggcctacgtcttcaaggaattctagttataccgagggtggtgtgcttgtgtactgggttgtgacctccattagcggtccatagaaagagctggggtagagatgaggaagcagttgggaggaagtggatgacaaagtgttacaacagtactagtcttagggaaatgtttgacgatgatttctattctggtgtactgagaagcaaagacagatggaataaatgaaccagagaagtcagctagggcaaagcacacagtgaattgggttttttgttttttgtttttttttatctaagaaaccccgagattctcctttattttcctcagttatatccttaattaatcagtcctgagttacagcttcaaatgaaaaaacaaacaaaaacaggctggagagatgactcagtggttaagagcacagacctctttttccagaggtcctgagttcaattcccggtggctcacagccatctgtagtgggatccaatgccttcttctggtgtgtctgaagagagcaacagtgtacttacataca

SEQ ID NO: 29816 - DNA, 1142 bp, Mus musculus
tgaatctgattcccatctataaacatgctgtttcttaccctttcttttggtcctgatccttgtttaaactcttatttttctccgtgtgttttggtccctggggtctcacttcaaaacttcaccctctcctaagagtcgcgtccttggtatccaaagtaaccacagctgagtttatcccgtcccttctactcttcctattggtcagttacattaactttttttctttctctgctctcttggccaatgggcttgaagcaacgggaaagcaacgaggggggagcgggggctcctctaccaatcggctgtcagtctgtgtattcagcgcactgtctcctgggatatgtagtttcacagttaccagaacaccttgatgtttggctcctttaaaactacatatcccgatggcctccgccaaaggggcggaaataggtgacttgtccaggtcagggtttcaactaggctctttgaagttttaactttcctaccgggatttaaggcgttaagtactgtgctgggggcctggctcgttcttccttggcggagccgtgcatgctgtccccttcgtgactgacccgaggcagctcgtggttcttgtggtcccgggaccagcgagccaaggctgaagcgttccaagggagagcatgttcggccgcctccctccttgcgcgtcccgagtgcgggcgggcgccttggtcggagctctcggggctcggacttgcggctccagtggggcgcagcggcagggatcagcgcccgatgactctggggccggcctggcgcgtggggctctgagggagtggacgctgcaggtgagcccgtttgggcgactgagggcgcggctcccttgccacctggccgtgaggcccctggatccccttgcgcacccggatggcgaccgcgtgcaggtggcggtgtgcggcgtggagcacgtggcgcgcggcctggacagcctgcaggtcaagtatgatgctgatcggcaggagatggccattctgtcggacgacatcgacccccaggcgtcggtggaggtgaacgcgcccgtcaaatttggcaagtgaagtgaaaaagggtttgggtcacaaaactaatagtgtttaagcgttgggtttccaattaaggaggaaaattaaagccgagtggaa

SEQ ID NO: 29817 - DNA, 1151 bp, Mus musculus
gtatgtgaatgtcacacatttgcagtttttaaaaatgtagcataaaaatttcccccaataatttctgacttattttcacttttaaaactttttcatgttgtgtgggaattaggtgagtttcacgttacaatgtcagtgtctttaagccatagataggcctctttggaaaatctcatgattatttctctctacacaaatgagcatgcatgtgaacatttgcttacaatgtcatgagttccagaaacagtccagaaattcacttaaggtcagcctcagatctgaaagcagagttactttggaaacaggtctttctaaaaattcattgatatcttggcttttagattcacatctgtgactgtgacaaagttcgagatactataaaccaaattcttttgagaacggttttttctttttgtcttttcaatactttgcttaaatccctggattatcttatggacatgcacagaagaaaaagtttcatgcaagcttactgtctctaccctctgtggttttttgtttttcagagtcaaaagttgcatgttcaaaccaaaggaggcgatgtgatctgttgtggaacggtttacggaaatatagatattcatgcatcggataaaagtgtaagattgaagtgctctcagtaacttcagcttagcttccccacgaacagcagctgctacaaagtttatggtgtaatattttctttttagtgcatttagttctttaacaagctcatatttggaactgatatttagttcattagattcactaaacccttgataagtctgacttatctaaagaggcttttattttcatggttatgaattaaaatacctcattaagtaataccacaagtatgggaattggatttttcttaggtgctgggtttacttgaatattgtattctcccagacttgctgccttatggccgtcctaagggtaaattctgaaatgatggtcacttatggacagcactgatttaactcatgggttttgaatggagaacgtgatgttgagagaggagaaaaggcagcagaggaactctgggatgcattggaggtggggtgagcagttgatatgctcaaaatacatataatttctatattcatatagaaattaaaaagcgtctggaagcccgctttagcatttccact

SEQ ID NO: 29818 - DNA, 1487 bp, Mus musculus
agcttcatgctccctccgagatgctgtgcatttccctttgagaaaacccgtgaggtacaggcaggctgctcctccatttagtcctaccattcactgttggataaaggtggagccagatgtaagaaaaaggatgaaaacagcacagagaacataattaatataagaatgaataagataagcaaaggaattgagtggtcatatggagataagtattcgtgtggaaatttttcctaatacagataaattacttgaattaatgagtttattgtggttgctagattaaggtcaaatataaaagtcaagataatataaacttttaagagatattgtgtaagagcacttttcaaatatctggtgggaataaacgaataagacaaagtctacatagaaaacataacataccttgttcagaggaagtaaagaaggcataaatcaatggagggcttgcatattggctctgtttcccatctcacagaatgcatgttgctcacagtcttgcagttgtcaaggtgactgtgtactttcctgacgctggtctttgctctagagccgtgggtctcaacttcccaatgctgcgaccctttaatacagtgcctcatgttaaggtgacccccaaccataatattatttcgttttagtattacttcctaatggtaattttgctactgttatgaatcataatgtaaatatctgatatgcaggatatccgtctgaagtgggaccccgacgggggctgtgactcagatcgagagctgctgttctagatgagctgtttgggttgtttacacgttgttttatgatgaactgataacgctctctctcctactagactgtgagcatagagaaacttcagggaagttgtgttaatatatctacggaggatggtttgcttcaagccaagtatctttatacagaatcttcctttctgtcttctgctgctgggaatattgcactaggaaatgttcatggtaagctgacagaggcctagtatatctcagactttacacatggcataaaagttaagagatgactgtacagttaaagcaagatcaggaactggcctacataattaattgtagaatagccatctttttaaaaaaatctatgaaggtaaaatatcttacaagctaatttaatttaattttgaagagaatttggaaattatgctattttttataaagctaatagtagttctgactttttaaaagatttttattattttagtgtgcctgtgcatgcatgtacatatgtcatctctccagccccagtagttgatatttaaatatattttataagaagaaacaatatccaagagatgagataaaagcaatgttaataaaggtgggattcttagcggttactttccatgctatgagaggttaaatgcattaagcatttgggtagatgagactatagagactctatgatactgattttgggtacactgcattaatgtgtatttctcctggcacaggtcctcttagcaa

SEQ ID NO: 29819 - DNA, 1131 bp, Mus musculus
caagtgaaactaaatatacaggatcctgtggctcatggggcatggtgagcaggtcacagtgtgtgaaatccagagtcactgaagtcacaggctttggagacactgcactatgcctaccactatctgtctgggaacttgagcaaatcctcacctataaaattggtgtgataaagggacttcagaaagccgaaatggtgattgtctgcctctttgcaaatggtcaccattagcatattttgtctttgccatgtgtatggtaaattactgcttttttttttctttcatggatgagctgtgtaaggatattagcaaaagaagagctagtagttcaaaatgttctgatgcccatactcttatcagaagtcaggatgggtgagtgccttgaggatactgtgattcctgggagagttttattttcaattaaatttaaatatgatttatttgtattgtttcactctaaatttgccacaggttctattgctgtcaaggccccatcttctctacgagcttattttaaattatcaggcaaagaggtagttgtggatgaagaagctcatgttcaggaaatggccaaagactgtaaaggtgatggtgtgacggttacaggtaaggagacggcatattgctgtggatgaatggttgtggccctgtgtgcatggcacagtgtgttaactgcagattaattcctagccatcctcgattcccagtgtctgagactgttcctctggtgataatgatcagtaacccaatcagacactgttgaaaaggcctcctttcatagcagatcctcagccacagggctccatacccaatagcactgggagggaaagagcctccaaggagtgcagacaggcctatgattgtaggtgggatcacccatgctgctcagagaaacccgtccagaaccctgaggacacaggaaccaaggggctgcctgggacaggagtcttccagtctctgtctgcgcccagagctgatcctgtgccacagagctacatacacaaattcctcccagaaagaacaggtcttccaggagtgcctacacacttgtgagcataggtaagaccaccacttctcttcaaattcctgacccaagagggaccctcacagagccatcaggacacaggaacc

SEQ ID NO: 29820 - DNA, 1073 bp, Mus musculus
aatgtgtatgtaattccgctattcattgtctgttgttctgttccagattataaaagtccccaagatatgtcttaggacctccagtgatacctgaaaccacaaacagtatcaacgctgtacactgtggggtttttgcttttaatataaacacatatgacagccaaatgctttttctatacaactaagcagttatttactctggccaaagcccttaccagtttagtcccaatatcaaaactagatgcctttctttttcttctttacaagttcacaaacagtgtgtccaccctgactgtagggcctagcagcttcagcagatgatttttatttttaatttttgcttactaagttgagaacgtttacctttttcctaaagcactctgtggcttctctttgccagacctaattagtgatgtcagacatgacactgtggttgtgctttagcgccattactaagctaaggcttcttgaaccctggtactgtgtgctactgtgacagtttgatggcctcggtaactactgagtgactaacggacggtgaacacccagcatgcgcgtactggcaaaggaatgcctcgcagcccaaatgcaatggcagatttcctcacgcttcttcaccgaagaaataaaatgcagaaccttggatgggggcaagagaacagtgctaccccagatttaataacttcagatagcgttccctcaccggagtctatgtagatgcttatgctggggttccgcttagtgtatcacatggccgggataaaagtgttgtccaggctgaggatgctatctaggagctgcggggagaactctgccaagagttatagggaaaatcggcttccttatacctggatgatgtaatttcttactggcttcagctaatggtcacctcgtcttctaaagacaaccacatgctcaccttcctagtgcagcccctcttcaggcaaaacagagtccttctctcatgccctgaatgtctgactttcttataagctggaacaatctctgcttggttggccaagttatttaacatgattatgagaatatcctaggtatgtacaccactcccacta

SEQ ID NO: 29821 - DNA, 1149 bp, Mus musculus
gagacgcgccggagcgttgcctagcaaccacaaaggaggtgccaaatagtccaagcctttcgcgagatgaagaaagaacctagcagggagggggcggggcaactggggcggggcggggcgattgcagaggggcggggcagagaggggcggggcgagtgcagagaggcggggcagagcggggaggggcggggcaggacagtacaggccggggccgggtaaaatgagagggctggacgggagagtgagtgttggggcggagctagggtctgtgttcaacgcgccgcagtcccggtcttggtccaggaaaaagctgcttgcactaggggcatcccgcctgcctggtgaaaggaaccgcagcacacagggtgggagggcttccgattttagcagggcggcttccggaaggcggagctccaaccccatttcctttctctgggctggttctggcccagctgcacctgcgtgtggccctggctcctcggctccctgcagctccgaggcagcagcatgggtggcgcgcgggacgtgggctgggtggcagcagggctggtcctgggcgccggcgcctgctactgtatctaccggctgactcggggaccgcggcgaggcggtcgccgactgcgcccttcgcgatccgcaggtgaggcgatgggctgcccggcaggtggactggttcggggctccggacccacctcaggccaggctgggttggaggtgccctagacacccgcgactgcatggggagaaaggctggaggtagacagacgactctggaagcccaggttgccttgggtgggtcctgagccgcttccctgctcccacttctttgtttaaaataagagctgaaaacattgcccgaagtgtcctgttacttcccttcggcttcacagccaagagctgaggtttctccgagccaagtagattgcctctcattttaaagttttacctgagcttttgtgttgttatcaaagagatgccccttactgtgagaaggttctcaggggcctcaagcctgggttgaaactttgctcgtgctatgtgaagaatggatccctgagatgcaattctgccagcactttgtggcacctgtcctgggaagtacctttaagtcatccgtagcgtccctgcaaccggggtgtgtgtgttggg

SEQ ID NO: 29822 - DNA, 1904 bp, Mus musculus
aaatcttagtttttcccctaacaaaacgtcattttcacttgtaacatggaataaaaatgaaacatgtcccttacgcttgcctggagtcagacttttacagtgttaactaatggatgctgttttaaaataggacagtgacgctgtttcctctttcaggtggattcttcattcctttccctttatgacggccaagtagcaaatgagattcttcttcgggctcttacactgtttcagaatataaacaactgcctcaaagtggaaggccggttagctaatcagattccttttgctaaagggtcattgttttttctgttatacggagaagaatgtgcccagaaaatgagagctttagcctgtcatcatgatgtggatgtgaaagagaaagctttagcaataaagccgaaattctgatcggttgctcctatttttatcaaagactcaaacagtaaggcagtcttaagtcagcacacgggagcgtttgcctgcctttaaaaggggtctttcagccgatggagttaaacaataaaagtgagtgagcagctctaatccaacacgatgttcaaaattttagattttggagtagttcagatttggggtttggggattgagtagagtctggaaccttccgaggatgtggatcatttacggggcaaacgtttggttatgatcgtggacagactggccatgctcttcaggactatttgaaggattctagtgctagtgaatgaatatgaggggctgtactgaagatacttgctgaggtatttaatggtttcctgacacgaactgagtggcctgtctctgtacaatcctaactcctgggagcatttgcagttgctcatgagacagcgttaagtgctgagttgaagtctgttactgccacagcaaggaccttgtgcctcaaaccagtgaatactgcaagctcgagtccaccaccaaccctgccatgctgcttgcaagtctgagctcatcgtgagacactgcctgcagcatttctgatcagtaggactgtactcccatttacatggaaagcgttttcttactgcttacccccttgtgtaagatactgcagagcactccaagcttccacccacaggcagacagccctttaaaaaagagtgtcctgataagtccagatggatacatggagaaacatacccatgagatggctgctttgaaagcatgctgggaagcaatgtattagggtcccgtgtcttttttttctctcagtaatgataaatacacttatacatggacagaacatttctagaacgattcagaaaacttctgggactgggactagggtacatagatttctttgtgttcctgtttctaccgtttggatttgtactgagcataaattgtataattttttaataaaaaggaaaaatgcaaggtgtacataatttcttcccccactgacattattttactaaatttcatcacatttttcttaagtaaaattacaatacatacattttttaaaattttttccaatttgttttatttgtgtgagtgttttgcctgcacgcatgtatgtatgagcaccaggtcaaaagaaggcatggcaactagagtaggaggtggttgcgagccaccatgtgggtgctgggaactgaacccaataccagtgcctcttggcaccgagccagttctctaggcccctgtaaacattttcaggtatcttttcaagtacttttataatatttactttatttagaagatagacatttttacaatgtatattagactaacaagagtagactttttttcaaaatttattttcactttatgcatacatcctttgaaatgtagattagaaaaataaagtgaaaaccattcaatagggtggttgtgtgagagagatttggtgtacttcacgagtggaacttacatgtaaacag

SEQ ID NO: 29823 - DNA, 1168 bp, Mus musculus
tctgtagtcaaaccagttggcccgagagcctctgaagcatctgtcctgtttctgtctgtcctttgtgaacaggagcatcccgtctgtctcacttctacacagtcagttttgtattgttatttcagtttcttgactttttgtccttagtgaatatgaagcatctgtaggagaggtagctgaatcagggtgcttgttgaagggtaatgtgctaactgctcccgttcttggagagaaaggcatgttctctcaagtgttgcctgtttgacagagcggttggttaaggaacatttcctaggctactgctagagcccagtggaaccagaactgggacctcattctccgcgctttctgccaatgacacacacacacagacacacatagcagattacatccaccccgggctaggaaagtggttttggaatgagtctgtttgaggttgttttgtttgacactgaacaccaggacagtaatgttttctctctttccctcctcctcccgtcagccgttgtactttggaggggaccgactaagaagcacacaggctgccccacaggttgtgctgaatgtccccgagacacaagtgacatgtttggaaaatggactcagagtagcttctgaaaactctgggctctcaacgtgcacagtaagtcactgctacagtcttttttgtttgtttgtttgtttgttttgttttttcaagacagggtttctctgtgtagccctggctgtcctggaactcactctgtagaccaggctggcctcaaactcagaaatccgcctgcctctgcctcctgagtgctgggactagaggcgtgcgccaccactgcccggctggctgctacagtctttagtcggcaccttgtctgggagggagcagccacagctgcagctctctggttggctgggttctccgagcttgaaccttcccttccaggtgcactttggtaccgagtgcttatgtccttctctcactgctgacatctgcctctgacggtcatgagcctggccactttcccacggccgtcagcaacacaagctcagggagagtcacgtggctatctgaggttataaagcttatgcttgtatctgagcctgactttctgacagtccctgatgtctattccacagttattaattagatgtgctaaatgagctatgttaagaattt

SEQ ID NO: 29824 - DNA, 1099 bp, Mus musculus
taattgtatgttgtagtataatatatgccaccttgctctttaggtcagtaaattagatttaacgagcatttcccaatgtgttttaggaagcgtctgtgtacagatgtgactgagagtgaggttgcacgtgcaaaaaatcttctgaaaacaaacatgctgctgcagcttgatggtgagagttaaggaagggctgcaggtgcacggagggcgggcctgctggggaggaagtttgccttgtctgtcgggatactagctgtccttctctgaacagggtcaactccaatttgtgaagacattggtaggcagatgctatgctataataggagaattcctatccccgagcttgaagcaagaattgatgtaagtaataaatgtggggcaaataggtcatttataaaggctgaggttccccaagtcttgacttagtttagaaaagtcacatatgtggaatctaagttcactacaaaaagttgtaattatagtatcatccctattgaaggctgtggatgcggagacggttcgacgagtgtgcaccaagtacattcatgacaaaagcccagctattgctgctctgggtaagcctgcctcttctccttctgcacatagagttggctaaggacttggaattttgccctgttttcactgttttcttttaaatccataggtcctattgagcgactaccagattttaaccagatttgtagtaacatgcgttggattcgtgactaatttttgtgatcaaatactctgcacatatatatttataaaactaagagactggaagttttcaaaactgccagtgttcaaatgaaaaaataaaaatatatttggaatttttgcgttagtctgttatatgtacctctagaggctaagtctacaaccctgaatgtttgatgtaatggttgaactttatgttgggagtaacacacttttaaatgatgactataattccaagtgaaaatgtgtacagtattttcagttttattataaaagtgcacacacaaccaggattgcctgcattatttcctggctctgcttgcattcagcacttgctcctgagcagctttcttggctttcaccatctccacaagttcctaag

SEQ ID NO: 29825 - DNA, 1106 bp, Mus musculus
agttcaaggccagcctggtctacaaagtgagttccaggtcagccagggctacacagagaaaccctgtctccaaaaacaaaaacaaacaaacaaacaaagaatgttaatttcacaccttcttgtctgaaccttagtgctgtttagtagtcaggaaagttatggaatactgtgttgaagctagcagtattaatttggtaatacaggtagcaaaccacggggttgttttgttttgagacagagtttctgtgtttatccctgcctgtcctggaattctctctaccaagccagccatgaactcagagatccacctgcctctgcctcttgagtgctggaattaaagacatgagccgcgctgcccggctcaaacttcaggtatttttaaaaagctttaggtgatactgattgagaatgctgttaggaaaggtgtgcagtatatttattataatttaaaagattttgaaaccaactctgtaataaccaaattttcttattagggagctcgaatggttcgtgagctttttgaaatggccaggacaaaaaaagcctgccttattttctttgatgaaattgatgccattggaggtatgaatgatattttattgatttagttactttttagtgtgtgtggttaaaggacaaatctatgggagtcaattcttttctaccatgttcaaactgggcaaaattccagccctgagcaaggaaagtggacacaaggtctcatcccttcccatgaagcagtttgcagttggtgcctgctgggaaaggagccctcgttattctccagtggagcgtcacagtttctatcaccctcacccagggcaggcctaggccaacacaaaacaaactgggttttgtctgcttttcatttcattttgttttgctttgaaatattttgctttgcaattagttttataacttcaaagtaggttgtgcacttagctgtaagggaaggctgtgagccaaggggtggcattttcaggtcctgagtggtgatgctcgcagtggacatgagctgcttctctgccttcttctcaggggctcggtttgacgatggcgctgggggtgacaatgaagtgcagagaaccatgctggagctcatcaat

SEQ ID NO: 29826 - DNA, 1197 bp, Mus musculus
aactttgtaccgtatagttcacacacaaagtgttgagaggctctgactttgtgtttgtcttaagtactttatgaatggctcaaaacggtttaaaagttgtgtttgtaagttacatttaaaacaaaatgagttctagtgcatctgacagcattgtccagttgtagtttgctttgcagtcattcagagctgagcagtcgagacgggaggctaacatgctatctgtttttgtttctaggatggtgaactttgacataataaaatacttgtatgatttcttgtgaaaacaagcctcaaagccatatggacactgtgacaatgactaagccaagctgtgttcatccaaatactcagctggccggggaaaggagttctttggctggattggatttgtccaaacaggtgctggcccagcatggaatccgatgaaaaccctctgattggtctgggtagctgtgagcagaagacggtttaccaggggcccaggagtatttggaagcaacgtgttaattataaacagcagggtttgagcacaatctgttctactcttaatgatgttatcttaacactgaaattgcctgaaacccatttacttaggactgtgttttgctctatgaactatcccctgcgctttgaacgtgccagcagcccttgtttatttgcccagccttttcacttcctctccacaggagtctctgctggctcttgccaaagcagatttcctaaggccactattttaaaagatcatagttgctaaagtatgtgctgtgtatgtttatcttcttacctagttttctcaaaacctggcagcttgttcattgtgcacacagcagcttcatgtctaactctgcttgctaacctgacagtactggtcactcccagttcaccaacgtattgtgttccttccttccatttttcttttgagttgatgaattttgagagcgccacaataaaattcttcctcttacattagctgtgttctttggttctgaccaccttacttgttcatattttctaaatagtttcctgttaccactgaatacttgaaaactgaatgggtttaaagagtttaattataatttagtttaaattttggagatattttactctttcattccattttatgaagaaaaattctcacagtcagcattcctaggtacgaagtcttttcatgtggtgattttctgaccctttcttctt

SEQ ID NO: 29827 - DNA, 1196 bp, Mus musculus
ataggtctatagaaatctctttaggttgggacctttcttccttcctttctttctttctttctttctttctttcttttttctgtgatttagttgaaaatattttctgggccttggagctctgactctaccttcttctatttcaattatttttatgttaggacttgtcacggtatcccaggtttcctggatgttttgtgtcagaatgttttagatttaacattattttctcactgatgtatcagtttgtcctgttatatcttgcatgcctgagattctcccatctcctgagttacgttggtgatgcttgtatttgttgttcttttccctagattttccatctctaggatttcctctttattgcttctcttttcactttcaggtcttgcacagttttatgaaggaaatacttcacctgtttaattgtattttcctgtatgtctttaagggattcatttgtttccactttaaagacctctacctgtttgattgtattttcttgtatttctttaagggatttgttcatttgctctttaaaggcctctgtcatctttataagattggatttaaggtcattttcttgtgcttgagttgtgttaggatatccagggcttgctgtaggagggcatgtgtgctctgaaagtgtcatattaccctggcttttgttgatttttttttgagggcctttagccatctggatggctttggtccctggatgctcctgttgtaatagatattgggagggaggttaaccttgatgctgctgatttgccaggcctctaatgggtatccgtgggttgtatggttccatatctgcaggtctgtttggttcaggatctgtagatcccacaaaggtgggcagaggtggatggagagtggaggtcctcctgtgccatcaggctgctcagggcagctcggctggctccagaggtctcagcaagcagggaagaaaagtctgggaagggaagcttccctgtatggcttaggatccacaggtctgatgaaggtgggcggagaggagggtggagaatggaggccctcctgggctagcaggctgctcagggcaactcggcgggctccagagcaggttaatatttcttgtttgctgtctctgatatgtaactgctttctcacttacagttactctttttcttttctctttctttttctttttctttttcaacatttactatcagtat

SEQ ID NO: 29828 - DNA, 1205 bp, Mus musculus
cgcccagattctaaaactcaagtgactgtgcagtaaatgcaagattggggtgctgtgcttcccatcagagtccacacgattgttatatctgttttgatgaagaagtttgtcttgatgagatgagggatgctctgaaggagaaagtgatcaaggctgttgtacctgcaaaataccttgatgtggatacaattttccacctacagccaagttgcagatttgttattggtgggcctcagggtgatgctggcttgactgaccgaaaaatcattgtggatacttacggcggttggggagctcatggaggaggggccttttcaggaaagggttacaccaaagtggaccgttcagctgcttatgctgttcattaggtggcaaaaaatccctcgttaaggaggtctgtgcaggagggttcttgttcaggtctcttatgctattggagtttctcatccattgttgatctccatttcccattatggcacttctcagaagagtgagagagagctattagaaattgtaaagaagaattttgatcttcgccctggggtcattttcagggatctggatctgaagaagccaatttatcagaggactgcagcctatggccactttggtagggacagcttcccatgggaagtgcccaaaaagcttaaatattgaaagtgttagccttttttccccagacttgttggcataggttacagagaagccttcaagctctgagggaaagggccttcttcctaaatttttctgtcctctttcagctcctgatcagttgcagtcactctaatcaatgacatgaattttagcttttgtgggggactgtaagttgggcttgctattctgtccctaggtgctttgttcaccattataatggatatagtgagcataggtgagccatgtaactgcctagaaacaaacactgtagtgaataatgctttgaaatcgaacctttgtgccctatcacctaatcctccaaagttctaattgcaattaccttcccaccagatgctgaaaacgtccttgtagtgtgcacgcaaagtacttgtagtttgactgtagactctggcaatgccacaaccctgtcagcatgaatctacaatgtcttgagctctatttattgaatgtgaagcccctgcccttatcctccctgtaactcatttctaattatgtagttctttatcagggagtgttcctatccaatcagt

SEQ ID NO: 29829 - DNA, 1466 bp, Mus musculus
gccgcctggcgcccattaccagcgaccccacagaagctgctgccgtgggtgccgtggaggcctccttcaagtgctgcagtggggccattatcgtgctcaccaagtctggcaggagtgctcaccaagtggccaggtaccgccctcgggctcctatcattgccgtgactcgaaatccccagactgctcgccaggcccatctgtaccgtggcatcttccctgtgctgtgtaaggatgccttactgaatgcctgggctgaggatgtcgaccttcgtgtaaacttggccatggatgttggcaaggcccgaggcttcttcaagaagggaaatgtggtcattgtgctgaccgggtggcgccctggctctggattcaccaacaccatgcgtgtagtgcctgtaccttgatggccctctggagcccctcttctagcccctgtcccttcccctcccctatcctttccattaggccagcaacgcttgtagtgctcactctgggccatagtgtggcgctggtgggctgggacaccagggaaaattaatgcctctaaaacatgcaatatgttttattattcagggccctacctgagccaggggtggaggaggaatgcaggactggaaaccctctgactttatcacagaagggcagcagcatctctgtactttgtttctgtagaaagttgtcagagaattcccagccctagcctggagttaggaggcagcaaaagagtaggggctgagggtgtggggcccagggtcccagtgtagatgacaacgtctggccctggccctggccctgacctgctttcccaacagctttggcctccccactccttgtgcactccacttctgtcactgcagacactccactctccaccttgtactctgcagagtctccaggccttttgctatagtgctcacctgaatgtcaataaacagcagctgaagaaaaaaaaaagaaagaaagaaagaaaaattatccaataaaaaataaaaataaaaaaaggaacttagtgatttggcccgtggccctccaacacaatgtaggtccagttggaaatgacatgtttcattggcaagccacaattatggaacctaatgacagcccatatcaaggtggtgtattctttttgacaattcgttttcctacagactcacccttcaaaccacctaaatgggttgcatttacaacaagaatttatcatccaaatattaacagtaagggcagcatttgtcttgatattctaagatcacactggtctcctgctttaacggtttctaaagttcttttatccatttgttcactgctatgtgacccaaactcagatgaccgccctcccagtgccagagattgctccgatctataaaacagacagagatggatacaacagaatatctggggaatggtctcagaagtatgccgtgtgatgctaccttacagtcggaataacctgcattatagctggaataaac

SEQ ID NO: 29830 - DNA, 1390 bp, Mus musculus
tggccatcaatgggaggagaggccctttgtcctatgaaggctctatgccccagtgtggaggaatgctagggccaggaagcaggagtgggtgggttggtgagcagggggaggagggaggggataggcggagggtgtttttcagaggggaaaccgggaaaggggataacatttgaaatgtaaaacatctaattaaaaaaaattttttaaaaaagaaaaattgccccgcacagcagcgactcgtccttactcgactgacatccctctaggtatcgcagcagcaaccgaagtttgcccgaggactttaggaaccatgccgaagccacacagtgaagcggggactgccttcattcagacccagcagctccatgcagccatggctgacaccttcctggaacacatgtgccgcctggacattgactctccccccatcacggcccgcaacactggcatcatttgtaccattgggcctgcttcccgatctgtggagatgctgaaggagatgatcaagtctggaatgaatgtggctcggctgaatttctctcatggaactcatgagtaccatgcagagaccatcaagaatgttcgtgaagccacagaaagctttgcatctgatcccattctctaccgtcctgttgcggtggctctggatacaaagggacctgagatccggactggactcatcaagggcagcagtaccgctgaggtggagctgaagaagggagccactccgaagagcaccctggacaacgcttacatggagaagtgtgacgagaacatcctgtggctggatacaagaacatctgcaaggtggtggaggtgggcagcaagatctatgtggacgatgggctcatctcactgcaggtgaaggagaaaggcgctgacttcctggtgacggaggtggagaatggtggccccttgggcagcaagaagggcatgaacctgccgggcgctgctgtggatctccccgctgtgtcggaaaaggacatccaggacctgaagtttggggtggagcaggatgtggacatggtgtttgcatctttcatccgcaaggcaaccgatgtgcatgaagtcaggaaggtgctgggagagaagggcaagaacatcaacatcatcagcaaaatcgagaaccatgaaggcgtccgcaggtttgatgagatcttggaggccagtgatgggatcatggtggctcgtggtgacctggacattgagattcctgcagagaaggtcttcctggctcagaagatgatgatcgggcgatgcaaccgagctgggaagcctgtcatctgtgccacacagatgctggagagcatgatcaagaagtcacgccccacccgtgctgaaggcagtgatgtggccaatgcagtcctggatggagcagactgcatcatgc

SEQ ID NO: 29831 - DNA, 2284 bp, Mus musculus
gagctttttgttgtctaaatgagtgaccttcgcttcattccacctgctgtcccactgcatgagactgcacctactcatcactgcgctgacattctggcagaagaaatgatctgaaggatcagatcagccttggcctgaggacagtagtctcgaggttaaaggtaagcagaaggcagggacagcagtttggtggtgaacagaaagcaagtgatctaggccagcagccttcctgagggacgtcggcccagaaagctgaacttgtgactttaagacaagctctatgaatgtcaaagaaaagttgacaacaggtatgcttttgccactgtacggggcaatatacaaagagggctgttgacatctgcagaaaaagacctaagatgctgtggctaaaaaaaaatcaggtggcagatctaaccgccaatcaggtggcccaaggagcaatgatcctggcagtcaaggagcctaaagattattatgacatcagagagaccagctttagatacacggctgagcactatcaagttatggacagtatttgacttgacctgggggccaagaaattcaaaggtgtggttaggtcctttgactactatgttacaggactctctgacttggcagaagaaatagtcaaaagcttcaaggactgtgctatgatgaggtagaatttctaaaagaaatcttcccaaggtaatggacctgcctttgttgcccaggtaaatcagggactggccaagatattagagatcggttagaagttacatagtgcatgcaggccccaaagctcaggacaggtagagagaatgaatagaaccattaagggacccttaccaaattgacagcggagactggcgctatgattggatagctctcctaccctttatgctcttcagggatagaaacacccctggacagtttagactgacccccctataaattactctacagggggcccccctccactggtaaaaatagcctctgtacatagtgctgacatgctgctttcccagcctttgttctctaggctcaaggtgctccagtgagtgagacagcaagcaaaaagcagctccagaaggcctgctcaagagaagaagacctgctacattagacatctccacgcagaaaaccttgagactccggtggaaaggcccttatcttgtactcttaaccaccctactttctacctttatgggaccccttttaattataggtccatgtgtgtaaaattggcaagtcacctttattagaacaagaattagtgcagtgcggcttttagttttgagacaacagtaccacgccctaaaggatcaagtatgtcagggaaaagatagtgtctagttctaagattagaactgctaacaagaagaaggggggaatgaaagagtagtaaactcagtgctccaaggtatgctaatcataaaacagatagtgacattcctccacccacccacttcctgagttcaaggagtattcattcaaagaaagtcaccctgaccattaccggaagctgcaatgcaaatgtgctattgttaggggctcttagaaattgtcttgagagttaacaattaccaggtattccttgtgacacctgtgactttgtacttccttgtgactcttatctggtatttttggcattttccaacaacgcccttcccacctccttgagttgtgtttttttcctttaaatacccccttactcagctactcggggcgccacagtcctctacccctgcgtggtgtatgaccgtgggcccgagagcgctcttgaataaaaatcctcttgcaatttgcaaaaaaaaaaaaaaaaagaatgaataaataaataattaaaaaaataatgccacttcctccattaattgatggcatctcacatataatattgactgacatcaatgttggtatggtattgaaaataaaatctcatattgttgcctaacttgacatctttttttaaaaaattaatttaattttagttatacttaattctgtgtcccaaatgctaaaccaagcactgtcatctttctgtttgtgatgcttgactccctctgtgtctttttcccttatagttatgctcctttgtaaagtgttgtacactgccattgaattaccgtccaaggtctttagcatgccatacaggaacatgactcaactttcactgagctcaaacttctacacactcactcactcctcactatctcaaactagctcagggtcctgtgtgtgagtatgtattgctgtgtgcccaccagcacagatctaacatatagatgtctatgcattattgtaa

SEQ ID NO: 29832 - DNA, 2231 bp, Mus musculus
tgggaagaggagagagagaaggctggcattggactataaagaatgaataaataaggcgccacagtcctctacccctgcgtggtgtatgaccgtgggcccgagagcgctcttgaataaaaatcctcttgcaatttgcaacaagaccgttttctcgttggtgattttggggtgtcgcctctcctgagtcagaacgtgggggagtcctcacgttgtgggtctttcatttggtgcgttggccgggaaacgcgaccacccctcacacccgagaaccgacttggaggtatggggatcccctcttgcgtgcgtgtgtgccggccggtgtctctgttttgagtgtctgttttctgaaatgaacattggaacatgtgcttgttgtgttgggttgtttgtgtcttgtcctatgtttctgaagtacggcgaagtctgagtttggatccgtctgagtttattgaatttgtgccttggttttccggttgcgagatcgtgggttcgagtcccacctcgtgctttggttttacacctggcagagtgagaaacaagtgagattctctggttttggttgtctaggtagaagtggacgacggtgtttgtagacgatggggtgatggggttttctgaaatgcgcgcgcctgtatttgcagctgtccttttgggccgtaaggaccggaggactgtggtcggcagacgtgctaagaggaccacaggctgtggccctgggggacgccctgggaggtagggagagtcagggacgcctggctgtctccggagatcggtcagagggaccgagttctgttaaagcggaagcttccccctccaacatcgtctaattcttttgcctgcttgtggaggacaagaaagggtcgactgtgtctggatttgttggtttctgttttatgtatttttgtgtacgtgtttagagctatgtgaaaatctagagaaacaaaggtaattctcataggtgctgtataccctgactagagatagtttacacctgagacgtgagagaatgggttttgagaaaagcagtactctccgactatctggagataatttggtaattaaaaaaataaaataaaataaacaatattaattggtctttggaaccctgcacctgtagttaggaatctagtgtggctagagaagccctgctaggcactgattataaatgctgttcttatagggaccagcagcttctcaaagttctatggtaagggaacagatggctgtttttcctacaaaaattggattcatcaggtgacaaggtgctcctctcttgaaattacagctagaaaaaaaaaaagaattttgtttggtttaaatggacaaatgtacacgaccatttcatttttgttcctaaatagtttcaaaagtataaatatgttttatatgtcttggttatagattagtggctcataagttattggttatgattaaaaatttgtaacattggtaacaaaaagttgacttaaaactggtaactctgggttagagtaatttagaactacaacatgcagcatgagacaacccataggaacaggtctctaaagatacgcctgaattgggtaatattctatgtaattcttatcctagaaacccgatttataatagatatattggcggctacaccttcttgtgtttgtgtgcaggaacagacagccaaactttgtagcaagtaatgtttttggagttcatttttaaagaaaatagattgttttcactgttaaaattgggttttgcttctcaaaattgtggttgtgctctcatgttacaagagaaattgaaggcttctcccgaattggagccaccagctaaatcggctcctctaaaatctataaagcctcctgagtggcctagttcacaaccttccccttaaacacagcctcaaccccagccgccgagggaaccccaaacccctcggggcgttgagaggtggaccgctgtgagtacatggagccacagggacccgcagagcagagactctggtggacccgcccaaactttaaacccttcagtactggtcattttcctctgctggtatttataactggaaaattaaccaccccctttctcaggatccccaatgcctcacagggttggtggagttccttatgttctctcatcagcctacttgggatgactgtcaacagcggttgcagatgctcttaacaaccgaagagtgagaaagaattctgttagaggctagaaaaatagcccgaaagccaacggtggtc

SEQ ID NO: 29833 - DNA, 1165 bp, Mus musculus
agccagcgattgcataaggtgaggaacaagacaccttattaaattcctcagggcagtacagcaagtaaacatagttgatcctgataagccacgtgataggatttactccctccccgcacacactgtttaaaaatgctttatctcaaatgttgtgtatctgaagagagatatatctgcagattatcacaaatgttagtcttagtaaataattagtggggaggtgcagaacttaggattaacctgaagcctccttaagatgtattaggtaattcctcttttagtattaagatgctatttaaataaaacagttattttgatcagcttcttctttctctctaggccccttgattgaatttaaacagtctcctagattgattctgcctcccaacaagaacaaactgaggaagtgatgagccacgtagccggtgacccttagagttttagatgtgcggttcccttcatgtatactttacagaaaaccagctaagccgggcgtggtggcgcacgcctttagtcccagcactctggaggcagaggcaggcggatttctacaaagtgaggccagcctggtctacaaagtgagttccaggacagccccagggctatacagagaaaccctgtctcaaaaaaagaaagaaagaaagaaagagagagagagagagagagagagagagagagagagagagagagagagagagagagagaaaagaaacccagctaaagtagagaaaggtgtttagaaaacttaatgttaacttttttgttttaacttttaattctttaggaatgtttcttaagtagtgatttatattagctactgggattataatgctaagctttagacattttatttggaataaaatgttatatggattcttttgtcatgcatgtgatttttgtgctcattttgcaataaagttaagtattttggttttattttgtttggggtttgtttttgctgaattcctcttctcctagggcacagtgctagtaagttttagtacttgtagtaattagccattcataagaactcagagataatttaagatgccagaaagctttgtggtgaagaccaagttcaattaaatcgccagccagtacctactaaggtccaataatcattcacgtgtgcatgggtggactaagaataagggaactgcagtaa

SEQ ID NO: 29834 - DNA, 1149 bp, Mus musculus
cctagatccgccctatctagactgtctctcaagaatgatcaaatttaaagtcaaagggaaatcactggagttagttctaaagtaaatttcggtgttgcttattttattcatcctttagagatgaagataatatatatgtgtttgcagttctggagaccttggagaagaatcaagtgaggtgcattcagctctaggttgaagatagcaatacctaattgggaaacagtctccctttccctttaatttctgagatggagagtaaaaactgtaatttccctcttttgtcctttacagattctaaaaatggcggccccaggctgatgttgtggtaatctaatcagctcgggtcctccacaccccatgcagtgcgtttgtctgcagtgtattacaagcgtattatgtttacatgaaaaagattgggcttgcccccccctcctccaagccatttacaaaaattcgtcaattttattgcaaattacagtgttgtgttatagttgattaattttattgggttttcctaagaggcaaataaaacaataccacttttgaaaacaataagacatttggccttggaaatttcatggtcggggggcttttaaacattaaacatttattcgatgcagataatagtctgtgttgactttaaatcgcccatttttaactaatatgtcaaagtaaaatgttttgttaagtagcccattttgcatgattgggaatttttaccttcagttaaacatttctcactcaactcctaactaattttgtatattttggttcttgtattctgttttggagtaaaatttagggagctgtacaaacagacctaaacctgttactcactggatataaggattcttttcttcctgttttttgtgttgcctctgttttctcctgtatttaaagctttaatcatttccagttgcttgtatatgtggtaaggtgacactccgtgctttgctgcctcttaaatttgtcttattgcatactatcatcattatgtaagttaaaaaataaggctttggtcttcattccttcccccatgcccagttccttattggattgggggatttgttgtgatagtccttaaataaaagcatttcttaatagggacttgaatctgttttatgccatctttaaaatcttgaagtc

SEQ ID NO: 29835 - DNA, 1639 bp, Mus musculus
ggcagcaccagccagcaatcagttcctggacatcacgttactccagggcattttctgccatctcaaaaccccaccattcaccatcaacctgctgctgctgctgtggtcccgcccccgcccccacccccgcccgctccaggaccacacctcatacagcagccaagctcacatcagcagcactctgtagcacatggagttgggccagttcatgctgttacccctgggtcacacattcattctcaaactgcaggacaccatttaccaccaccccctccaccacctggtcctgccccacatcaccatcccccaccccatcctaccacgggactgcaaagtctacaagcacaacaccagcatgtagtaaactcggcacccccgccccctccccctcccccgccccctcccccagccagtgttctggtttctgggcatcattcagcatcaggtcaagccttacaccacccacctcatcaaggacctccacttttccctgcaagcgctcatccagctgtcccgccgtacccctcacaagccacacatcataccactttgggaccgggaccccaacaccagccttccggaacagggccacattgtccattaccagttgcaggtcctcatctccagccccaaggaccaaacagtattccaacccctactgcttcagggttctgtcctcatcctcatcctggctctgtggccctgccacatggggtgcaaggacctcagcaggcatcgccagtgcctgcacagattccaattcacagagcacaggtgccgccgacatttcaaaacaattaccacggttcagggtggcattaaaatggactccaataacattttttaaaatgttctgtaagataaactgtatatttcatatgtacctgttaaggtactttttaaagcttgtacatgaaactttgtataaaaaaacaaaaacaaaacaaaaaaaaaaaaacaaaagcaaacaccagtgctctttcattgtatctttcccatttttgctttttacacttccttatgaaatgtgctcttaagccagctgtaggtatctttattttgtaagtgaacattccaactgtttttctgaccatagatctgatgatacatgacctttaaatttcattgttgcagttaaattcatttaatgaatattttctgtattattttatacatatgcattaagtatacagttaaagaaagcactaaggatttccttttttttttatggtcagcagttatttgagtgcatcttaggtctgaaaatgcaatacaggtttttatgatttggtgtggacatggctcatattgttttatcagttttttgcaagcaaaatgtaatttaatgtatagataatttttagtgtctcctgacagactgtaaatactgaatttcctttgcgtatataattgctcccgcccttttcatttggaatatagcactgtacatatggcaagtctgctgcaaacgtgtgatctctgtgaaagtagtacagcacatgacctttcctttttatttcaatacgctgtcacattgaagcactggttgggcattttaattcatgttaataaaccacaattatgtcagttttactaaattgttctgtacaacttctgagattgaggtctgcttaatgat

SEQ ID NO: 29836 - DNA, 1143 bp, Mus musculus
tcatatttgagccgtggaaaagatcaagacttttcaactggggaattctgctgaagaaggtactcacagaataatctggaaccatctggtatctatagagtgaaacctttataaacgaataggcttccagcaatcctttctcaaacagctaccttgtaactccactccaagcaccagtgtgtgtattcacagatgtttagaaaggacttcaagcgggttttgggcgagaaccagactcagctgggtgtgatgatcacccctgtaaccccagtactcggagccgagcctggggaatcaagagtccaaggccagcctagatcacacactcacaaagctagacttctcttcctgttcctagagtttagtgagacagcctgcacatgggtgtcgtgatggccatggcattttcttgggtgtgtctcacctctttggcattgtgtgggcctgtgaagtcaggggacatgtactttgggttatgtagacagtcccatgggtgactggttttaatgtcattgtgtagtttgcaggtagtaccaggtcttaaacatacctccaagcagtgtctctctctcctcaccctaagaagtggatcctcagagaaggctggagcaggagggcggggagctcaggtcgtccttagctacactggccaccacaggttaccatggcctgggggatcctgccgaggacaacaaaactctggcgctcttggcttgggagcctgtgtttaccagcttaggttcagttgtgtttatatcctctgttaaagtttgcttgaggagctgggagagttggtaaagtggttgccgtatgccctttaagggctgagctcagtcccagtgcttacagagacaaggcagccgtatcggtacatatgcttgtgatcctggcgctgtggacaccaaacacacacacacacacacacacacacacacacacacacacacacacacacacacacacatacacatacacacatgcacacatgcacacacacacacacacacacacacacacacacacacatacacatacacacatgcacacatgcacacacacacacacacacacacacacacacacacatacacatacacacatgcataccttgagtaggcatagagtccagtccaggttatttca

SEQ ID NO: 29837 - DNA, 1146 bp, Mus musculus
tcctctatccctttgcatctctacatccttgcatccctatgagcgccgcttcctcctctccggcgggcgtggaaagggcacaagaccaagagctgaggaacctgggtccttgagtgtctgtgtgaccttggagaagtgattttcctctcttttcctactccattaggctgcgtgagtttaacgaaggaaagatgcacacagcttaaatggaaagtttgtcacagaaagcctaattttctaaataccatgagataagagcctaaaacagcaatcatgccaaaaagtgattttttttttcttcctcctataatggggaaactaaaccctaaataggtcaaacagttctaccagcctgtatttctattcaggcctggctggtttctctttctgccttcccaggctacctggtttctctttctaccttccaaggctatctaagatgcaaatcacgctgactgacacgtagttaccacttcagtgttctcttgtctctttgaacaattacagtatcttaaagatactggtcctgaacactcagtccttcattggttacaattgtatcgttgagttacaactgtatcactgagtcttactctaaagatgtcccaacaaacaggaaaggccgctccaagtttgaaaagattttactttctccattttttttttcaaaaaatctgaaacatacaagaaaaatgcagtaatcggcactattaacccacattcactaggttttttttaaacgtttctccacagttgctctgtgtgtgtgtgtgtgtgtgtgtgtgtgtgtgtgtatgcatatggtgtattttgctgagtcattcagtagtttgcagactgttaccctccaccccaaaagatttcaatacatatctactaaaagcaaagattttttttttctacataatcagaacgttatcactctaagaaaatccaataaaatatgtttggcgacattttttttccaacccaaggtcatccgttactgttagtgcccatgtgtttttaagtgtgtttagaataatccctgggttgggactttttttttttttttctgatactttccctgagttccaaggcaggccttgaatttacaatgtagccagtctaagtacacctgcgttgcaggcctcttgccttacttag

SEQ ID NO: 29838 - DNA, 1283 bp, Mus musculus
ggctacacagagaaaccctgtcttgaaaaaaccaaaaaaataaaaatattaatatttgaatataataaagtaaagcctctgaagtaagaatgagcaatatttaaaaagaaaatgtttcaaaaaatggaaaatgatatagcagaaggcatctggaccctgtgtagttccttttgagttaccatggggtgcgtgggttacaataggtttaacaatctctccaagatcaggatcaagaaaaaggattaaatcttgtcttctcttaaattcacaggaagcagacttagggaaggagcggagggacacaagggtacaaggtgtcggaccaaaattaggggatcttctaaatcagaataaaacacgttctccactcaagtcagaagaactgtccattcaaagcctacagtgccaacctatgacaagattgcaggatggcctgttaggaagcccacaatgactttcccattcactataagttacccacagatgaaagaatttcacaatgtcacaatgaatttggttgccgacacagagatcctagatctaaggagatttcaggaggcagaggtaggctgctgaacacactccatgtgaacaactattatataacttgagtgtttacaaagtaacttaagctgtagatggagccatatcaggtccaggtgctagagaactttccattaaatctttaattttgagactgttaatgctgaatgcaaaaaaaaaaaaactattagaatttcaagagtcagatctacgcctatttatttatgggttaaaactactgtggatattaggtctagtatttccaattcagttatgattgggcaggcaattaccaaaggtggtctgagtgccttatacttttagccgaggcagacatttcctaaagggctggagacaagcagtacctaacaagaggacctaactccgctggcagctcctcattagttagatctggcagccatgttcggtcttaaatttcccaggacagcccagcttcctgtagaaaccccagaaagagggcagccaatcagcaactgtcctgatgtctggccaagggcttataacaggtatgaaagagtccctataaggtagcaatctctcccttgaggtacaaaccaaccagaaatttacgaatatcctataccataaagctcaaccaatcctggtgaaggtgacccaactacaactggaaaaccaactggttctaaaaggggcctactagcctccctcatggtccctgattgtgcttggatgattgacccctacatgccagctgtatt

SEQ ID NO: 29839 - DNA, 1265 bp, Mus musculus
cccgtgatctttggtcagtcttttggtcactcttctttcttgcccggcagaaggcaaatacagggctctgaagatggacttttctcttcctccttctacttacgccaccatggccattcgagaagtgctcaaaatggacaccagcatcaagaaccagacccagctaaatacgagctggctgcgatgaacagtgcatcgctcagagaggggatgcagacctgcttctgacctcctattctggtctttttttaagtgctgactcatgtttggagtttaaaacttttgtagtaaaggatgatttgtattttgtaaagtttttaatcagcttaaatactttgcaatatttgtacacatatacaagtcctgaggatcctaatttcagctcagagatcgaattgggtcagcatatcctgtaggtgcttagattctagtacagcatcagcttcctgcctttaacacagggaagggggacttggtttaaagttgcggttttaggttttgctgcacacctgaagtacaaaccagaatcttagatgtttgtgatgagattacacatggtccgtgtcagagcaaatgcagcagactggaaactagagactgcacacttaacacgcagttcccgtgttggtttcaataataacaaaacatccacgggtttataaacacggcgtggcttttgttgagtgactgtgttagcttcaggtgagcatttatacacatcttagcttgcagtggcttttctggttagtctatcagcatctttcagggcactcttttccttgataggagcctgtagcttttcttgggtacagtctgattttactctgggtgcctcttactctcagaaccttttcactggactcagaagtaaatagtgtgagttccaggacagccagggctacacagagaaaccctgtctcgaacgcaaaaaaacaaacaaacaaaaggtaaatagtgaccatgaaggaaatctgggaaacttagaatggctcctgcagccgggcgtggtggccacgcctttaattccagcccccgggaggcagaggcaggcggatttctgagttcaaggccatcctggtctacagagtgagtttcaggacagagaaaccctgtctcaaaaaaccaaaaaaaaaaaaagaagaagggctcctacttccatctgcagcgctgaccctcagccagcagctgcttaggggtttccatcatggcagtgcagaaaaccctcctctaaaaagatggatatgcctttcagacagtgtgagaca

SEQ ID NO: 29840 - DNA, 1126 bp, Mus musculus
tctgcttaccaaacatggatatcctcactcaaatacagaaaacatggcatttttaaggagttagccgctcacctgagtccatctctcattatttatacttcagtcaatgtaaacatactgtctgtcacttggtgtttatgtcccctaatgttctccatagccaggagactttccatttatttataaccctaagaaaagttagatattttttgtttttgtttttgtttttcatcacatcagtacataagatgtctgtgtctctgctgcatgtctcaagttctcctgtcagtggtctgttatttcaaagtagatgtgctgcagggaacccataggatgatgtcataggagacttgaaccccctagggcttggtcagtgtcccctaatggatttaagagatggtactgtgtagaagactccattgttggtcagtgtcccctaatggatttaagagatggtactgtgtagaagactccgttgttggtcagtgtcccctaatggatttaagagatggtactgtgtagaagactccgttgttggtcagtgtcccctaacgaatttaagagatggtactgtgtagaagactccgttgttggtcagtgtcccctaatggatttaagagatggtactgtgtagaagactccgttgttggtcagtgtcccctaatggatttaagagatggtactgtgtagaagactccgttgttggtcagtgtcccctaatggatttaagagatggtactgtgtagaagactccgttgttggtcagtgtcccctaatggatttaagagatggtactgtgtagaagactccgttgtttgcagtgatgcttctggtgaggtgaaaggactgaagagaaagaaagccagcttgactccctggaaacggtcaactggaagtgagaagctttgagtggctggaagggaaaggtggagatctgaggctacttctctattggtgccaaaacaaaacagacagacagacagatagacaaaaaaaaaaaaaccaagggaagctaggcatggtgtcacgtgcctgtcgtggggggctaaggcaggaggatgtacaatgtctaggtcacagtgtcttagccttcgtgtcagacaagcctgcaaagggctcactgcaa

SEQ ID NO: 29841 - DNA, 1211 bp, Mus musculus
gtgggctcttgtaaacaagttccctgtgttgtagttttctttccgttagaggttagggttctgttgagccccttcgagagtgaagggcagcatgagccaccttctaaggtaaggagttatttttcccttcctcattcaggctcaggagacacatctgacgctgcttctggttttgaaatcagagaaaatgtttcactttcttaaaggaagagtactgctattacctgcagtactatttgcttctaaacattaagagtttttgcttctggggtggaaatagtgggaaagatggcccagagggaataaaatggactcccagctgtcagcagtatgaagattagagctctgtgcaggaataaatgctagtcagaggcaggccttccatcaccagatgcagctaggagccaccaggaaggtcctttctgaaggaagctgtggctgctgcttgtaacagtgctggttcttttttcttttgagcagatgagtgctgtgtccaggatgatcatgaattcaaggtatgtgttagatggcaagtttggctttccaggcataattccaggaacagttcttggccaaggatgagaactctaacctgactggatacgctgctgtgatgggttaaaggatttacctgaggccaatagaacaggcaggaatttaatgcagtcaccccatgtctttttaaagtagatgaggggttggagaatggagtgagagggcttagcagtgccaagcccgttacctttgattctgggacctggtggagagagccagctctctagagttattcttgcaccttcatgtgtgtgctagcacacgtgtgtgcacactcaaaataataaatgtaataaatgggagcgttggtgaatgtttaatacttagagggtgatatggctttgcatttcaagttgtgttcaaacatttctgagtagatccacccaatgtactgggtagtacattaagtgttctatttatactaaaagatggttaatgtcaacatagtccacacatgggtgtgttgctttatttattaagtaatggttgcagatgtacttacctctggtgttccttctgcagctctggagcttgagatgaactggtccgacttctagaagagaaggtaggcatctgtgtgtagagtcaaggttttaggttacctgttccccttcatatcgggaacgggtgaattctgaggcattctcattgtatat

SEQ ID NO: 29842 - DNA, 1211 bp, Mus musculus; identical to SEQ ID NO: 29841

SEQ ID NO: 29843 - DNA, 1211 bp, Mus musculus; identical to SEQ ID NO: 29841

SEQ ID NO: 29844 - DNA, 1169 bp, Mus musculus
tcttaatcctccactgttgccttatatccctcctgcaacgccctctgaagacactcaggaaactgttgaaggctccatgccttctacccctcaacaagctacctctgaataattatttaagactcctccaaacttgaccacaatggaaataacaccttggctttccatgttaatgttcaactcacttgatcttggttggcccttagactggcatccctaccaagcttaccaagagcttagacaggcagtttgagaggatggtattcatgccccttgggccaagtctattctcctgaaccttcctgctgcccttaatataccacaggactggcatgacatctgttgaccctccttgcctaccctcctgttcctttagtgggaggctttttatagaaatgaatgcctgcaacagatcaggaaaaatcaaaaccaaacccaacaaaatatcccttggggctttaatgagcttttgggccaagatgacttctccacacaacaacaggctacccaacctctggagtgctttggtcaagtacaccttgtgcacttcggatctgggatcacatagtccctgactctgcatcccaagactgggcttccttgcttctctgcctctggcagatacctgaaaaagccctctctgactttgttcttagaacaaacctgagcctggaaatcaaaattcctgactctatgggtagagaagtcctccttaaaagcatagtttggggaggcgtgaatttggaacactggctggtgtgtcagagctggaagatgaacattataagaaatgatagttgccactgaagacattgggaccctataaagccgcctcccttgccaaggccttcacagaggctcttaaaacaaaaactgttttaaaggtagaaaggaatacttgaaaggtgaatgtcccaactctgcaccatctaacggagtggaagctgcacaccccaaaagcctttgtcctcgacacctgaaaggattccattggaaaaagcactgccgttctaaatgtgataaggatggcaagcctgttttgcctttaaactccaaaaggggcaacctgcagcccaaacaatgtgacagaaaacccacaaaatgtgagtcattaatatttctgaagactcacacccctaactcaatataaaagttggaagagaactatt

SEQ ID NO: 29845 - DNA, 2308 bp, Mus musculus
tagtatcttaataaaacttcaaaatttcgggggcagacctagtaaatcagagctgaccttgttaaactagggatgctagtatccatctgtctttgtgaagacagtttcagagtgctaactgctggtctaatgtagggtcctcagtggtctcacagccctcaagcatgggcattagattctaggtcgtcacaattgtcataggttttgataaccaagtagcttttttaataacattgacatgtgacttcttagagactctcatttcaaatccccacttctcatttgtttctgtaataaaaatgcagcaccttttgcctctcttgttggcaataaatgagcccagcgctgcagacacttcgggtttaagcaggaaagccctctttgctcttgagctgttagatgagacacagaggaacagttgcacacacgtccatcctcttacaaattctgtaacagcttgcacagtgcaatgagtctcaagtttgctccaaatgatttacatcaattgatttcctggggtgtggtgttacatgaacagtaaagttcttttatactacttttgatactatttcaagtaaggattgtgtacatcaggggctttcataccagctgccaaggccggatgctgtcacctgtggcaacagctgttctagtcactttcctactcatctttcaaaggtgagaagttgtgtggctttgtaggcttgtttctattaagatgctagtgtagtcatctcatggatccagaggaatagcttttaccaagaggattccacacagaactggggtctggcaccccatagttagctctagataggggctttggattgactcaacccttgcacgcctctgacactgggcctggcatgaacctcggcaatccaagtgaagagagaagcagaggatccagctgcccgggtgctgctacccttccacttcctggagcctcgagaaagccccttggcatggctgggacacggcctgacccctttaagcccatctctgtagcacagaacagcaggaattccagaatgactggcttgttttgaaaaggtagtgtttcattgccctttcgattgtaaagcagcaactctgcaaatagcactctgctgttaaaaaaaaaaaaaaaaaaaaagttgaattaaagggaaatctgtctttaaatcaaaatagatttttaaaaatcccggtttaaagggattgtgcctattttgaagtatcatagttaaaatgttgaatggtaaattatggaggaaaatatatacactctaaaacatgattttaagcaaagagttagagtaagacagctcaatgtttacacccgtgggcacatgagacctcagtaaaggagagcacgctgaggaagcctgtgctaagtattgtaactgacagacaatgcgaaaacgcacaatgttggcactaaggcactgtagatagaaattaatgtacaatagtgtcttcccaacccgagtgaaaggctaaaaccccagtcctttagtgagcacgagtttacacttgcacatttgctgctgagtggtagaacattgggaaatggagatgtgtgctttttaatactgctcgtcttcacagagagcactcgtgggctgccttctgtactttgtaacttgcacatatccaaaaagactgagcgtgaacaatttgaagatgttttgtatttttgcagaagcgtgctagtggacatgggcctcagttgtgttttttgggccccaagttgtctgtcttgttggaactggccatctgcctctggcctttccttctgatcatgtgatgctaaactcttctcacaaatacacgtgtcattgtatgcctagtgtttacattcctaagaataaatcttggatatcattatgtgctctttacatttttaaggtttgaaataaactggagttgagttctttgaagttttgtacatttgtataaatgttctccatatgcagtactttatacatcaagtgtttcctcttgttttgttgaaataaaaactaaaagaaaaaaagtgttcttctagatcattctattcactaaaaactgctataaaatctgtgagcttgctattggggcagaagaaagcttgtgtggacatagccacaggaagctgctggggttggcccgccgttaccctcactcctgactttatgtctcaggatgaggaactggaaccgagcatccccactggtgtccatccgaagctgagccccagggccctggcgtggtggctgacttataccagaagcatgagcaaagtggccttcggtgtgggggcatggagacagggaacacattgggt

SEQ ID NO: 29846 - DNA, 2272 bp, Mus musculus
ttgtttaggagatacagaattaacaggtcaagaagaactgatggacataactgaagttgacgagggattttattccagggctgcgtctagcaccagccagtcgggtctatcaaacagtagtcacaattgtagtaacaagacaagtgtaggaaagaaccagagacggtcgggaggaagcaaagctggagcgaaggagagagaaactgcaggggagtcttgcagagatcactttgctcgcaagcaaacccagagagcccagagcgagaaccttgagcttctctctctgaagagactgaccttaacctccagccagtccctgcccaagcccagcagccaaggcctggctaagactgcggccactgtatttagtaaatcctttgaacaagtcagtggtgccccagtcccacgtagcccttctcccgccattggctgtgttgctggagcagatgccaatagattttctgcctgtagtctccaagaagaaaagcttatttatgtgtcagaaaggactgaacttgcagtgaagtgtcaagccggccagcagggacctcctagtattagcgtcactctgtctgcagagtaactgtcacttcgctcctggagccagtgaagctggaaagacggctctgctcccttatgaaagcactgagtcttcatgcctggtcctggcaggagcctggggtcttgaattctgaaggcccccctttgactatgaagggaataatgtctagtttgcagtaagctgagatgtggtcgtgttatttcttgggaactcttttcccctgggtttaagttctttattcttgtattctcctttcctgttacttgttactgttaacgtcctcagtgaggttatttttaataccttgttttttagtggttgtgtatttgccctgggaagtcaaagagagtctgtgagaggactgggctgtagagcccagggggaggagcgagtccatgaagccatgctgctccacaggcatgtgagaaaacagcctcacgtgagagcagtggggatgctacgagctgtgaccacatcatgcttaggatgggacagtgtgctccacaccgcaagttgcctggcaggacagttgcaaggggaagctgggagaatttctgttgcagtccttagaacattaaatagcaaaagtgagattgctggtaggtgaccttctgaagtgtgtgatctggactgcaggcatgaaagtccctttcggtgtctaaagtgtaaccagccacaaagctgttgggctgtgctgctctggaaatcctagttagtttgtatcttagtggtcagagcacacatcatagaagacgtcctgaaaacccctgtaaatcttgtagcacagctaccgagataccagaatgaagcatttatttaatagtaaatgtctgtgaatgaaggaaaccaggtcatgtttcatccacaaaatgtggtgaaagaaaacagtaggtgtgggcagaggacatttgtgcattagcttgtgtttgttcttgaatttaacataagaaagagtgcacttcttgtttgtgagctttaagtattcttgttatgttgtagaaagaattcagctatcacccattcctgccaaccaagcagtaagaaatgtggtaaggcagaagctaaactctgcgtcctctagatggacgcccaggcttggtgcctgtggtctgctcagttggctgacgctcctgtgaggtgcacgtgctgtggtgctacactggggcatgagaggagcagggtcagtggggaggcctgggactctgtctacttctcagctttcctgacttagcacactgaggcctccttaccggtggcctctcgctgtgctcacagaacatgctagtggtcctgtctcaaaccacgtgggtccagctcatggagatgagaaagctgcatgggttgcagagtgcaaagcatttttacacttgagatacattttttaaatgcttacctcctagtttaaacctgattatccaaggcctatgctttttagcataaatgagcttaacattttattttagtttcagtaacagaacgaactgctggcttaaattgtcctcatcaattttaaggtaactagatagtaaaattgataattggaataatctaatagtaatcttttatacagttgaaatgtttgtaaaatgtcactgtgaatttcctgttgtctttttgtaattccttaagaacttttcttaaacatagttactaacagtgttgatattattaagaagaaatttaaagattgtcactaggcaagttgaagtg

SEQ ID NO: 29847 - DNA, 1104 bp, Mus musculus
tatctaacagtttgtgtgactccgcctgagtatcagttctgactgacattctgaatacttacggattgtgttctttaagatggaaaggagaggtgaggtccttctgtagacacatggcatgtttgattgacttagagactataacttgttagtacagaacagtcactacactgtctgtgcctcagccatcccgagaacagtgggactttaatgtcgttggacattttctatgtggtctgctatgcttttgttttgaaaatgcaacagtacacatgttacctactgatgctaatggtaactgataatggagttttaactgtctttaaattcctttaattctggtctttaaaaattgtcttagagggaagaaaggggagggagagatgttgtaattataacctcaaaaaattaaacctggataaattgtcctaataactaaattttatttttaaaatgttgcatgcaaaaggtgacttttaagatatttccttttacttttgtaggaaatagttgacaaacacggacatagtaaagtattgagttttacaattccatctttatccaaaccatctgtatatcatgaagtaagtagttttttatcaaagtacatttgttgggtcctaagctccaatagtcccctaagttagggtgtagttacctgtgcacagaagtgaattgttagtacctcaaaaggtattgatcatcaccacatggagtgtttactctttcaaaagagaagtcaaaaatcactaaagaactgaactaagatctgacagtgagagccttatcaaaagcactttttatctttgtataatgagtaaggcttgtcttaatttgtgtctgcatgtggggtgagtggataattgtgtactctgtgattgaattttggaaatttaaattttgattttcatttgtagtttagttttaacttgttattaaatcttggggtggaaatgtgacaggcagtctgaatatccctaagctaaatggtacacctagtaggcactctccatgctttgtgcattcttagtatcaccttcaacaaaacagcatctcttctctagccttccagcattgggtctatggcgctgacggagagtgcgc

SEQ ID NO: 29848 - DNA, 1719 bp, Mus musculus
tggctttgaaagccctgtttttatagtgctgcagatcaggctgggctcacccaggccaggcggattctacctgacccatactcctccctaactatggcttctgagattgacttgaatacgtttatatatatatatagctttcagtaatttgagggattttaaagtttaacttttctaaacacccagctaaataaaggatagccaaaaaagtcaataagcaagggactcttttgtactgtaattacgagtggaactaaacagtacagtgtactgaataaagtaattttctcattctactccactttctgtccctttaaatagggatgtgaacagtggtttctggagatcaaacccaggtacagtgtctcctgcatgacaggaactccgtctcccaactctgacttgtgcctgcatgtgtgtctgtgcaccacgtacatgcctggttcctttagaggtcagattccctgcagctgaggttacagttgtgaggcaccatataaaggtgctaggaactgaactctcgtcctctgaagcagcagtcctcctaacctctgaactatctacctctccagtcccaagccctcaccttttacatgggagaaaatcaaacgtggaaggagccgctgagtgggtggagcagtggctgcagagatatgcagatgtgaggacccaagctgatgcccagcacttaggcatgggagtgcgtgaatctgtctccccagcactcaagaggcagagacaggtagatgcccagaacttgctgaccagccatttccagaaaccctgtcaaaaggatggagaaatgataggggaagacacctaacaccaacctttggccatcacacacacctgcgcacaaacacacatgcgtatagtagaccaaaaaactcaagcaaatggcttacctattgaaggatgggcactccaggtgttcatgaacagtgcggagcattctttccctcgggatccatattctgacccttttaaagtgtgattcccatctaacatcagaggcgttgctcttctatggagtccagcaaatgcagatcaactacacaatgacaggcggaccaatacatgcgtgtcattaacaaagaatcttccatcacgtgtcctttcacgtgcttgctttagcagagcatcctctctcctgtgtctgcttcagcgaaacatgccgtcacgagtctgccttagcctttcacacctgtgtccactttaacaaaaacgttccttcatgtttgccccagcaaaacatcatccaaacaattttccaaagaacccttaaatttccacttcattatttaatctggagtccaccctgagaagtgggtatggtacggtatgcatccactttccacaatgaacatccaataaacaatatagataaacatggactgtctgttatctaccaccaccatggggagcatgcaggtctttgctacagagccgctgcagctaaatctcaggtagaaggcctctgtacttccagcctcctccactgagctaaggacaatcacccctgagacaagctggcacttcccttcctccccaggctctcacctagatgctgtccccagcccgtgcacacacacacacacacactcctccgttctcagctcttctgtgactcccaagagtccaagaaccccactgccccagccttgtcacagtcctggggaccgccgagccagctccagctttcccacatctcagactctg

SEQ ID NO: 29849 - DNA, 1208 bp, Mus musculus
tcccctcaggtccccactctgcccacctaagcctctctgacctccagtctccgccccttcctcctcccccacgtttctgacctccggtctccgccccttcctcctcccccacgtttgagtgccttctcaagctctgtggtctttgcaggtttcccagttcgtggcgtttgaggagcttcctgcaggagccccagagctcccccaagatggccccactcgacgcctctccctgcccggccagctgggggcccttacctcccagcccctgcacagacatggctcagatccaggcagttagtgatgctgcccactgtggacatgtggctcaccctgggttcagggcattacctgaccgctctccttggagaccctggtttggaggggagacctgtgcagaagcacctccatccccacccttgggaccagcatctcctcctgcaataccctgggccccactgggaggggcaggacagagctgggcagtggatgggggtctgtggtccccccactgccctgggggcattagctggtctaactgcccggaggcaccggccctgggccttaggcacctcaaggacttttctgctatttactgctcttattgttaaggataataattaaggatcatatgaataattaatgaagatgctgatgactatgaataataaataattatcctgaggagactccagggtgctggttagcttcagccatcacctgctgtatctcatgtttatgttctaaacgtacttaagtggcagtgccagagcctctgtacagggatcctggcctctctatgtccaggcctacaggggtgaccagatatccttccccttttctgtgtgtgtgtttgtgtgtgtgtgcgcgcacacatgtgcgggcacatgccttctcatatacccatgtacccatgtacataaaagatggagagtgtttcctggagccagacaatatggtcctggatttgggacaaccaagccatgtgggctactttgagtctgataggctacttgtaccctgagtgcaacccttcacaatcatgctgatttacttcctgggcactggtcctaagtcagccctacatggtaaaaccacacacttgtccctctcaaatagttcacaagtccggcatcacacccacctgggttctctttggtcagagttcagcttccctacccctcattggctttaggttgaccttgtatagt

SEQ ID NO: 29850 - DNA, 1122 bp, Mus musculus
aggggcctgactttcttcctgaccccactcctctctggctccaggtgccttctctggggtgtccaatattttcagcttctggggggacagtcgggggcgccagtaccaggagttgcctcgatgccctgcccctgcccccagcctcctcaacatccccttgtctagccctggtcggcgatcccggggtgatgtggagagcaggctggacgcactccagagacagctgaacaggtaaagatgggtgcccagggaatgggcacggggtaggctgcactgtgggggaacttggggcctctttgggtttctgctgatgtttcaggggtgctctgtctaggactgtctgtgccaggcaggtggaccctctccttcctcagctgcatgaggagggagcctagagtgaaccagctatctccacttctgagaaatcttccttccttgccccaggctggaaacccggctaagtgcagacatggccactgtcctacagctgctacagaggcaaatgaccctggtccctcctgcctacagtgctgtgaccacccctgggcccggccccacttccgcatcccctttgttgcctgtcggccctgtccccactctcaccctggactcgctttctcaggtacattctagagcccactcccagcctccagccgcaccctctctgccccaacgactgcacagctgctgggtgtgaaatgtggcttcctcacccccatcctcttctacctgctcctgccaggcaacctaagggccagatgtaaacatgatgtctgagcctgggccttgggtctggatgctgcctgagagtggtccctgctgtggttatccccctctgactttgccgcctctcatcttggctcttactctagcagtgctatagcctcctgaaggctgctggcatgtccagggtgccaagatcaaggctctgagataggacctccctgatccacatctcttctctttgagtaacctcctgaaggacagctgtagctgggtcttttctgccagctctagctttgataggtgcttgaagggggtgggggtgggggctcctatggcacccagaggtggcttgggatctactcccacccccagctctgctccctgtcccatatgctg

SEQ ID NO: 29851 - DNA, 1203 bp, Mus musculus
ctgagtgtgcccagcggattctcagtgacagccccagacaagcggggctgggtcatcaacccccttggagaaaagacccccttccctgtgtggatgatggtggccagcctgctgcctgctgttctggtgttcatcctcatcttcatggagacacagatcaccacgtgagccatcctagctaagggagtagggtgctcccagatgcaggaatgtgggacctactgccattgggccctgaatgccaggctaactagtttcttttccaggtaacagaaacgtcactgatgttagctggggttggacagggcacaggcattgtaggctcctagcagggcttgctaggagaaatccaaaggttcaggctgaggataaaagttctgttacggaggtccagtcccggggggatggacagaatccaccagagccagctgggccatgctggaatgctaggatctcccatgctgcgagtagcctaggtttcacaatgcctccctcctcccaggctgatcatctccaagaaagagaggatgctgcagaagggctctggcttccatctcgacctgttgctcattgtagccatgggtggcatctgtgccctctttggcctgccttggttggccgctgccactgtccgctctgtcacccatgccaatgcactcactgtcatgagcaaggctgtggcacctggggacaaacccaagattcaggaagtcaaggaacagcgtgtgacagggctgctggtggccctgcttgtgggtatgccgcccatactctgaacctcaccttccatgggggggtccccaggtttactatggaggggaccaactgtttttccccttttcccaggcctctccatggtcattggggacctcctgcggcagatccccctggctgtgctctttggcattttcttgtacatgggagtcacctccctcaatgggatccagttctacgagcggctgcacctgctgctcatgccgcccaaacaccacccagatgtcacctatgtcaaaaaggttagttcctgcacttgagggcagccttggccagcctgtacagaggaggtctggaaattctcatagtacctcatctcccaggggaggggaaggacactcgtcctcttggctggctggaatgtatgtctaggctcacctcatctctgcctgcaggttcggaccatgcggatgcacctgttcactgcct

SEQ ID NO: 29852 - DNA, 1118 bp, Mus musculus
ccgctgcaaatacaggtgggctaggggaggggcagcccaggagcagagcaggagagccagagccaatggttcctaacagaagatactttcctctaccactgtgctttccttttagtcacaaggacatggtcgctgaggggctgcgccagctattaggggaagaaaactaccgtcagaatctgactgtacctccgggctactgcacaggtgaggtgtggatgggaacgggtggtcaacagtttaaagcttaaggctaaggcttatctgtcctgcagactttctactctgtgtgagtagttctggtgctgtgctgcctatgaggacacaagaccccttcctgccctacccaccacggtcctgccaacaggaccaggcaaactttaactccacaacccaagaccctgcccaaaggtagggaaaatgaaacagggttgggagccttggttgctggtctaacagcagcctgagccaagccccctgctctccagggtggtgctgatgctgagagaacgctggcatttctgccgagacggcagggtgctgctgggctcgcgggccttgagggagcggcacctgggcctaatgggctaccaactcctaccggtaagaaattgtcccactcagtgggtgcatgtgttcctgtagccaactcactgtaacctgccttctctccacagctgccatttgaagagctggagtctcaaagaggcctgccccagctcaagagctacctgaggcaaaagcttcaggccttaggtcttcgctggggacctgagggtgggtgaggaggtacacacagggctcaggatggatcccctatggggaggagggcagacaatttgcactttggcttcctgttattattattatttttttcattaaaacccctttccttcctgatgctaagtcttgtttctgggataactgggctgggccaccgcatctttccattcatgacccccaccaccaaagacacaagaccaagcctaggttggggttgaagcactttactgcaggatagggagaagggggctttaaattattcacttaaataaaaatgaggaggggcaggaggagaggacccccagccctcaccccttagtccctctgctgtgcct

SEQ ID NO: 29853 - DNA, 1158 bp, Mus musculus
tgttacttggtgaggagggtattggaaggtgtgggtgtttcgggaagaatagaggaagagagagcagtagaggacccaagccattgataaaactcatgttcccattcacctccccaagcacatttgctgattgctctctgtatccatggtggatgtccaagtcaagcagcatctttctaactgccgggtactaggttcttcctaatacagtgctctagggagccacagacgtatagtctgttatactcggcacaaggtgacttttgtataaggctttccccacacactgttgatacatcatgctcacatgataccaaatcactccactgaaacaagtattttcccattcaagaaacgatgacaaggaatttggggactcattcactccacttggcaagatggcacaccccagctctcttaccaggatggtcttcatccctctctcaggctttccatcagatggaccactcctgtgtgccctcgagcaggagcgcaggtcccgtctccctccaaagccaccctccccacatcggcctgccatctatggtggtcaaaggttggaagtggccctgagctgcccccgtttcctgcagtaccctcgtcagcatctgatcagaagcctggcaggtgccaagggttaaaggcagaagggaggcaagggatgagatgaagccactgggatgaaccacctgggctagagtgcaatctagcccacaggagtcttccttgaagacactgtatgacaggctgttcttcacagaggcaaggccagaagaactgactcctcacgtaatggtgcttctggcccaacacctggcccggcaccgcttgcgggaaccccaacttctggaagccattgctcatttcctggtggttcaggaagcccagctcaacagcaaggtgggctggccccccacccttccacgtttctctgagttgtccttagcaacttggtcaggcccagcccctatccagcttgtttggcttctcctggagcaagcattccagctaggctgtgttccttaccccaggacatctgtctcttgctcactggttttccaactcccataatcagtagagtagtatgtctaaggccttgaaactttccaacgctcctgcatagctgcttagttctgctctagtcctgtgagccatacc

SEQ ID NO: 29854 - DNA, 1205 bp, Mus musculus
gcacacacacacatacaaaatgtcatttattctcctttatattaattctattcctttggttcgttactccaggatttgttcaggtttaaaataagttagtattttaagttagtatcttagtatagatttttcttagtcgtttgtttctgcgttcggggagtgagcccctccaccctgcactgttctcatcggcgctttggcccattgtgctctagcagggctgacagggctagcccctgatgtgtctgaggccctgttcctgaccatggtggtgtctggtgggtgctttgtttgacagtattgctttctctttccccagctcccctccttgggtaccactcacagcccctacctcttgcttttgaaactgatatagctgtgacatttgtacctaaaccaagatggagggtgaggggaatctagacccctaagtcttcctgctgtgctcctgccaggtcaggcctcaaaggcatcgtgtttctgggacaccaagtatcactcttgtttggagggtatttcctattagagtctaactaccctacaatccttgttctgaggaaacttgcaaagatttgtctgctttccactctaaaaacgctgctgcttggctcttgtctcaagattactcttgactttctacgttggaataagtagtcaaagcctgtaaggagggctggagagatggctcagcggttaagaccatcgactgctcttccaggggtcctgagttcaattcctagcaaccacatggtggctcacaaccatctctaatgggatctagggccctcttctagtgtgtctgatgacagttacagtgtaattacatataaataaaaaaaatctaaaaaaaaaaaaagcctgtacggagtggaattaagaaccatgttttagagctgctgaggtcacttgttgcacaggcctgcagggttctgctcctcagaaccgacagtggaagccaactccttagagttgctctctgacatgcccaaaatacacctgcacatttatgaatgcacgtgtgcatgcacgcacacaaacacacacgtacacaaataagtgttactcagatggctcaaccaagcctgacaacccaagtttaatctctgggatccacatgataaaagcaacggttacaagttgccctctgacctccacttgtggcctatgactagaatgtgcatgtgtgcatgcatgtacacaaaata

SEQ ID NO: 29855 - DNA, 1223 bp, Mus musculus
cgggggaccaggcccggctggatgctgcgccaggctcgctgaatggagaagaagggagctcggcccacgccggccggccaaagcgaagaggcccagaggggcgggggcactcaagcccgctggcccagctgctcctggggggagctttcctgcccctcccctcctctgctccttcctgcatggacttctgccgttcctgctcctgctccggaagccgccgccaccgcgcttgccttgccccctctttttggcccctcccccctgtttcctaggatccgcatttgggtggactctgccccaggagcttggcagggtgcaggccctcttctggcctctctcctctctctctccatccactgtgcccctcgggccacaccgacatgctcggtgccgtgtggtgtctgtgccgcaaagagcacctgcccgctcacttccggactttgctctccctggttgtcgtgccctgtgctcctggccagccctcagccccaccgggccacctctcctcacccctcccttcacttaacaaactccaggccctgggctgcacactcattgcgccctccgtattttgtgtccttgctctttgtgaggggcgggcctggctcagtgacctgtgctgctctgtatggtgccgtgtgtaagaataaacccattggaatactcgtgtcttggttccttcccgacccgccgtccaggccaaacccagagttaggactgcccaggagagggaggaaaacgggagggtggagaacgacaggcgggcaggactcgccagagaggccccagacctctaacgtgtttgttcttttctctttcagtctcgaaaaggtgctgacctggacagggagaagaaagctgcggagtgcagagtggacagcatcgggagtggccgggccatccccatcaagcaggttagcccaggacaggagccttcttcccggggccaggatcctaggcctactgtttaccaagggactggtgatcctcctggtctgaagcgtgaggcccaagaacctggtccccagacagctgccttccctcttccttaccactggagagcagcagagagccacctgcggccttcagttggcttccggacctgatggttcgctggtgcaacctggagagggagcctcctggactctgagctaaggaaaagacttgggggtgggggtgggggcggtaacgtaggggctgggtatggtggaacgtgtctgcag

SEQ ID NO: 29856 - DNA, 1219 bp, Mus musculus
tgaatgtagatctatgtatggtacttaacacacaacccagggatgggcaaatgacattctactgatgatatactccaagtccaccaaagagaaccaaggactggtcagaaactattcaacaaactgttgtctgggactgtgccaagggctgattgctccccagtaccctggtgtgggtggtagcttgtgataggagcttcttggaagcctgggactcctcagccacgtgggtactctccacaaaccctttctttaccacctaagacatctcttctaatggctttgagcctaagtgtttggttccagagcttttgtttgctcttcctcttgtcttcctagctgaactccacccctctgggcaccgtggagacttgagcataatccaaacttggagatttgtttggcttcagagatctgctttctgggactaagtgccttccctggcacttgtcccccagttagcagagaagaagaaggcctagacagtggagggcagtcagtgctggagacaagttgctgaggagaaccaatctaaagcatcttttgtcatctgtgcacccttaggattacatgcaaaacatccacggcaaagagatcgacctcctacggactacggtgaaagtgccagggaagcgtctgccccgagccacacccactacagccccaggcaccagtccccgtgccaacgggttggcaatggagcggagtaacacacagctgggtggggccacaggtgaggtggcagctgtggtggagagagagggaagttttggagatttggggagtggctgtgcgtgggcctagcaggacaggctgcttctgagcctgggcatcagggcttcgtacgtgctcaccagccaaagtcgacttgagaatcctctccaccgggagtcatggctaagatgcagatcagagcagtttgttgaggtagccttgcctatcaggtggggctagggcatggggacagctagtgatcctccatgcatttttagctaaggtaggccaacaactcagctcaccacaggagaggggcagagtcacctggcatcatcaggaaaccatctcaggtctgtggtacatgcaagatctctgtacagaaagtgctggctctaaacccagtggttcaggagggcacaccatggagaatggagagtcaggaaccgtaggttgacagttgtgtctgggcaacttgtctatggctatattcttttattatgtc

SEQ ID NO: 29857 - DNA, 1159 bp, Mus musculus
agcagggggtggggtgggggcgagggacggggtgggtatgccatggacactgagtaaacagggatgtgcctaaggatactgagtcctgtggactgggcaggaagacccaaaagtaaaaacgttttcattgtaggtactggtgggatttgaaccctgagccttgtacacactagcgttgctgatctgtgtccccaccctctaagagtgctccttgtttgaggcgaagtaccttatgtgattggtcattctaagtgggctggagatgtgaggaaaggtgcaagagggttctggctgcatcatttgatctgtgccagtatagcagatgtctcagaaccaggtaccagggccacagcagcactgtgcaaattagtctccagtttcatgaggaaacaacagttctggcgctgtgaaagcacactgtaattaatatgtctatatactatatgtcaggggtctgggatcgtaccgtatgtgagctgagaatggggagctctggaggtgtaccccaggaaagcaggccaagggaaaggcagtccacctgggaggtaatacacacaagcccggcctgcgtggcaaaaagaataactcccatattgtcctcagtgctgagctgcagagctcctccagagttctgtgcagggagcctatgtggccaacctcagccctacgtggaaacctcaggtgtcttgtactggtaccataggagggagtaaggtggccaaaaaagcagacctttcctcaaagatggatagtgagaggaaaactgggatatctcccaaaaatgggaggcacaagatgcctctggctgtcccatcccatcctgggcccacctaggatgccaccgttggcgtgcgggagggggccccagcagcttgctcctgtaattacagcacccacacatagaaacacatggatgatgcttcgcaagcacgagttcctgctgccgcacgctgacaccgaccctcatgcacactcacatgtctctcgctcaccgggcgatgttaacatctcattatctttgttactgtaattacattatccgctgctttatgcagaattatcctcggaggactaattgatggctccatgtttaattcattaatcattagcatcaaattcgacaattacagtgcacactgattgtgggattgcaggcgta

SEQ ID NO: 29858 - DNA, 1220 bp, Mus musculus
gaggatgagtgttgtcaaagcagggtctggatggagttatggcagtggggtgggtgccactgggtatgttcctagcaaagagccctgactgccacttcccttcccagaggcagaggagtcctttgagtttgtagtggtgtccctcactggtcagacctggcattttgaggcctcaacagcagaagagcgggaactatgggtgcagagcgtgcaggcccaaatcctcgccagcctacaaggatgtcgcagcgccaaggacaaggttggcaggggtggtagagcctgcttggagagcctggctaggggagagccagtggaggggcttgagactgatcgactcctgttatctctcggtctcatgcagactcggctggggaaccagaacacagccctggcggtgcaggctgtccgcacggtccgcggcaacagcctctgtattgactgtgaagcccccagtgagtacgaggccagcagagctaggagctgggtgtctagggttcaagtggcaatgggaggtgggcagtatgcagaggggtgccacctgctctatttttctccttctgcccacctagatccagactgggccagcctgaatctgggtgccctgatgtgtatcgagtgctcagggatccaccgacacctgggagctcacctgtcccgagtccgctccttggaccttgacgactggccacctgaactgctggccgtcatgactgcaatgggcaacgccttggctaacagtgtctgggagggggctctggatggttactctaagccaggccccgaagcctgcaggtaagccagtactgcccaggaaggagacagccggccccatcgtgggggtagacagaacctgtggcaatagcagcactaaaagggttaaaaggctgttgctctgcttggcagtcggaccctgggggaatccctcctctgctggtgcctgtcactcaggcacctcacaacaacagggccttttctgagctgttatcgcaggtcaggggccagcaggagacgcatgcgtggaccccgtatcactgcgccgctcctgcgtccaagcccacacacggagatggggagaatgggtggtagatagggcagccgtggccctcgcaggccgtcacttgctttgttccagtgccaccaatcagcttgataagctgccactcaggccgctcggactcctgctctctatgccctcatccctgctggccccaggggtc

SEQ ID NO: 29859 - DNA, 1195 bp, Mus musculus
gcatgtctttaatgccagctctccagaggcacaggcaggtgcatccctgggagttcaaggctgtactggtttatctagaaagtgccaggccagccaggacaagcctctgtctcaatgctacagcagctgctactgctggtagggatagtggtggtgatggtgatgaggatgaagaaaaaaatatttcagttggaaagaagagaggatataataatatgagcaaagggctttgtgttgtgctcaaggctgctctaagaagctgcaggcaagggctctccctcaaaggtcattgacgagttgggtctttccatgagctgacttgacatcaggaaatagaaatcaggtgtacaaagaaagaggcttatgtgggcatactgagagaagagttgcggtagaggtgagaacatgatttggagcagcgatcctcaacctctgggtcttcatcctttggggaattgaacaaccctttctcacaggttgcctaagaccattggaaagcagatatttactttatgactcacaacagtagcaaaattacagtaatgaagtagcaacaaaaataattttatggttgggggtcaccacagcatgagggactgctttaaaggctcacagcactgggaaggctgagaaccactgactgagagggtgtgaggcaaagcctggactgggtggggagacacagctgtgtgtgagctggagttagagatgggtgtgtgtctcagcccgtgtgcacagacgccggaagcctgggctcctgttgcacaggaggggctggcagtcgttgtcaaactctgaacatgtgggaagagttaccagtttggaggaatttggaggcactattgactggggaaaggctgggggaaaggcaggttaagggagggaggctagcaggttgaattcgggtgtcctcaggagagacagccccatgctggtcaaagccaccaagtagggtctccactggcccctgggaagagtaaaaggcttcctgtggcagcgagcatctgtatgtgaggtagatcctggctgtgggaaccgtgggcacgagagccacgagggccacagcagaaagcaccgtgcaaaggatgagactaacagaaatgtttctgacctgggtagcagcagcagatttccaaactgtgaagcacaggaaagaggggtcagaataggggttgtagcaaagctagaattttca

SEQ ID NO: 29860 - DNA, 1125 bp, Mus musculus
gttaaaaatgcaggtacttgagctagacctgtcagctgcatttggtggagtgggagagatgcctaacatgggattctattatcttttctatacatgcccttttattagctctgctagctgtagtagctattcctggttgtcaacttgacaatatttggaatgaactacaatccagaattggaaggctcaccagtgacccttatctggaggcttggagatccttatctggatcttggtatggagatcttgagccattgtggctatggattccagaattttgagtttgaggaacacacctttaatctgggctacacctttcatctgggattaaaggtgtggtggaacacacctttaatctgggctacaccttctgctggagacaatataaggacattggaagaagggagtctagctcttgctcttgctccttcgcctgcttgctgcgtgagactgagtaactgctagatccttggacttccattcacagctgcgactgaaccattgttgggaattgggctgctgactgttaagtcatcaataaattcctttactatctagagactatccataagttttgtgactctagagaaccctgactaatacactagcttacattcaaggttctgcatacatagcctgtgctccattggaatttggaggcttcctgtcagtaggcactgccgtcctgagaaccttagtggccatctttgtgaggaaacacacccagccatttttcagtgtgtgcgatagtacatctaagatagcaaaagaaacccccagatggtgtccaaatccccaaggagctcacagtcacgtggggaagccaacacgacgtaggaaggctacatcatgctcaattttaatttggatagtagcgtcaaaagtactcaaaatggaggaaggtctcctaagcccagcccagaaacgcagacaatctgttcccccaaaaaagtgacaaaggtctctcagatgatgaggtcccagagctgcttaagtggagcgaccaagctatcctactgaaagttgagattggcaggtctaggttctaccacagctgcagagaaacctggctcagttcactccctgggcaggaagcagagtggtttaaatcagcctgccctgtgt

SEQ ID NO: 29861 - DNA, 1215 bp, Mus musculus
gtggggagtccacactgcattcaagcctgctcctgggaagcaagttgttgaggctgcctcatggcctccgagagttggtttcgtgtcttagagcatgagtgtagactccacttgctggctggaagtttctctggctggttcaggagctcgctcagtgcaggctggagtgtgatgatcagacgcgctcttactgagttccccaagactgcttattgcagtccggaagccaggccttcagcctgtcccttgttttacagtgtaagaaaaggacattgtttggcaacttgctggagtctgtcagccccgtcaagtaatctcaccttaatgcttgttgccttagtagcttgtttccccttgtcctctgatgcgcaccagctccatcactaccttcaggtgcagaagatctccggtttccctgcagtcccaattcctgtaactcactttctacctttccttcctctgaggtagtaagcagattggcttaaggattcagtccagacctgaccaacgtcgtgacaggaaagctgcacctttcatttagcatttaagatgtttctgtttctttggcatccatcagagccctctttattcggcccttcatgctgcttctggacgagcctaccaaccacctggacctcgatgcttgtgtgtggctggaagaggaacttaagacgtaagagatggggctgggagctgcagtcccagggaggtcaggagcagagtacaaagggattaggtgctcagaaactgccctgatgagtgcaggtgaaggaaggccagagacaggccagatgcagccagtgccagtgaagtcagaccggctctttctgtttcattggggtgggtttttaagtctgaaatacatgagtcttgtttttcctatgtccaaaatacagcatcttcactaaagaaaatgtttaattgtatgtgtgcatgtgcacacatgtgtacataaatcatgtacagtgagtctaatgcttaaattcatggtgtggtggtgatacagaaaaataatagtaaatctattgtctcaacgttaaaagtaaacaggagctgccttagtgctgtcttcaaaaagaaaggacttctgtttctcttattgagtctgggttgaccccatccacgcctctggataccttttatttagatacttgtgtgtgtacagactgttgatagcaggacttcacccatccgtacttcattctgttgacagaa

SEQ ID NO: 29862 - DNA, 1299 bp, Mus musculus
accaaactggaattaaactcaggccggcgctatggcctcattggcttaaatggaattggtgaggcccttgggggtcaggtggaggaggtttctttcttggtttgcctgttactcactatgtgtttagcactaacaaagcaagaactttatcccatgagtgggggaccagacatgctggagacatggggcttatgacacagctgtgtgtagcaggtaccatgggagtttttgacagaaggtgctatagagaggttggtgggggagtgagggtgaggagtggtggtgtgaagaagcctttgtaaatgaacaggatttcacaggcacagtaagattagacttgaagggaagctgggaaggagagcctgagagtgagccagtgactgcctgttaggaacaggtgccaaagagtggcggtgaaggggcttagtgtcgcctgtcaccctcttaggaaagtccatgctgctctcggctattgggaaacgtgaagtgcccatcccagagcacatcgacatctaccatctgactcgtgagatgcctcctagcgaaaaaacacccttgcagtgtgtgatggaggtggacacagagcgggccatgctggagagagaggctgagcggttagcacatgaggatgcggagtgtgaaaagctcatggagctctatgaacggctggaagagctggatgctgacaaagctgagatgagggcctcaaggatcttacatggattgggcttcacacctgctatgcagcgcaagaagctgaaagacttcagtggtggctggcggatgagagttgctcttgctaggtgagttctcccctttccaccatccttggagcccctgtctctcaaaggggagtgttcactctggtaggagtattatgtgtcggatgagatagccattagtgatgtaatgtgggtcagtgtgtggacctgactgactgccctggctgaagtactcaagaccacctccatgctcggagccagttccagtagtgctctgagcagacccaagtaaaatggtagttaagtgtcggttttcaccttgacccccttcctgccttttgtgctgctgtcctgctagtttttatggcagtatgatactggacacattgatgctacctgtccttcttaccccgtaagcctgaggttaaagtgagtttgtagtccagcactacaccagcaccctccccagcatgctgagatgtgtgtgctttctcttaaaattataaaattatggagcatctcaggctgcacactgtgaacaaaataggtgcatctttgttcatgactctagaggcac

SEQ ID NO: 29863 - DNA, 1188 bp, Mus musculus
atctctttccaagttaagtgtagcctgacacagtatgccctcagaaggtagagaggccaggagctggagagatgactcagaggtcaagagcacttgcctgctcttccagaggactcaggtttgattcctggcccccgtgggcattacgcatacatggtatagcgattcatgtaggcaaagcacccatacacatgaaattgtttttaaaaaggttcattcaggtgagagctggagaggtgccgtgggtagtgcagtggctttgcctgcgtctcctatggaaacccagcggctgcacacggttgtctttagatgtgttgtaatgctttgtttttttaaaaaagtaataatcttctgagtgtggcagctggaagaaccctgcctgcttatttttacttttttagcagtggaatcgacacttagaatgggaaggtgtgataagggagccgaggtgatggtgggaggggtggggctctgtgaccacttaactcctcctacctctctctgtctggaagccactgccaggctgggtgcagggatcctggcctcggcctcgagcacaagctctgagactcccactttccatctccctggcaggtgccaaacagaaggagacagagactgaatgaccgccgtgaatgtagacgcccgcgcaggagaacttgaacaaagtctcggggtcacggtttgcctcatgaacactggctgcaatagaagagagtaaaatggctaagaatgtataccagggtttagcgatgggtatttttccagtgatttgtaagtataggaaaagattttatgtgcttgaagattcaggcttgcgttcaaagactgccctcagacctgtctgaaggattttcaatgctgtatgtcattaaagtgcactgtgtcctgaaatagtactacttttcatttcaaagaagtcactgggatggaacaggtgacagaaagtgagtgaacggcacgtccagatcacggtgccttatgtccaaacgcaatatgtcaccgccgctgccgcacgccccaaagtgctgctgaagagacacccagcccaagtgtgagcatcttcagaccttttacccagtctcttccttttcacttaattggttgaaaagttttaatttgagtacaggcaactgaaaatgtgatgtgatgcctctaagcgctctgcatccgtcctgttctggctgc

SEQ ID NO: 29864 - DNA, 1951 bp, Mus musculus
cagcagagtcacagaatggtccagcactttttttttcttttttctttcttctttccttccttttgtttccttgtgggtgggttttgttttgttatgttttgttagtctcactaaggagaaacttttactggggcaaagagccggtggctgccctgccccagggtgggggccttcctatgaatgtaagactgaaatcaccagcgaagggggctgtccagagtgctggccacgccttactgacaggggcaggccctcagtttaactaaagtggacaccactgatcaaggaatgtactgagatgacttccttagggatagagctaagggataataacttgcactaaatacatttgaatacttgattccatgagtcagtttattgtagtttttgatttctgtaaaataagagaaactttttgtatttattattgaataagtgaatgaagctatttttaaataaaagttagaagaaagccaagctgctgctgttacctgcagaactaacaaaccctgttactttgtacaaatatgtaaatattttgagaaaaacagtataaaaatagttattgaccaaatgctaccaggcgctgcagcagctcgggtgcttataaccgtggtagggatgttacaatataattttgtgttattaaatatgccattataattatgtaataaccaaaattttgccccggtattcctgggctttttggaaactgtctcttagtgcttgttttctacacctaacttctgacagcagcgcgtgtgctacaactacaacttttatagctgttggcgatttaaactaatgtttcatattatattgttgcatccctacttcttcagtcaggtttttttgtgcttacaatttgtgataactgtgaataacggcttaaacacaacccaaatggaggctgaattttttcttcagcaaaagtagttttgattagaactttgtttccaacctcacagaatcatgtaaacatagagtcatgtagcagggacctaacccaactccttagccttctatttaacataaaaatttgaaaaagaaaaaaaaaagagagatggggagaaagagaggtgtgattatgctcccagctgcaggactctggcaatagggtttttcgaagatgtaattttaaaatgtgtttgtatgaacttgtttgtttacatttctttaataaaaaaaaaccacactgttttgtgtttgcttgtagaaacttaatcagcatttgaaccaggttagctttttattttgtacttaaaaattctggtactgacacttcacaggctaagtataaaatgaagtttttgtgtgcacaattcgagtggactgtgagctgtgggtacattcagtgactcagctctcagcttgtaatgtatatggcatgatgtatttttatcttacagaataaatcaattgtatatatttttctcttgataaatagctgtatgaaatttgtttcttgaatatttttcttctcttgtacaatactctgacatcctaccagtatttgtcctgccgagtttggttgttttctgttctgtataatagtatctaatgttggcaaaaattgaattttttgaagtatacagagtgttatgggttttggaatttgtggacacagatttagaagatcaccatttacaaataaaatattttacatctatagaatgtgcactgtgttctctgtgggctgtggtcatgtttggagtttggttctgcttggtatctttcagaattgctagtctagacatttggatgtaaattcagccatgctccctggctgtgggctcccctcccgcagtgaaatatggaagagaacttgtattagggtggagtacagcagattaaagatcattcttcatgtttatttgcttgtttaaactctgtgcattggtttgtgtctgagatgacgtctcactgtgctgcccaagcccaggcagccttt

SEQ ID NO: 29865 - DNA, 1134 bp, Mus musculus
cctaaacatttactcatctgtgcctgccccttaagtcatagactattaagcttctctccatcagtagacttgctttactggcaagtgaatccttcccttttctcatgatttctttttgctgcccaggaatcccttccgtcactgccacagtcccctatgaaggagccttccaaagcatttcaccagtatagcaacaacatctccactttggatgtgcactgtctccctcagttccaggaaaaggtttcccctcctgcatcacctcccatatccttccctccagcctttgaagcagccaaagtcgagtccaagcctgatgagcttaaggtaacggtcaagttaaagcctcggctgaggactgttcctgttgggcttgaagactgtagaccactgaataaaaagtggagaggaatgaagtggaagaaatggagcattcatattgtcatccccaaggggacctttaagccaccttgtgaggatgaaatagatgagtttctaaagaaattgggcacttgtcttaaacctgaccctgtgcccaaagactgtcggaagtgctgcttttgtcatgaggaaggggacgggctgacagatgggccagcacggctgctcaacctggacctggacctctgggtccacctgaactgtgctctgtggtctacagaggtttatgaaacacaggctggtgccttaataaatgtggagctagcgctgaggagaggactacaaatgaagtgtgtcttctgtcataagacaggtgccaccagtggatgtcacagattccgatgtaccaacatttatcattttacttgcgccactaaagcacaatgcatgttttttaaggacaaaacaatgctttgccccatgcacaaaccaaagggaatccacgagcaacagttaagttactttgcagtcttcaggagggtctatgtgcaacgagatgaggtgcggcagattgctagtatcgtgcagcggggagagcgggaccatacctttcgtgttgggagcctcatcttccacaccattggccagctgcttccacaacagatgcaagcattccactctccgaaagcactcttcccagtgggctatgaagccagccggttatactggagcacccgctatgccaaccgacgc

SEQ ID NO: 29866 - DNA, 1196 bp, Mus musculus
aggagattccctcagtgtagacttgctcttctgagcccttgggccttgttcacagtataccttggctttcacttctctctgatgctgtaaatcgcataagttatttgtactcattgctctttatttcccatagaacttgcagtatcagcttacctgtcaggaagtggatctgtgctctcttgatgcactgtacatatttgaggatcttggtgctttgcttttgtttgattctttagtgctagcctcctttttcagctgtttgggagtgggtgttttcctttatttgaacttcattgtcaaatattagattccctgccactagagcttagaaaatttttattaaagcaaaaaaatataaagtaagtaatccatgttgtaatcgattacatagtttcattttctattgtgtgctacctgtatctttggtcagttttaattgctaacaaaagtccactccttaggtctttctgggtataaagactctagtcatggtccagcagaaggtgcgtcgctccgaccacagtggtgctgccactgtaaggtggttattcttggaagtggtgtgcggaagtcatgcaaggatctgacctttgtgaacaaggtactttactattcttcccatgacctcgtcctacttctgtttttgccagtgacttctgcatcaagacaaagtgcttcatgggatatgatagacaagcatgtagtagatgggctcagcttcaaaccaaacagctatagcagactactaaattgttcatttttagaatacagtaagatatggacagtgtagtttctggggttttttttttttgttgttgttttttcttttttttttttttccccttctaaactatttgtgtctctatttagccctggctgtcctaggccaggctggccttcaactcacagagatctaccttcctttgcctccaaagtgccgggattaaagccatgcaccatcatgcccagctttgcattggtttttaggtggaaaattatcatagggtgaatattgggacagtgtcttcacagttggaggatatagagcactcacttttgaatgtcacctaagattagcagtccacagggtactagtttaattagcatgtgtcttactgaggtcccacacatttccctttgcttttcagggttcccgagagaacaccaaaaggatggaaaaggatattgtcttttgt

SEQ ID NO: 29867 - DNA, 1099 bp, Mus musculus
tatctgagatgtaaattaggttaaagacaaatgctgtattttcatattttaataaaaatagaaaaaaggaacgtttaactactttttgcaacttagtcaattttaaaactgctttttattggttattttaatgatgaaacttgagaacaattatacaaaattaagtataacaaaaattaggttcttcatttcaaagctgaatgctcaagctgggccaagtaggcaaatgggtaacagcattgtatttgataacctcgtggccctgtgtatatatatttttgttcttgtgcatttggaactggagatgcctctagattatgtttcctgtagccttgcttccttgtgctaaaaattctcagaattaggttttagcaaggtcaatgcatatttgctcagtagcatataatttaaaattttttggtctcctgcagcagaataatttaagtaatcctccaacaccccctgcctctcttcctcctacaccacctcctatggcttgccagaagatggcaaatggttttgcaacgactgaagaacttgctggaaaagctggcgtgttggtgagccatgaaggtatgacaatagcatccaaatcttacagctctgaagtatctacctttgaaagctatgtgtatactgaagtgtctgcagaactgaactgttccctctgtatctactctgttctacatactttgattctatttgtttgctcttgcagttgccagagctttaggaccgaagccatttcagctgcctttcagacctcaggatgacttgctggctcgagctattgctcaaggcccgaagactgtggatgttcctgcctcacttccaacaccgcctcataataatcatgaagaattaaggtagaaaccactttttaaatgtgcgcatgcatgcctgcgtgcgcatacatgtgtgttgcctgcatatgtatctgagcaccacatacctggtgtccacagaagcctatactatagaacattggatttctgcaattgatgttccaccctgtgcactgggaattgaacctcggtcctctgcaagagcagcccatgctttcaaccactgaaccatttctcccagcatcagaagctac

SEQ ID NO: 29868 - DNA, 1192 bp, Mus musculus
ccataatgattctataccagttactagtttaattagaattaataaggtttcaccaaatggatttaactatagagattaatcactagtttcatttttttttaatttggtataatcattatatacaaatgcgtacaagaattgtggaattatttgagatatttttgttttagactataaaagagctaagtagtaccccttattctcacccccaatgtcttagtctatagtccaagttggcttgaaactcttatgtagctcaggctggtcccgaacttgtggcattcctcttccatcaacttctcatgaaataacaagcttagtctatccatttttaataaagattgcaactaggaaaaaaaacttccttgtttgtgtattgaagctagatttttcactgtaaacgtatcataaaaattatttttctgaaacctatgagggcccaagctctgcaatagtttagctggctttttatgcagctttactggtccctatgaagatagtggcctacccattctgagcggtcatccatagtaatgggaaggtactgagtgcatactgagaagaggtctgttgagcatccagaagccagttgtcggaagtctccagtgttactcttctctcccctggaagagaggagtgttaggtacctgtgtgatttgttctgagctcatcagttgatgctgtgcgcttttctttacagattccccttcatgggcccatcagtggctggaacacaaaacaatgacggccagaccctagtgccacaagctgtagctcaggtaatgctgctcgaatcactggtttatggaagacacatggacctactatgtcttaccaaacccaaatcataatgaagcccctcctagaaaggaataggagctgatcttctggcaacacagtgaaataaagatgtgttgttgctgtgtaaaataaagacagatttaaagacgagaatttctgcaaaggacttgcacacgttaatgatagaaagtcacttggaaggaagcgaagtgctctggctttatattcatttctaactctcgaaagacatttcatatcctgctaattggaattaatccatcacatttaaaatgtataattattggaaacagtagtggaaaatgtctgtaatcattctattaggtataattattccttgagatgatttttttttaatattgagcatctataa

SEQ ID NO: 29869 - DNA, 1162 bp, Mus musculus
atacttcctatccaaactttatttaaatggttgtataatgaaaaaatgaagcatatgcaaattagatgtaaaatataattttgctctcaaggtttaacctcttggattattgtatttagaaatcccccattcagtctctgctggttttcttctcagtgctccttgttttgttcttgttttggaagctgaggataatagtgggtaccagtaatctgagtgcttggtgatgccgaggcagcaggatggtgaagctgagctagtctgtattacagtgcataccaggccaggctcagcgacatagtgacaccttgtctcaaaaagcacttgaaaattaaatcatgaaataatgcctttgaaaaactaagagctgcttttggggttgggatggagcacctgggtacactatttggttggcatacacaaacgctctccccacctccccgccccgcattaagaactaacatcctgttgtattcatacatttgttgaatgatacatgtacagcaactgaaaattaattctgtataagtctttttttctcaaacatttcctgattggttctttttctgttcagtgccttcctcagactgctgcgactcttctcttgtggcacagatcgtcacaaaagtgaaagagctaggtaaaattggaaatgtttttcttttaattcttaaacaactgacttgatgcttaaattaaattaagtgaattgtctgatgttaatatcaagaattaatatataaaatgttcatatcccattttgatgaagtagtattcctataagtttcaggaaataatgaaaataatagctctttggattaactgttagtatcttgcttgccttcacttcagctgggtattgtgcttgcttagttgtcagtaaggagaaaaagaaagcctgtttaactaagcactcatttagtactaattaatattttacaatttgttctctgataacttagaatgatgacatgacattttatgatagatttatcctttaaccaatatttttacaatatttggatataaaaacatttggattatattgaaattattttaataaacaagttttcacattaaaagttatcttcagaatttatgatcttattagtattttaagctagaacacaaaacagtgtattaatgggtttgaatacatgta

SEQ ID NO: 29870 - DNA, 1134 bp, Mus musculus
ctgtatgcatgcatgtatgtatgcatgtatgtatgcatgtatgtatgcatgtatgcattcacgcacagtggaaattcatgcaatgttctagttaaacaaaaatgattctaagttaaatacataaagcaatcacatgggttttattttctttttccagatcactaaagtggttcttagcaaaggttggagatgtcttgagtgcactgtgtgtgaggcctgtgggaaggcaactgaccctggaagactcttgctatgtgatgactgtgacataagctatcatacctactgcctagaccctccattgcagacagttcccaaaggaggctggaaatgcaaatggtaccctaggattcatgttactttgtcagtctttcaagttctgaacttctgttctcattctgtgcacttgtagcttctcagatttttacactttaatacgaaaataaacttgatactttcactgggctttgggtttcaggtgtgtttggtgcagacactgtggagcaacatctgcaggtttgagatgtgaatggcagaacaattacacacagtgtgctccttgtgccagcctgtcttcctgccctgtctgctgtcggaactacagagaagaggacctcattctgcagtgtagacagtgtgataggtactgcgccccttaacctcctttgctatctttaaagcaggtttctcaaaggtagtaacaaaccttagaaaattactttgctggattataaatttagggaacaaaactttgctttctagatttttagtctattagaagcttccggactactttactatttaaatttttaaattttagacacttcaggctttcaattgggggtcttttggtgatttatcagtcccttgaaatcagatacataattagtgtttgcacatacacatttttgtggagaatttctcagtcttttggtagattctaaaaatattctccctacattcttcttttttctcactatttcgcccctaaaacttaagatcttgatcttcctaactagtatgtgcagactgcttctgttgtttttctatcagtattgttagcagtttagcactgaatgtacagtgtcacctttgactcattggtggtgcaggattatttgtaagtaagttgtg

SEQ ID NO: 29871 - DNA, 1146 bp, Mus musculus
gaaggctggagcgggccggcgaacggcaggtgtccgccccgcccccacccccgcgggcaggaagaggaagcggtgcggcccggccccggggccacccgcagggcctcgcggggcgggggcgccggagctacaagaagcgcgtgacctagttcgtcccgaagtggacttgacaggttgtcatcgcggctccccgcccccactgtcttccgggtctggctcctcccccaccctcgagctcccactggcctcgcccaagctgtactccctgccattggcttcaaaccaggggccacgccccaacccagctcgccctgccattggccacgcgtcccaggccgctctcccagtcattggcttcgtcccagaggccccgcccccagtcttgctggtcctcgggttggccttgcagcgcccctctttcggctcgtcctcctattggcccctcgcgccaggcgccttgcctcctatggtccgcggtggattccagctggtcactgttgagtttgttcccgtgggcattccggtttctgtcggcttccctccctctttgctgcgtttcttcctgctttctttgggtctgggagcccgggcctcgatacctggtcccggtcccaaactcaatgtagcagcgatctacatttgcctctgtaccccgccgcaccccgcccctttcaactccttcttccccagcccccacgcacaccgccttcattccctcacacctctccttaaattcggctgagtggaacagacttcatttcgaaatcagggagaggggttaagtgataaacgtcaatatcaatattagctggttttggttccagaaaggaactggacggcccagatcattcaaacattttgttgttgatggtggtgggggtagtgcttttctttgggtgtgtcttaggtttggaggtttcttcaaacaggatctcacctctccctttgtatctctgactggtttggaactcgctagttccttggtacggggtttgactgcagaagccagagagggcggccgctgggttcctggagccgctggttgtgggccacctaacttgggggctcctctgcagaaggtttcatctctccaccctgggattgaatttttttaattaattttcattttatgtgcattggtgtttt

SEQ ID NO: 29872 - DNA, 1231 bp, Mus musculus
tgggatcccatgtccatcttctgagccatcgatggagtcacaggcaggctgccatgccatgccaacctggcacttctgtgggttctggggcggggggtgaaaaacagtggtcacacagacatggcaagcactgcccactgagccttacagatctccagcatatatgttcttgtttattttatttggcatgtatgaggggtgtacatgccccagcacatgtgtggtgagaggtgtatgcttatggaggtcagagaacaacttgaaggccgggtgtctttctactctgtggtgtttgggagtcagtctcaagctgtcgggcagcggatgtctttgctctcagagccacttcacacacctctgccttgaaagtgtccacacaaatcctagacaattctattttacttagaagttctttttagtgcatatggttcacgatatttttaaaagtataaccgcaatgcttgtgctacactcatttttatttttgttggtttgcatcaggatctaaccaagctcctgctagttttagtctgtgtggaaaagtggtcattctattgaagtctagcttcacagtcttctttgtgtgttccttcatcttcatatttgaataagacggactgtcactgtggacagccagcaaggaagttgccacaacaggattcttctgcacatgtttattgggagagcttgatagagaaggcaaagaccccaagccccagaactggcgctgcttatataggcctaggagtggcatgtctatgcctgattggttgtgctttcagtacctcatttacattccccgggatgggctgtgatgtggcgtgaaacccttatgcacatgtgcacattggttgtttacccaaacttacgggtggtggccagcggtagccagcgccatcttgtaatggcgtatgtggcttcccacagtcaccacactgaagtacctgagactgggcaacttactaaaaaaacacaggtttgtgtttgtttagcttctggtcttggggcctaacagtgctgtactggctggttttgtgtgtcaacttgacacagctggggttatcacagagaaaggagcttcagttgaggaaatgcctccatgagatccactgtaaggcattttctcaattagcgatcaagggggaaggtccccttgtgggtgatgccatcccttggctggtagtcctagattctataagaaagcaagctgagcaagccaggggaagcaagc

SEQ ID NO: 29873 - DNA, 1155 bp, Mus musculus
gctggcctgcctgcgggctgagctggacagtccttttgttgtttttttttgagacagggtttttctctgtagccctggctgtcctggaactcactctgtagaccaggctggcctcgaactcagaaatccgcctgcctctgcctcccaagtgctgagattaaagatgtgcgccaccaccgcccagcctgggttggacagtccttaagcagagaaggtaggagctgacttcctgacttcctcagccactgcaaggtggacagccagttacttcagtaatgcttccctcggggtatcatgctccccagttaactcttctcaaagactaatcagtgagaaggaagactttttaacccagggtctcactgtgtagctccggctgccctcctagttgcaggcattaaagatgagttctggtctgcttggctcattattataatttaaaaaatagtttggcatttctaggagccagtcttacagcagacatcccattctctggctcttatagtctttccgccccttctgagatgctacagccctgagccttgatgcaggatgtactgtagacagatgatgggccgggcatctcatgctcgcttgttcccttcatcttgatctctgtggttttctgtaatgatttctgtggcaaagagacatttctttgttgaggaatgagagctatacttaatctttgtatatttacaatgcacagaggaattatgctgctttaataaagtggtttattaatacaatttaaaacatttctatatttcatattttcattgttttcatttaaaaaaattgttgtgtgtaccagcaagggtgtggagttcagaggacagctctcaggattggttctcccctgccatcttgtggggttcagaggtcaaactcagaactacacatatgcacctctacatgtcacgcaggaataatttattaattattcgtaatttcctgtatggaatctgtcacttttacagtgctgttctcccatagaagacgtgcaaggcagtctctcccctctcagccctatagcctggtaaagtgtgtgacaagcagctttgcagggcctagcagagctctacccttgatgtgatgtgatttccctatcctttaatggactgggttattcaggaccatgactaaaacataaca

SEQ ID NO: 29874 - DNA, 1120 bp, Mus musculus
tcagtcagaacatgctaaactccaccgagcttgtcttgaagctcaaaccatgatacacatttcagactaggtcactttctgcatactttaggaagggttcaccgctggtcccttggctcctagaggctgtggctggagagagtgcacagagctgttactctaatcaaaggaagacacacagggccaccagctcatctgcctccctcaggaaactggaatgagctgggtgtgctgacaggtggctctccgtgagctcaaagcttgtctgatctagatagtgaattccaggatagccagagctacataatgaggtcctgcttcaaagagctactcaggaaacagatagctaggtaaatagatgagactagaatgttcgagtcttcctccttcctctcgcccatttttcttctttctacctgctccccttgtcccaaggatgtcctatagttcaggcaagtcttcatcacatttctgcctctgaggtagccaggtaaacaatgttgctccttggagctgagaattctgataagttgcacttgaagatgaatgtctatgatttggggttctgtgtaatttttcacacacagggaaatgatgtactcactttcgaattcggaagttcattttggaatgttcatctcactaattgatagatctgaagagttatactagatgccttggaacatctaggctgttatttccagctgtgcgctgagggagacttggcactgctcaggaggtgtcctagtgaagattactgttgtcatgaccaagcactgtgagcaaaagactgttggagaggaaagggtttgttataaggtttacacttctcttgtatattgtagtccatatttgaaggaagtcaggacaggaacttaggaagggcaggaactttgaggcaggtgtcaatacaaagtccatggagggtgctgcttcctggtttgctccacgattgatcataatgcctactgcctgatcttatggagacatcttctcaactgaagctccctcctctctggtgactctagtttgtgtcaagctgacataaaactagccggcacagagtacctgtaggaagaaggctttagaaaatccctttacatcttctgacccagggaaa

SEQ ID NO: 29875 - DNA, 1120 bp, Mus musculus
aagagagctatctgagtgcttatactatctgagtgcttagccaaagctttgaacgaatgcttcaaactgaaattggttggttggttgattgattgattgattgattgattgaggtaaccagagctcaataccaaggccttgtgcttatgagtcttcaattaagctttgtcccacctctaaactaattcagaagagtattatgtaacagcatgccttgcgtcttgtcaccgattccagagacccttttctccaaacgctgctgagaatcaccttgcatccagagagtagcagacattggcgtgggaaggtgttctcagcagggtccaggtacagaagtgacccagtgcatcattgttccagcctcacaaggatttgtgtagttgctgaggccagagctcccgaggctctgggtggatttgggtctgttctgcagcttttgctgctgcttccttctgtcttagccagtgttttattgtcatgatttaaatataaggacaaattaagtagattaaaagattaaaccaggtctggtagttcacacctttaatcccagcatttgagagcaaagacactcaaatctctgtgggttcaaagccagcctggtctatgtagtgagttccaggacaaccagggccatattgtgagatcctgtctttaaaagcaaagcaaataaatttaggtaaaattaataagttcgaacatatagtaactctttgttccctaaacagacactgtagtttttttataaagtgactttaggaacatcttaagaactgattgattgtgtattttcaatgtagtgtgagaaattaggtgttatttaaaaactctaccattaagatcagataaaatgtgaaatcttaggtggaggttggagcaattctggttgaaatttagggactgagccaggactttacaaggctctcactcaaaagagccttcttcaggatacagttgccgagtcctgtgtaaagatgggtaacagttttaagatgtaacatttccactttggaacagaaaataattgagcttacattgtcaccttctgctcaagacacatggttgtaggaggaattttgagtatatcgaagtatgttcaggcagctaattctcctgactt

SEQ ID NO: 29876 - DNA, 1162 bp, Mus musculus
tttgctgttgctttgtaaagttgggaattgctgagtgagttttaaaaagcgaagtaaactgcctggtttgttatcaggtcaggtgtggtactgtgattggcagggacccatggataagtccctcccctttgctcaatgttttcctcttcccacctgctcatcttcttcctcctgctggctgctcctcttgcagccggagttctttcaggtctgtcacaccaagaaggactatgaggaatacggcccaagcatctgccgccacaaccctgtcttcggagtcatgtcctagtgtctgcgttggagccattgtctgacaagtgtcctgttggggaataagtgtccttcagaacccagagcagccacggctcctgtacatagcagtgtggaatgggtgtgtgagcagcgtgctttcatcgccagtggggccaggcacggtcttcccagtaaagccatttatccggtacgactgttcgtggtcctcctcccggcccctcccctcctgcccctcccactctctctcctttccacccgagattctagtcaagtgtagctctgaaggcgtccatgcaactgtagaaactactagaggatgcagtggtttctccaggaaagactgtaaggtggaggaaccctggccttcccagcctatttttgtaaataaaatgttataaacttgaaatacaaattgatgtttatatttcctatcattttgtattttatggtatttggtataaccagctaatgctaagcatgagtagtcacagagttcatggatgtcagagttctgtaataaagtacttgattgtgaggcatgttctgatgtgtgtgcaggctttatgccatgtctgctgggaagtgattacatgttgttggggtggtgtgacatctgagcaccaaccactgttgagtgagagttgctacagatgtatctaacttcctggagctgctttatagaagacaatggtttaatgttgttgagtgcgggatgaaatactattgcactgttgtaataaaggctgctagaatctttataactgttccttgtggtctcttttgcctccccatccattcagagaacctcagactctataggtttgcagacaattgatgattgatacagtgtgtgtgtgtgtgtgtgtgtgtgtgtgtgtgtgtgtgtgtg

SEQ ID NO: 29877 - DNA, 1133 bp, Mus musculus
gcacagcctcagccaggtgcctgctttcatgagctcaccctgtttattgtctagcctcctgccatgttctggtctgagcccctcaaccccaacattcttgtcatcaaactctcctcttccccctttctcttctgcttcttttccctttcttcccttccccctctcctctcctctcctctcctctcctctcctctcctctactctcccattcccttcttcccctctgttttctctccttgcttcttctctccttaagatgacatcaatgtcatcctagcccagtcaatcattctaaaatctgtttttctcctgaatattcaggcactctgtccttatttaaaaaaaaatcattatagggtatggaaacagtacctcgttgtgcactaaattgcgggtggggagggggaggttgggagcatggaagagtctcatctagaacggcccagcctataggtccacatggcatcagaggcatgttttcaggcaataggagagcagaaggggatgtctgatttccagcctgcctgactctcatatgtgagaagatctagaacactctacactgactttccctcatcagaaggaaagctctggatcccacgaggactttgcaggtgtctgcggcatcttcctgttccctgagagatgtgttatctgatgtttttaatagcatcatctgctggtgagggtgaggctctgagctgcagcattgatcttgtcactttggggaacagtttgatatttaggttataaatagcattttcattgctctgttaccatgttcaagactcatttgacatctgagccaaatagtataattttcttatcaaatatgaagatgtacagttttcctgaggcctgaactcaagctttctgaggttatattgacaggtactaaagaaagagctttgctgtgaagccatcataattcagaagggctacagcgcttctctcctgtagaaggaaatggagccctcactgagtcgataatcactggtgaatatttcctaagccctatctctaatccagccacagagacttaggtcttgtgacaacctgatgaggaaatggcatactcactgctgtgtcacagtggcagaccaaagcgaggggcacactaccacagggctaca

SEQ ID NO: 29878 - DNA, 1147 bp, Mus musculus
aaataaggctgctatgaacatagtggagcatgtgtccttcttaccggttggaacatcttctggatatatgcccaggagaggtattgtgggatcctccagtagtactatgtccaattttctgaggaaccgccagactgatttccagagtggttgtacaagcttgcaatcccaccaacaatggaggagtgttcctctttctccacatccttgctagcatctgctgtcacctgaatttttgatcttagccattctgactggtgtgagctggaatctcagggttgttttgatttgcatttccctgatgattaaggatgttgaacattttttcaggtgcttctctgccattcggtattcctcaggtgagaattctttgttcagctctgagccccatttttaatggggttatttgattttctggagtccaccttcttaagttctttatatatattggatattagtcccctatctgatttaggataggtaaagatccttacccaatctgttggtggtctttttgtcttattgacagtgtcttttgccttgcagaagctttgcaactttatgaggtcccatttgtccattcttgatcttacagcacaaaccattgctgttctattcaagaatttttcccctgtacccatatcttcgaggcttttacctactttctcctctataagtttcagtgtctctggttttatgtggagttccttaatccacttagatttgaccttagtacaaggagataggaatggatcaattctcattcttctacatgataaccaccagttgtgccagcaccatttgttgaaaatgctgtcttttttccactggatagttttagctcccttgtcaaagatcaagtgaccataggtgtgtgggttcatctctgggtcttcacttctgttccattggtctacttgtctgtcgctataccagtaccatgcagtttttatcacaattgctctgtagtatagctttaggtcaggcatggtgattccaccagaggttcttttatccttgagaagagtttttgctagaggatagatttcttcatttgtcctatctgaaaatggagactaacatttaatcattaaacattggcaacagcctccattcaggaaagtgaaataagggggctggagaggtg

SEQ ID NO: 29879 - DNA, 1148 bp, Mus musculus
tggtcccttctccaaaactcgcgtgtgcgtgcatatgtatgtgtatgtatgcatgctcatgtgtgtgctcacaccagccacgagcatgtactgcttgttgaggctcaagacagtggatcctttgaagctagagattcaggcagatgaatgcgtgctgggaggtagacttgggctctctcagagagcagctctcattcatctctgctgagccatctctccagcccatcagttatagtttgatattctgatgggactttctgatacagtgtgaaggtttgttagggtggtggatctgctctgagagcatttggtagttagtggagacaccagtggtttccattgtgaagtcggatctactggacactgtatgccacccaggcagttctgccacacacgccactgaccaaaatgtccacagtgctggggggaagaagctcagttttaagcaaaaccgttgcattcctgtttctttgaaatgactgaatggtatagtgttactctgagtgctcggggagattctgcgaatggggagtgcggcacgccagggtcatctggcctctgttcctagctggctgaattgaaatcacagttggtaatagtctgaataattggaagtggtgacgggtttcctggatcttttgtgtagataatccaggcacatggtggcactgtggaccccactttcacaagccgatgtacacacctcctctgcgcaagtcaagtcagtagtatgtacacacaggtaagaacagctggccaccctggttgggaggatgccacagtgttatattcatccctagaagcaagtgcttgctgtgtgtacttgtggaacagggtgtcatgttgtgggaaatcgtaaaaaagattggcaatttcctgcactatacccaactactctctgcccatgatcccactgcctctaggctagcctctgtgtgagctagtcttcccagctcctgttcgcctccctcagagctgcccattcattctcagccatctaccccctgtggtcagtagtcccaaacttcagtaacccggtaaaatcaaaactctagaagtcagatttgtataacaataaattctcaattcataagatccccacacaatttcagagccagttgataatgatacaagctgcccacctagat

SEQ ID NO: 29880 - DNA, 1667 bp, Mus musculus
tagttataatcaagataatttcttacagaggtgcccagatgcctgcctcctaggagccaaattggcacttaatattaatatcataccctgccactaagtgttggttttaagttgtattcatactgtatgtttaacttcttgggggtaagagggcagccacacctttctgaccattcctaatgcattgacctgaaggcacttgcccacagttcctttagtgagtgtcaagactgtcttggactgccagctcggcaaaaagcattaatgtgtataaatagagatttcagctctttttttattattttccaaaagatttctagttctctgtgtgtacttgaaatgttacctataaaagttgatttaaaccaactcttgtaagcttcctacttgagtcaaggccccttcttgtggtgcctcttacagctctagctcacaggtacaggagtgggcttttcctctccgggtagcatggcaggcacatcaacagctctgtatccatagccctcttatcgcaaatgcatgattacaggaagagagcaaaagcgtcattcagtatgttatgtttcattcctaggagaaatacgagcgtgctgtcaaaagaacaagtattaagattgtcaccccggactgggtcctggactgtgtgtctgagaagaggaggaaggatgaagcgttttaccatccacgcctgatcatctatgaggaggaggaagaggaggaggaagagggagacaacgaggagcaggactcccagaacgagggcagcactgagaagtccagtgtcgccagctctgcagtggcctcccctgctgagcagccgtgctctcccaagcccagggctgaggtgtccaaaggagagttgatgtttgatgactcttctgactcatcccctgaaaagcaggagcgcagcttgaactgggcccctgctgaagccccaccactcaacacagcccagcgcaggctgcctcagggaaaagggccaggactcattaacctgtgtgccaatgtcccacctgttccaggggacattctgcctcctgacatgcggggtaacttgatggcccctggacaaaacctccagaattctgagcggtcagaaatactagggacctggagcccagctgtccggacgttgcgaaacattacaaacaatgctgatatccagcagatcaaccggccatccaatgttgcacatgtaagtctcgggagtctgaaagctgccttaaagagtggggttttatggccctgccttcagatgaggtgacttataagtcccatttttgtgtgaatttctttatattcatgttaaacaggcagaagtcacatggtgacatttgggccagcagggaaccaaatacctgctatccattacataaggccttatggccctttattctcccaggagtgaacttagtgggtttcctaaagacccatgtctttgtatgctttccctattggtacttgttattatgtatttcagtgttaaagtcacactgatagcaggaagaatcttatgagggaggtgatgtcagtcagacttgaatggcaggtgtggagaggaccaaggtccgagttctaggtgaagcccaaagtgggcaaggatttgctgtcctctgagaacaggagatgttgcctgggtggtgtgagaactccaggggctttgttat

SEQ ID NO: 29881 - DNA, 1195 bp, Mus musculus
gggattttgtttatttcttttctaggtgggtggggtgagcagcagtaagagtgtggacctaaacttacacgtctgtcaaaatcataaggaatgcagtggctgcttcactctgggcctggctgggcttgtggcttgggcacatgacctttggttgctgctacctggtcctcatgcttacaggcgggtgtctgtagtaggtcacaacagagccttttaatttccaaaagcaactactagtgaggtcatgtcattctggtcacagattgtgaatgttttttgatttgtgtaattcttctttttcagccttcctgggtgactctgtccgtgcaatgtggcgctctcctgccgtatccttttgtgcgataaggacggggatagctgtgggtttaagaaacagtgagttagtgggctcatgagttgggggtctgagggaaagcttgggtttaagatacagtgagttggtgggctcatgagtgaggccagccctttcctctgcacctctgcccctgctctttcctatcctgtatgaaatggtatgtacctggtcctcgtcattacctgcgtcaaaaagctgtgactagcagttgtggcgaggaccctgggttgcagctcttctcagtcttatgtctgtttagacaaagattagttttagaattctaaatcaggtgaggaagtacgaataactcctagaacatgaggaggaagttctgagtttgaaggcatgtgtttgtcttttcagttagatgcatggaaagtttattattttacacttcctacccagcacttgctctggtgtgaaaatagagtgatgaagaccttattctgggactaggggttgcagctcagttatagaaggctatcttaattttgggtcctgggctcagtccccagcactgtatgaattgggcatattggcgcatgctcataatccgaacacttgggaggtagaagcaagaagatcaatagttgaagcttatccttggcttcataagagagagttcaaggctaccctgggctgtatgagaccctgtctcaaaacaaaccaaaagcaaactcactctgcactgtgtagcctcctccttacctgtgtccaccatgtcatattttcatgctcagggtcctgtgttgtgtcccaactgggccactcctcaccattgctgtcttgctggaggcttactggcttctgcttcactgt

SEQ ID NO: 29882 - DNA, 1059 bp, Mus musculus
agacagtccctcccttcctgggttttactctctttgtgtcttctggagtgcccaacttctgctgtccaaatgttttggagtccaatctgtgtttgtgacagttcctaactctgagaaccacagaaccttctttgccctccactttacttacataatcctcatttcacacatgcgaaaacaaactcgaggagacctgtccagcctctctcccttcttgagaccctaccctcctcacagtgtgagacttgtcttcactggggccaggtcaaggctgagaaaaagagagcagtgtggggtggccttcccacagccttttcttacaggtgtatgtaaggtaatactttgtgctacaggtgacaaactgccgaggaaaataagtggtttggatcctactaataatgaccacacaaggactgattttcaccagtgtatcctaatcctgttttgtttttctttaaacagctgttgtcggtttactgtatccctgtattgacagtcacctgggagaaccacacaagttcaagagagaatgggccagcgttatgcgctgtattgccgtgttcgttggcatcaaccacgccagtgccgtatcctcagttggtgtctgtgcagagggtcatctgggttgtggcagggtatattgacactgctcgtcccctcgttcctgagcttcagagtatgacttggctttcacgtggcaggaattttggggttccgttcctaggacctctgtactaagagtagaagcagaggtttactgtggctcagtggacttttgtcctctctcttgccttctaccccactgatgtgctctgtggtagtgagagccctgtccctgttctctgtcacaggagcccaaggctggtcaggaggtccctgcgggcttctactttccatagctgacattttgcccttcgtgtaggctgctgtggttttatgcattttctatgaaaatgaccaatttgatggtaaactcttcaaatgctaagtttctagagcaacttagagtaaaagatcttgtgaagttgtgtctgcacttggggccttcctttcctgcca

SEQ ID NO: 29883 - DNA, 2726 bp, Mus musculus
aggcctagcagaagcagcgactcctggcttgacctgacaggctccagcaaaagccacttaccttttccataagtaaatctcatttaaaacagttccaccgggtcagctctctggtgcacctgtcctaccttggcgtgggtggcagtgctttgatagtgctgtttcctgtggctagaagcttagtcatgtagttgtcatcgtctggcttgtatataacaggctttataggaaggcattagcagcaccagtctctctgaggtcgagattggtgtaacttgataggtgcgtgcttggcagcctgaagggcaatagtggggctcaccctgagcctgtcaccgtctgcacgcacgcaggcagtcgtttagccccaacatttaagcactgatttttctttctcttttccacacagggtgttccggaaaagcctcacagtgactgagcttcagcacatggttcagagtggaagcaggatgtagagacactggtcctgggtgtgatgaagatgatctttttctcaatgttccatttaggctgggctgacgataaatgactcctaaagacatgttcacttagtctagactagcaaatggaggcaaggactgcttacctaaaagtcttaccttgctcccccaccctcacacctgtcttctttggaacattccatcccaggctgtatgtgaaagtcgggtaaggggggcagtttcccgagtattagagttcactcatcattcaaagcaaatgccatatttcaaagccttgaatcaaaatgaattaccaactagcagttttgtgtcagtgcccaaaggagggaggttgatggtgcttaacagagatgaagtgtgtgtagtaagaatatttatccagaattaaaataaagggttgtgtaaagaggggttgagagcagcagtgagttggaggaagatcatctcccagtaggacctatagtgcagccatatctccaggtcacgctcaggctggcgctcacgtgtgggtttcatcagtgtgggaacgatgctttttactgccgggaggtttgtagacgacaatctcactgaaagccgagggcagcacaaagtcagggttctgcactgcgatgctggacttctcacctcagtttaagagaagttttatccgagctctggaccatctaagagtgagtcgctgtctgctgtttcagtcataatgagccgaaattgtgtctctgtcactccagggtggagaggactcttccacagccctgtggagcttgcaatctgtgattgcttcgtaacaggttgagtgtgcacgtcactgtgttaattacgcagtgtcctatgtgcgttggacagcatagaacacaacacgtgggacctaacttgcaaggattgggtcttcaacttcaagtgcaatgtgtatgaaaaccaatctgagccttgtattctcgtaaatatttattttgtaatttttgttaccgcacgagctattccggagaagggttctcgggtcatttcagaggtgcgtggaggcacactcagcaatactgtgtcagccgtgacgtccctcagtcataccctccactgcacactagtcctctgacatactccagctttgtgagttcagtgatttttacttacaaatttaccatttttgtattccaaaatgtgtttgttttaagttatatgaaactgacctcctgacacagtcgttggtccccaggcggggcagaagctctgtacctgtggacacctgggtttgggttaaccctcgcagggctcctcatagggggttgcttttttttttttttttttttttttggagggaaatgtttgaagtaaacctttgttttctgaaactactttggctaaaagaaaatgggttgtgctagactttgggacggttcttaaagtttcctggaaataaaaacaaatgattggtattttgaagacattcttcagctaagactggagtgtcttgcacaagctacagtgactggaagaaaaataagtgatcttggtgatgcacttgattgtatacaatgaggtttttttttttttctcttaaactggaaataaatgttagaaataatgtagccaaaaaaggtgaatctgaaggatgcttttgccaatagttatagcagttacaacaaaccaaagtgactgagtttgtacaaatggtaactagtaccaagcacactcactttcctgatctgaacacccagcgaggttcatgtccgtgctaagtttgcagcattgtgttcttttgcattctttttttttttacttttattaaaggttcaaaaccagctgttgtattcctgaggttttcttttggaggagacaggcacttttgcccagagtgttgggtttatggggaaaaggggtatgatggaatcttgatagacactttgggaagtgtcatttgagggtgtttcctatgaggtaggagctaaatggagcccagcaaaaatttgccactgcccctcctgcagtgatgtagcgggtaataggatgctcacctgctcttgcaagctactggcctcgggatttagggtcaagtgattggtgcctatatgcagaaaagcctcttgtgctccttaagtgctcaaagaaggcttctacttctagaatagtcccaacaggcttaacacaaagattcccttcaatccagagcacccaccatgcttaaccgcccaattgctggaatttcgggcactttgagcaccaacggcccactgctctatgacagtt

SEQ ID NO: 29884 - DNA, 1206 bp, Mus musculus
gaaagccacgggcaacaagaacactttggcggtgcacctcatggcacagggcctgtacaaccattccaccacggccaaggagggcaagtcggacagcgagtagggcgagcagggcgggtgggccggccggccggccaggtctagggccgcgagaaacaatgcaataattttaaaaccgtgaacaaaaggccagtgtataaagattataccagcattatctgtgaaaatccagtgtattagctatggttctacaataatctatgtacatataatttacaggtggtgtaaaatccaaaaatctgactataaaatatttttgagttttttttttgtgtttcagaggttatgctaattttatgttattattatttttctgcaaaggggactgtttagggtttcagatctttctttcatttttcttttctccctttttttaatcccttaaattccattatgggacattggacacttcttcccccgaaagaaaaaaaatttaaaacaacttgctgaagtccaaagatttttattgctgcatttcacaggactgtgaaccgaataaatagctcctatttggtctgtgggctctgccgcttgctttgtgctggctcggacagcactgtaggaagcgccagccagagtggtgatggagagctctggtggggagagagggcgcagttctttgctgaggtctgagaaagtccttgcaggccagcagctctcccggaacctctccgcctgcttcctacgcagcctctcttctcaaccatctcagaggcccgtgctggcagccaccgtgtgtctgcgtctgtgtcgatgacccctgtccgccacagccccgtagcgacctgccagcgccaactctcccgccaccgtggccagcgttggggcctggggagcagtgggagtgtgtcctgaaggcttgaaggctttgctgccgggacagctagccctgacccaaaagccctcaccgagataggccttggggcctggcagagcgagttggaatcatcttcctttcctttttcttccctcttttttctttttcatttatttttgaatggtaaatacatgtatgtgtacatacttgtgtatgcatgtgcacgcacaccccaggcctgtgtgaagctggggttctggagctcacagctaccttgactttcaaaggaactcgaatcctcccgaatctagaggacatgtgtaaataat

SEQ ID NO: 29885 - DNA, 1163 bp, Mus musculus
gaggtttgttggttttgtttgtttcctcctgattctgtgccattgcacattagtggcatcttcttggtttttgttttgttgttgttgtttgtttgattttggtttttgaattgaggcttctctgtgtagtgatggctgtcctggaactcactttgtaaaacaagctgacttcagattcatgtatattcacctgcctctgcctcctgagtgcttgtactaaaggcatgcaccaccatgcctggctagagacattttcttactgacctcattggtgcccagtagaggagtagtttcctcctctactgtaatggtctgtgaacattggctattttttagatttactaaatctacactgtgaaaatgaaagcatttaaggttgatagatgatacttgtactagagattggtgcttacttggttcttactgttctctccacagatgtgtgtgtgggggttgtacttaacacctgtacatctttttacatagaactttctgcagaagccaaagctgcattgctggaatttgaagaaagagaacgacagcataaacagggacgctatggttcccggcggggaggaaggcgaggaggttctctgatgtgccgtggaatgggagaccagaggcgagacaacagcgaaaggggaaggatgaaggagcacaggcctgccctgcttcctacacagccgtctgttgtggtaattataatgttacagtgcagtaccagacagttttagaagaatgaaggtgtgctcctgtggtccacacagctcacacttaccttttctgaagtgacactgaagcaatagaagaaatactgaagcttctcaagtttggtctgtgccaagattctatttgtagcccgaggattgggtatttcattattggcctgttagaaatccatctcagcacttctgttgagtagctgatgacctatgtggctaccaccgagccctgcttttctcccttatatcagtgagacctcctcaagtatgctgaaatatgctgatgttaacgcaggatttaggtcatagttgattgttttataaactgttttcctataggttttccccgctgtagcagttttcttaattatataccttctaaaaatgttcataacttgagattgaactatgcagttaaacttggatggatttcttctggga

SEQ ID NO: 29886 - DNA, 1172 bp, Mus musculus
ggcaatgcattctaatcttctggctctttctcactctctgtcttgttctgtctttacctgtgtctagcttgttctctctgcagtctgtctcttcaaaaaactgccacacactcaccacccactttcctcctcagtgctcttaaataacctgtctttcctgtctgttctttgtgagttgagtgtatcctgtctctcactcattctgtcagtctttctctaatccatcactttgcccctcaattagatgtcactttcaaaacatggctgctccattctacacactaacctcctcttcatttttagggattaaaggtgtgtgctaagggtgtgtccatactctagccaggtcctactgtaatccagtaggtatcagcattctggagagaccctgccttagcatgtgatcctatgccacagcagccatgttgctggattaaacttcctctatagcgtatctaagaagtgtttctaacttgaaggtaatgaatcactattcagtttcaggtgaaccaagattccccagtcatctttttttggaacagcgaagtcctcctccaccgccgcctcctcccacgctcctgaacagcagccatcctgttcctactcagagtcccttaccgttcactcagcctggaccagcttttaatcagcaaggacagcagccagtgttccctcgagagaggcctgtaagaccagccctgcagcccccaggcccagtggggatcctgcactttagccagccagggtcagcaactgccaggcctttcattcctcctagacagccatttctacccagcccgggacagccattcctgcctacacatgcacagcctaaccttcaggtatgcacatgagctagccttgaaggaaaccatgcctctatggtgctaagtctttgtgtttcatgaaagagaagtttcgggttttgtttctgctaacttacagttatgtaaatgataggagtagtagtcttaagtatactgttcatatagccagctcttttggacagtattgtttacttccttaatactaggaaatgtgataaagtgattcttgttttctaggaactgaacttggaattttaaaagcgatgtaagaccactaacatttaaagtatttaaagccctgatagtttatcttgtgtaatgcttttttagcatcctattcctgct

SEQ ID NO: 29887 - DNA, 1214 bp, Mus musculus
ttggagacttttaaaaaaattttaaagatttatttgttttatgtattttatttattttatgtatatgagtacacagtagctatctttggacacaccagaagaggacattagatcctattacagataattgggagcagcctctatgtggttgctggggattgaattcaggacctctagaagagtagtcagtgctcttaacctctgagccatctctccagcccacagttggagatttaaccctgtgtatgccatatgtccattggcctgcgccatggtgggagaagtgtatgtttggctaattgctgccagtgttgtactttgcggcttatgatgaatgaaagtaatgccagaatcccttccaaatatagctgtagaactttgggacttagtctcattctacttgctggtattgccctggttagctattaggccaccctttaagaagatcttatggctcacagcatgtcctgagggaccctgagcactttcttacttttgtactttattagccactacaggaggaatccactcaggtgtcagaatgtatcttctttgtcattgccaggccatcatgcatggacgaggacgaggagtggcaggtcccatgggccggggacgactaatgccaaataagcagaaccttcgagtggtggaatgcaagccacagccctgtgtggtgtctgtggaaggtctatcctcatccaccactgatgtccagctgaagagtctgctgatgtccgtgggccccatccaggtgggttgcctgtatgtgatgataatgccagtgggttatctttccagaacagtggccattgtgggttacatttgtagtaagatggtactcaagaagaaaaatgctagtgcttgcctcacagagtttaggaagtaaacactctagtggaacaaattgtcctttgaagtctgtcctacagttcacatgtgtacaggcacctatatgtttttgtgttggatcacattttatttgtggtaatttctcaaattttgaagtaaattagctccctagtcttattttctgaagctgtgtcacacactcacagttctggtgctcatcttagcatttgcaatacagatgtagcagtaacttacactttgtggtcatgtcctttaaaattgttggtctgagattgttacaaggatgaagacagacaccactccatgtcggctatgagcaaatggtctgaccctacaagtgg

SEQ ID NO: 29888 - DNA, 2399 bp, Mus musculus
gaaagaatgttaccagctcaaattccgaggatttttttttccacagcaaagaatatttgataatggttgcacttatcttcagtacaggctagaaaagagttctcaaccaggcttaactggagtggtctcagaaagccatcaacaggctctggtaaaacataggtaaaaatgggtgattatgattgacactcacctgccctggaaagccagggtgtgagatgggtgtctgggagtggtgccatggaagtggcgattctgcttcttataaatacctccaaagtgccacctgtttcaacagaaacgctcagattgctagctaggcaagcactgggcactccagagccagtggctctgccaccctgcaggcagccctcttggcctagttttcctggcatagggtgaggcacagcttgaaaggtggtcagacctgcttgggcttctttgcttttcaaatgtcctagctctgtagttcgtgctgtcattggtttgattgtctcactgtccttcattcagggctctgagtttcctttgggctgcctttctatcacatttgtgaaggatggatttctcagcagggctgatgctgcccaagataagtatatctgtccacattagtcattttagtcgattccaacaggtgagacttgctttctacaaagcatcccttagaagtccatgctgggcagacattgaacacagtgccttattatgtttctcccttgaatgcttcagtgttttgagtcatactctagaatggactgacactaggacacactcaggacttttttagttgtattttatacctgtgattttatctcacatatcttggtaggatggaggagacagaggtctgttgtcatctactgtcgctgggtaataaggagggagctctggactcaaagcagctggcttccacagctgaaggttttacattacgttttcaattaagttgccaacgttttaacaactggagaatggtattccaggccccaagaaactttgcttaggattgattctgagatgacactgtgtgctggcaaggagcattggggggcacagttgttgtttggtatccaggcagttgagctgaggcattcataggatgtcttagaagacattgtggtatggtgccacctctgaccacacagcctctgcctcacgcctgcttggtacactaagggccagccctgcaggggctgtacccagcttggccttagcccatctaagtgctgtcaactggtctcccactgtcactcccactcatttcatttggacacaggaaatgttgatagatatttcgttaaattggtgagtttggtaatatgttagctctcattggacaagatagacgccatataggaggctgagggttaggacacagtaaaatgaatttaacagtttcactgctttctcaagtagttttgagtgctgggtccttaaaacccaactatgcatttttgtctgaaagtaggcactgaagcattgaagtaaggtaaggagacatcctcttcgacaccgctgttgaccgaggagctcagggccactttgagtgtgatgagatacccaggaacacgtgtgcccacagctgaagttttacattacgttttcaattaagttgccaacattttaacaactggcacacacatgagcctacacacttgagcctacacacatgagccagtttttccttattgtagtgtcctgtgagacagaccagctccaagcactgcttagaacaacggctcactctgaccttgctacacatccatttggggtggactatcagaccaggcaagccagtcctaaaggcttctgtgaaggaaaccacagaaagtgaaagaagcagaattagaaagagcattccccacttgcagtgtccttctcacagggaagtcagacggtggaagatctgctgcaaccattatctctgttctttgtgtatcatgcatttaaaatgagatggaaaagcattagcatactgtgtaaatatggaccttttcagattaaaacgttaatggaaatgcttttaactcaaacagcaacatcttagctatttgttagttctcttttgttgtcttatcaaagtttaatggagacactttcataattgttgttgtgtgtacatttgattttcataaagatggtagtaagtcaatgcattaaccctcatctgtgtattatttgttcacaagttccagaggttgaaggactgactctcacatctgtcctgaggtagagagtaggggtggggacaaggtactttccctctctctgccttgtttattttgtactgtaatgaatgtgagtcactcagctgcttacctgaacataaccttatgctgcccttggcttggccacatttgttaaatccttattatattgatactcttcttgaggag

SEQ ID NO: 29889 - DNA, 1099 bp, Mus musculus
ttattcatttggaggttcttaatttgaagatgggatccaggtttggactgactggagatatttggtgatgagatggaagtgggctttaaggattgtcttaccttgattcttgggccttctgtggttgatgcactgcgtggtcaccaccctttgagggtcactggtcactcacctgagagttgcctggagggagggactggttccaggtgccatcacttcactgggcatgtgctagaggctggctgatacagaacttcacgaaaggacagcagcatgctgaggcttcatattccaagttcgtgaagacagttatatgcaggagtcctgcattgcagtgctgttttacagagtgcagaaagctctgcagacaagagctcccattcacactagtcatggcactctagttttgactagatgaggttgcaccagtgactctgttgagtagtccttttgttctcttaccttgaatgtcctctttaaacgggcatgaaactgggcatggtagtgttttccttatagcactcaagtggcagaggcagaaggatccctaagaatttgaaccagactaggttacatagtgagttccaggcaagccagtgctacatagtgaaactgtctctcaaaagaaacaaacatacaaacgaaagcaaaaagaggaaatgagggttggaggtggaatggctggagagatggctcagcagttaaagagcactagctttgctttcagaggactcagatttggttcttagcatccacatggtggttcacagtcatcagtgactctagtcccaggggattaaataccctttcagacctccatgggcactgactgcaggcacatggtgaaggaaaaacacttccatacataaaaataattactacaatttaagctaaaagggcaccaaacactttatagatcttgatgagaggctatatcaaattttatacattgtgacaccggttttttatagattttctagcatatattttagatctatttatcatctatctatctatctatctatctatctttctatcatctatcttatataaaataaagtctgacctaaatatgagaccctgtatggttgtctaaaaa

SEQ ID NO: 29890 - DNA, 1271 bp, Mus musculus
gcaagcatcacacattcccagcttcccactcttattctataaatttgtagtattttggaactggtcttgtttattcagttatgtgatgagcgttaggaatgggtaaagtgttgccactggaaatgagatgtagaagtggaatagacatcatatatatgtaagtagtggggaagaacaggttctagtgaatggcacctaagcttggtctttaatgtaggcatgatggggtactcatgccagtcacacatgcaagtgactggcatgtgaaggtcagggatggcttgggttgccctgctaggaagcagtcgtatgcttcatggcagagtcttaccacagaactctacaaacctctgaggcagtctgtggagtctggcctaatcccaactgcatttgttacaggtatggacacaccccactttagtaagaactctatttttattttttaataggaatcactagattcgatctacttggagactttggaagatttaattggctgggaaatttctatattgtattatcctacaatttactcttcgccatcatgacaacattgtgtttgatcagaaaattcacatcagcagtacgagaagaacttttcaaggccctaggtaatcttgagatttatagacatttttctctactaatcatgactttaatatttgtctctctatttagtttctaagtgtgcatggctgtcagtcccatccttgactcatgtgttggtgggtctggatcagaactttgtcactgtactgcaggacctcatctgtaaggtgtgtgagtaggaactgtggttgttctgatggggcctcaggacagggcggaggacatgataagaactttaggatggcagtcagccctttctgtttatcattgtatcattgtgtcattgtatcattgtgtcattgtatcattgtgtcattgtgacattgtgtcattgtctcattgtatcattgtagtgaggaggaagacttggtgttgcaggcttggtttttatcatggtaccttttaccattatttacttgaagttttaggaggacttggatttcctaagtgaaaaagcaatatataattctcgccagtaagccatataactctggaaaacaatgttagcattcttggtatggacaggatagggtgtttgctttcatgtctccatcatttgtattgtggtaaagagcctgctcaagtgatatgtctttgctgcattactcctacacacatgctgaacatagtcctgggtttgtactttagggtaagcagcactc

SEQ ID NO: 29891 - DNA, 1226 bp, Mus musculus
aatttggggattgaaaatgctcacgtgtgtccagtggatgtgtcactgcacagacatgtattcacagcaagaacactgggagcaaagatcctgtacagtttacagtggcactgacaagaagacattcctggggtaagactgagaattgctccagacttcataaaaacagtattgcaactgtagacttaaaggcttatctccagcttgtggtgctattttgcacaatggttctcaaccttcctaatgctgtgaccctttaatatagttcttgatgttggggtgactcctaaaccataaaattatttccactgttacttcatagcagtaattttgctcccattatgaattggaatgtaaatatgttttccgatggggttaggtgacctctgtgaaagagtcatttgactcctaaaagggttgcggcccacaggttgagaaccactccattagaaggtgcatcttagcagccagaagctggaggcatgtccttgaaggatatcctgtctgtagtcccttcccttctctctgcttcctggacaccttgagatttgagaaaccaggaaagcacctcagggtgaggtgttatcagggagaagcacctcagggtgaggtggtatcagggagaagggggcattgacacaggtccaaggggttttgacactaagctttgtgcacacttcattctgataagggtaagacgtaaaagtcaatgaaaactaagacaaatagtgtggaaagttgatgttctatattttactgaatgtaattagggtaaattgacggtaaagacagaatgaatgagtgtgggctacttagaacatcatcttattctaggtcctccttgtcttttctctgataaagccaaagctttgtatctttcctttcctagctgaagtaggaagcactccaaagctttccattctgagtctagtgacttaaaggccctgatgattggggtgacctcttcctgctgtgctgtgctcaccaaggctccagaagcagatcttggggaaggggttctctaacattcttacctcttctgcttcccttttcttgtcattctcacctattatttctaagtctcgatgtgaatttccagttcctgttgttatatctccattttcatttctgattctgctaatttggatactgtctctgtgctctctgcttagtccaggtaagggttcatctatcttgttgattttctcaaagaaccagctcctggt

SEQ ID NO: 29892 - DNA, 1124 bp, Mus musculus
gagatcagggatttcccactgttgtacccacacagtctgtgcaagcagaactgtttacttccagggctcggcagtgaggacccattacagtaatcaggagaaaatcatttatagctcttcccagtgttaagaggctgcatataccataacatgcttaactgtttaagtaatgcagcagcattaattgaaataattagattttgtgcgtgtatagcccatgggtgtactggataactttagaagttctataatgaatagaaattatttttttttgtttgagttcaaaacatttacagctcttttaaggtaatttatttttaaactattaaagtctttgaactataattcaattctgttaggcactattttcatctttgtgataaaaatttgtatatcacttttggaggagtggcagtttcttgcttgttttattctaagtaagtttttttttttttccagtactggagattgaacactgggccttctttgtacatgctagccaggccctctaccactgagctctcgccagcctcttgatcctaatctttttttttttctttcttttttttaaggctgttcacattaaaatttacattaactctttattcagagcacagaagcagtagcagttttttctaggttttaataccgttgggttctgaaaaacaaaggggctgaggagaacaagctgtgcctgtgcagcctctcttcccggacctcggggacctcggccagcttctgtgtcattgtcagtatttgattcttgctacttagaagttgagtttcagggttttgtgaagatactgaaactcaggatttatctgtggctgctttgtcatagtgctttctgtcaggcacttgtgttaccgctgtactgcaggcagttaggatattgcttatctaatgtcatttatagatggcgaacacaatagctttcttaatcaatgagtaaagaatacctctttgaatagggatataagcaccatatgtcaagtactatagtaggctatatgtataaattactgtatttgtttgcctacacatcacacacacacacacacacacacacacacacacctctagggaaatattttggacttcaactctgggattctatgcaaagt

SEQ ID NO: 29893 - DNA, 1200 bp, Mus musculus
tgggatatagttatatctgttttgttttgtttgagacaagatttcttggtataacagctttggctgtcctgtaacttgctttgtagaccaggctggcctcaaactcaaaggagatcggcctgccattgcctttggaatgctgggattaaatgtgtttacctccatgcccagcatgttttatatactttaaaataaatctttgtgtgatgaactttctgttaacttacagaatttagatgtctttagagatacttaaagcagtgaatattattcatttgttcaacatactatgcagtgtttgatatatatttaattaattgttttttgttcttaaaatttcatggagcattttctccctttgaaacatttctcaaaagggttatttattattttcttactttagatctttttattctacaatttagaaactagactgcttaatttacttaaataggcaattacagtgttcatcatatatttctacttattaagataaagcagactattttaatgtgccacgctttcacttactaaaatgtgctgatatttttacagatctctgggaattctacttgccctatttgtattcttgcatttcgctgatgggatgcttgctgcttctctgtaagtactcttcagtgtgacactgacaggaaagggagtttgtcttggaccctggaaaattgtgccagtttcctaattgaaactccttaatgatgggggctgtttttcgagttggcctttttttattgttctagatagattttattaagcagaactgtgaaataattggatagtttgttcactaagccttttgcactgggttgaagacacacacacacacacacatatacacgcaccacagaactctttaacagtatcccatgtccccctccctccatgtctccaccatgtacacattctttacgtctacttctagtccaaatattaacactagatcactttaaatggcaagaatacaattctacttgatgaatttgtagtctttatttcaaaatctgtttggttttactgaagacgccacactcgatcttagggatagtttaagttgtcaaacagttcaaaggacttgtgactgtagctgtcactcttagatactctctttgggctctcagtcctcacaggtgacatggtctgtgtgctttttctgggtctatttagtttgttttaagcagagag

SEQ ID NO: 29894 - DNA, 1198 bp, Mus musculus
gaggccctcaaaaagaaaggagaaagtgacctattgaagagcaccagtgtgggagcctggggcctttggcagaaagaagataggaccaaagccacacatgggcccagggagccagggttttttcttggatagaggaagatctgcctagatagttgactggcagatcctgtactttgctggccgctttgaccccagtgtagaatgatgggaggtggcctgatcagggaaaggcttcaggaatcttgaaacaaaagtagcatgtatgagtgtggtggcagtggatgtagccttaggagtcagaagtaactttcatgtgatgggagtttgggaaagggaagactggaagggaagatgaccctgcttctgaatagtcaagttggcatctagattaagtcttgacggagggtttgtcatgaaggatacagggtcaccctcataccagggctgggcttgtgggagtggaggagggaaggcccgtggatagtgctaaggtttgagagtctactgttttaaaaactgtatccctgaaagcagtgttgaaggtaacacagactgcctccagctgtcagtgttctcatcattgttgcctctctgcgtagctgagatgtatttcttaccaagctcaatcatcagtgactatcagtgataagtatcggtggatttctttacccttaaggtacggtttatgttggaaacaatgctggctctgaagaacaatgacctgcgtaaaatccctggttataatcctgagcctgtggaaaaactgaagaagttacaaagaactctggtgagtgacaccctattctggtttgtcctgaacctccatgccattatggagccatcatgacaatggttcaggctatgttctgcacaagtgtttgaaactgtaaatctgtccaggtcgtaatggcatatgccttttttttttaatttttttttaatcatttattactttacattccaattttagccccttcttcctcctggtttcccctcacacagctcctcccctgtcccctcatccccttttcctctgagaattaggcctccctgagatcaccccaccctaacacatcaagtcacactgtaggactaagcgtatcctctccactgaggccatacaaggtgtctcaggggaacaggatccacaggtagtcagcagattcagggacagcccctgctccagttattggggacc

SEQ ID NO: 29895 - DNA, 1828 bp, Mus musculus
catttaagctagcatggaggacagacacaagacaaaacatcctttgtgatgggatgtgttggaggaagaaaagcccagcatgctaaggaaagcatactgttaagctcccttcaaattcaacttgagtttgtgttttctccatgttggtgtttgtggttgtctatgtataatatgtttatcgtactgctaaaaatgagatgctttgctcagtttttgatgcttttctaagaaacacataatatgtgtgtgtgttaacctaattttctatgtggagttgtaactaaagagtaactacttcagaggacagaggactccaaccctgggtttggagtgtatataccctatagctatgatccccactgcattgtagctcacagcctaggaaccagcccaccttgccagtagtaagtactctgtcattgccagcagttggttcctgacagccagtgttgtagagagtaagaagggccacaaaccatgtactgaatcagcatggtgatgctttcctaccccctgacccttaggtagttgaattcagtgaattggataaacccagagttcacttcctacggagggtgttgactgcactgttgatggaaactgaagacgacgacttggctgtaattttttcaaggtatgtgcctagtgttccctgattgaacgtaggaagacttcttgctcttgctccttcgcctgcttgctgcgtgagactgagtaactgctagatccttggacttccattcacagctgcgactaaacaattgttgggaattgggctgccgactgtaagtcatcaataaattcctttactatctagagactatccataagttctgtgactctagagaaccctgactaatacagaagttggtaccaggagtggttctagagtaacagaaatacaaggatgaatcttttaaaatactggaattggcttattgatccaccacttctaccactgagtcttatccctagccctcagaaagataaaagtgggcactgtggttcataactttaatcccagagtttaagaaactgaggcaggagaattgctacaagctcagggccagactggcatacccagtgaattttaggccagaataacacagtgagactctgtctcaaaaaaaaaaaaaaaaaaaaaaaaaaaaaaaaaaaaaagaatttttattttgttggtttctatatttttgagacaggttcccactatatatccctggctagtatgaacaggctggccttgaactcacaggtctgcccagcctttgctaggattaaagacctgcaccaccacacctgacaaaaattcttaacaaagaatcctactttgaaagaagctggagctaggtggtagcgcacacctttaatcccagcactcaggaggcgttaagcaggtaaatctctgagttcgaggccagccaaggctacagagcaagtccaggacagccagggcagagaaaccttgtcttagaaaaaagcagaaccacaaattagctagatagctagatatgtaggtgggtggattcgggatggatggatggattctgggtgcaactagttatgcagcctatgctagtaatcctagcacctcagagactgagtcagtagggtcacaaatttagcgccaccctgggttaccctctcctttaaaaacagaagccaggtataatgacattcttgtggttacaccttttctagagactgagccaaggatgattctttgagtccaggtgttcaaggatagcttagacactatagtaaggttctgcctaaaaatacagagattttcttcaataagccacaggattggagtctcagtagcaggaca

SEQ ID NO: 29896 - DNA, 1226 bp, Mus musculus
cagctgcatgtagagggttagccttctgggttggctgtaggttggatgatatctggggagatttctctatttctaatgtgtaaatcttactctacattaagaagcagaaccaaccggggagtggtggcacacccctttaaatcccagcacttgggaggcagaagcaggcagatttctgagttcgaggccagcctggtctacagagtgagttccagagaacctgtctcctggggaaaaagagaaaaaagaaagagagagagagagagaagcagaacccttttcaccacttgatatcactatgtactcctagatccccattcagccttaatgtaggtcaaggaactatggcttggtttatttatgtgtatagtgttctgcttgtatgtgttctgtgagcagcaagtgctctttaattgtttagtcaactcacatgaaactgtcaccatcattaaggtcataacatatcctctatatttcaagtccactcccatcccttattactgtggcttgggttcgggtagtcacttaatgtcggatgtgtttaagtacaggacaccgctcttagctgtggtccccatgctttgaagtacaatgccagaactaccctccattgctgttggtatccttgaacatcactacccccggcccttgacaagcaccatcctttttttgctattgaatatgttttagagatcatggaaaggtgagatctactgtgtttgtgtgtctcacttatttcactcagcatggtgccgtccatcttactcatgtggtcacaaataataggactgttctctgtatcccttcttgcatccttgggcagtcaggcttttgtgagtgctgctgcagtgaacatgggaatgccatgtctctggtactctgacctcagttttagcagtgagcttattgtaccctatggcatttctactgctcacttttggaggaactttcccactgtttgcataatggctgtaccaattttcatccggcccacacaacacaagggctcccttttgttcaaaccctgtcatcacttgttatgttcccgtgttttagcagtagctatagtatatatagtagtagtagacaggtgtgaggtgaagcctcgttgtggctttgattccacactcctgttggccattttatatctacttaggagaaaagcttattcataccctttgcccagcttttgtcagggtcttatatcacagcaacagaaatgaaat

SEQ ID NO: 29897 - DNA, 1116 bp, Mus musculus
gcttgtttgcctacagtagcatcttacttccacccccacctccagggtttttgagaggatttcttagtgtagccctgtgtgtcctggaactagctctgtagaaaaggctggtcttgaactcagaaatcttcctgcctctgcctactgagtctgtgctgtgcccagctacagcacatcttttggagacgtctcacatgattctagctatcatctcagatgattctaactatgtcaaattgacatagtgtgccactcatttctggatataccaggttttcttcctagcccctttacagaacagggaggggattttgtgaatgtcatgtgtatcagtatgtttacacatggcatttatgacttcattaagcctggcttaacacagatgactcaggtacccagacaacactctagcagtcacacccttcccgttctatatctctggttccctttcttctgtgtgagaaacatgcagttgctcagtcacacattgtacgtattgctgttaggttggctgactgaaagactgtagagagttttgtgattagttcaagatgtgtttctgagtcctctgggataggcacaaagcggccagagccaaagcacctgatgttgagttgggggattggttctcgtttccatgctctgaaatgtagataacaccattgttgctgtttgttttccactcgagccttccctccatccttctgatttatggattgtacattacttttaacaaaccattatattcatgaagttttactgtgtgctgtgtccttctgacatattccagacaaggaacctttgaaattccaaatattcctgtttatcagtaaaccagatgtgtgtctctggtgtgccacagctgtgaaagtatggcttattgccagtggcagctgcagtgtgactttttgtggttctgattacatggagatacatgtgccaggaattgtaggttaaagccagctggctatggctctcagaggggccctcccctcaccttctatgcaggcctgccactttgccatctcagtaggctgctgagattgagtgaggcacatatatatgctccagggtctccctgtttccccccctgttctcttgacatatcatgagaaa

SEQ ID NO: 29898 - DNA, 1408 bp, Mus musculus
ctctacaaaaataggtcattcaaaagatcagttgtaccatatgttgctagagttagtaatgatatgtcaaaattgctcaacaatggggctagggaaacagcccagcagttaagagtaaatattactctttcagaggacctgaatttgattcccagccttaatctgaggcaatttacaatcccctgtaactctaaatctagttgatttgatgccctctaaggacactgccataagtaaataagtaaataagtaaataaataaataaacaaataaacaaatacaaggaatcttgctgagcataatggtacattgcctttaatcccagcactcgggatgcaaaggcaagcagatatcgaccaggacagctagggctacatagtgagaccctgcctcaaaaacagaaatgaaatcttttctaaaataaagataatcttggggccatggtggataagcttgatctcgtcttccctgaagtctggttccttggcaggaattatgatggtaaccctcatgacccgtaaagacatccccccgtgggtgaaagttcctgaagacctgaaagatccagaagtattccaggtccagtcgctggtactgaaatctctgtttggcccacagggatctcgaatgtctcacattgagcaggtgagccaggccatgtttgagctgaagaacctggaatctcccgaagaacttatcgaggtcttcctttacggctctcaaaacaacaaggttctggctaaatggatacttcagtccatggctgagaggtaccgcctgcgccagcaaaaaggagtgctgaagctggaggaatccatgaagaccctggagctaggccagtgtatcgagtgaagccagtttccagtcattgtgtctcccacctggacgcgggttaagctgtggccagtgtttggttctggcgggatttttagctttgttacatcctagcaagatattcctggatccctgctgcacattctgatgtgagtgccaaggttaccattctaaataaaaaataaaattgaaatgattaaaaaaaagataatcttaagaaattctgtaatgtattttcctgacaaacataaatgcaaaaatcctccataaaatatttgagaataaaatttaaaaacacattaatatcatacatgatgatcaagttgttttcaccctaggaatgcaggtatgattcaacatgaatcaattcaagtaatacaacaggtatgtgatagaaatcacatgatcatctcacagatgcagaaaggggctttggccaagatccacatcccttcatggtaaaatccttgaagggttccatagcctgctgtatacagttcctgccaggagagagctagtctcccaggagtgctctcactcccaggccaagatttccactttctctccaataact

SEQ ID NO: 29899 - DNA, 1099 bp, Mus musculus
catgaagtacagacctgatgcgttgcaagattccattgggtatattcagttcaggtatttgagaatgtgacttgaggtctgtggctggaagaagacagacagacaggcagagtgctaataattctcaatcattccccccagagtgtgtccataggtgcaggcagagaggcttcactgaagtcatgggaggcacacttcaaagagagctgagatgagtgagtagagcctgtgtgggacagaggctgatgaccacaaggatgatccagaaatagcagcttcacctgggacgtggagaagtctgtgtatcccttgggctagctagcttgcaagctttgttctgccagttctaaaatttgctgagctaaccatggcaatgactccccagagaaacatgggctgtcagtttctatggccactaactagaaagaggcaaaaaatggtgagctgggccagatataacatcacctgtaactctagcacttgggggggtggggggggggagggaaggagggaggaagattgggaattcaaggccagcctgcaatgcatgagacactatatcaagaaataataaaagattgtggattgagatctccaactagatctcaatttgttttatggattagtgtctactgagtaccctctggaacaattggtattaagtgatatatattatctaaaagaaggttaatattctctaaatttatccaatgaattttagaaattattagcaagttatttgtttaaacctgtttgaagaatataatgatgagtctccaaataaagacattgttaaaagtttaaaaaaaaaaaaagaaactaaagaaaaaggaacgaactgtgtgtaaacaaactaaaagcacagacaatgatcacaggatcccatcctaaagtctggactgttgagaaaatcaggaggctggagagacggctcagcagttaaaagcatgcactgctcttgcagaggacctaggtttggttcccagtacctgccatggtggctcacaactatgcataactccagttctagggtatctgactcctgacctctaagagcaccagtacacacattcaggcaaaacacttagacatgttaaaa

SEQ ID NO: 29900 - DNA, 1592 bp, Mus musculus
tgcacagtcacacctacttgtacatatatgtaatttaagataactctttacaagaaagaatacttttgagaaaagcagcttccagagtaactgacaagcaagctctggtaggctcccggctatactagaatcctctaaccatatcctgtgcccttcttctaggagctataccctgcgttttgcattcacaatggaggctctgaccttgagcggctacctacagccagcacctgcatgaacctgctgaagctcccagagttttatgatgaagccctgctgcgaagcaagctgctgtatgccattgagtgtgctgctggctttgagctgagctgaattgagcccagagaacttgatctcacccaaaggcagccagcacctaccagacccaagagagcactcaggcaggaccctcagctctcctcaggccttctatctggcatctctccctttctaattttttttttagatgattttatcgtgacatagtcacatacatagatggacattgcttttcacataacctagctattgttatgtgctatgtggctggtttagtaattttgccaagaagagcacaggttttagaatagtggcaactcagtgaaattaaccaaagatgaagctttggccttgctgacccagtttatatcccttcttgggtcaggcaccagtatctgcatacagaatctggggctgatacacagagccaagccactgcttctcatgtggttgattgtttacaagcctaattgtaaaaactgaaggcatttttcctgctgccttttcccaaagtggttaggtttggaaaatggataacactagtattattttatttgtgctttttaagccatgtcccccaggtgggaatcgcatgcttgtcttcagactcctactgacctgcctcatgaggtttggacatggctgtgtgggttgaggtgactgctgccctcattgctctttgcctgtctctgctttatgcctggaaagctttccaggaggtggaggagaagggtccttacacttcctgaggtaccgtgtcacctgcagtgagttggcaactggggatgtgggcactgcagcttttattaaagtcatttgaaccaaagtggcgggctgcgtctctccgtgatccatatgccctcctagcctggctgtgcccatcatcttgcgcatcttggggggacttatcccaggcctcagcacctctgctttctgccgctgtcttgataagaagacagcatccctggcatctgccagggaagagcatcaggccaggtgattctcacttgggcactttatcagggtcaaacttgttgccagttgacctcagcctctgcaaacaaagcagggaagcatctgagaggctagcatacaaggatcatcatggagctggtgaggactccagactctgcttctcgtctaagtccagcatctgtgcctggaggctctttgtgctgttggagttaggtgaacagaattagcaatatacttttaaatgtgggaaaactgaatgacacttttaagacaatgacaattatcagacaaaatgtataatttcttaatttgaataataaagtatttaaatgctattt

SEQ ID NO: 29901 - DNA, 1246 bp, Mus musculus
atttgagtccacatttacttttggcaggattggaattttaggaagaactcttgagcttagttttcatggatctgttatgtaaatcacaaatattatatatatatattatatatttgtacttctaaggactgagctcaggaccataagtttgttagtaaaactcttgctaaacatcccgattgaacagaggtttctaaatgggtcatttcttacaggattgtggagaacggtcaagaaagagtagaagttgaagaagatgggcagttaaagtccttgacaataaatggtaaggagcacctgctacgcttggataacaagtaactcaacgcacgcatttaacagaaatgttaaaccataacaagcaccatttgaggaataacaggaactttttttttgaagatttgaaacgaactcgactttctgtataactgtacctaaactaaagtatttataaaaaagctcattggagcctccatctatcagatttttgagtttgttgttgggaccacaaaataggaccttattttctatttcttttgtccttaaaattgttgtaatctctgtatgcactttgctttaaaccaatcgtaatctgaggtgagccctgtgacttttgagtagtgctaggaagagactgtctgtaacaccagcatggatctgcttcccattgtggtgaattgtgagtgagtagtgtcagcctgctgtggacttaacattgccagatgaatctacagaaatacttcaattttattttcagtatttagtgatgaaagctattactgcatcaatggtaatacatttctggtttagtgtacactaaggatgttttctagttgtgcatggatgtcggcaacctcgtcagtttgactattgtttaaatatgtaatgttaagcttaggtttaaaaaagctggtaatttgggtttttgtcatttgcttaaaaaaaaaaataaatgcgaatgtgtttggtgcattctttcatgagtggggtctgcagccttcttgtgtctgtgtgattttgtgcctgagcttctaagtgtcacctcattagtgcttccttctgtcatgagggtgaattctgagtggaagttataagatagaccggtcttcagtgtgtacagagagcatatgaatgaaggaagacctgtaaactatgagcaacaacttggtgtgatttgtaagggtgggtatgggagtggagattatatggtgacctgtataaataatgagccgtacttttgtgatat

SEQ ID NO: 29902 - DNA, 1195 bp, Mus musculus
gatctgaaccagccagccaggtgctgcacagcctcaactttgggagcagaggccctgtggggttaacttgggtctgccagaaacagtgcttcccgcagggaaaatctgggtcaagatggaggctgctctggaacactgagtgtttcaagggagaaagagtgggaaccgtggccctttggggccagaccctgcaggagcttgcctcgcctttgaggaggaggcactgctcttcaggtgccctggaggggcttttagtgccatccccacagcagagtaaaggtggcgcgtatgtcatcgggtggctttgcgctggtagaacgctgttctctaccctgctgcagcctttcacactcacacacacacccaaacacacacttctcggccctgtatgttcaggtgagagacaagggaagatggctcatcattttcagccatgtccccaaagtggcctctctttcatgctctgtgggctttggcctgcagctgttccagagttagggatgtgatttttgtctgtgaggtaccccttgccctagtggatcagttacaggcctatgtccagcaccagagtccctgttccgatatcatcacagatagcctgttgttttccacagaggagccagatgtaagtcagacacctccagcctaccagtctcctgccatcagctttggctctaatgggctcttggtggcctccttggtgtgtcactggtacaggacagcaagtggctcagaaaggctgcttgctcctgagctcagccacttattcacatggttcagagcagatctttgtactcttcagactcaagtatggtgatctgtttgacagtagaggtctggcctacccctcaccctcattctccagcacctctaacaagaaccacactcatgcctctggtgtcagttttcttgtctgccttccctggcctacctagatatttatttcttgtgttttatgaatagttaagccctgcccatctgtgcctttcagacggaaacacagaaacctaggctgtgccatttgtcttctcacagttgtttaatgaaacctcaaggaatatggaaataaaggctagaccctggagtggtgaaagagtagggccctgggtgttggctgattctttctgtgaaaggccatgaggaccaaggatgtgtctctaaagcagggaaggactctagaatggtatgtgtagat

SEQ ID NO: 29903 - DNA, 1147 bp, Mus musculus
gcgtacatactctgaagtgacatccactgccactagaacttggaacctcatcgtctctgttatgtacagcacggggtggagggtagttagcttgtctgagtgggaggtatccatctgtaggtaaagagtcttaggctataaacatacaggaggaagggaacctacggctgctagttttgtacacactggtcactctgttacacttggaccccctcctcacccctgccccaagaaaagctttgtcatgcctctgagctttcccggggaaggctttgctactcttaccgggctaaggcattggagtccttagcatggctatacctatgtctaaaatatacattcatttgaagactttactcactcagagcttcctctgctccctgtaggagatggttctctacttctattaccagtcctgaggctcaaactcaggtcctcatgcttggtagcaagcacctttgaccactgagccatctcattagcccctaacaatatttttatttgtatgttttgcctgcatgtatgtaagtgttccacatgtgtgcctggtgcccatgggggtcagaagagggggtcagatctcctagaactgtagttatggataattgtgagccaccacataggttttggtaaccgaacccaggtcctctgaaagagcaacaagtattctcaacaaatgagccatctcttcagctccaccataacagccagccagccaacctacctaccttccttcctttcttttttgtagcactagctgacttggaactcgctttgtagaccagaatgcccttgaacttataataatctgtctctgcttctttttttttttttttaaagatttgtttactttatgtatatgagtacactgtagctgtacaaatggttgtgagccttcatgtggttgttgggaattgaatttaggacctctgctcgctccagtcggccctactttctcagtccctgactcactccagcccaaagttttttattataagcaagtacactgaagctgtcttcagaaacaccagaagaggacgccagatctcattacaggtggttgtgagccaccatgtggttgctgggatttgaactcaggaccttcggaagagtagtcagtgctcttacccgctgagccatcttgcca

SEQ ID NO: 29904 - DNA, 1360 bp, Mus musculus
ttgggagatcgctagaccaccctaacaaccctgaaccagggaacagatggctgtccaatcatactatactaaccagaacaagcaagaagtcatatatttgtctccaaaaaatacaatatatgcacagtgctggctgtcagacccagagcctcacaccttagacaagcgctgtgtcattgagaactcttagcaaaccctgtaaccagttctaatcagaccaaggggtgccagggaggggactaggaaagagttgaacattttctttactgtttcttaaaaatgaaatgtctcagctgtaataaaccttctcaagtacaattttgcctgcttgtttttcccccctcctttacttttagtattcaataatcctgctacataagaatgtataggaaaccccaagtgggtggtcattaaccccgtagtgtgtgacatatactgagagtcagcccctgccacttagcaggttgatggtggaggacagaaactgctgttctgttacccgccatacccaccagcttcccagggatactggggccagttttgtttccccagacattgaacactaaaagagtattgtgcacgacgacgaggtgacggtcacagaggataagatcaatgccctcattaaatcagctggtgtcagcgttgaacctttctggcctggctcgtttgccaaggctttggccaatgtcaacactgggagcctcatctgcaatgtcggggctggtgggcccgctccagcagctggagctgtgcctgttggtggtcctgctccgtccgctgccgccgccccagctgaggagaagaaagtggaggcaaagaaggaagagtccgaggagtctgaagatgacatggactttggactttttgactaaactgcttttgttaagttggccaataaagagctgaacctgtttaaaaaaaaaaaaaaaagagtattgtgagtaaccattcaaataaaagacaggcaacgtgacagttcaaagggaggcagaggcccaggttgatatagttaggtgtcaattggttgagggccctttacccagatagaggcagatgaagagaaacacctctacagttcttggcacctctcctagtttgaagcagcgatgagctgcaaggagatggcctcaagcagcagtaggtaatagtctttgttcctggcttttgtgcagggagccttaggtactgtgacctttagcttacaatagccaaggtaagctttggtgtgggtctaaaaagttcatggggatttctagccactaatggtgcctttttaacagctttaaggtttaaggcattgagtcatggtctcaccaagtagctcaggctagcctcggggagggggtcaccatgtagt

SEQ ID NO: 29905 - DNA, 1191 bp, Mus musculus
tggcagaggccgtacctcccagcactccggaggccaggaggcagaagcaggcagatctcttgagtttcaggccacactgatctatagagtgagttctaggacagccaggcttatacagagaaaccctgtctcaaaaaaccaaaccaaaccaaacaaacaagaaccacaaacattaaaaacaaattttttaataaaaattaaaaaaggagaaatggtgtgtgcttaaaagttttcttttcctggaaggaggactggggtggagatgtcacgcagtactagagcacctgcctggcatgtgcagggctagaggctctgtccccagcatcattgactccgaactacacaaaactaaacatgacaagaaaccctcactgtatttagccttagctttgccagttcccagcacatggcctctagcttcatatatgttgtgtgttttcttaagtctttgacgggaaatgtgattaagtgctttgtcatgtatctttaagtgaaaagagctttaaaagtatcatattacaatgccattattacattaaaatttaataacttagtgctattaaacatgatttatttggaggaaggtgcgcacatctgatgaactgttggcttttgtctcccttgccagcctccgtgagtagagagagctgtctctttgtccagctctgggttactctcccagcccttgggtctcagcctctgctgtggtcatttctccatttgccatgagactccaatgaaggactcagaggctggagtgtgtgtgctaatggaggttggttaggtgagcaaatccagtcgtcctatgacttaaccagtttgtggactgctgttgaaaggttccatatgctaactagttacctgcgatgccttgtagtagctatttgatggcagtattggaggggaaagtctcttacaggcaggaaggtttgccatatagcaaacttcagctcatttttagtaatcactttgatgagacttagtgaacatagaacatcgctggctccctggatttcagttgttaatgcctgtgttctgtctgtttcccttccagactatttcttttgtctacatagtgactgcggttgtgggagttgaggcctggtatgaacctttcctgtttaatttcttatatagagacctattcactgcaatgattattggtaagaagccccacgtggaagcctgttg

SEQ ID NO: 29906 - DNA, 1097 bp, Mus musculus
actaaaacggaaatcagagatggtagtgaggccaaggactgtccagtgctatgggtcttttctatcacgttggctaagctcttttaagcagtttctctgggtaacagaattcctggtaagcacgtagggatggcctgttgagattgctgtttctcagcagcagggagcatcagagccgcctgccatctcgactgtcgtgttatcagttggatatcctcatcagagcagccatcctccagacaaagactcagttgtgtatatggttagttcattcagaatgtcccaagaaagcagaattcagcactgaactcagaatttcagttaaacaacaaaatctccccacttttgggcagagtggaagacaataatggccaaggtactcaggaacccaggtttcctctcccttcctgcctaacggtggtaactgaatggtaactgaagaaaattaaagtgctgcttttgtgagtgaggcttcatgttctatgctgagaacaggtaacaggggctgtgtggctaggggtttaatttggtgcctttatgggtagacttctgaagcaagagtataatttcttcccagatacttaaaaaacaccacgagaacaggtggggtatgtttgccacaaagaatgaaaaagatagcagagatgaagaaaaagaggacataaaatgtctccccttccaggtacttttagttgtagttggcctgcctagggctttggtgttagtgtagcgtttgtttactctgcttccgtgtgctctgcatatgtacatgtttactatgcatacctgttctctatgtatatatgatatggtatctaatggacttgactcttgattatcagccgggtggcaaccctcattagtctgttgctttgtgtggatttggcgtgcccatggcccacatggaaagccacttccccacctttcccctccagggcatctcagccctgagaaagccctcacagtagatgatatttcacttccctttcaccaggggacttcgagccagaaagactggtttccagaatgctggctattacttcggggttgaggtttctgggtcggcccggccctcttttggctgggaggcagctttg

SEQ ID NO: 29907 - DNA, 1220 bp, Mus musculus
cattggtttatctggatgtcgctccacgctggctttccagaaccagccactgagagtcacaaagttgggatttaaaagatgcggtgggaggggcgggtgattttttgaactgctggcgaccgagttctggcggtcctgacgcgcaccttgggcttgctcgcgttcggtttcggcagcaggaccaagaaggcttagggaaggcggcgggacccggcccctcgaggccagccatgggcccgcgtcgcaaaccgcagaccccaaggaggagaccctccagcccggcgcctggaccctcgcgacagagctccagtgtaggtaagcgagcctgccctgcacctccgaggccggtgcggtcatcctgtggggccgggcctgtagagggacggttcctggtcacggcttgccgctaacctcgcgtaggggtaatggtttttttgtttatttgtttgtttgtttgcttgtttgttcctgaccggtttacagcagggagaaaaacgaaatgcagacaagacaaggagttggagcaaagacaaactcattctgacggacacggggtctttttttgcatttatttactttgcatgtattttgcatttattttgtgttcgtgctctggcgacggccagaagagagcgtcggaaccccggggccggagttacagttgtgagctgcccttttttttagagtgctaggaagagaactcggcccccctggaagagcagcctgggctattaacagctgaaccagctttctaactcctactctttattatttatttgcagcactagagatggaacccaggactccgtgtatgttaggcaagggttctactacagaactatatccccaaccctctccccgacccttttttttttaagacgggaactcggtatgtatcggtgtgtagccttggcttgctgacctgaaacgtgctatgtagactaggctagcctagagctcacagatctctgcctgtgttggggatggttgtatgcagtgtgtattcaggaactatttctgagatctggttacaatccagacactgcctcaatgtgatgtaaaaactgttttccatcacctctgattggttaatgagctgatcaaccaattggctgggcagaagaaagaagagtgggacttctgttcccaatcagagggtcctgaagagaccaggtgagaagaagagatggagagaccatgtgggtgaagaaggattactc

SEQ ID NO: 29908 - DNA, 3398 bp, Mus musculus
ttttcattttaagtagtctaatatcagttaagtttcttcttcaacattttagagagttagaagtgtgttttctgtctgtgttgtgggggattgaacccatggcttcgtgcatgttagcaagcacatcacggcagagccacagctccagagcaaaatggtttggtttggtttttaattttgtatttttgttttctaatgagaatttgaatttttaccaaaccttgtggcttcaccatccacattccagacagtagcactgagttacaccctttccaaggtcccaacttggtctctaatgaatgctagccaactgtttccacttcccaaggctccagggtaatcaagacaagggatttgtactagatactcctaattccttccagctaatgagaagaaagacaaggacctaaaaactgaaattgctaactttccagtctggtgggaaggacatgagatccatgaatcctgtgggccctgacaggttgggtctgtagggatggaactgcagtctgggaaaggctttgtggaaggtaatgtacaaaccccaaagctcagagcaaattcatttcccaggcatttcttaagcccctgtcagcttgctctgaggatgtagttccatgctgaagtctgttgccttcgtgggaaggtttgtgtctgctgtgctgccacatacttccactgcctctgccttcatgacctacctcttctgctcaggctctcagacactgcgcagaagacagaaattcatgtggcttaaggaaatcaagaccctgcagaagagcacagacctcttgttcaggaagaagcctttcagcatggttgtaagttctagaggcctttactcagtcctgggccaccttttctataattctcccaaatgtgcaggatgcttgtgcatctcactgatgtggctggaggttgtctccaaccctctgagtcactgcacaccctcagtttttatgatactgatttcttctccttacccctgactataatagaacctctcacccggtttacctccctaccctgaggttgccttgtttcctcaccacccgtaagccatgccagttcctaagctcctgggagtccgtgcctactgagccaggccctgaggtcaagggccaagacataatggtagacatggatgcattagatacttgagaaagtccctcgtccacttttcagtcactgttctgtggctctctgctcatccccgtcccactcctccacaggttagagaaatatgtgagaagttcagccgtggtgtggatttttggtggcaagcccaggccttgttggcccttcaggaggtaagaaggggcagagatgagtgaaggcagaaaggaagtacaccccagagctccacaggagcttatggcctaccacaggctgtgtctggcctcctgaaaagaacagccaatgtgtaacacgtgagggtgtggaagcgggtctgatgggtggctcctggatccaccttgttctttgcttcagtcctttgagtctgtctgtcccctcagccacgtcagtgttctcttctgcccaggcagcagaagctttcctcatccacctctttgaggacgcctacctcctctccttacatgctggtcgggtcacgcttttccccaaagacattcagttgaccaggagaatccgaggcttcgagggcggactcccctaagctgccagtggaatgtgtaagtcctccctgatcctcagagtgctgcttgtggctgggaaaagactgctctgaaggaggagtggcagccatgcccatccttagtccctcgccctctcacctgtgctccctaaggaaggcctgagccctgtccctttgtgcagtattaagataagagtggagcttcacgcttgtaagccaacactcgggaagcccaagaccaatgtgagcatctcacgcgtgcggatgggtgcctgccagcactatagactgagatctttttaaaaacaagtgaacggatgagttgtgctccgtatttctgatggtacttcttaccattttacaaagcctagacccccctgccccacccctccatcgccactttagtaagggtcttattatgtaattctggctgtcttggaactgtatagagcaaggtggcctcagactcacaaaaatctcctccctctgcctcccgagtgctgggattaaagttgtgtgccactatgcccagctttgggtcctcgaattttaagaagaagggggtgtttgtttgtttgtttgtttgtttttaaatgccttgttagtaaataatgattcctaaatttcacagacattacctggaagcttttggagttgcagcttgacagtggtgtcggaggagctggctgggttttgctgtttttaaatactggctacacggtgcccttaaaactgtctctgaaggagaagactgtggccttcccccgacacagaggtctgcccactcgctcccatggactcgagtgtttgcagaccaaaggtcaatttggtttgtgaattgctcagccctatggctgaaggtttcagacacccgatacctgccatggtatggttatttcactcttactgctctgtttgcatcttttactattagtttttgtacttttatttaaaatataaggaagaaaaacctgaataaagcgcttgaatctgttgtatgtgagccgtggcagtcccgccatataaatgcctgccttccagagtgacctcatcctgtcatccatgtttgtctgtcagtcagcaaacatgcagctcttctttaaaacctaagtagaattacatacaaaatcttttcttctcttcaagactggggctcgaattcaaagatttgtacatgccaagcatggactataatgctgaactacatccacagcctgaagtagatgtctttctggttcctaccagtgaattcctatcaaaaacgtccagagtctcttatctttagctctaaatcatataaaatgtctcatatcagtctggaattttaaaatgtgttttcagaatttttacagattaattttagcttatttggggagaaataataaaaaataaataaaaataaaaataattccttaatgaaagaattgaagtaaagttactgtaatagatgttcatgcttttttagtaaatattaagctcatcattttataccctttgaagcagttataacggaaacaagagaagtgagatgtgcagatttcccactgatgaaaggaacacacagaaaacctgccctctgtactctcgataagagcaatgtaagaggtttgcagtaacgggacacgccacctcctggcttgaggtgctgtggtgagaccgcagtgagcacaaactcctgatgaagacatggctgctgactgaaccgctccataaacttaccctttacaaacacttaccgacg

SEQ ID NO: 29909 - DNA, 1204 bp, Mus musculus
catagagcttgcaggcatatgtccccacgcctgttgtagagcttgcttttctcacacacctggacattgttccttttcctctgtaccatcaggacagatgtaaaatggaagctcatcttgatttgcatttctttgaatattaataaaggtgaacatgctttcatttcttactagccatatgcatcccctctcccaatatcttggctgctcacattcttcacctcttttctcaattggagtttttctgtctctgaagatttacaagcagtcctataaattgcaaatgttagtccttgattacgtgttggaaacctgtcagggccagctttgattcatttttatggaaagtaatttgttgtatcttttgcagtattacagcttcccagtatcctatagtcttagctaaaccaatcttatttttctgtttttgggttatgcagtgaaaaatctcaattaagtttataaataatacactctgtggtttacttctggttcactttattttttatgtaaaatgtaaatataatgatgtcacttctttgctcaagacacggattggcaaaccttcctgatgctctcagagccttgactcccctctcaagccgtgtctgaagcggcagaggaagtgatcgccgccctttacattcccatacatggcatgtgccagctggtgaaagcatggggccaaatggcctcggggctcctgtgtggaattccattccatagcctcgcccacgtcctgggaagctgaacacccaccaaggttcaactcagaagcatttctgagaggggtctttccctccagtcagagctaagtgtgtgcccacctttctcagtgctggcatggctcttctggctcccatctcaataggaaatgtctgactataaacttctgtcagtgttatctgtcaccttgtcagtgacatcatgggctatacagctaccttgggtgttgctttttgttctactatgataaaaatacccaaaagaagcaagggaaaggaaaatttattgggctcacatatgttctggtattagggcaagggcatggtggagtgtggggcactggagcaccaggctgcatgctctcaactcacacatcaggaagccaactgctcaggcaggacactgttggctatcaccttcaaggcccatctcacagtgacccagttctctagaatttccacctcctaaaggttccaaa

SEQ ID NO: 29910 - DNA, 2253 bp, Mus musculus
cctaacaaggcactttgagctgtccctcctgccctgctccttccttccttggccctggggtttctctgggccccagaagcccacactatgcacagcacccaatgcatagcacctggccctaaaccctcctctcaccatgacctcctgtgctggctctgggaaggcccagactttagtgctctgccctgctgcccacccacacaggtgtccagagcactttagcaaatgtgttttataagtaagggccttcccccttcatcccttaggccccatggtgacattttcccaagtcagacaggtgtcaactccacagccatgcccaaggtgtcccatctctcctgactcatcccagctgtacccttgtgggtacagtcaggacaccccgggtgtggctgtgcttgggacaccctgtgctttctgctagcctctttcattccctacccacgccctctgggagtcccaggccccggaagggtagctgggtgggcatgtggctggtgccaggcgcgtgtaaatggttttgttttgcacgtttggtttgcgcagtggtttggtttgacttgtttgtgcaccctgtggaaaataacggtgctttgtgtcactagcatagcatagaatctggaatagatttggtttgtaggagatgctgcactcaccaccaaccagacagtacagggcagaggcgggggcaggctggacccctggccccttcctcccaacccagggtccttttgcttcctgtaccgtgcctcccctatcccacacctcctgccaccccctcctacttccctacattcaaacaatgctggatgctgaccctggaaaccttcaggccgcatctctgctccgggttaccccagcgctaaccccacatccacaccctcatagcccaacacagcttcctataacttgcccctgctgggcaaggcctagctactcctcctgggtgactagtaagaggcctcatactggctgagaaagagggactggggggtggggaggttgcctaggcaaccgccagggaaggggcttcaacccacaaggcctagctgtagcatccacccccactgcacaggtgctatggaatcctcggcactaagctctccttgaggactggtcggacccgccctgttttagaagctccttagaggttctcgtaggtggctacacagtctgcagagtggctcagctgtctgcctttgataagcctcatccccgcccctctttggcaagtgatctcacttttgttggagctccacaaacctgtcagaggctccacagagcttgtcagtcacccctgcacgcttttgtcctgctttgggtccatcaaagagctcagctctcactgagtgacaggtaaactccaaggggcttctgagatggggtggggcttaccactgtcccccatcttgcagataaaaactgaggcccccaagagtttaggcaccagaaatgtctgtccatgactgctctcatggcctcggcagtctaacctagctgtgggaaacagttgtggattgatgtcaggcccaccaggagtttaaccagacagagtgctttcttcctgggggcgtgttctgctttgctttgcacaagccgattttatctttgtcatgaactgactcatgttcgagcctggactagaaaagtgttaggaacctgcgtgcggttttagttgcacccaatgtcctcacttaggagctgaagagacagataacccagaggactgagatagccctgggaacagtaggtaatgaccctagaggtcacaggtatcataaacagtgacgctgacggtgtctatctctctttctctcctactctccttctcctaccttctcctcctcttctcttttctcctccccctcctcctctttcccctttttcttcttcttgagacaaaatcttgcttaggtagcctggccttgaacttacagaaatcctgccttcgtttccccaagtactggaattatacacacaagctaccacacctagctatacatcatctttgtctatttctgcccttgctgggtcatgggccttgggcagatgccaaagatccaaggggtggtagggccagctaggcaggccacctggagtgggccaggagcgctttaccctctctaatcgcctccacctgagaagtgcatcacctgaagtggtaggagagtgcgcgtacaaggggccactgtgggccttctacttcatccaccccgcccttccacagacccaagcccaccctttcatagcctg

SEQ ID NO: 29911 - DNA, 1300 bp, Mus musculus
ctccctcctccaggagggatttgcaccccctgaggatgatgagattgaagaacaccaacaggaagaccaggacgagtactgagggaggcgccagccctggctgaccacagcttccctgcccacctccactctgcccaccccaactatgcccaccccacattatagtcctttcctttcagccagtcagccagctgggtgctttgtgtcagtgccacagcattagggagccggacgagtggggttcagggtggtgggggaggcttgggcaggtgagaggacgaggccctgtctgggtcccccgagtggcactggcccaggggacgtccaggacccctgtccactccccactcctatttatttccgttgtctctatgctgtgttggccaacactttccagggtgccgctgtaccccacaagccagccacctgctccctggcagccagcagctgtatatttgacaaagtcattggtatatttttacttactggattgcccttgcactttacctgttcttttccagggctgacagcagggcttggggtagtctttctggcttggctccccttccctagagccgagactgggacaggactcacccattcttatttattttgtcttttgacttctctctcagtagatgagggaaaggctgatatgaggaaagggaagggaagctgaggaggcagtgctctgggtccagggagcatgcgagagtagacatgacctccaggcactgggctcccccaccaagcccctgcctcagcaccaacacccagcactgccccaggcttcctagccactccctcctgcagcctagttagaccacacagactctgcctggcccccattgtctgtctgtcccccattctctcacccccacctttgccccttgggcaccagcctgcatatctgttcagttttatttaaataaatttgtgtggcaagccatgatttcctcaattgacccacagcaaggggtcagaacatagcaccttctctgtcttttgtaagaggatagccatgcagcacaccttcatgagcagaagccaccactgacaaccaggctctgacctagactcaactcccacgactgaggactctttgtgaggcaggtagtatgtgtatttctctgggagatgtaagactgtccctgaaaatgggatgataccaacagcccaaaaaaggacttgttcaagttggtcttggtgagtaacaagggtttgttagggatgagttacaggccagtggatcacgaaaatacctctctataaagacccctagctagctggtttatacagt

SEQ ID NO: 29912 - DNA, 1195 bp, Mus musculus
tcgaccataaaagcgaggttataagcgactagggcaggacctgggactgcacccagccagtgggctcggagagtaggagtccgggccgccgctgcatcccagcgtccagggcataggggtccctcgctcccgtggctcggtcttcccttctggcctgggtctcggtgaatggaccccgacacttcagctgacggagcgaatgtctttcgcatcatcagaacaacatgctttatatactttcatcacgccgaaaaccaaaggaaacctggagcagaagcagcattcgtagtcccaaacaccgaaactaatgtctgcttagcgagaggaaggccgccccagctttagcctcaatccggctcacggcgagctcctgccgcagggtgcgagcctgcaagcccgcctttcttctggcccgggatcctttagtttacgcagaaacacattagggaaaaaaaaaaaatcttggtaagcattagagggaaaactgcagcagcccgacgcagcggggccttcgatagctcagttggtagagcggaggactgtagtcagtacaatatggtaatccttaggtcgctggttcgattccggctcgaaggacttcgtgcactacttttagtttacctacaccctaggtcaattgctccgtgggggaaacgcttacttgaggataggcagtgtattttcctggctacgttgaaaaccccttgagtacatatagcagttaagtagtcgaagtacaacgtaccttgttcgcatattaggtgttaaagctatagtgacatgtacttcaagaaaagtccttattgcttatgtatgtattacatggctctgtttcaaaatcttgctgagggctccatcctactttatattgtgaactacattagaaaactgagtctcaggaaaccttgtaaaggttacaggaaggtacagcactacagctgggggattagctcaaatggtagagcgctcgcttagcatgcgagaggtagcgggatcgatgcccgcatcctccacttccttttacacaccatcaggctcatgatctgttgtgtccacgtttcgttacacagtagagctaggagcacggtaaacaaagatcggcttcacatgctattttcttattcacaggtaagtcttttcctgtttcctgctcactgctctgtctttcccgcctcggggaggcgggccgttaacc

SEQ ID NO: 29913 - DNA, 1193 bp, Mus musculus
gagatgatcgggagccccgactagagcagctatttcctgatctcggcactccccgaccattccgtttcacaggcaaaagggtaagtaagtgggaagaacatgaaagccgtattcttgggtggaagagagggctcagttttaagaatacttaatactctgttacaaaggatccttgtttggttcccagcacccacactgtgccgtggcctgtaactcctgctccaggggatagaatgacttcttgtggcttccacaggcccccacatatatcagttgacatacacagaagtaaaacagtaatctaacctcatcctatctccggccactgtggatagcttacagctgttacctctacacattctggacccggtttatcttgtaccccagggtagaggattaacaatcctgtacctctggtaaacagccatctagaaaaggctctttctgcctcaactactcttgcccacccttgtcagggtggaagtatagcgccactgacctcctgtctgcttccttctccacctcagatattcttcttaagcagtagggtacaccctggagagactccatctagctttgtgttcaatggctttctggacttcatccttcgacctgatgatccccgggcacaaactctccgtcgactctttgtttttaagttgattcccatgttaaaccctgatggtgtggtccggggccactaccggtaagtagccaaaacagcctttctgccttttctccagtctcatgtctcacttggctgtgcaggtcagccagccttctgactggtttgtatttccaggcctcttgtaccctaaccagggcaagcccctctaatcttccactgagctgagaggggtgtaatcatgtgaacacatcctgggtgggagcaaatgtcggtgaagactagctgggtggagggaactgtccgtggactatggtggcatgaccgcacatgaaggaaggctctgtccttctttccagcatgacttaagcctttcactttacaagtcttcagtgtccttgtcacctaccctaatgtctcctttggtggcccagacatctagagcctgttgagtcctgtcttcctacagcacggactcccgtggagtgaatctgaaccgtcagtacttgaagcctgatgccgtcctgcacccggccatctatggcgccaaagctgtgctgctttatca

SEQ ID NO: 29914 - DNA, 3198 bp, Mus musculus
agtcctaatgcaagggatccgagcaccagcccctagtaggcttttcccaatcaccatgacagcctctggcttgtcccctgaagacgagaatgagcagctgctccctagagaacagaggggactgatcatcaaggtaggactacgagggatggtaacttcccttgtatcagtttcttggccttgttgtgttccctttatggtgctggggattaaacctagtatttcatgctaagctggagcccgtgctcaacctctgagctctatcagtagcccttgatcctcagcatcattgaaaaccaatcatttatctttggtgatttagtacatgcagggtgtttagtgccatccttccttaaactactgtgtgctccttacccctaggtccttcccgtggcaacaaccgagtcctctctagatgttgtcatatgtgagaaggtctttttgttgttgttttgttttgtttcgttttttcaagacagggtttctctgtgtagccctggctgtcctggaattcactttgtagaccagcctggcctggaactcagaaatccgcctgcctctgcctcccaagtgctgggattaaaggcatgcgccaccacgcccggcttatgtgagaagttctaatctcatccaaggagtgaagctgcaacttcaaaccctcaggcttagctcaatctgtaaagtttagagcttacaccaatcctgtttaggagtaaagtccagctgggcatagtggcacgcctttaatcccagcattccagagacaggcaggcaggtgtctttgagctcaaggccaactaactggtctacataatgagttctaggacatccagagctacacagaccgtgtctcaaaaggagaaagaaaacaaaaacccaagtccattctgtacaacaactgattaaaaatggataggttggtgcagtatacgttggattcaattctaggaaacaatcctgcctggcatggtggtgatgcttttaattccagcactctggaggcagaggctgctgggtttgagaccagcctgatctacaaagagaaaccctgtttcaaaaaaaaaaaaggaaaaatgattccatttagttccttttatcactgggtttctaaaagaggactgggtgtggctttgagtttagagtataggatgccatctgtagtaatgacaggtgaaaggcctgcgactttatcctagctcttggagttggggcacctgggtaagtagcactttgcaggtagaaaagtcctcgggccttgaactgtagtgtgaggactgacagtctagagcagcgcctgtgcagagtagtcatccagggtatggtaactgttactttattttacagttcatgtcattgagtcccagcctcctgtacaaaggcacgtgctaggagtgtgaggtaccaggagaacagcgcctggtctgacgtggcctgaatatatatatatatagggcagttcaaaaaagaagtccaggctaagcagcaggatggctgaagaagtttcttctcgaggcttagataggagcctgtctaagccctgggtggtaggaaagggaagaaagtgggcaactcaggtttcaggggcagtgggtaccgacctgataagctgagtgaattgggtaggaggcaggagcccatgtttcgtgaggaggttgggccagaactagccagagttggggatggggccaggctgcttgtggtagagcgatggttcagtggctgctgtcgccgccttctgtctgagcatcggggctctgagtggaaaggacacaagcagggaaaagatcaagaaatgagacagtgtaaggtaggcttcactgtcgtgcttcccctggccaggcacggccagaagcctgttttcaagctctcaacaaatcagctgcccactcagtgagacatctggtattccagtcgtccatacctcatccaaccagtttgataagttcctgaacttggcttctaaaacatggctttgcagggcttttttcttctaaccgatcctcttctcattgatgttcctaccgcttagccatctgacctcgctctgtctcctcttaaatttttaaatctctaaggcccttttctcccagaatgtcttctgtcagacacttcgacctgttaagtccttggctgccaaactcaatctgtcttctccccagtccattccttgtccctgtctgctaaaaagcttgcttcagttttcagttccctcccttgaatttctttagtcaaatcctaatggttcttcaattgcagtggtctctagatacaagtcttttcactcactttactttctctcagctggattaaaaaaacaaacaaacaaatatatatatatatatattcacccttggtgccaacaattatcatcctaaaatagaagtctggttaaaaaaaaaatcaccgtgtcttgggtgagagagaaacaatacagattcactgactttcctctctatagagctgaggctagacctgaacttttggtcttcctgccagagcatccctccatgcttggattcctccatgcttggatttgtatgcaggcattgcgatgtgtggtctgaagggttttgtttgtttagatttatatatttttatatgagtacactgtagctctccacagagacaccaagatgaggtcatcagatcccattacagatggtcatgagccaccatgtctgtggttgctggaatttgaacttaggacctctggaagagcagccagtgctctgaactgctgagtcacgagccatctcagattctggaagtcttttaaagatatagtctacatgaaccctttcagcacagaacagccagagtccagtctgctgtgtccaggccttctgccattaaggtgctggtttgagagctgggcgtggtggtgcacgcctttaatcccagcactcaggaggcagaggcaggcagatttctgagttcgaggccagcctggtctacaaagtgagttcaaggacagccagggctacatagagaaaccctgtctccaaaaaacagaacaaaacaaaaatactgatttgatcactcaacacctcagccactgttgctaggagctctgtgggtcctttgaaatctcagtttctctctctcttttttttttttttttttatcttccatgttccatctcaaatgccagctccctgtaaatgttgccttggccattttcaggcagaattagttctt

SEQ ID NO: 29915 - DNA, 1202 bp, Mus musculus
cttctcacataagccgggcgtggtggcgcatgcctttaatcccagcacttgggaggcagaggcaggcggatttctgagttccaggccaggctggtctacaaagtgaattccaggacagccagggctacacagagaaaccctgtcttgaaaaaacgaaacaaaacaaaacaacaacaaaaagaccttctcacatatgacaacatctagagaggactcggttgttgccacgggaaggacctaggggtaaggagcacacagtagtttaaggaaggatggcactaaacaccctgcatgtactaaatcaccaaagataaatgattggttttcaatgatgctgaggatcaagggctactgatagagctcagaggttgagcacgggctccagcttagcatgaaatactaggtttaatccccagcaccataaagggaacacaacaaggccaagaaactgatacaagggaagttaccatccctcgtagtcctaccttgatgatcagtcccctctgttctctagggagcagctgctcattctcgtcttcaggggacaagccagaggctgtcatggtgattgggaaaagcctactaggggctggtgctcggatcccttgcattaggactcgattgcaggtaaaatttttggggtctttccgtgtttttagcattagcagaacccatcaagacactcttgtgaacactgggggttgggctggggtaggggaatgctccttcctgatttacagccttttatatccagtctgtcaagagttgctgtgatatctgtgtgttaaccttcccagtggtaatcagctaggttttttgcttgcttcagactccattgtccctgccagatgcaccccaaccacagcctactagctttggctttcctacccgtccttagcttctcctctctttctgaccagacctgccagaggagagtttccgccaggaggggtcccggattccccaggtaacacatctggttactgctcctaataacaccctaccatcacctccaactcagacaagcttcccttcctagtttgactgtagctagaggcagaagctgactggacggatgaagcttaagctgctctggcaggggcggaggctgagaaagctgagggctatccaccagtccactcccatttttcttcatagtgcttctctacccagccatctcttagccatgggatacccatgga

SEQ ID NO: 29916 - DNA, 1483 bp, Mus musculus
gggagaatgctgtcccacacccagccactggagtgccaactgcaccctgcatgagtggctgcaacagcgtggcatccccggcctgcaaggtacgagagcaagcactggggtgtctgggtaaagtacacagtacctagaccgagagaatcagggaggtttctgggatctgttacttttgtgtagtctgctctttttttttggtttgggattttcaagacagggtgggttatcatatagccaaggatggcctcctgtagcttcccaaagtgccttcctactaccttgcccagcttatgttcttactcctatagtattgtttgccatgtttgttttcttctagaagttatttccagtaattggggctatgtagattgtggttcagtttggatgtcatatttagggcaagaccacttcatggcagtgttctttcatcagagtggtccagaattttgatgcgtgtagaacagttgcgattgatcgggtctgaggaggaggaggagtgttcctggacaccctcactggtgactgagtttgggtccatcatctgaggctgcgctgttttgacaggagtggacactcgggagctgactaagaagttgcgggagcaagggtctcttttggggaagctggtccagaaagggacagagccgtcagccctgccattcgtggaccccaatgccaggcccctggcaccagaggtctctattaaggtacagaggaagagaataggacatgtttgcaggtggaagaccagtggttacttttctggccacaattggggcaaactcaaggacttcaaagatggggtttggtgtgagcgtgagttacacgtgctgatcacagctgccaactgtcggtcttgtctcctcagactccacgggtattcaatgcagggggtgcccctcggatctgtgctctggattgtggcctcaagtataatcagatccgatgtctctgccagcttggggctgaagttaccgtggtaccctgggaccacgagttagacagtcagagtgagtatctgggacctgtgcagatgagtggcttgggtctgagcggaagagctatccctcaggacaactgataaaagtcagggtgggttgcaggaaggaaggcagagaccagggatttcacttcctcggtctggggtgggtgtgtgcttttattttacaagtttatttattgtagtaacgggtgtaagtgcgtgccccagctcagctttcaggagtctgatctctcctaccacgggttctggggacggagctcgggccaccaggcttcgcaggtggtgctttggttgtcaaccttctctgcccattccagaatatgacggtctcttcctaagtaatggacccggtgaccctgcctcttacccgggtgtggtgtccacactgagccgagtcttgtctgaacctaacccccgacctgtgtttggaatctgccttggacaccagctgttggctttagccatcggggccaaaac

SEQ ID NO: 29917 - DNA, 1099 bp, Mus musculus
gacctgccccattgagtcttgagcaggaggaggagatggattaggtctacgggtatatagatgttgagggcaggaaggatagaggtcacttactgaggacagagtacagagaggggaagaagtgcctaagtcctgtcttctgtagaagaggctgaccagccatttttgtcctgttaggcaattaaagccctaaaggaggaaaacatccagacattactaatcaaccccaacattgccacagtgcagacttctcaggggctggcagacaaggtctatttccttcccataacacttcactacgtaacccaggtacgggtcagataaggatggcctgggggctgggggcggggggtgggtgtcgcgggctcttgatgggcaaaggggtttgctgatgtcactctgggcacttataagctgctttgatctactgtcccctaatgcctttgactcctacctcctgcctcaggtaattcgtaatgaacgcccagatggtgtgttactgacttttgggggtcaaacagccctgaactgcggtgtggagctgaccaaagctggggtactggctcgatatggggtccgggtcttgggtacacccgtggagaccattgaactgactgaggaccgacgagccttcgctgccaggatggctgagatcggagagcatgtcgcccccagtgaagcggcaaattctcttgaacaggtttgttaggtgtttgggtagaagtggaatgatgtcatttcctctgaatcttatttcttttgggtccagaaatgacttgttggttcatgtctcccactcactgcaggctcaggcagctgccgagcgactaggctaccctgtgctggtgcgagcagcctttgccctgggtggtctcggttctggctttgcttccaccaaagaggaactctcagctcttgtggctccagcttttgcccataccagtcaggtgctgatagacaagtctctgaagggctggaaggagattgaatatgaggtggtgagagacgcctatggcaactgcgtaacggtgagtgccgaaacacttcagatatagcagggcctggggatgtagcctcctgggccttttgacccccttta

SEQ ID NO: 29918 - DNA, 1153 bp, Mus musculus
cttggctggttgacagtaatggcagcatcgttcacatgatttactattccttatttccctggctgtatttttttccaccccggcactgccctgcatccagccgtctgtgctcttcccccaacaggagctggagactccgacggataagcggatctttgtggtggctgccgctctgtgggctggctactctgtggagcgcctctacgagctcacccgcattgattgctggttcctgcaccggatgaagcgcattgtgacccacgcccagttgctggaacaacaccgtggacaagctttaccccaagacctgctgcaccaggccaagtgcctcggcttctcagacaagcagattgccctggcagtcctgaggtcagagatggtggtgtggggagggagcttttgcctcgggaggcccattggaggggagccttggaagttcttctcttcatctgcccataggctgtttccttgctaaccctgccctagcgcttgcctaagtcagtctatactccattcccacatctggtctttcccttcctttagcacagagctggctgttcggaagctgcgtcaggaactggggatctgcccagcggtgaaacagattgacacagttgcagctgagtggccagcccagacaaattacctgtacctgacatactggggcaacacccatgacctcgactttcgggcacctcacgtcctggtccttggctctggtgtctaccggattggctccagtgttgagtttgattggtgtgctgtgggttgcatccagcagctccggaaggtcagaggccctgttctctggtagttctcctgttctctgtggtgtttgcctgtcctcccacaaaagataccggatcttcctgttcattaggaattaatagaagtcctatataaacaacctctctctgtgcctgaatctcatccgtaacatgttatctacctatgtttatagctgtttcacgggaaacaggctggctggccggccgactgcattggggactttggctaagcttctctatgtccttcctctaatgtatgagtgctctatctgcatgtactcctgcaggccagaaaagggcatcagatctcatttcagatggttgtgagccaccacgtggctgctgggaattgaactcaggacctc

SEQ ID NO: 29919 - DNA, 1668 bp, Mus musculus
ctcagtggcgagagctcagtgaccttgaggtgggctggggtctggcaggaagccgcggggcggatgtcgcttgtgggtgagtgtgagcaccccactgaccctcctgtccctgcagtctgctcgccagttctgccacacggtcgggtacccctgcgtagtgcgcccctcctatgtgctcagcggtgctgctatgaatgtggcgtacaccgacggggacctggagcgtttcctgagcagtgcggccgccgtctctaaggagcaccccgtagtcatctccaagttcattcaggaagcaaaggtgagggtctccccgccagccccagaggaggctgtgtactcgctgggtcacaggcacagtggccgggagggatggcttgtgtctgacaacgctgtttcaccaaagggcaaggagaaaatgaccctgtcctacaatcccgctgcccgtgttgcctccaggagatcgacgtggacgcggtggcctgtgacggcatcgtgtcggccattgccatctctgagcacgtggagaatgcaggtgtgcattcaggtgatgccacgctggtgacccccccacaagacatcaccccgaaaactctggagcggatcaaagccattgtgcatgctgtgggccaggagctacaggttacaggacccttcaatctgcagctcattgccaaggtaataagtcaacaggaagggacaaaagcctgtgttctctgctggccccaccgccacaaatccctgcactgtctcctaccctcactcactcaggcagcaaagcttgggaagggctcacgtctagagcccactgcagtgtcagggctggagcccactgcggttttggagctggtcacgatcatccggctgattactcagtcgagagagaggctgacacccaggtcactagagtggttgtcagcccacctgggcttcacaaggcctaacctgaagttcctttcctaggatgaccagctgaaggttattgaatgcaacgtgcgtgtatctcgctctttccccttcgtgtccaagacactgggtgttgatctagtagccttggccacaaggatcatcatgggggagaaagtagagcccgtggggctcatgactggctctggagtcgtgggagtaaaggtaaattgggcgatgggccccttgagcctggtgtacagatcccctaattggtataacaagctcaggtcaaaaactagatgattctgtaagatgtgggacacctggctgctttgtttaattcatttatatttttgagctactggagactcaaacccatggcctcaggcaagagtgctgctgctgagctaaggaagagagctcaatgaacagaactctcacccacacaaggcattattgcccaaccataggatgatatggtggtcatcatcccttaagagtttaccctgtaggaggcaaatgaagtttggttcaaaaatagcttgttatagaacagtctgtgatacacctacataactgagttataaaccaaatgtacaaggagtttggagatgggcggtgttgtttctagagtgtgttttgggagacggggtggtactggaactgaatcgcaagaatggtaaggctgttgggtttgcagagctccttgggcctgggtccagggccagaaaacagccagagtagaggccagcccttctgtgt

SEQ ID NO: 29920 - DNA, 1117 bp, Mus musculus
gttgactgcatgacctcccagaagctagtgcgcctgcccggtgcgtgaggcctttggggtggactgtctgcctggggttacggactgtgcaggccctagaatcgctcttggtgtgagctccctcttccatggtgctcttcattgagaacttgtatcagtggctgtagcttttctcccacgccaactctgatctcgcccccaactttctcctaggattgattgatgtccacgtgcaccttcgggaaccaggtgggacacacaaagaggactttgcctcaggcacagctgctgccttggctgggggtgtcaccatggtttgtgctatgcctaatacccgaccccccatcattgatgctcctgctctcgcccttgcccagaaggtgagccgctataccccagagtgctggtcccttgctgacttacctgggcatagatggcagcaaacctgacctcgtgcgtatgtaccctatctagctggcagaggctggcgcccgctgtgactttaccttattccttggagcctcatctgagaacgcggggactctgggtgctgtggccggctctgcagcaggcctgaagctctacctcaacgagaccttctctgagctgcggctggacagtgtggcccagtggatggaggtgagctgtgtgtcaccacacgctctctctcggcttgaggcctcgtctacctgagctgccagcagagaggattcaggggtttctgaggaccctgggctctgatgagtgcagcaagacaaaggctcagcactttctctcatcaattctttctgtccccagcattttgaaacctggcctgcccacctccccattgtggcccatgcagagcggcagagtgtcgctgcggtcctcatggtggctcagctgacccagcgtccagtgcacatatgtcatgtggctcggaaggaagaggtgagagtgcatcagagctcctggtacccctgtcactttcccaggaagaccagaggttactgactgtccttggaggcaggaaggggtgggagagcccaaggccagtacctttggcacatttggccctcgctgttctgagaaagaatgccaagcatagagacggaagggcagggcatgtcacgtcggg

SEQ ID NO: 29921 - DNA, 1153 bp, Mus musculus
gtggccatccctgaagtctctaatggagtccctacctaccttacagtgctttggtcagttcatcctcactcctcacatcatgacccgggccaagaagaagatggtggtgatgcacccaatgccccgtgtcaatgagataaggtgatgcggcccctctgccctgggatacccttggctggctgtgggaagggtcctttgcctggacgggctctccaggagctgggtggtaatgcttttgcttctctcacagtgtggaggtggactcggacccccgggcagcctacttccgccaagctgagaacggcatgtacatccgcatggccctgcttgccaccgtgcttggccgtttctaggtcccagcttcctttcttgtctcttcaggcccagctgctgggcaaggaatcccgatgccccccccacgggggcagcacacttagcagacaatcctggagcatacagatagcccaagcacatagatgtactaaactgggaccatgctttaggctccagacgagagtcttttctaacttggggatgcagtctcagatactgggggcccctctgcctcatctccattcttacacctcaaatctgtacagttacttttgtactgactgtaataaacagccaaacagttcctggttcgtcatgagtactataggctagcagaggatgcctctggtaggaagacagacagacacacacacacccccacacaccccacactggtctctgtagggttccagctgacacttggtgctcttcatgtgtttctctgacatcaaagctctcctagagactctggcttatgtccaggctgctctgggcgaagcggcaggccatgtcctaagcagtggggcttggccttcctggtagaacacccaggtcctggtgaaagggaggccgtgtactgggtgggggctgctgagattcgttgtccctcttcctttctgatgagctgtgaccttcagtggcctgtgccaacacatcctcgaacccttaccatggtactctccagctgccatccctgggggcccctagggtaggtgctaagggggtgtcactcttggggctgcaggtgagagttgagcagctattctggtccatgaacttgaacaacagaccatgtcctatgctcaaggccgtgtgcact

SEQ ID NO: 29922 - DNA, 1402 bp, Mus musculus
tggttccaagcacccacatcgggtggctcacaactccctatgtctcaagctccaggagatctgatgttctcttctggcctctgaagcacctgcacaaacatgtatatacccacgaatagacacgcatttgtaattaagcacacaatgaaatctttaaaaggaaggagtgtgtcagcttccatgctatggggttgctgatcagaatagggtgaccactctgaagtggcacatttcactttaaccactaagacatttataatattgctgtcactctggcccttagctgatggggacacactataagaattgtgtcctgggggctggagagatggctcagcctgtaagagcactgactgctcttcagaagctcctgagttcaaatcccagcaaccacatggtggctcacaaccatctgtaaagagatctgacgccctcttctggagtgtctgaagacagctacagtgtactcatatttaattaattaattaataattaattaattaatatagaattgtgtcctggaagccaggcatggtggtacatgccttcaatcccagcacttgggaggcagaggcaggcagatttctgagttcaaggtcagcctagtctacagagtgagttccaggacagccagggctatacagagaaaccctgtgtcaggaaaaaaaacaaaaaaacaaaaccaaaaaaaaaaaaatgaaagtctgtgtcagtctcaacctagtgacaatcctgcctcagcttctcagcttctcaaatgctggattagagaattgtgtcttgggctacagatatcgctcagtgattaagagcactgactgctcttccagaggtcctgagttcaagtcccagcaatcacatggtggctcacaaccatctgtaatggggtctgatgccctcttctggtgtgtctgaagacagctacagtgtactcatatacattaaataaataaatctttttttaaaatcaaacaagaattgtgtctttagcagttttgtcactgtgcacacataaggagtatacttatgcagatggtaacaatcagttgctcaacatggcctcttcgtgcacaagcatgtggtgtatttttctgctgccagtctgacatggtatactgttttacagagagctttttcatatgtagaacactgtcattaagatgtatacgctgtacataattgcacaagatatacttccatattactgccagcttggtctgtttccaccagcattattgcagattcatgaataatgcaccaaactgagacataagaactaatgctgctatgtggtagggatatttcagctccgctatgattatctgaagccaccattgtgtgttgccatcactgactaaaaggttgctatgcagcatgactgtctacattcccaccacatagt

SEQ ID NO: 29923 - DNA, 2063 bp, Mus musculus
tgcaggtgcactctgaggctctgtgggttttctgctctctccacaggtacgcttcagcccaaacctggactcctatggatggctggtatctggggggcagtcagggttggttcggatccattttgttcgtggactcacctctccgctggcccaccgtgtacagcttgaaagccgagccaacttcaatgctatgttccaaccgtcctttccaactgaagggcctggtttctctccaagcagccattgccttctccccaatccctagtctgggccacacagaactcttggattgaagtctgccaagaacaaatggcgcccatgcatagagcatagcacctgggcccttcctggacagtgatggtgccaggcctaaatctttaggcctacatgccccaaactccttaaatccctctccttccacagacttctatggtcacagctccctgcaggtaggggggctccccctccacaacaattcctatgcctaaaaccatggctcacaagaaacactcaggccaaacctaggcttgggagtcaaattgctcatattgagcatattgtgaaggaggtaaagctaagtaaaggtactgggtgtttttgagagcacttgtgagtgggtgtttggacagtcggaaaggatatcttcatgaaggctcctgtctatttccagaattcgatgttattgccttccgatctccctcattagaataaccaacacacaggcccgatggtagggacagtaatttattggactgaagctgctcataacttaactttaactgaggaacaacataagcaccctgccagtaggacagcagctagttcgtgtttctgcttatgaaatattcccaatcactgacatatgacactacttgaacactcctagatagtgtttttaaattttttgaagctgagtatagtggtgcatacctgtaatcccagcacttaggaggccgaggtaagaggatcacaagtttgcattcagtctgggctatctcataaaaccaaaaagtaaaaaaaaaaaaagtaaagaaaagaaaaaaaaagatcttctttatatcaagtcagagtatacctctcttaattttactaatgggtgttagaaaatagtcaccccccctgtggctgccctttcagtacttcacagtagctatcatgtgttcccaaggcatttttcctctagattaaatatctttagttatttcaatcattcttttacaagtcatgatttttgatctttatgatatggtcacattgctgacgtattaaacatgtttaaactctgtatagaaagtatttagaacccaataatgtattgttcgctcaatcaagtcctctgtggatagcagcacctcacatgactgatactgtcttgaaaacacaggcaggggacacattggagtatacaggctgaagtgtggaaggaagtagttagaccatcttaggaaataggaaacaggtagcctgtttcctcttggatgggatgcagtttacattagtattgcctgaaacaaaacctagactttagagcactcaagattggtctgttatatctggaaacagttttctacctgagtagtgtagaagatttgtcaaacgccagaagtctttaagaagagagccaagtagtgagtccccttcctatacagaagaggaagcagacctctaggacagtaaggtccttacacagcagaagggcccataactgcattagtgttaggagccaagtgttatagcactctgttgtgatccagctcaggcggtgtcgggcttgctttttgaactaataaagaagtgccttccattgcagaggagcttggcttgtcctgcagagcaacccatccatacagcacatctgtatttccctacttccagcgttagagaaggtggaacctgggggggggactaaaggctgtgccagcgaccctgctcctggtgttgattcacgcttgagctgagaagtaactgtgggggcaatattttctgttctgttctttctcctctcccacaagccttttctcctcagtcctttcttccctatcttccttcccagtgtagctgtt

SEQ ID NO: 29924 - DNA, 1099 bp, Mus musculus
gtcatggcagagtcctgctccaatcacagattcgccagacatacttgttcctagtggaacttttccattttgtcctaacatttttgttattctgacttttctctagatttagctcgatcacagcacatccagagcgctgggatgtgtccttcttcacagggggaccactctgggctctggactggtgcccagtgcctgaagggtcagcagcttcacagtatgtggcccttttctccagccctgacatgaatgagacacacccactgagccaacttcattcaggccctgggctgctgcagctctggggtcttgggacattgcagcaagaaagctggtgaggtggggctgggacactgccactggcaggtgggtgagggagaaacagggcggggcggggtttgcattgggctggcaagtcaaggaagtggagctccgttaatcctagactcttcctacccactgtctcccatttttttttctccagtcctggcaatagggcccactttgtctatgggattgcttgtgacagtggctgtatctgggacctcaagttctgccccagtggggcatgggaacatccagaaacccttcggaaggtacttctaattgacgggactagccctgggggttgttagggttggaggaaggaaggttacatagagtgtggtgggtgggttttccagcaaacccatgtcatgtcttaagggaccagaggctcgggttttctgagaggcacgtgaaagcagcaagcctcaacacaggtctgctctcaccctccaggctcctctcctgcctcgcctgggtctcttggctctggcctgctcagatgggaaggtactgctcttcagcctgccgcatcctgaggccctcctggcacagcagcctccaggcaagtcacatagctgcattcgtggtagccagagagctcaggcctgtctgcctcccgtgacctcctctagtgtagtctctagcataaaagcatgttcagtcacacctttatgatagtactataacttcagttggtgatttttgagcttaaattctcttttttagactacctgcaccttttcagcattttaccagtcatttctccctcttt

SEQ ID NO: 29925 - DNA, 1138 bp, Mus musculus
ggaccccgcatcagcgatccagtgttcatctgctcttctaccacttggtgcatctagcccttcactcaccttcgcgaacagccaccgccaccgcagccatgactgtgggtcctaggctcctcccgccgaggtcactcacactacagcgccacctgggctgctggctcccctgatgcctcccgcggagtcagtccccagcggactacaacttccggcgtgcactgggtcccgcccaggactacgggtcgcggtgaggaccaaaggatgttgggttcccaattaggagcgtctccggcgctcgactacagctcccagcatgccgaggttgctgctcgcagagccgtcatcctacagccttcccacctcggagttcaggcccaccaaaatggcgagctgggctgcggagacgcgctgagtggcagaggcaagcgagcagaggcgctgcgaacctggtagtacggagctctgccttagggaacatgcacttttccattcctgaaacggagtcccgcagtggggacagcggcggctccgcctacgtggtgaggaggtgctagaagctgggccagggcggggataacgggccggagctctcggagcggcctccagccttcgaacctcactggaagccatctcatgtctcagtttcgtacttaagccaccccaagctccaataggttcttctttccccggccaggccgcgactgctctggcggtgggcactattgtcatctccgggagggatactgccgcacaagcgcccgagtgtcctcgggactgggccttctgcttgaaacccggccctgggggaaaaacaggctaaatcccgggaagtctcggagcgttgcgcagacggatatgtcaggcaacttccggacaggtttctggggcaagaggtggtttgcacgtcgatcctgagatgtttgcctgcttttgtgtcctcaggcctataacattcacgtgaatggagtcctgcactgtcgggtgcgctacagccagcttctggggctgcacgagcaggtgggactaacaaccctgtctagatgcagcttcaagcccttccatacccacggacattaatcccctttcattacatcaccctataatcactgctacagtggaaggtggactttgttag

SEQ ID NO: 29926 - DNA, 1270 bp, Mus musculus
aagttaatgtcagctagcaccttggctcccagctcagccttgccttcctgctgcccctaaatctaaccgttctgcctccttccccccaggagtcaccagacgccagccgggagtccatggtgaaactctcagtgagttacagggttggtgaggttgactgtagggcctcacaggctgccaccctctgaccctcctcccacctctgttacagagtaaactgagtgctgtgagcttgcgggggattggcagtcccagcacagatgccagtgccagtgccgtccacggcaatttcgccttcgagggcattggagatgaggatctgtaatctcagctgcctggatgtctgccctctacctgagaggagatttatacacacttgccctgtgcctatgctcccacgttaggggagtctcttcctattccctccccacttctccttgttcctcttggccaggggcctcctaaccataccttcccttttcctgggctggctacacaaaagatcactgtctcttttttagagctggcccttgatgccaaattagcatttagtattttgcacaaagtccaagagactgtggctacttgcctcggagaggaactctaacactccatgggttgtttctggcttttgaggaactccagcactccatgggttgtttctggcttttcagggcctgggcaaagggtgggcagaggtctgtgaatggtctgagcagctccccatcattaaactcagcctgattgccgcctacctttggttccctctcactgcccctgtcagaaggggtaaggcctaaatagttgccattgccaattcagcagagacatggctctgttagtgtttcctttattataaagcactgaaataagttaaaacagtaaaaggctgggcagctcccaaccagttcatccatagcctctgggagcagtggcggtgaatccaaggccctaatcacttagctcatctggtacgtgagctaagacaagtcccctggtctatatggccccctgaccatgggattcaggctggtccatatagtgcctaggttagtctgtgtggagcccctgaccagcgggggagaaagggaaaggtggtttctagttcatttgtataaaatgcaggaggcatagggctaattcctagagccccaggtaaaagaacctagttagttcaaggtgagtctgaatgaagagccctgctaccagtagcacccagggctgctggaccccgagtgctcaaaacagagggtgggctatgaggtggggc

SEQ ID NO: 29927 - DNA, 2323 bp, Mus musculus
ccattggtaaggactaagaaactaggcaatcttggggttttgtcctgtgtcccaaactaccaatagcaaagtttaagccctgtgctcttcagaataagctcatgccttctttgttcttaaatacctctgtaaaatggtaaagttatacttttccctgtgttctggatgttaaaagaggcaaatgagctctttgttctgagagcagatctgaaactagaaaagatgaaacttaaagatttgacccacctctaatacaagtctgggaattagtcaaactactcaccgtccttacttttcaggagaccacttctacaagagaaacaaaaacttgccaccccaggaacagatgatttctgcccttcctgacatcaaggtgctgactctcactgatgaccatgaattcatggtcattgcttgtgacggcatctggtgagcactggtgaaagaaatgcccttaaacacccttgtgcaaccttgctcatctcttaagagcactgactgctcttccagaggtcctgagttcaatttccagcacccacatggtggctcacaaccatctgtaatgagatctgatgcactcttctggagtgtctgaagatagctactgtgtactcatttacttaaaatagataattatttttaaaaatgttttgaaaacgcgcactaagccccaggccaagccgaggagcatttacaggggtgttgaaattggcctgcgtcagtactgatgcctacctgcctctctttggtaggattaaagattgattgtcattttttgacccaggaatgtgatgagcagccaggaggttgtagactttattcaatcaaagatcagtcaacgtgatgaaaacggggagcttcggttattgtcatccattgtggaagaggtgagtctaaagttgggaggcaggcgcctggtttacacagacacatctcttgagatgtgagcagaggctgggagtagaatcactgtacacactagatgactttgattaaaaaggtggctctttcctcatttccctgatgtagccttgggcctcagaaattcacaggtttcttctttgtgataacttgcccattccttctgtcctgccttcttgtattagcaaggacaagccttcttgtggtactttggttcaaaccccatggctaaactgccttaacctttttgtagctgctggatcagtgcctggcgccagacacttctggggatggtacagggtgtgacaacatgacgtgcatcatcatttgcttcaagccccgaaacacagtagagcttcaggcagagagtggcaagaggaaactggaggaggcactgtccacggagggggctgaagacaccggcaacagtgacaaaaagaaggccaagagggactagtggtcaaccggaccctgcccatgtggactgttttctgagcccttggacccgagactgagttttgtccttgtcctttagccttagcagtgggtatgaggtgtgcagggggctgggtggctttcctcagcccattacaaagagggccccccaccccccccacgcggcagcctgggaggctctgctgtcctcttaagcctccttactctccttgggctcatcgactatcggttctgtgcctgtgctctgttgtgttggagggaaggactggtagttctgatttttactctgtgaacactttatttaaggacattcttttttattggcggctctgtgacccctagccgcttgcacccgctctctgttgtacactttcaagcaacactttttcagactaaaggccaaacaaaagctaatcgtgctcatagtgtcctgctttactctcctaccctggccccatatgtggtgggcggctgttgctgcatgcttgtgtgtgtcccgagcctctggagagggggcagtgaatgtggagcaggagctgggagtcttaactcctgagtaagcagcccgctggaggccatcctgcgctgttcgccttcaggcacgacttcctagttcgtatatggagggggcagggtaccaccttcctggttggctggttgggttacgcgtccagcttctgattggttggctagcagcgcatcacaatcacttcctggtcatgctgcgactgcgctccggttgtacagcccatgaactacgcatcccgtgttgctctgcggtggcggaagcggaagcgggtacggaggtaccagctggtcttcggaggggggtagggggctccatgaatggaagcggcggcggcggcgggagcgacctgagctggattccggggccggggccaggggctgcccagggcccgcaccggtgtatgggggcggttcgtgg

SEQ ID NO: 29928 - DNA, 2323 bp, Mus musculus; identical to SEQ ID NO: 29927

SEQ ID NO: 29929 - DNA, 1198 bp, Mus musculus
atactcagctttgctcaagggagtctccttcccattttagatttccttgtttcttcagccccacccttcccttgttccagctcaccttggcagcagtgcccgcttcataaaaggccttgtctgcagggagtaactgggtgtggcgcaagagcgaaacagaaagcctggcagctacggtttcctgtggatttaaggcgaagtttatgatcctgactgagtgaccagaccagtgagcctgtaactaaggcagagccagttctgaaccactctagatctcaggctattccagtctttcatcagcacagtgtaactggccccagattgtgtacaggttccttccacttctagaatttgaccaagtacacgaaatgtatacatagttacaaccaaataagtcaaaactgtgtgtgcttataggaggtacataaaaactatcagacatctgactgtttcaatagattgagggtggtaaggctgtgtgggcatagagccctagggtcagagcagtatgggaagagactggcgagtgttaaagactgattagaccgagaagcacagagggagacgtggcagtttaagggcctaggctcgtagatccagaactgacacttgtgcagcttcatagctgtgaatgtgggtccttgtgactgagggtgctatgaatctccctggctggatcttaccagctgtttgatactctgggctgcagatcgcgtagcgtagtaatgagagatcagcagcatcatctcaaactcctcatgcgctgcagagtttgcctcactggacttcaccaggttttcacactgtgagatagaggggggggggaggggaggggaggggagggaggagagacagcatgagagcacagctaggctgctgtggggtgagagcaaagccatggaggttgtacagtggttactgctgcccatttggactgagaccaggacagggacagaagaaggaaccctgtaatttcattgctgacccttcttcttaccaggttgaagaggacatcccgaagatcagcccagctatggtaggcctcagcattgttggtcccaggagagctaaccatgtcagtgaagatccttttgtagatgttgaaattctagaggttaagggggaagggcacctgagtgagtgagctgtgtgtataggagcgcagcctagattgatggagaaggcagagatgttaaga

SEQ ID NO: 29930 - DNA, 1207 bp, Mus musculus
ttttttttcctggagagtgctatggtcagtcaagaatgtgtggatcagccgctagggctgaggaatttctaaggtggcatcctcaaagtaaaactgaaatgttgtgtctcagggaaagttggttaaccatccatgcccaccctatgccttggcctgggccaccaacagcattgtggccgctggctgtgaccggaggattgtggcctatggaaaggaaggccatgtgctgcagacttttgactatagccgagaccctcaggagcgggagttcaccacagctgctgcaagtcctggaggccagtctgttgtgctgggaagttatgacaggtaggtctcctgtctagtcgtatcttctaccttccttctctgtgaattgtgccaggcaagtcattctaaactgtaatgggagcctgggcagaggcaatgtctgttgaaaaggattctcagattggcacacattggcacgttggcagcttcaaagtgcaggatgcttcctcggcctgcgattcctggcagaattcatcgcattcttcatgtccccatggagcctcctgcagactttaagtttatcctgcagtaccatagttgttgcttctgtttcgaggggaccttgaggagaaggctgagcagtcatcttttttacctccggtgcctacaatggcatctgctttgtgattataaccactgtttggtgagtgagtaaagaatgaatgggcagatgagcaactaggatcttgtcccctgttttgtgtctcagttttgtacatctgtgtgttcctctctgggttgtcccactcttcacttgtctcgctttttctacttctgtccttttgtgtcattttttattttttgaggtggactctcactctatagccctgaatagcctggaactcactaggtagaccaggctggcctcaaacttggcagtgatcctcctgcctctgttcccaaatgtttgcattacagatgtgctctgttttcttttgccttgactttccaaactccctttgaaccatctagctctctcctgctgggctgccttgaggcctgccttgatggattgttgggtggcgttagcttccctttcttgtagaatgagactgctctcctttagttactatcttcactcttttgctccgcccccatctcgtctaaaagccacaaacctttctagacttcgggtgttcaactggagtcctcgaagaag

SEQ ID NO: 29931 - DNA, 1101 bp, Mus musculus
gaaacccacacttcaggcagggagagggaagtctcagttgaaggcacaaggatattgtagacatctcggccagatctgagtagcagcgcttaggacagtgtcattgggagagtttctaagtccttaaactcagtattgccaatgggattctggggttccatggtacctttgccacagtgcaaagcactgttccatggtctctaatgaccctgggcatttgatgatttgtggagaggaatcaagaatgtcaaaagcaaggtgaaaggaagcagagaaggtggaaccacgtggctcaggacatagtggacggagaggcatgacgggctgtgacgtgtgctgtgcgctctggctgtgagagtttgccttagctagattttgtcaaatatattgccattttggactatttcccatgaattctgattaagacattccccgttccttttctcacaatcactgcccaaattctgagatgattctcttttctttctttgaaacagggcaccttcgtggctggaaagtacaagtgtctcctgtgtgagaaagagtttgtgtcagagagcggggtcaagtatcacatcaactctgttcatgccgaggtatgccccccacctcccctagtgtgtgcagtcctgtgtccccatcttgaggctctaagagttgaccttgcccctggcttcatgatctaggactggcaaagaaatttgtgctgagaacttgccagagttaaaatgccatctgaaattacatgagtgtaaatgaaatcttctgtgaagaaaaattagataaagctcactgtggctggcatgtttgagcccctataattctcttacctatgatttaatggaacatttgggaaccaggctgaagttacatgtttgatcttgttttacagcattttcttctgataaacatttagatgttttaatgtttgccaataacctggggtctttaaattatcatcagttctgtgtcattttaaaaacatgcttactctttcttgggagctctccccgagttcccagctatgctccgagaacagccatgttgctggctggtgtttttcctctgctaagcagcccaacaaccatccctcctgagaac

SEQ ID NO: 29932 - DNA, 1184 bp, Mus musculus
ttgttctagacagtatctatcatagctaagagcttttggcctaaccttttctttgtttgagacaaggtctctctgtgtggtcctgactgtcttggaattgctctagattaggccagtcttgaactcacagagatccacttgcctctgtctcctgagccctcggattaaaggtgtttgccaccacgccctggagcgaaacattcttcctggggtactacttggcagttatctttagtcaggaagaaagtgtggaggaagggataagaaaatgctggtaagatacggtggcacttgtacaatctcagcgctcaggagactgaggaaggagagcagctcgggccacctgggaagcgcaaagtcagtccagacaagtgaggtcatgctctaaagtaagccgttctctctttctctctttccccctcagatatccgagacacagtgaaatataaagaagtcatgaagcagtatccttttcctcatctgctgcgagactgactcggtcatggcaaactgctgtctttcattgctttgggggagtggctttgcctgtcaagttgtgacaatacaagtagaaaactcacgtccttttaggtaatcgtattaagaggataagatgagggctggtgagatggctcagcaggtaagaacactgactgctcttccaaaggtcctgagttcaaatcccagcaaccacatggtggctcaaaaccatccgtaaagagatctgacgccctcttctggagtgtctgaagacagctacagtgtacattatttatataataaataaataaatctttaaaaaaaaaaagtaggagagatcagagatttcagcaatgcctcctgttttcttaacatcacctggactgtaagtgctgtcactaaagatcggagacgatgtgtggccagctgttagttactgcctgggcccagtgaagtgatgttaccgtggcgggtgaggcagtcatcagtaaagttactcacaggaatttagatcaggaaacttggacaaataaattgagttgtctgcttatgcattgctttctgcatgacatctaggaaggtcgcttgcttagtgagaagtagaattaagagtgttacatgcagctgtggctggcctgaaactctagctgtctgccttcctcttcctcctgaatgctaggattaaaggtactgagctaccatgc

SEQ ID NO: 29933 - DNA, 1149 bp, Mus musculus
actgagcctggagatgaggacacagggcactgtggtcaggtacagcaaggagtgatggcacgctgatgctttctctctctctctttttttttttttttttttggtttttcgagacagggtttctctgtatagccctggctgtcttggaactcattttgtagaccaggctggcctcgaagtcagaaatctgcctgcctctgtctctgcttcccaagtgctgggattaaaggcgtgcaccaccacgcccggctatgctttttctcttaacaagtatttgtcatcccttatgtttactcgatcacttactcccatgggagggagttatactcataataatcttgattctgccacttgagacattaacatttgaccaaagccaggtcgagtgtgcaaggggaccacactgtatcattgacaggttggctctgggctctgggccatccaggtcgcagtgctgtggctgtggctctgcttccttgcatcaaggagtccattacttggtgtcccaggttgtgctttgagatggtgcctataatacaagccaccctggtaggagcctccagtgttgtgttgtaagtagatcctgttataagtgacacctttttcttctaggtgatgaaatttattgagaaggcccagaacacattcaggtaggtgatttcagttaactactggttattgcctgtcatcagtatattctagtctttagagaggattgggagacctttgaaccctgaagctgttaactgggacaaagtcattagaaattaaaacaaagaaaggtggacaaggaaatcatataacacagaggattctccaattcctgtgacccctccatcacccatggtccattttacatgacgtggagaaactttcagaggaagacttgctcactgtttgaggaagtgcagtctgccatgatggggaagacatgaattgtgtgtgtatataatcctactgtcatttttcaccattaactattattaaatttttaatatgtttactttttctaagggagaaagattttttaaaagatattctcattataaaaaaaattaagattatggctcggtaggcagaggcacttgccaccaagcctgatgacccgagtctgagtcctgggaccatgtggaagtagagagctcctac

SEQ ID NO: 29934 - DNA, 1151 bp, Mus musculus
agggactctggcatttgtttgtttgtttgtttgtttgtttgtagtgcattatcccctggattttagatatacagaaaaattatgtctttagtacaaagaaccactgtaaccactgtaagtcccagaatgttaaatctacattttctttttctccttttcctgctacatgtgactttacatatcacatagtatacgtcacttttcctaaattacttaaaactcatgcagatatagatgcagtgttcttttattttggatctgtgtattctttctaaaaataatgttataattttataaaatcccagtgcagttacgaaaaatgagattaacatgggcacagatttatctaatacgtggtcttaggtgtagccattcccttcagagcagacttggctcatccggtgtgggaccgagcacccttgtccagttctgcctagctggctctggactctgcgtagtctgctgattgctttccttaaatgcctgcacattcctcaaatgtggccgtcttagaaaaggcttcagcgcctgctcaggctgctctccccgtactgtgtcctctccggctgttcttgcattcacggcccacatgcacgtgcacaccagcttaccacgtgcacgtgcacaccagcttacccagcttcctgggaagctttgtgtcgaggtttccttgtgctcctaaattaatccaggaagagctgacatctctgtgctcttgcttcttcctcctcaagagcaggaagaattttcgttttggcaggtcttgagtctttctggaatgttatcttgcgtatgttttgcatatttctaattacattattgagtggattttatcttctttactacatgttgttttactctggtaactggtaggggtttgtgctgttttttgtttagtttttttctcgttatttgtattctgctatcttccctcctcctccctccatccctcccttactcctctttctttccttcattctgttatttttatcattgaccctctgtgagtgtctaggatgtgcttatattaaaaaatatatactcctggggctggagagatgggtcagcagctaagtgcacttgctgctcttgaagagagcccaggtttaattcccagcacctacatgatggctcacaaccacctgtaactg

SEQ ID NO: 29935 - DNA, 1390 bp, Mus musculus
cgtgtgctggtgctaggctgaggctgtgagtgagtggactcttctttctctggcctgcctgagcagacctcagattaggattttttgactttgatgctgcatgttctagaagccatttcattgactgagggtgtaagtatgtaattccttaaaagtcatttcagccaggtgtggaggcgcatacatgcctataacctcagcgttggagagacaggcaggaagactatgggttctaggccagcttgggattcatagcaagtcccagtcttgaaaaagtgaaaaataattttaaaatgtatgtctctctttctctctctgtctctctctgtctctctgtctgtgtgtgtgtgtgtgtgtatgtgtatgacaggagctctgattcattgtctactatgaaggttttaaacacagcacccttgtctcctgcagttacagaggaaagccgtgaagagccagcatttcagaacttcatggaggagtcaatggcacactggaagaggaacaagtaggccctcccacctgctgtacagctctgatgtgctgagtctccatgcagaggacatccttcctgtgaaccagggctgcagtcaagagcagttttctcccaaatggtgacttctctgagggaaactgggcttagatgaagtctggttgaaggcggagctggcaggtggatgcccattcttgggtagctcctcccgatatttatgcaaggatgtattctcaccgctctggaagctgagagatagctgctgagcctataacttcaagtatcatcgtttgaactcaagtatttctgctgctgatggacagagaggacgtctgtcccagagacgctttggaccttgactagctgggtctgtgggcacagcaggatggaaaggagagtgtgtgtgtacagagggcagcacagtgccctgggcagccaggtcggatgtgatctgtgctcacacgaggtagcccattttcaagaatactgttaggatggtgacttggataaagattttgactttaactttgtggtaagctttcctgtcatggtttgatattagaaagtatgtgatcactaatagatttcccactattagttatgaccaagccttaaagacatgtctggtaggatataatgcatagtaggttagtttcccatgtctatccacctaaccatggccaaaatcatgtccttatattgtacttagaacaatacaaagcattgtttgtgaccaggatttggtccattccgtccattcagagctaggatttgccctggttctcaggagtgtagtaaaatcacgagccaggcagttcttatggatacacctccaaatcagctttcctagaaacggggtcgggggtggggacgcagcaggctggctcataagccttccag

SEQ ID NO: 29936 - DNA, 1211 bp, Mus musculus
tcccactccactgacagcctcatggggtcctcccctgtgttcaatcagcgctgcaggaagaggatgaggaagatttaactgcagagcgccagcaggaagcccatgagtagtaattagactgtattcttaagtgtagacctttgctaatgtcagagacagttcctaacctagtaacagttcactttgcgtcgtttctgtacttctttaaaacaactaagccaccgttcgcagctgagttgtgatactgacctggtaatcagaccaaagtactgtcccggctggttttatctcagctcctctcagccgtgtctctggcacgcttgagaggagtcatgccactttgatgctccttgcagaggtgggacactgaggtgctttgcttaaatttcaaagcttgcatatattcatgtaaatatatgcaatatatgacgtctataatagacgtcagcaattcattcgtctattttgtgtcgtcattgggaacccagtagcaagacagacagtaacagctaaacttaagtccatcagtcagagttcaaactattcatgctactcaggcctcttacaaagtgagagccgtggggacagctgttacccttatgcagctgtccccagagttctttcttttctagattattccagccagcctcgtcatttttactttccatatgctcttgtgctgacccagacttttttttttttcgaggcagggtttctctgtgtagccctggctgtcctggaactcactttgtagaccaggctggccttgaactcagaaatctgcctgcctctgcctcccgagtgctgggattaaaggcatgtgccacccacgcctgacttttgacccagacttttaagtatctttcaccatgcacacgctttcaccttttctccttgtgaaggtggcaaacagggcccaccacagctgccgggtacgcagcatctggctttgcttcagaacagctgttggtttgtttcaggtgtttgttttggttgttttgtttaaaaagacatttgaggatccagagagatgggtcagtgggtaaagtcacttgcaatttaagtttgataccggggacacacatggtgtaaggagagaaccaactcctccatcatgacacacacacacacacacacacacacataaaaataaattatttttggaaaaagtcatctgagttattccaattcttttttaaagattctttgac

SEQ ID NO: 29937 - DNA, 1151 bp, Mus musculus
taaacacctctcatggtctagatcacttggggttcagcagggcagagatggcagaatctaggaaaaaaaatcactttagttctagaaatgccaattactgtagtttggggaaattattaccatttaactaaaatgagggagctttacaaaatagcatggccatggctaataaatggaattaattctttctaatataaattttccaaaaggcagtggtggcccatgtctttgatcccagcacttgggaggcagaggcaggcagatctctgagtttgaggccagcctggtctacagagtgagttccaggacaaccagagctacacagagaaatccagtcttgaaaaaataaaacagaaacaaaaagaaagaaagaaaagaaattttcctactgcataggctggctacctgacttaactcactgggggaaacacacagacttaaagatgaaatgtatgccattctgttggaggcatttggatgccgtctaaagtttcagttgggttaagcatcgtctttgttctctaagcctgtccccctttaaaggcaaggtctcactgtgtatccctgctgtctggacttcagactcactcacctgcatcccctgagtgctggaagtgatgtagtttaagggacgttgtcacacccacctgagcttggttttggtcttgtttgtttgttggttggttggtttttcgagatagggtttttctgtatagccctggctgtcctggaacttactctgtagactgggctggccttgaactcagaaatctgcctgcctctgcctcccgagtgctgggattacaggcgtgcgccaccacgcccggcttgttttgttttcacttgaaggagtaagttgggttttactcttacatccgagtatcatttagttttgacctaaggaagttcatcagtcatagaaacaagcgttatcttttacaaacccaatggcctgaaagatcttttgcaacatactttttggttttggccttatctttctgtttctattttagaataagccttcccttcaggaataaaaatctgtattttttctctaaaaatcctttcttaaaaacatttttcctttaattaaaataaaacaacaacaacaaaacttgtataccttcctcatatttagttcatcatttttc

SEQ ID NO: 29938 - DNA, 1197 bp, Mus musculus
ctgcaatactgaagttttcctatgctacctcattgtcaatctgcaccattcctgtttgggtgtgaggccatctctagacagtggaggttctgtggtttgcttcccttctgactgcccagtgcccagctggttcttgtgcacccattatgagattggatccaagtcaatgtttgccatgtttgcctcagtagctcacactgatagaagtaatgacttcgtagcatgtcaaggatattgctgattggctggtgacccctcccttggcttcttacccatttctttttgtcttctctggcctgtgagatggagaggctgggtttgcaaatccgcttatcctcacgtcaaacggaaaaaatgacagaagaggatagagggctcagggtatattttaataaaaatgatgatggttcctatttttctcctacaatccctttttcttgcttcacagtgaacaaaaaagttctctttgtggaacagaaaaaaatccgttccctctgagtagtggattgaaaatgaatttgattcctaaatgagaagctcgagggtgaggcaccgtttcgaactctgcagtgtgcaatgaagacgaggaagttccagcatggcctcgggggatgttggctaagggacagagccgaaagagtccttcacagagaccacatatttatctccctggatgctttataggccttaataaaaaaatatcaaaatagtctatactcttgtctcttagaggtattctgtcatatgaagtgtaaaaaaccaatcacctaaccaagttgttttacataaggaaagccatttccactgcgaggcttgagcaagagttcctcggctgctccttgtgcctccataggacagtgctctagacagtgctgaagaatctgctttcgtggtgacaggctagcaggcagcaggaaagaaagaaaacatctgctttggtttgtgtatatgtgtgtccttgggaacagtggtccatatatatatatatattttttttaatatttattatatataaatacactgtctctgtcttcagacataccagaagagggcatcagatctcattacagatggtcatgagccaccatgtggtttttgggacttgaactcaggacctctggaagagcagtcagtgctcttaaccacggagccatctctccagccctggtccatattcttaaacagctcaccagagcc

SEQ ID NO: 29939 - DNA, 1178 bp, Mus musculus
agtccatcaagccagagtgcctacttgattaccttttgagagacagaatccagtcctcttttttcttcttgttggctaccagtcagcacatcttgttagaggatgaggcaaccatgatccagctatggcagagtagaccactcagttcacacagcacaagtctgtttaacaggaggcctccaaagtgggatcagatctttcttgtataaagtagaaaggcagtacaatcaatagccagactgttgctcactgctgagttattacagcagcagcatagagctgccctctttcccttatgatttttggtactcactcacatctcaaagtcaggggaacttgcgctgggtaagtgtcggacagatgatgtggcctctccttatgccttgttttccaagtctctctgcaacaagtgattggctctctacagtctctgtacctcatgtcacccaggattactagcaaggcctttccctggcactgaatgtgtcaccctcataggaaagaagaatctaaggaacccgaggctggctccttgcattgccgtaaaggcaagaactagaagtggctgcaccatgattgtggtgattcagttggttttgttttgaaatgaagctaggacttctggagtgtttgctgtgcatgtttatttccagagcctgcctgttcctgtggcatactgggaatggttgatatgctgaacaccagctgcgtggttctcagctcttgtgtttatccttggatcactcacttaatgtcttcaataagagtcatagtttccctcctcctgtcttatcaccccaggacttccttattgcagcctgttatttcctatctttgtatgcagcttagtgccaataattttactttacctttgtatagtacttggtattttatttacagagtgcctgctcagttattgtctttgcaagctggataatgtaggctttggcatccctgtctccagtgtaaaaattaatgtgcaggtattcttgaaggctttgcctaccctcattgctttccccaaagacctggagagagagcgaggcttctcaagacagacttctcctggtttctccatgcactatcccacatgcatggctgttgccgttcctcttacttctcttatttcttgatgggtgttgttggctctctttatattctaaattcaatgataaatt

SEQ ID NO: 29940 - DNA, 1125 bp, Mus musculus
tcatctcgacatcacctaatctagcctaagaaggtcttatggttacccctaatttacagatgaagaagaaacagacagacattaactttgttccctaatgaaagcccacaattttagattcaatgtagggaaaagcaaacaaacaaaaaatgtattcttaaatttcgtatgagttaggccccaagccctttataaactatggattgaggttaagtaacatggcagtggagaattattgtccagtgtgcatggtgcatgctctttccacagccactcttgcttggggtctgtgaaccatgcaaacatctgagtcgagttatggataaagttgccagttatagctgaggaggtacatcatgccctcaggaagttggggtgccacctgtgggaatcagcaggaagtaaaaagccaggagactcttagcagggagattacaccttcaggaatgtgggctaatactctcccaggctatgagaacctttcgtaatggagggtagccatatcatttctgagctttagtctgtcttctgggttcttgaagtcagtgatgacagtgagtgtgacccgggctggtgtgctgagcgctgctaaagcccatcaatattccacctgctgctcactctgcttcctgcctagccatgtgccctttggaatatctttcagtctagatgaaggggcatcttttggacatattgctttcagaggttccattagtttctaatgcacacacgaggcaatgctggctttttaattccacgcttacctaactcaagccctgtgtaagactaccattgttctttatcctttcattgctgtttgactccactcttgcaacactccttgactctgtgtacagctgtcaccacagccacccccacgactactacagagagggagagaacagcaggtgacgttccttgagtgtttgtgtgtgccaagccctggcttcagtgccttacacgtggatcttgttttcagctccacattgttcctgggaagtgggtgctgtgacctctcactgagtggcagaagagattgaagcacctttcagactctagatctgaggacttgaccctatatcagtctcttccatgaacacttacagatgagatggctcagaaaac

SEQ ID NO: 29941 - DNA, 1164 bp, Mus musculus
gtctctctctgtcccgtagcttgtttcaagcccagtcttctcctaggaatggacaggtggttctaagggtgagtgtctagtaaatgtggcaggcagaaggccaacataggctctttagacatctatgagaggtagtgcagtagtgaactgcatgtagttcccgtcaaacagtccagagggcttcgcctctgaagaggagagcccaacccagcttgcatgaacaataaataacaactgttctgagttagggggaaagctctgagttgcatttttttgttcaagctgtttatgctaaccacagttctttctcccctctttcccaccagggcttatttcaaaacctttgtccctcagttccaggaggccgcatttgccaatggaaagctctaggaaacaccagtgctgagaggcggccaaccagactgctcagtccacatgcgtgtcagcgctcgggctgcttgctggaaactgctcggaatgtcttcatggcagcccttggctcccacagcagctctgcctgccccgcacagccctgctctgccggagcccaaagctgagctggctggtcataccctgaatcctagcacctcactgctggtcgcccctcctcctccttagatttcctagctgaaagaaataaactgctttacgatggagaacttttccagggaaaataaaatgtcatgaatgcacacacccttctttcaagtctttgtcctgaaggcttcttcaaagttccattgaacacccttggcttctccccaccctctgaaactgttagtgttaagtttgtatatataatttgtaccccaacattcatacttccagctgaggaagtcttccactggagaagaggtgacccagtgattctgaacctgcagggctcagttgcctgctccccaggcccagagccagcgctcggaaatcctttggtcccagcactgtgcacccacggctcctgtgtgggttctgcctttccctctcctcagctcatgggagctccttgggctattctggctctgtgggttattcatgggagacaaagggtaagggtcaagagccatcactggtatgtgtgtgacatctcacctcaggcctggcaactgtgcggccgagcaggatcaaagctggggagccaggtatatgtacatgccaggatggagt

SEQ ID NO: 29942 - DNA, 1190 bp, Mus musculus
aagatgttgacgtgcttggacctaattatatttagtgaaagtcacttagaaacctagtttcatccctgaaaacagttaacaaagtgatcagagcaagaaaaggagccgccctgccagtcttaattaaagtcattaatgtgttcatgtcttcgtgataaatcagtaaagtattgcaatataggctggtgctcagtagtagtgtaatgcaaggagtggataagctgtgtacaggaaatgctagccagaaaggaaataaaggcctccacgtattacatatacttgagtatgccacacacatatttcctgtatgcagaagtcaacagaaagtactaccctaggaagctagagaaagttgtactttaacaaagactggtttagactggagtgcctagggacaagggatgatcattgaagtttaagaaggcaggagagatgtgctgtaaatgtgtgctgtattctgtgcttgcttctatttcactgttggtttgtttgttttttttctgttttctaaaggtttgctttgtgacttactgtggtccgacccagataaggatgtgcaaggctggggagaaaatgaccgtggtgtttcttttacttttggagctgatgtagtcagtaaatttctgaatcgtcatgatttagacttgatttgtcgagctcatcaggtatacagtatacgatattttattgttaatttcacacattttcatttattggtaggtaggtagataatttaccctgatgtcttttagtttctgtgacacttgaccaaggcagcttataaaagaaagaatttaattttgagctcacagattctgtgaccattgtggcatggaaaggggtggcaggcaggtaggcatggctctggagcagtagctgacaatgtccatcttgaggcaactgccatggggcagagagcgagaactaagaatggcttcggcttttgaagtctcaaaaatcccaccctaatacttcctaacagttccaccttctgaggaccaaacattcaaatatatgaactgataacctagggaaggtagtgggggaagggggttagagagttggctcagtgatttaatagcgctggcttttcttctagaggacccaggtttgattctcagcatattatgtgtcagctcaaaactgtctgaaactccagtcccaggagaccagacacctctagcctccaa

SEQ ID NO: 29943 - DNA, 2488 bp, Mus musculus
taataaggtgaactagtagagaagattctttaaaacttaaatttaagcctcagttatgaggctgtctatctaagctgtgtttctagaatctaaagcaaatgttaagcaagtgttcttccttgggggagggcggtgctgcagaccaaatccaggcacttcctattgagctgctcggccaaacttacacttcaatctaagaaatgtttgtgcagaattgctaaggtatttttattttcactggacagttgatggcatttattgaaagaataatattgttaataaacacattatttatttatttatttaaagatattgaaaccatctgaaaagaaagctaagtaccagtatggtgggctgaattctggacgtcctgtcactccgcctcgaacagctaatccaccgaagaaaaggtgaagacaggaattctagaaagagaaaccatcagatttgttaaggacatacttcataatatataagtgtgcactgtaaaaccatccagccattcgacaccctttatgatgtcacacctttaacttaaggagacggtaaaggatcttaaatttttttctaatagaaagatgtgctacactgtattgtaataagtatactctgttataatattcaacaaaattaaatccaaattcaaaagtatccattaaagttctatcttctcatatcacagtttttaaagttgaaaagcatcccagttaaactagccctgttagtgacccagatgaaagcatgaagatccatctgtgtaatgtggttttagtggtgcttggttgtttcattattttgagcttgttttgttttgtttgtttttgctagaataatggcatctacttttcctatttttccctaaacatttttaaaagtgaaaatgggaagagctttaaagacattcaccaactattcttttcctttacttatctacttaagtaactgttggatcttactaagaaaacttacccctcattacagtaaaaaggaactttagaggtcgataggttttaaaaatatacaaactatctgatccattgattttaatcaaacagtttgactgggcaaactttgcagctgataatgagtatttcgctttttacaaaattgccactgatttggatttgtgcactctaatctttaatttattgatgctctattgtgcagtagcatttcatttaagataaggctcatatagtaatatccaaaactagttggtaatgtgattatgtggtactttggctttgggttctaattcgcacgaaacaccttttggcatgcttaactttctggtattaccctcacctgcattggttttgttttttggggtttttgttgtttgtttgtttttagattcacagaacatgagaatcctttttgacaagccttggatagctggctctcttctttccctctctctatgtgaaggatgtatttaaatgaacgctggtcagtgggacatttgtcagctctgaatattgggtgcttcactaataattgccatgtgaatgttgttttgactgtaaggctatgtcactaaagatttttactctgcgttttcataatcaaaggtcatgatgtgtatagacatgctttgtagtgaagtatagtagcaataatttctgtatgtgatcaagagtttattgcattatttctttccctgttctcttttttttttttttaagggttagcattaacaaatgtcaaggagtagcaaagtcaacaaagattttagaaggaggaggaactaagagcatacacagacttatgattctttggatgtgacacttattggatgtgattctaaagtcttttattgaacattgtcaaattcgtacgcttcataggatggacataatgtttatataatgcccttcttatgtgttaccatagatgtgtgaaaccttatagcgtccttgaaagtgttaaattgagaactctgttaacattttatggattgacacattatattactgcaagtaacatttgattttcagcacagtgcaaaagttctttaaaatgcatatgtctttttttttctaattccattttgtttaaagcacattttaaatgtagttttctcatttagtaaaagttgtctaattgatacaacgtctgagtgattattctgtgttgttttgttttacagtgagatatgtaagcacaagttgacatagactgaagcatagacagtctctgagctgtagccatgttctattaggtcacacatgcttttatttaatgcgattggataacttacatactagagtaaacgaacaattgtttactcaaacaattgctaataggattttagatgttatctctgagtaatcaatacttaaggtagctcaagaaaataagccttagtctcaatattagttaatgtacactaatttgtatcttaaactgttttgttttttgtaaatgttcattcaaattaaaactaggggcgaaaagtaagcaaattagtattggttgttaaaggata

SEQ ID NO: 29944 - DNA, 1191 bp, Mus musculus
ggatttctcactgattgaaaagtttgctgctagcaacactctgagatatcctgtgtcttctttcccagtttactagaatgtgctagagtagttgacttttttcatgggtgctggagatcttgtgtcctcatgcacatgggacaagcaacttatcagctgtcttttccctatcctcacagagtgtctctgtgtaccttaagaaggcttcaaacgcatcatcagtttccttcagcctcttgagtactgatctggatatgtgtggcatatccaactatatctcttcttattatgattctccatcccagacataaagagttgattaatatggtgatttttaaatatatttttattagatattttctttatttacatttcaaatgttatcccctttcctagtttctccttcgaaaatctcctatccttcccccaacccctgccctacttaccaacctacccactcctgctttctggccctggcatttccctatacttgggcatagaaccttcacaggcctcttctcccattgatgaccaactaggccatcctcggctacgtatacagctagaaccacaagttccaccatgtattttctttgattggtggtttagttccaaggagctctgggggtactggttagttcctattgatgttcctcctatggggcttaagaccccttcaactccttgggtactttctctagctccttcattggagaccttgtgctccgtccaatggatgattgtgagcatccacttctgtatttgccaggcactggtaaaggccctcaggagacagctatatcaggctcctgtcagcaggctcttgttggcatctgccatagtgtctaggtttggtggttgtttatgggatggatccccaagtggggcagtctctggatggttgttcattcaatctctgctccaaactttgtcactccttccatgggtattttgttcccccttctttttttttttttttttttttttggttttggtttttggttttttggttttttgagacagggtttctctgtatagccctggctgtcctggaactcactctgtgaccaggccggcctcgaactcagaaatccacctgcctcttgttcccccttctaagaaggattctgagctactgggctaatatccacttatcagtgcgtgcatatcatgtgtgttcttttgtaatta

SEQ ID NO: 29945 - DNA, 1164 bp, Mus musculus
tacttcctgcatattcaggtaatatttatcccttctcaagtctctgatggggttaaaaactagctagtctcacaattaaccttaaatagtttaggatttttttaaaaatgtttttagatctaagaagatatttctggatttacaaatacaagttttcatggaaaatgattttaagtacagaactctaaacaagataagatcaataatagagtactttctccaaagttgccaaatacaaatgggcaaggcattgtgaatgtaattcttacctgatgattttcattattgttcttatcgtatataacttactgtatataatttagcattgtaagagaaagagccttttactggattaaaagggaaaatgtaaaaaacaaaaacaaaaacaaaaactctcatacactatgtaaaagcattcacccgtcaattaaaaaaaaaaagcctagggctggagagatggctcagtggttaagagcactgactactcttccaaaagtcctgagttcaattcccagcaaccacatggtggctcacaaccatctgtaatgggatctgatatcaaaagcttctggtatgtacactgaagacagctacagtgtactattataaataaagtaaataaatatttaaaaaaaaaacctatagccaatgagctaagggaagaaataggaggtagaagttctaggagagagaaagaggatttctgggaaagagcaagatgcaagagatttgctgtgaactccaaggaggaagcaagacataaaactgagaagaagtcgggtgtggtggcgcacgcctttaatcccagcactttaatcccagaggcagacagatttctgagtttgaggccagcctggtctacagaatgagttccaggacagctagggctacacagagaaaccctgcctcaataaactggaaaaaaaaaaacctgagaaggtaaccaatcatgtggcatactcagactagaataaactggattattgacatatgagctagtcaaaacatatattcatgaaatattaaatatcagagtcattatttctgggaacaaagtggctgggttgcagccaacagtaacagagacatagtgctggacagtaattgagagttctacatcctgatcttcaggggaaaagagagggagagggggagggagagtgt

SEQ ID NO: 29946 - DNA, 1164 bp, Mus musculus
ggtaacatcgaactcagaaaaataatactttagttcatgctaagtacagctctttgacacttctgttttctctgtaaggtacagcttagacttttacatctgtatatttttatttttgaaaataaatatacatctgtatatttttttgaaaataaatatacatctgtatatttttgaagcagggtctctttcacaactcagtgattgactagacaggtaagttctaaggatccttctgtttcttcttccatattgtacagcagtttcctgagatcaaaaccttccattttggagggaaccttcttaagatacaggatgtaaaaaggaaaatggaacaacaggatgttctaagaggagggaaaacactccagcctgtacagaatctccttagctatgaagtaaatcaaaatagcttttgggagtccctgaaactgaccagattctccaagaatgtataagcagtaaagactgagaattattctcaagacaagccaatacctgaaagactctcagactctcttgaagagactcagaccagcctagctgcctgaaagaagcatagaccagcacagctgtttataagaggtgtagaccaatggactaccaggaaaggacactctgcttgtaggctgtgcaatgtggctctggtttccagccttcatgcttgcatgggctctcggtgatgtagctgtctttaagtcatttatggtcttattacaagtaagccctcacccatattcctataagcaaccctggtaaaacttattcgttcatcaagttgaactttggtagtatctgaacttggtctgtgtcattggttccctgtctggggtgtgtagatatttgttctcatcttcctagggatagtgtcattcatacagtattccccaacattgagattgcaagcatgttctgccactctggttttgatatggatgatggagatcagaactcaggtttttcatgcttagtcagcaaatagtttactaactgagttatttccatagcctcttctttcatctaggcatacttcaccatgaaccctaaatcccagtggggacatttaaatagcaaaataaaatgtacaaaaatggaaaaaaaaaacccactaaagaccacataaagggcactcaagaaagcagtaggtcaccttgttttgtctat

SEQ ID NO: 29947 - DNA, 1159 bp, Mus musculus
ttcagatttcacagtattttgtttcttatactttgtgtgggatcttttttaaaaagagagaccagcttctcttgtgctctaataatttatgctaacacatgcctcttaataaggtctgagtttggaactcagagcaatccataaaaaaaaaaaatctggtgttttgaaaatcttcatttattatgtgtgcacatgtacaccatggtatgcatgtaaaaatcagagaacaactttcaagggtgttctttaaaaaaaaagaaaaaggtcagttatatttggctgaagagatacttcagtggtaaagagcactcttccaaaggacctgggtttgattcccaacatggcagctcacaattcctctaactcaagtcccagggcatctgacacactcttctggcttctgttcgtaccaggcacacacatggtacacaggcatacatgcatacaaaatacccttatacatgaagtgagtgatttaaaccattctctttaactgaaaaaagtcaatccatgcctctttgccactcctgtttctcctgtgttgattatttcatgctagctggctcagaaggtttcagcctgttgtccgtctctgcttcccattttacagtagagtgctgagattacagacacatgctgtcacatctggctttttatgtgagttcctatggaatacaagctctttgctgttgtttttgtttttcaatacaggatttctctgtgtaatagacctggctggcctcctctgcctttgtctccccgagggctgggattaaaggtgtatgctaccacacccagcttgagtggcaagaccttttacccactaaaccagtggttcttaaccttgctaatgctgtgactctacatttcctcatgttgtggtgacccccccccagccataaaattatttttgttgttactgtaattttactactgttattaatcataattaaatattttggagatagaggtttgccaaggaggtcacaacttgtaggttgagaaccattgcactaaatcatctcactcccccacaccaccactaccaccaccaaatatctctaaactcttgtttacacctggtggttacttaaaataaaccacaccttatatttataatatgtgaaatgagatggacatcagtagttgcttctatgtg

SEQ ID NO: 29948 - DNA, 1102 bp, Mus musculus
tttgatttaatattcatatctatttttactttgttatttttatatttattgttatatttaatttacagctattccttgtcatgttttctgtcacactccattcttttttgttttttgttttgacagggttggtcctggctgtcctgtaactcactttgtagaccaggctggctgtcctcgaactcagaaatctgcctgcctctgcttcccaagtgctgggattaaaggcgtgcgccaccaccacacagcttgtttttgttttcaagacagggtttctctgtgtagccttggctgtcttagaactttctctgtagaccaggctggcctcgaactcagagatctacctgttctgcctctcaagtgctggaattaagttgtgcaccccactgccaaacatcatacaccattcttattgatacatgtatgtaatttttttgaccctcatctttccaaatcaaaatatcactaattttttttagatggtattttggcaaaatggggagaaaagatgcggaaagattacttctgaatcctgggaatcagcgaggtattttcttagtaagagaaagtgaaactactaaaggtatgactattatattatcatgtgcctagaataccttccccatagtttggggaagctggagtgacagtgcctatccccctccctccccaggtgcttactccctctcaatccgtgattgggatgaggtgaggggtgacaatgtgaagcattacaagatcagaaaacttgacaatggtggctactacatcacgaccagagctcagtttgatacactgcagaagctggtgaagcactacacaggtaagtgagcacttcagaggaggaattaatccctcatgttctgtttcgtgaagataagcctgtcaagctttaatctcatttatatttacacacatatttaccttgcactatgtggctcctatggatgaaacttaagttgtcaggcttgaccacaagcaccagcttccaaatgaggaacaagacttgcatgttgcccaggcagtatagcaggaccctgactcagaacaataaagaatgataatacctggaaactaaattggattataagattgcatgctc

SEQ ID NO: 29949 - DNA, 1149 bp, Mus musculus
tgttctcatttaccagctgggaccttgggacagttctctagcttttccaatctcaatttatatgaaagatttatattacataataacataggcatacatactcagtaaatattagcataaaatgtatttctaaagtgtttcgtttgtatatacttcatcattcttcttattgaaagattcccatgctatatatctttttagagtaaaactgataggagactgattttaatttaatgacaagctttttaaaagaacaaataataagccaggtatggtggcatatacctttaatcctagaagcaggtgaatctctctctgagtgtagtccaggccagccaaggctacatagtgagatctatctcaaagatcagtcaaataaataaataatcatatgatacacacactaatattctgtttgacttaaaaagtaattcatttacaatataccctgtttatctatctagaacatgctgatggattatgccacaagttaacaactgtgtgtcctactgtgaaaccccagactcaaggtctggcaaaagatgcttgggaaatccctcgagaatcattgcgactagaggtgaaactaggtcaaggatgctttggggaagtgtggatgggtaagaagcctgaactttgttgttacttcattttgttatggaatcataaattaaaatatgtacaatatatattttattatgtagtataacttttactgttgattgaattttggtctaatagtccttgaaatacagattgagaaagtaaaataaattgttttcctaggaacatggaatggaactacaaaagtagcaatcaaaacactaaagccaggtacaatgatgccagaagcattccttcaagaagctcagataatgaaaaagctaagacacgataaacttgttccactctatgcagttgtttctgaagagcccatttatattgtcaccgagtttatgtcaaaaggtacgtgcattgtttgttaaaggattgtgttacgatgaaacaatttaggttgttttttttttcttttagatttatttatttattatatgtaaaagtacactgtagctgtgttcagacaccagaagagggcatcagatctcattacagatggttgtgggccaccatgtggttgctgggatttga

SEQ ID NO: 29950 - DNA, 1200 bp, Mus musculus
gagctataatatgttggtacttcagcaccttagatttgtgttggtttttgttttgtcttatgatgcacttcttctaaccattgaccagaaaataggtcatagtgatatgttgggttttgttttttttttcttgcagtgttaggatataaaaatttagcttttttttgctcttgttcttttggttttttgtttgtctgtttgttttttcgagacagggtttctctgtgtagccctggctgtcctggaactcactttgtagaccaggctggcctcgaactcagaaatctgcctgactctgcctcccgagtgctgggattaaaggcgtgcgccaccacacccagttttgttgctcttgttcttgttgcagagatttttgttgtttttattgttgtgttctagactattactgtcattgtttttgagctacccagtttttcaacagtctctttagtttaacagtaagtgtcttttcccctttgcatcatatattttgcattttttcctctcctaagatcgctgatggcatggcgtatattgaaagaatgaactatattcaccgagatctccgagctgctaatattcttgtaggagaaaatcttatatgcaaaatagcagattttggcttagcaagattaattgaagacaatgaatacacggcaagacaaggtaaagtaacatacatagatgcttataatctaatgtcctatgcttgtcttaatactactttgaatacccagagccttgtggaatacaaaaagttctagtggatagccaggtccctgcctgctcctgcctgtgggctgtcaggtaggatgcagcttcaaaagtcctttgttgtgaggctgcctttttgtcctttttgtccagcatgtaacatgcatgttcatgtagacctgacacaaaactatctgtagactaaatgcctctgagtgggtgtttctcatgtagcaaagcagctctctatgtttgacccctagaatccctgtcatctgtaatcctaacatttctgtaggaggggatggaaggtgaaggtaggagagccattcagaagctggcaggccagctaacctgcagtaagtagattagcatcagaaatgagagaccctgtcttgacaaggtagaaaaaagaaacaactccctaaaatagtcctgtctgccgtacccatgctgtggcatgaatagcctgcactcaaatgcatg

SEQ ID NO: 29951 - DNA, 1096 bp, Mus musculus
tttgtttgggtttttttttttatttcatggtgatcaaggaagcttcctttttttaaaaaatgagtcctatatttatataacatttctccccaatattttctaagtgagcatactgatggaagtcaaaacaaagacatcagtttttgttttcttcaatgttttttttttatttgttttaactgaccaaaggagaaagaagtctaaggaggaatctgtgagaatggagctgataaataaggagactaaactctcattaaatagccaaccttattcagcacctcaaacagtttgtactctgagggttaagaaaggtcacatgagtaaagttctcatgagttcaagctgtgtaaaattcccatagaggcataaagaggatagttttagcatctaattgatttacaaccacaaactaatgaactatctgaagtaaactcaagtcctatgctacacctaggaggagcacaaaaacacattccaataataatttcatgtttttcaagaaacttaggtcacaagacttgttttcttagaatgttctcataagcactcagaattctcctcacatgacactattcctggactatgtttctcaacagtgctctagtagaagaggcaaaattaaacaaaacctgaagccaggtcttgccaaggaagaaccaggtgatttgacagtacatttactgttaaaaccgaatgtcctgtagaaaaacaaatccactgtgtgtaattcagaatgtcaacgttgtcagaaatagtatctgctcaggacccccacaatcaggttctcagcacaaaggagatttgtttgcctccgtgggagagggcagtgaataagagacagacgagagatagaggacaaggagaaggggaggggagagggagagaggcgtatttgccctggaggacaaaggactgcctctggatagagacagatgtggccccttaggcaaatggaggcttataaaggtagagggggaaattccatgtaagaataaggtatttaattttaattgggtgtattcattaggtgagccaaaggaagctttttttttttgttttttttttttttgttttgtggctttttcgagacagggtt

SEQ ID NO: 29952 - DNA, 3357 bp, Mus musculus
cttcctccaacaagaccacacatattccaacaaggccacacctcctaatagtgccacttcccatgggccaagcatattcaaaccaccacagtcatattaaaatacagattattatttaacatttctttatattaattgatatgcctttttacaagataaacttgatgtttcttcagctactagctaggatgtttactctcttttggtatttatggccaagactgttgtttttaatatttgaatcttaacattaggtatggtaaaccgtgaagtattggaacaagtagagcggggatacagaatgccttgcccccagggctgtcccgaatccctccatgaattgatgaatctttgctggaagaaggatcctgatgaaagaccaacatttgaatatattcagtccttcttggaagactacttcactgctacagagccacagtaccaaccaggagaaaatttataatccaagtaacctgtgtgcacagatctgccaaaacagagagaccttgtgtgagttcttcctgcacagaaatgagaagatatgcttcactcggcatgtttcttatggtaaactggaattccagatacggttactcaaaaccactttttttttctccaagcattaaactctaaagtaccaatgatgcatcttacagcatacttcagggtccagagaaagtagagctagagagtgtgattgtgggtgtagcatggtaagaaagagcaacaggactactggtcattgccttttcttccccaaacttgccaagagaaaactacttcttggtatgtataaaacttggctgttactccacaggaaaattctaagatcaaagaacttcatgggaccaaataattccattccagttttttaaattttctagaattttttttctcaaagtttttttttgtttgttttgttctgttttttccctgtttaatagtcaacatgcactcctatcagaggcctccttttgtgtgaaaatgggccaagtcttccaaatgcaaaggaatggattataaacagcatcaaaaacattgatttaaaaagccatggaagttagaagcataatacagtatgctcacactttgtccagagaactggaaagcaaaacaaatttttcatatcagtcatgtcttaaattgttcagctttgaataatgaaggtaaccagaaagtggattaatctttttacaagggtgtattaatttttaaagggttatatacaattgaaattattctatccagtccaagagaaaaatcttttaatatttgcatagcataaaaataaaaaacaaacctaacatttaagcagtcaatttttaaacaataagtggagtactatgaggtgttgctagtatgtttttatgattatgggctccacaaatagaaaacatcactagatcagggacttgaatgcactttgcttatattgagtatagaataggagagaagaaaatgtatttaaagaaatatgagagacgacatgtgaaagttctacaggtattgggatggggtgggatgtctaatgttggtgttgtagagaaacaacatggctttctggcactcaaaactcctcattagctgttttcttataccttaaaagttttaaagtatgattgtaaaactaattttcttatcatatacactgttttatctcctcaaaatagtgaggataaggctctaccctaatttcagtggcccagcttttatacagaacctcttagaacaccaagtttcaaatccctgttggaaactttacttacattacaactatacttgatggttatcatattttccttttataattaatttgaggaaaaatacttactgagtaactgtaatataaaggggggattttgcccatttaaagtacaggtgtaaagcatttaaaatgagagtttttctaactcagaaattatgaaatattaatttgaactgagtagtattaacagtttaaggatctagcaagaggaaaatggagtctgctaaaagtctaatatttatgttttaaaatatattattttatagttatactttaaggcattatatcaagttctttttattttcagaatataattttgaactaccatcagtaaatgtaaaaatgtgtgccatggtaaacatgttcaaattttaaatgtgacaagtgaacttcatgcaaattggcaaaagttctggtactaaaagttgtatttgtttttcttttacttaacctattcagtactgactcctctgccaagagggtctcctgagaagactgggtcctcttgccctgatgtctactctgtgacatgagtgttttaaagggcttcatgtgaactatggtattatagtgtatgtaagcattcattaaagggtaataaaatatgtttatgtactaaagctgatcagaaaaataaggcagaaaaattgatggcattctttagattttaactaaatggagcagctccttataatacaaattgtatagtaaggatacaacactaattaatatgttttcagtttaatttgttatgtattttttaattatcaagaaaaagaaacagttttgtacatttgaggatttttttttcaacagctttcatctgtattgtcttaacgtggaactttaacacaccagaaacgaaagttgttaaaagcagccttctagcacaaacacttttttaagtaaataatggtagcctaaaacttaatatttttataaaatattgtaatattgttttatgaattattaaaataaaattctttgttgaatgcatctatgtattcttttctgttgctctttgtatttcattaactttgtaaattttgacatattctgaatttattcttccattaggggaaaaatgttcagttagaacatccttggaaatccttaacagagttaaaatcgtctcttcttacatttagaatactgttgaatttatttcacatgactaatttcttgtgtctagtaaatgatatgttctaaaattgtatcagcaaatacagttactgtatcacataggaacccttggtgttttgagtgaagctatttaggacatgtaggcagtatggaggctgtaaagtagagcagccactctgggccataggaattcacacacacatctctatgtgttctacaattctcttttcaaaggtttaatgaaaataaaaatttaaatatcaagtcaaaagcccttatcattttcggtactgtaattgtgttgattactttttactactgcttcaagtaagatttttcccctcttcatgatatctttaaaaacatttccaaataacagtaaatcagcacaatgctttcttcagtgcattatttatggagtatatcaacaagcctatggcatacatact

SEQ ID NO: 29953 - DNA, 1615 bp, Mus musculus
ttgctcctaggacctgcacacaaacagccccaggtacagcaagggctcctacaatgacctgagctttgtaacacatgccaacaaggagggcattcccatgcgcaagggtgagcccctgggggagttcaacctgggctccaccatcgtgctcatcttcgaggcacccaaggacttcaacttcaggctgaaggcagggcagaagatccgctttggggaagcactgggctccctctagtcctctcggttgtggctgccaaaggatctttccacacaggagcatgagggtcttcagcggagcctcaggctgtctgggtgaggggcactgcggggctgaccttataagattgcctgtccatgggtgcagaggagaggttctgggtctctcaggacaggacctagaccccttttcagagtatgggtgggtgtgatttgaccccaaagtcactttcaggggtgttttaaatttttgtacaagccagagcctcccacccctaactcctggctgtgtactaccacaccctctagctgtgacccctcccgtcacagggctctctcaatgtgcacagggtgaggtgcctgctgggcacagactgtggatccactgtcttcctagagcaggccacatggccttcataactgctttctgctccccaatttcacccgtctgctttctggaaaagtaaaatcatttatataatgctgaatgtgttatcctgggctctgccagtgtcttctgaggacaatgactaatgatgtagacctttgtaggctctaagaagctggctgaatccttttgctggtaggcaaaaccaattaattactggcttgtctggtagagtctggagtgaaagggcaggtggaggccctgccctgcagaactaggggacatgctgctattggtctagggactgtgttggaggcagagggtatagaggtcagtacctagaaaacaggtatgcaggccatggggaacccagtggtagggacaagaccagagttcatgtcgatcttgggaatgccatgaatttctcctgcaggagaaatcacttaactttttcaactgtatcagtagtaccgtattttgtatgaaaagtaggagacttctgaacagtaattcatttcattgcaagacattttgaaattaaaaaaacaaaacaaaaactaccgtagctttgtattttgttgttgagggtggggcagtgtgtccaaggcctggtgaaggatagcacctgtcccccagggatgggcccactagcacagagcccgtctcaggctgacactgggcctcgagctccttagccagctgctggatctgcagttccacctggggacatgggagagagggagggacaaggcaagctgaaaggaaggacagccaggggcttacctcctccagttcggttttcacctgctcttctagatgaaggtccttagatctcggcacctcctggcttagctccagccacctacgcaggctgttggcttgttgctggcatgacttggagatggggacacctatcaggctgggtccttggcacagcctcaagcgagccctttgaagaggtatattggctaataaagtgctttgagagaatggccaacaatcttctgtctt

SEQ ID NO: 29954 - DNA, 1191 bp, Mus musculus
ggcagcaggctgctatgtagccaaaagtcattattggctacatgcaggccatgtacaggtgctcactgtgggatgaatggcacctggagcttgtccaaaagccaggccttctttctgtcctacccaatagcttcctccagtgactccttcagaaaccagctggtcacccgggaagggaatgagctgtaccactgtgtcatctacctggccccaggagactaccactgcttccactcccccactgactggaccatctcacatcggcgccacttcccaggtctgcccaggggtgggcattagaggccctgggccttttgacttgggaggactgggcttgaggctggtgtcgtcaaggccaggagaggacttcttgaggtggctgactataggcaagggtatctggggtcctgcttagaatttggaacgcttggcctgtgagtccctgtggctctttggccattctgatgtgaacatgtcaggctctgagcagaaagtagcatattctcttgtctcttcaggttccctgatgtcagtgaaccctggcatggcccgatggatcaaagagctcttttgtcacaatgagcgtgtagtcctaactggagactggaaacatgggttcttctcgttgacagcagtgggagccaccaatgtgggctctatccgtatccactttgaccgagtgagcaaagcccacaggccaaacctcttgggtccaaccacttcatttgctgtacagccatatctttgggcttataaattttgtggtggtggggggggggggatgttctagctctgaccaggcttggctctgctgagcagctgctctgcagacacccctgtcagctcagcctccctctctctgttgcccaatctgtggccattcacctgcctgaaccaatcccacatcctatcacactgcttctgccaggagccctgatcagaggcaaggatggagcctgcaggagggtagagttggcttgggtgagaaaatctggtacccactctgcctttttaggtgttaatggttgctgctggcgctaacctttcagcatttatgtctgacccctgccccgccttgtcaaagtcacagctgatactgggagtgttgattagttaggcctttgccctgagagacttgtctctgccacctgggctgggcagggttgagaacaggcaacaggctaattagct

SEQ ID NO: 29955 - DNA, 2034 bp, Mus musculus
cttctcagtcctgcccactgaatacacatattcatttagtgacgtgcataaaagcagatttctctcgtaaccacttaaaaactgttaaggtggagtgtgggtttctctgaaatgttggtatatgatgaagttagcagtggtgtcagaggctgaccaagagtgttttcagctgctagagtgcctggttctgtcaagggccagagccagtgctctctgagagtgcctcgtggactctgctccctcgtcaaacctactggaaaggtttgcatgctacaagtagcacagttcctaggtttgcgcccagaggagtctgcaggcggtaggctgccgtctgtcgtctgagcagcaggccctcagagctcaccctccccagtgtccttactgtgctccttcctctcctgtgtgttctcatcccaccctctctcccattcattcttcacacctaccgctcagaggtcagaagttcaaactgcttggctgatggctaagatgctcaagctagctgctgaacaatgctcatttcttcccattctcctggcttggtccagggacatttctctgttcgtctgtagagaagagtgagcagtgctgtcctggaatgttggccaacgcttctacgattctttcattccccatttgtcagtggctaaggagaaggggcaccaccagttcagggtctttatgtgcctttcctttgcgggttggtggtctgggccaccctgaaacagttaaactggacataagtatggggaaacgtatcatgtccttcacctcctcagctgtttaaataagttaacacacacctgctggtgtatggagacttgaaggtcacagctctatcacagaagagaacaagctagtttgcacgatggtcttcagcagtgtatgcagatcctggtttacacatgatgcccagaccatacacacgtgacctgtgttcacctgaatctctctctccctcgttggggcaggagttttagttactcagtgcttctgaactctgtgttgttacttcagggactgaaatgagttacacattttgcccttctacaagtacatctaagacactgtacattagacagcttgcaagctagtgggcagcaaacagcctttcatcagtttaaccaccatggttactggggcatcagattaccccaaaaaggtgaggtgtccacagctggggtaccaccagtatacagacctttagaatttgtccatgactagtgtggcatgtaagaggctggaaacactggtctggactcttagcatctcggagcacaggacttgtcctgggaatggaagaggaaatctgccatcttggtctgccctccagctcagaactaagagactcagccacacctgtcttaccatcatgtttcacagtggtcagccagcctcagagacaccttagtgtcctcagaaccttggtctttgacaatgactggaggtggtggctgctggcatgtcacctgccaaacctatagagtggttctgtaaaggtagaatttctgaggatggggacttgccactcaagtgatgagaagctgacattaagcacaacatacctagctgtagctcacctccagaagtttagtgttttcatgattatggggaaagaagacaaatttcaggttcagccagatttcagtcgtttccttggccacctttcagtctctcgccagagcagcctcttccctcactagtgcctgtcttcttttcctcccctgctgtcccatcccgcctctccacccatctagttgtacctcatcacctgttaaagcagattgtgtctgtcttcctgctgcccttactataagagctgactgagagaggtgcagtgggaagagatgaagcttttttgccttactggagcctgaagagctcagaaactcatgctgtgaatcctaaactctgtgctcctccaagagctgtgaaaatcatgactttttttttttttttttccacaattttgcctgaaagggtcttctgtgagggctccagagccagcctgaggtcagttctagatcccaccct

SEQ ID NO: 29956 - DNA, 1147 bp, Mus musculus
acaaaaattaattttaaggtaggtgttgggggcacatgcttttaatcctatcactttggaggcagaggtgggtggacttctgtaagttgaggccagcctagtctgcatgagtttcacacctcattcaggcctacatagtgaaaccctgtcttagttagggttttactgctgtgaacagacaccatgaccaaggcaagtcttataaaaacaacatttaattggggctggcttacaggttcagaggttcagtccatcatcatcaaggtgggagcatggcagtatccaggcaggcatggcacaggaggagctgagagttctatgtcttcatccaaaggctgctagtggaagactgacttccaggtaactggagtgaggatcttatacccacacccacagtgacacacccattccaaccaggtcacacctattccaacaaggccacaccttcagatggtgccactccctggtccaaggatatacaaaccatcacagaccctgtttcaaagaaaaagtaaaataaaaaaaagggaaagatttgcaggtgatgttagtgacttgtgcttaaaggtggtgtgtctgggaggcctggcaagcccttcaggatggaggaagccactctgtgttgtgagttggttttctgtatgttctgtctccatttgccagcctgtcgtccatcttgatgctttattctttaggagtctcacgaccataggactgaatatacttgttttctaaatatgtctaggtaagtcacatttgggaggtttggtttttctttgtggtttgtttttgagaataggtcttgtataagatggccttgaacttcctgtctgcacctctgacatactgtgattacagctatgtgccaccaaatccagttttatgccgtgctagagatggaacccagggctttgcgtgcgaagcaagccctctcctgtgtgcgcttactatatcttcagccctgggttttgttttttttttacttttactttcttctgctttcaagttcagtttatagccaatatagttatttcctttgacttatttatttattactaatacttagcacaaggttgcccgtaagagtggattagatcaggcgccaaccttcacagtagttacgccagatcccagtttgtgtggaaac

SEQ ID NO: 29957 - DNA, 2302 bp, Mus musculus
acatgaaggcaggaataccaatggatttacataaccctagtgaaggagatagcacatacatcagtgtcaacaaaaaggtttgcaaaacttgtcactctcttaagaattccattgataaacatttgcctatgacaatggaaacagcaattagaatgaataaagaagaaactgaaaaacatcagactggactactgggtcacatacctgttggaaaagcatctgaggagaccagagaaggtcatggtggtaattctcagacccacttgaaatgccagagagtgcaaaatgttactgaagccccacaaaaccagggacctgtggactctgccttgccaaaggaagcatgtacatatcaaaagggcacacatgcactgctgggacaacacttgtcgtcaggcacagtgtcagatgaggtgcaggataagcaacctgtggctgaccaagatgagtccatcctgataggagcaatcaccctaagaaagccatccaaggacagaattgctagacagcttcagtggttgaaatacccaaaagaagaaagcttatgtcattcattaaagaaagacactgagttatgcacaggtacttgccttcctggtgcctcctggaaagaacatgaccccagctttgctggaggtgaccgaatacacggtgcctttgtgactctgtcacatcagcacagattgctttctgtaaagaagcagccgcatcggacatgtaagagaatttcctgtcaggagccggtcactgtgcggagaaaaataagtaaagtgagaaattctgattgtggaaagagtttctctaacccaatccccacaaaagcacacagacttctcagcccatgtactgtgcctgccaagccattggaacctgaaaccgtagctagcgagaacttgcgcagccacataccaaagccgaaggctactctgtgccattccttgaggagccggagttgtaggaagcctaccaaagaatcagccttactaagcaagctgtctgtccttgcctccagactgacaacggcaacaaagccccaggaacttagatgtcggcgggattcctcttcccttgttccattggctaaaaactacaagcgcctcagatataaaaagctcctagatggattttcacataatgcaatgcagctggacccatatttggcagctactgggtggaatagagggtctaacagtaggcccttggcactttattctcttgaagctgttaaaatgagcttcatagatttgagcaacaagatgccatcactgctgtttggtacggaaaacgtcccattttcctttcatgtgaaatcagtgtccagctgcatggctgagtcctccaggacttttcctgagcactgcgctccatcgaggcttgccttaacagaggcctcccagtgctcagctccagctcccaagtggaccttctcttttttcttgtcccatggttgccctgggatggccacattcagggaagacactggcctcagtagtcagacacacactcaggctcctctccaagaatatggaggcactgccatagttcagaccagggcagaccgctctggccttggccttcacacacttctagcactttgttcacccggatgttaccgaatctggacaaaaagacggaacttctccagtaatatgcctatcatgcagaggctcttcctgacccagtttacacagggcctaaaagggttaaggtctccagcctctatagcagataaggtcttctgttctctgccctactcggtgggccgggtgttgtccctttggagccagcacgggccctcttgtaccttcaaattgccagctcttcattccacccctagcaagcagcaggggagcctgaacgccctgagcaggtaagaacttgtctccttttctttcattctgttccatatctgtctcctgctgcctgggaacggagaggggccagtgctggaaacacaggactgcctgctgggggctacctctattacattgttcaattgtaaagtctctgttgagaatgcggtagtaattcttgcatttagaggccccgatttgccctctgactccttcccccaactcttccacaagactccctgagctcctgatgtttggctgtgggcctctgcatctgtttcagtcagttgctggatggagcatctcagaggacagttatgctaggctcttgtttgtaagcataacagaatatcattaatagtgtcagggattggttccttatttgtttgtttgtttgtttgtttgtttatttatttgagacagggttttcctgtgtagccctggctgtt

SEQ ID NO: 29958 - DNA, 1425 bp, Mus musculus
caactgcagctctgccagaactcacagaagagagacaaggtatgaaagccagaggaaccaagggggtggtagtaaggggacggtaatgaaggatgctaggtggcactgtgagacaacatctgacagctgggagcagtgcacatccaggagtagataggagcatgaccagcaatgagttttgggaaaacatagctttcattaccacagaacctgtaacctttgtggacaaaagcaactcttaaacaaaaataaatggagaattactaatttgtcctttgtttgtcattaccagggacctgtactgtttccagaatgagcaaagggaaagaagagtcatgtgacttagaccctgtctgggaagaagctgacaatcaccagcagagtctcagccactgcaaggaaaagcacagttcagcacacaatagctccatcactaaaggaagcatagatactgtaaagccctccgaagaaaattctaaaatcttatatctcacatcatttttgtctggtccaaaatccttagaaaaatgtggtttcgaatgtagtggattgataaaggcgtgtgctgaaaaaacccagaaggttgatcaaatggaggacttcacttgtggagaagaaagggctgtggaatccagtaaccacagcaactgtcacactgaagctggttgtccctgtacagacagctgtacttccatgcgtaattcttctactgaagccacagaaattatgtttaaaaaaaccgatgtgaaaattactttaaaccttcatggtaatttgataaactctgaggaccatagaaaaactgttgatgtgacccatcctgagaaacgctctgaggaaagcagcttttccttgttggtgcatattgaagaacctgaacaaacaactgtaaagtccagtgcattaaatgggaagatttacagtaaagatgctactaagtctgtagtcagcatccagaggagtctgggtgactctctgccaagtacagcattgtgcaacaactttctgtttgaaagaaagcctcctcagagtttgatgtcagaagacccaggaagttctgaacataatgaaatatcaaaacccaagaaaggtactgcaaaattaccatcatctccaggaaaacctgttcagacctcatgtgacagcatctcacattttgatgaacccatcaccacctgtgagatgagtaaacgttctcctaaccgagccctggttgcacacaaaatagagcatgaatgtgtttcacatcaacaagtgtcccttagttctcaagaccatgtgacaactggctctctaagtataaacagagaaatgccttcagcaacatgcagagatgttcaagagagccaccattctctggagaatggagtaaatgttacccctgatactcaaaccattcctgctgagacaaaaatggaagccatg

SEQ ID NO: 29959 - DNA, 1093 bp, Mus musculus
aaccccctctttaaagttagctccccatcttcttgtgaagggaactagaagcggctgtagacagcggtgtgagctgcatggctgagcacagagaaacttctctcctgcactggcttaagctggcactgtaccaggtgctcctgtacctctaactcttgatttcagaaggcacttacaggagctgcatgccgacacacacctgcagtcccaccactcaagaagctgaggcaggacgactatagctttgtttgcatctgcttcaagttcagactccagagaagtaacctttttatttattaacctaaatctgagcttttcttcagttctcaattcctgtgactactggcagaagtcctggcgttgcacggagctctgaaataataactgcgtttgtgagctcagctacctctgcgtcttctcttgactgtggggttttcttgctgcaggatctcctcccgagacaatccagcaaaggacctgtgtgtgcagacctccctggagagccacaaaacaacggaggtatgctacttttttcttgtttatttttgctttttctgagacaaggtctcactatgtagtcctagctgacctggaactcatatccactgcctctgcctcctgaatacatggaataaaagcatgtgccttatacatgggaaggtgttttgctttgttttgtttttttatgattcacttgtttatgtgtatgtgtgagcttgcttaagtgtgtgtataccacatgtgcaggagccagtggaggtcagagaggatgtcaggtccattggatctaaagttaaaggcagttgtgagtcacagtgtgggtggtgggtacccaaacagggcctattgcaagaacagtaaagcactcttaattgctgagccatgtttccagaccccaaattgaggtttattaggaaaaggtttagttgttttcttttgcgtagctgccagaatacactcctagtgagaatagtgtttctttttagttactgtttgtttgcttgtttgcttgagataggttttctctgtgcagctctggctgtcttggaacttgttttgtagaccagactggcctcagactcagaaatccccc

SEQ ID NO: 29960 - DNA, 1167 bp, Mus musculus
cattgggtgtagcttgaacatttaaaaataatttctgattgttggtgtgggagatttgaaagactcattagaacacttttaagagggatagctcagccaagttggtggcatgtttccttaattccagcactaagaaggcttaggtgggggtgggggggttgggggggtgatgtgagtctgaggctagcctggcctacataggaagtttcaaattcatcaggcctacaaagtgagatcctgcctcaaaaaaaagtggctcataaggccttcgaaccctttcccattttctccatcttagtaagcttggtggtctatgctggctcttataaggggggttatatatatatgcacacacacaaacacacatatgcagacctgtagacctggtggtattttaggatgaggagacatcaggtaggacctagccatagtagaacaaacagtaagtagtggattgaccaagagaaaaaaatataggcttgggtttttgttttttgttttgttttggttttttttctaggtacgtgacttcagcaaaccctttattttgtaaaaaattgaataactctcttgtcctagggtttttgctaacaaaataccatgaccaaaaccaaattggcttctttggcttaaaaatcgtaaatcatagtccattgagggaagctaaggctggagctcaaattgggggaacctaggagcaggaactggggcagggactatggaggaatgctgctgttggcttgtccaggctgttttcttacatagcacaggaccaccagcccagggtggtaattaaggaaacatgacattttctcagtcaaggtgccttccttccagatgactctaacttgtgtcaattgtcataaagttagccaacacactcccctgtccagttcccctatgtcccatctggataaggttgtgtaaataaatcaaatgcaaggtgagaattaaaaggcttgacactgtggtaggcaggtgtcaagtgttagcagcctttccgtaagttactaggtagctaggctatggtctttgccgtggggagtagcacatactgtgttgttctcagaggaatgataaattatctatttaatttttcagtctgcctctgagaaaaccaaaaatggtcgtgatacatgtgagtatttttaacattttttcatcact

SEQ ID NO: 29961 - DNA, 1195 bp, Mus musculus
agggttccaaagttgaggccctgtctcaaaaagacaaacaaataaacaaaaaagcccttttattcttaaaacaagtaagaattcatgggaaatatcaaaaggcatataggaaggttgttgaaccatgttctcttcccagtggtaacattgtatttgaagtgtacatgtgtatgtagtgcagcctctaaaaccagaaacttgacattggtaaaattcacagagcttatttgcttatgctgcactcatatgctttgtgtgtttttatcatgtaaagattcatctttcctcagctgctattaaaacacaacagggagccgggtgtggtgacactccttcaatcccagcactccagagacagaggcagttagatctcttagttttaggctagcctagtctacaaagcaagtcccagggcagccagagctgccatacagagaaaccctgtctcgaaaaacaaagaaacaagaaagacagaacagttgtgaggccaggcctggtggcacaggtccatagcacagctcctggggaggctgaggcgggagggtcacaagttcagtgcctgtctagactgcatgtggttcaagcccagcctgagcaacgaggaaacattctctcaaaaagtaaaaaattaaaaagtgggggtgtttgggaatgcagtccagtgggagagtgttcgccatgcatgcagaagtctgagtcacactgagttcctagtacaccgagaagaactacagagcagtgctgttactgtcctccctcctgcaagcatgcagagccatcccctgctctccattgtcctctataatttcattacttaaggatatgtgggtgggaggcacatctgtcctgattgtgtgtacagcctaaggagtgctgtatactcacagttgtcccttgcagtggaaggagccctaacaggcaggtaggctggacagacagcagaccattatcaagtcaggagaacatccagcagagcacagaggggacctttctctgccacagagccaaggccacaccaagctaggacagtaggacacatgacataaacatgcttgcatcggaaacaagggagggactcctcatctgagtcccagttcaactgcggatttgccaattaaatgtgtatgtcgtactgagattgctttgatagaggacatcactgtgcagtctgaccagtcttttaattagcctcaac

SEQ ID NO: 29962 - DNA, 1152 bp, Mus musculus
cttatctatcacgcttcctctgtgcctgttagtgtctccctctgccagggactctcaggtccctctatttagagtttctctctctcttttctttctctctctcttctctcttctctctctctctctctctctctctctctctctctctctcctccttacaggggatttctgtgtcattctggatggctttgaactcacagtctcctgtctctggctctcaagtattaagattacaggatactccagcataacatgctttaaattgcactttcctcttttaaaaactgtcaatctagagtgctttgtaggacctaggagggcagaagtttaattttccccatccatagtgccagcaaagtgcctttttcagagtagttgttctgctcgtagcttctgtgtgcagtactgggggtgggcccagggccctgtgggtgctgggtcagcagtctcccacggggctacatccctggtcctgcctgtggctttgcatggagtgaaagtccaagtggagatgtgactctgaagtgatggtctacccaaaggtccatctcagaaaacgctagaaaagctaccatacccctaccacataccccacctccagttctgtggtggctcctagctcttcttctaaatactctggataattggagtgagtatagtacatcttctctgaggtggattgcctttgctgcaatcctgggttgccccaagtggaggtttgtttgatttagtttgttttttgttgtttgtttggggttttggggaaaaggggtctcactatgtaaccctggctggcctggaactcggttttgtaaactatgctggccttgagatctgcctgtctggggctaaagtgctggggttgaaggcatgaaccacaatgcctggctaaattgggttcttaaaaaaaataaacatcttggggctggagaaatggccagcaactgagagtatttgctgctccttgtagaggactcaggtttggttcccagcacccaccctgggcagctcaccactgcctgtaactccagctccagaggatccagcacccccttctggcctcctagggcacttgtactcatgtgcacatgcagacaagcaaggacacatacatacacacaataaaataaaggtcttaggctaggggtgtgg

SEQ ID NO: 29963 - DNA, 1142 bp, Mus musculus
taataaagccctccctccctccctccctccctccctctctccctcccccggtgtctgttcccagccttgttggtagccaggccagtcaggtcacctcaggtggccagagggcttcaggacacactggtcttgagtctggctctgagctggcttgataggtttctttttcaaagtccttgggcaagaacaaggatcttctggacaggacaggactactgagcagacagtacagtacagtatagtaagaagctctaggcttgtcatgtcagaaatatgcctcgttaagtggatgggccagctcagggaagcagacatcacggcattccctacacgtccagtgagtgcttttcgctctagactgctcagggaaggcaaagaccgaagaccatgactactgcttcctcctatactagagttaatcacacaccccattgatgtaccttttttttttaaagattttattcatgtatttggtatatatgataaatacactgtagctatcttcagacaccagaacagggcatcggatcccattacagatggttctgagccaccatgtgcttgctgggatttgaactcaggacctctgggagagcagtcagtgctcttaacctctgagccatctctccagccccttgatgtaccttaccttctttacctctcctgggccctatgtacaactccaggtccagccttccttgtttctcttctctccaggaaacctaacttgtctctggttcatcctactgcactctcctgggaaactagggttttgttgggtttttgttttttaaaaaaactactccaagcaggtacagcagcttcctgtaataccagtgtttaggagactgaggtaggctggcctccatagtgtgtacttagcaaagttgagctttacaatgagactgtctcagaaagtctcactttggggctggaaagatgactcagttaagagcatttgactgatcttacagagcacctgagttcagtgccagcgtgaggtcactcacagccatccatacctggagttccaggggactccacaccctcttctgaccttcttttgcatcgggcacacatgtggtacatatacatatatccacatatataatacgtgcaagcaaagcactcacataaaacaa

SEQ ID NO: 29964 - DNA, 1339 bp, Mus musculus
tgtgtatgggtgcatcgttaggtcaaaagagaggacatcagatcccctggaactagagtctagacggtcgtgagccaccatttgggtgctgggttgggaacctgggtcctcccagagctccaagtgctcttactggctgagccatgtccctagctcctgcatgtgaagcttttgagagagtaagctgttaacgtgtgaaagtgtgatccatgggaagtaagcctaaaaaaaacttagcttcacacacacacatacttttcttcccatgaatattgctcctccttgatgtcagccttcttgtcagtgggagctgtctggagtaactggggggttgaggcaggtacagctggactttgtggagtgtacctgtaaccgcagcacttgagaagactaaaggagagggaagaaggttgctgtgattttgaggtcactccaggacacacacagtaagacactgtcccaagcaaataagcacacacaaacaaaaaggatgttttcgtttgaaagagcttagtactgaaaagagagtaaatcaagttctcgttttcccagatgggtatgttcagggttccatgccagcctcctctgtggtcacagcagctgttggccacgccagaccgtgtgatctcgtgtggtcctgttatccatcctatggagccatcaattaccccttcacatacagtttttgtcatattccagaggtaacttggaagacatagaaaattacctggcaggagttcaactgatggaataccaggtcacttgcctatcagctgtcctgagatgctcctggccttgagctccagttcctgcagtctctagcattccagattccaagctcaataaataaaggtgtttgccattggtgatttaagttcagctccccagacctatatggtggaaaggatcaactccagaaagttctctgatggccacacagatgttgtggtactcatgtatccacatatatacatacatgcataaatttaattgaaaaattttaaatattaagatctgttaaagttcactaaagtggatagaaaacagccggagagaagcagaataaaggccaatttattgttctctacagccacctactttctgagcgcttactgtgtgctaggcgtgacacatgcctgagaagaggtaaagggaaggcctctggaggtggaggccaggccatacagctgagaggaatccaggctgactgttttgtgggatagcatgacatgatcatgtgctgtgccaatcctctttgccttgaactgcaaattccatgtattcagacacaggcatcctgtaacagggccatagcttcccacacagaatccctgctaga

SEQ ID NO: 29965 - DNA, 1177 bp, Mus musculus
aatcactatatctagtgctaaacctatctgtattggcagcacagctattcagatctgccctcctgtcccttgggaagcagtttcagataaaccttcatgggcatttgctggactgatggttgctttgagtcacagggcgcttcctttttgaattgtgcagagaagtgtgttctgaacaaggcattttattatgtctgttgatctctagcaaatccaggtgatggtaattgagtgtagaaaggagaattagccaacacaggctatggctgctatttaaaacaagctgatagtgttttgttaagcagtacatcttgtgcatgcaaaaatgaatttgaccctctcacccctcccttcagctaatggaaactgacacagcgacaactcattccttcaccatcagctttataaactgtttcttgtgagctttcagcagcccttgctgtgcctctttaaattatgatgtgcacacaccttcctttcaatgcaatgcatcagaagtttttgatatgtgtaacttttttttgattgtgattaagaatcatggatttattttttgtaactctttggctattgttcttgtgtaccctgacagcatcatgtgtgtcaacctgtgtcaattatgatgggtggttatgaaatgccagactgctaaaataaatgttttggacttaaaagagtaaataaatgctgctttagggatattatctgtgcctggccttgattttttccccctcccccttctcaaacattgcagcattagtcatatacatgaatattcagacttctactgtactctgatttcattacatattttaaagcacacagtagtgttctatcaaataacactttgtccttgttaaccaatgcttataaatgagcaaagtgctgccttctgtggtgggaccctctgtaagttttggtctgtgtcttttgggagggtggtggttgacctacctgagggttggctggtgtttagtacagacagtattcgttccaaagtagataatataaaatgctaattagggggatgcaacctggggccttgaatagttttagccaagtgtggtggtacatgtctttaatcccaaccctaaagagaccagagcaggtgaatgccaccctggtttacgtagtgaactcgggctataatagatcctgtctccaaaaggtatactaa

SEQ ID NO: 29966 - DNA, 1167 bp, Mus musculus
cctgtctcgaaaacaacaacagaaataaagaaagaaagaaagaaagaaagaaagaaagaaagaaagaaagaaagaaagaaagaaagacagacagacatatgggagggagggagggagggagggagggagggagggagggagggagggagggaagaggtgagaggggagagagagagagagagagagagagagagagagagagagaatatagtggagggctggggtgtagcttagttggtaaagtacatgcctagcaaccacacaggcctgcattcagtaccgaccatcacacaaaactgtgcatagtgcagatgcctgtgactccaatactctgaagatggggagagagaatttggagcccaaagttatctcctgctacatagtaattggagtcctgaaacagtagagtccaaagaaatggccaagaaagacacttttagagtttctagaggaataacaatacattttctaaagaaatgacagaacacggctggagaggcagctcagtagttaagcacacatactgctcttttgttagtaatttctttagattatatattttgtctgtggatgtttaacacacgtatggatgtgtctgtgtctgtgtctgtgtgtctgtgtgtctgtgtatctgtgtgtctgtgtctgtgtaccatatgcattcctgctgcccagagaggccagaagagggcctcagattccttgaaactggagttacagatggttgtgagccaccacatgggtgctggcaatcaaatcctggtcagccaaagggcagccagtgctcttcactgctgagccgtctctctggtctgtggacacactgctcttgcagaagactcaagttaggttcccaaaggccacacaacatctcacagctgccttaacgccaggcccaggtttccagtgtactcttctggcctccatgggcacctacctgcacacaggtacacacgtacgtacacacacacacacacacacacacacacacacacacttacataatcttaaaagagtttctcttcaggtgtcaggtgattcagcttccttaagagcagaataagcatttagaaaaaactcacaaccacaaaaccacagcatatagtcgcaggccccaagtccttctggagagttagcagtatcagttagcttggtggaagctacagg

SEQ ID NO: 29967 - DNA, 1191 bp, Mus musculus
gtgtgtgtgtgtattgtacatacgtatatatgtttccatctgtaggtacatttgcatgagtgtgcatgtgtatatacatgtttatatgtgtgtggtgctcatagatgtatagttgtgcatgtaagtaagtgcacatgagtgtggaaacctgaggttgatgctggttccttggccattctccacattgtgtacttaggcaagatctctcatttgaacccagagtccattgatttggctagtcttaagtagtcagcttactccagggtttccctgcctctgcctcccgtgtgttgggattataccacggccatctgccatgttggggatttaaatgtcagctttattcttgcacagcaagtgatttacccactgagtcgtctccccggcccttcatccaattttttttccagacagggtttctctgtgtagccctggctgtcctggaactcactctgtagaccaggctgcctcgaactcagaaatccgcctgcctctgcctcctgagtaaaggcatgctgtgattaaaggcatgtgccaccacgcccagctgccttcatccatttttattgtgtaaataaatccattgtacagatggcttccttgtacattttcctgcttgttataacctttgtgctcaccctttgttactttctcagacatacatgccttttttattttttactttgggagttcttcccggtgctttttcttagtgatttgcaagagttctttgcatggtttgggagcttatacttttacctgtggcacatgttgtacatcatttcctcctgttccttccggctgctctgagaccaaggtcaggaatgccccgtcccctcactcacagcagctgttctgctcttgtattaaactgaaccacatgtcttcacctgagaggaactacctactgagaacccaggctgtcttccctgaggacccaaagtctgctgaggtgaaggaaggatgtgacccataaagaaaaaatagggtgtccaatgggtagcatgcagaacatctaggaggccccaaagtggtcaccaccatatgggcaggctccttaacttgttgaggaacaagggctttggaccaagatagttgatgtctggattaattgggtccagaagcaaaggtttcctacaaggaatgatctaaaactaacagggctgaaagatggtaggtcctagcatttag

SEQ ID NO: 29968 - DNA, 1899 bp, Mus musculus
gcaggcaagggaggggacagtctgcaagacaatgaggcttaaacctggaccttggctagtaggttatgcagtagtgggtcatatgactggggctacacccttatgtaaggcccctgtggatgttagaggattgagctggatgggacagtctacttttcttggggtaagaggtttggcctcctagacaggactgctgggcagaactgttgttgggccagagagtagtaaggagtcagggaatggggcttggggaagacctcatgtgagaagccaggctgtgatgctgcccagcactgaccaagtgcttactgcctccaacttttctggacctcaggggtcattgataaccatacagaaagggctgtgtgcagcaggtgggtctctgtagagctcacacgtctgccctcctctctcagcaggtaccctccaggcgtcgtgagtgtggcccccactggcatcccagctgctgtggaagggattgttcccagtgccatgtccctgtctcatggcctgccccctgtggcccacccaccccacgctccctctcctggccagactgtcaagcctgaggcggatagagaccatacgagtgaccagttgtagcctgtgaggagctgtccagccttggcacctggtggagggtgctgcacgctcttggacccaagtgtgcagaggtggcatccagtgtgggccctagcactccagagactggcccgggcgtgcactaggcggggcaagaggaagcacgtccccaagttgattgtagttgtcccgtcctgtgggctggctcactgtcctgtgtcctttgcgttcctcgtttaagcaaaagaagttagtagctaattctatcacgaatgttcttgtctgtgtacagtttttagaacattacaaaggatttgtttgcttagctgtcaacaaaaagaaaacctgagggagcattcagcaagtcagtttgagattatttttccttttctacgttggaacgtgccccggaatgtggccgtcggcacacttctcaggacaatgaatccttcctgtttttctttttatgccacacagtgcattgtttttctacctgcttgtcttatttttagaataatttagaaaaacaacaaaggctgtttttcctaattttggcatgaaccccttgttccaagtgaaggcggcatcacgagtggctccgaggcgtctgcagtgcccagggtgctcaggaccaccggggtctgtcctgggggaggcaggggttggcagacccttgcctgcgtggtgccgtcctgctcatgtggtaggctagcaatattttggttaaaatcatgtttgtgactgtaaccatttgtatgaattattttaaagaaataaaaatcccagaaagagccggcacgcctggcaccagttttaatggcttcatcaaatgggagcactggtgggtcccttctggtcctagctctcatgacctgctccactcatcttctgtggagcaggcagtcctggggagacccagaagagggcagcagcaggtagggctatagtccccactacatcttaaggggatagagggccctgggttggggaggccatccttacatacagggagggagggctgtggtgggaccaccccttttctccaaacaacagcccctaggccagcagctcttggactggcattttggaaaaacccactgaaggaaattcaacagaaaattactactaaacagaagttttagcttgcatgcaaagtgccaggctgtgtgtgattcggtttcccatttcctccactgcattgtctttagatgcaggctgtgatccactgaactgatttgacagtaattcccaaaaggatctgagcctggcatcaatgtccagcctgcaaatcaaccaaagcaaagaggctctgcctct

SEQ ID NO: 29969 - DNA, 1314 bp, Mus musculus
ccattagttggtttattctatggtagcttactttttggaatgaaccttaattcagatcttagtttgcatggcattttctcattttaatgcgtaactctgctcttgttttccagtctctgctttctattcgtcaagatgataaagttgtttgcccaagaaccaaagaagtcttccacttctcccaagctgagaaagtatacatcatgtaggccccgagttgctatgggcacgcccttggccagaggcggtggtgggtgggagccatgccctcctgccctgacccctgaccccagaccccagcctgcatcgacatttgtttcttgcgaccaaagatcagtgagcaacgacaaatactcttagaaaaagaggaagtgagatttaataagtctgtgcttgagaacagcgtttgattggtaggatttgtaacataagtcgacgatgcctctgcagggtcttgcacctctcaaaggaaactttctctacagtgtgacctggaggttcacccaggaaatccagagcatctcagaagtaggaattggttcatcggttatttccctgtgtttctccgtttccttccttttgctagtgatgggactcaggggagcttgaggagcaggctggccctttgccaactcctgttggtcacagcttgggcaaggtgctggccacaccaggttggctgcagtgacttgtgacgtggtgccgaggcctttcctgacttcactgtctagctgctgccaaagcgccgtgcaccacatgcacctgggctgctacttgaggaggctctgcccacgtggccagtgtctggggctgtgtctgcacaggttcagcatctcaccttccagcaccgccttatctcctgctttgagaatgtattcacgggaaagccactggactgagtttctgcagaggccttgccaggtggttccgtagtcctagagtgtacatgcttttcattacagaaactgatagttcagctaaaataagtactgacgggttttcaaaacaaatgaaccattgtaattcacacacacccatattgtagaggtttgtatctagcgcttatttttgcatgttgatgttgattagctaatgaactgtaaatgtaaagtgtgttaataaaatagctttctatttctcatttgtgtgtgaggtgtttgtaagacctcaggtcccttgctaaccctgccaccccacccagtaggccatgcagcacctctgtgggacatgagtttgtctgtcacaacagtgaagggcactcagcatacctattttggtgcagtatacaaaacattgtctgctaacctccaaagg

SEQ ID NO: 29970 - DNA, 1235 bp, Mus musculus
cagtgtcccacctccaattccctgcctcagcttattggctattagcctttttttttttttattgacaagtgatgtttataagagatcctcctctctacagatcttctatggtaattccttttctattgattaaagggtgtgttttcaaacccggatgagcttaaaaaccccatggaatagccacacaggccactaagctctcctggactctctatcagcccctaacccttgaaggagccttcatgcgtacacctaaccctgtgctcacaccgacacatacagcacatgtctgtccatctgtctcccctacttgttgtcaaagccgccccccaccccccatggatcagccagggctgttaatacagcaggctccacctcatgctttggtgtctggatagggcccttgcatttccagaaatcgcaagcatgctgtctgaccattgcttggatgatgccatgaaccacttgcttctgggcaaaaaatggctgttgccatgttactcagagcagctgtgatcatgcatacaagacttagaggagatggtggggagggttttagactcttatctgagagtccaccccttccctactcttgggagatgctcggctatcctgtataggggatagaagattggcagaatttgggagatcccatcttccatatagtactatggaaggcagtagggctgtctcctcccccttttcagacagggcggctcctaggctgcctggagaagtcccagaggccccaggggtcggtcatgagcactgagcagacaatcacctcttggtcaaagcttttctcctgcacagtggtacacacttgggtaaccagagcctgtttctgggcctgggagatgggagatggcttcagtacccactctggactaaaaaggaggcaagtatgactctgctaggcctttgctcagtgggagtgggacagtgttgtcagcttctgtgtcgggccaagagacgtgaatgatgttaaaaggcttgtttaacattatatatctgtgggcagcacagagatcaccagtcatgggctgtggtgattcctcatgagggctggtgaagggcagatcagaaggcttcttggaggaggtggttcagcgtccctggctttttgcactggcccctgattctgtgtaggaggagagctgtgcctgatatcagggctggaagccttccgggagatcagagtgcattctggcgagtctgagatgcaacgcagcaat

SEQ ID NO: 29971 - DNA, 2041 bp, Mus musculus
cacacagatagggacatacaaactcacacaaacataaataaaacatagtttcaaaaagttttaataagataggctctacagacaaacacgatggaaaacttctcaaggacagaggggactcaggtccctgagaggagatggcgcccttttacagagaagtcacctggctgctctttctgagccacttgagtggatgctggccaagaatgcagcggtaccccatctggtggcacctgcctttaatttgggagggggaggcaggcagaagcctgtgagttcaaggctagcctggtctacatagaaagtttcaggccacacagagatacatggtgagaccctgcctcaaacacatacacacacaaaccaatgaaccagacagagacaaaaagaaggcagccctctgtccataggtgggagtgaatccatgtaatgtcctgaggtagggacagcagggatgttaggaggcaggctcagttgtttggctaagaggacacaggtcactcagtcaggctccaagctggcatggttgctctgtttacattttactttgggccttttttatatttttgttttttctttatatgggcctcacagaagactttggactgaaaacaagcctctgggggagtgggttgcaacctatgggttgccatccctctgggggctcaatgaacctttcacaggggttgcatatcaagtgccctgcctattagatatttacattacaattcataagatagcaaaattacagttatgaagtagcaatcaaaataattttacggttggggtgtaatgtgaggagccatattaaagggtctcggcataggaaggttgagcagcagcactggaggctctccagaagtctgggggatacagaacctcagtgggtgttgggaggagcttggcccctctcctcagccgcctctctagtacggcaacacagagcccgtggcatgcaatatagaccagagacgccattcccccccacccccaggccagtatgttgcaggaaaggaggagctatgtacacgcttaatcactagttaggatacacctgtgccttttgacttggctggagtgtgcacatacttgtacaagtgtgcatatgcatgtgttaacatacatgcttatgagcgcatgtgtgcacatgtaggcaggcagataagacttagcagtgtacaggcccgactggtgcacacagatggacacgtgccctgcggccgtgcatgtgtgcgcttgcgcacatgtgcgtggtttggctttcctgtcatccttctcaagaaactacacacacacatggctgtgatgacttcccttggagtttgggagaccactggggagtgtgttcttctgcttctcgaagtgagcagaattaaccacctgctgggaaaagaatggcctcacactcttggaaatcgcagctgagggccattgctgattgatctgcactctgtccaggggccctaagattcccgctggggcagggacaggcctcctacctctgtgatacaaagcttagcagatctgtcagtgactgccattgaaatgggagatctgtattttatagcttttttttttttttaagtaaaagctaaactgtctctgttgtctacatttggtcccatctcacatgagccactaggagggtcctgagctagggaggagtccttagtaggagttgtgatattgtctcatttcttcatctgtggccatgtgactgtgactgctgacctgcactggatggccatctgctcttggatcacatctctccactgtagagggcacaggcaagtctagcctggttaaataggcatatggtcctccatccgaactatgtcagaagctgggtcctacagttgggggtatccgagagagaagagacatgggaatgatagaaagggacttctgcaagccttggtctgtgttaatgccaccggcatgaaccccaactgtgccccactcccacttcaacttcatgcctgtcacccacccttctatgctggcatcacagcaaggcaggagagacctgactggagctgaa

SEQ ID NO: 29972 - DNA, 1611 bp, Mus musculus
ggcgattctgcatggcttggggcagcaagaagtaaggtgggtagccctaagtgcctgctggttcctcacaggatgcctcctgtgaggaggatttggaagggatgttgccccaggggccacactctgtagagtcttttcttcaggaggagtctgcggtccgctcatcctttcattcaccaggtacttccaaaatatctgctgtgacttctttcaaaatgtcccagtgtcatagggtcttgaggactgactccttctggggcttggccggggccaggggggggaacctcagaagagggatagtcagctcagccattgctggacttgaggttggggtctcctgagggaggcagcattggccccatttctaggggatctgggcttggcttgcattgtccagcttagccgcttcaagactggagagtggtggacagaggggtcgctgaagagcaggcctctctgtcctcttggggtacttcatagggaaagggcctccagaggagtgtcctgcggaagggccagtctctgactagccccatgcctggtgagttcctagggagtgtcagatgtgcagggtctctgaggatcttggcacagtgctagggttctgaatcaactcttcctgccttctaccactgactggaatctccagaacacggagagggagagagtatgaagggaacccagcgtttctctagttcatgcacagcctagcagaccctagcacccattgagattttagtgattagcctcccagtagcagagacctgggactcagtggctgctgtagtggtggaagtcccagactgaatccaagcaccattctggtgtgtaccccagatcatcctgccataacataacctctgactccttctgggtctttattgtaataggttgtgccagccagtgcttatatgtcccctgtgctggggacagtatatcaagctagagtccaagagcaagcgcctcctcaaaaggaggaagctgccacagggacttgaacttggcctcctagtaggtaccagggaactgttctgtggacccttgtccccagagccggggtgtgcagtgtgtggtgcatccagcagatggcgggaggccttggaacctctaccccaccttcacccctccctcctcctgggtcctctcccttcctgtgcctgacaagcgaggaccgcccatggtcacagcacattttaatagtggaatgtaattcctgggcagcagaaaaatgaaagtgagcagtctatgaattattgcaagcgcactcaatctcccagccgagccgagtcctgggctacggagccttttcttcttgtgtttaagttagcgtggaagatgaaatagtcacaggaacacactggccactcgaacctgttattgctagctgtgtgtctcctataaacactgctctgatttataagctcgctctgctttataaatggaaaaaccagaaatgcctccaggagcaactttctggagcccgagatgtccctgaaggcgcgcttgtggccgtgaattccaaccttgtggggagggaactgtggaatgagtgctttctgtgggccgagagctgaagtttggatttgggcactgttggtgcttgtctgaacc

SEQ ID NO: 29973 - DNA, 1183 bp, Mus musculus
cactgtaacaaatactggagataaccaacttatgaaaaagcccaggcttatttgaactcacagttttggaggttttagtccttgattggttgatgttgttgctttgggcttgcaattgtacactgaggagcagagtccaaaactgcttaccttatatttgtggaatgaaaatgagaaagggaccaggattccatagtccatttgaaggaacatcctcagtgaaaagttctcaccaagtctcgcctcttaaaggttctaccaaacagggatcgaacctttaacacatgggggagtgttctagatccaaactacagctctacccttctaccacctgtccgcctaccaacccctccctgcatgagttagccagtcattgttgactcccttgctctcctgtctaaccattatcaccagctctccatgtttcagctccttatccccagaatatctgggtctgcccagtcaaagccagatagtctccatagccacatgtggtccatccttgctgtgtgctgcaagctcaggatgggcgagtggctgagacgtccaggcagtgtccactggacacacagatgggcttgttagtggaacgaactgtcaggcacaacaaggagaaagctcgatttgtaaacactggtcaatatgaattagcgccatcaggatggatttgggactaaattggacaatcacactggctgcacccagagcccagcaacaataggtaaattaggtcatcattaaattatcatggaagaaaaccgcacaatcggcagccacgctggtagaaagatgacagttatttacaaaaaccctgctgtttgcaaatttgtacaaaattatttgttccaagaggaggtttatggagctatctgcacattatctccgcccgagatcctcagccctgcatattaactaatgtctgtggtttaattggaaatagaacaggccaaattgtaaatcgctcttctgccatctgtctctgtctccacgcttgtcctcaagagaggaggacatagaataagcagatggatggctggacagacgtgtctctcctccctcggcagagtcttgacctaaccctcgcttactgccattctctggtattggccagagccacagcagcgtgtggtggtagcttacaactgccatgtaaattggctgtaagtgggcaacaggcagtagg

SEQ ID NO: 29974 - DNA, 1367 bp, Mus musculus
ggttgaggtggtcgcccggagtgtgagaaagcaggatggggcttgctctgcggaaggtcttacggggctgccctgtcatccattactgctaattacgctgggctggtggaggccacacctcatgcccaagcctgggctaggtgggcctctctctccttattgtcctctcccagagatgtctatggccagtgggaagggcctggggtctccctatcgtcccggagcaggagccagacgtcgtggacaccccgtgatagatggagcatggaaattagttccagagtttaactgataacgggagccggcgacactcggttatggcagccctaattgatgagctcgttaagcccattattagagaaattgatttcaaataggcacttagagcgggaggcaggcagggagggagcatcggaggcaaaggaagtcgcgaaaatacataatgaggcaagtaattttataggtttgtttaatgaaaagccgagacagcgcactcgtggccgtgtgggttttaaacactcattttatgtactaataaaactcccggtggaggatccgttccctaggcccaacccactggcctctgcactgccctaattaattaattaacccaggcgaggcgatcaatgagttagtcacgtggaatcgacactcgaggttgtgttcgtgggggtctgggtagtgtgtcctcagccacctcgggaccccagccctgtctggcccagagcttttaacaccagaatagacgtatatacaaagccatgacaggactgtagcatccacagtgagggtctggggctgtgaggaccaaggtggaagctgtactgagagctgcctcaccaggttatagagggggccatttacagccccttatggaaggtaggagtagttatgcgagctctgatgtccagcccctctggtagttgagacagccttgactctgacctgaccacttgctctgtctgtccttgggaccgtgtggagatagcctggaggtatgtcaccctgcacatagaatcccacgtgtacacgtggagtacacaggctcagagatgctgaaatggaaatatgcaggctcccacagggattcacatgaaaacagctggaacacttttctgaagcatgcttgtggccttgaggctcagagcttccaactccattcactgcccgtggctgctccagagtatcagctccttgggcctcttcacgccccactcggttcagccttagggttctgcgcatgcgctgacgcttacctgaaccctggcctgactacccaaaggcctcttaactcttcctagacacccccaggcttctcatgtccaacatggctgaggacagatgtgagctctgtcctcacgactccc

SEQ ID NO: 29975 - DNA, 1674 bp, Mus musculus
ccccagggaaggctgctgggaaaactcaggtattcttagaattcatccagagttggggtaggatcaggacaggggggtatccccgttgcaatcccaaagagccccaccatgccctgctctctcccatcagaagccggaactgcacatatcatcccagagatcttggcacaccttccatgttgaagggctaggctggacacagacctcagattcacagacctcctctctagggagcccttcaccattactcctcagtccagagtccctgcccaaggactgggctgggacagggtgtagggaagggtaggcctgtccaagcttgggacttttgaaagtggggcccttgggggcagcttaagcaacgtggtcagaggctgactccttgttctaatttgctttctgttgctgtgataaaatactgaccaaagcgacttggcggtgggggaagattcctggagaagaaataaaatgaaaaacagggttactatacttcacagttggtctttccagctgctaccagaaaggcttattttagattataagttgcagttcataaccaatggcagccaaggcagggactgaagcaaagataacgatggagtagtgctgcttgctggcttgctctccatgacttgctcagtctgctttacatgacccgcaggcctgaaggcctgtctatggaattaatttctcaagccccctccttcccaggtgatttaatttatgctgagttgacaaaaactaacagtacacccttctactggagactctctcacatggacacctcctttaacgtggtggacattccttcatctggagaccctcccaaacctggggacccccatatccctggaaattcccatatctggactccccttctgggggcgtctcctcctggagactttcccacttagagtctcagcatttagaggccccaccaggtgaagagtcctctcttctggagactcccacacacagagccccccacctctggttcaggtgtcccaacctccccgttcactgtgcttctgccctgaggagcctaatgtatctgctgatgggctgtgctccccttccctgtcacttctctggagagtcaccagccctgctgcatgcagttcttcccccggccattctctctagctatttcccagcagacacgatcctgggtactgcatttctgtcatctcacagaattccaccccgaggcactcacactttatagaaagggcaactgaggcaagggagtgtagacggtctagacagtggctcctctctgtatgagggagcaggtgttccaggccaaaaaaaaaaaaaaagtcccattttgcttaaggatggttggctggcagaaagtgtggggacatatagccagtgcccctgcagagacatcctgccttgctctgcagtcttggacaatttaagtgtggggacatatagccagtgcccctgcagagacatcctgccttgctctgcagtcttggacaatttaagtgcctcctcttctgggggggatctacagcagaaagcacctgatgtccagacaccaacccaacacacctttgctctctatggacactcaagctctgcagatactgctctgtgtgctgaccctagcagtcctccctcccctgcactgtcttcctttgcaggtgctcctcccagacaagtgct

SEQ ID NO: 29976 - DNA, 1149 bp, Mus musculus
cttaaagccaccctgggctactttgtctgtctgtctgtctgtctgtctgtccttactccagacacatttagggtggttctcttttttctgttgttttgtggccctggtttctgatgaggctagggatgagatgagcagagtccaggaaacagttctagggcagtgactggtgtctggtgactggggtgggctagacacccttctaggcaggcacaatgttgtcttgcacatcacctaccagaaatgccttcagtccgtgtgttttctgttgcagactttaaaaaactccaagagcctttgctccctggactatgaagacgatgaggatgacacccaggagaagactcttgtgtcctccccgtgtaactcacagggcctcgtgggcatcatcacaccgagctctagcccaaggattcccaggcctggccctgacagccccagtatctgggcgtcaggggagccagaggccaacccaggcgagggtgggagcagtggggaccccagtgactgggacagtgcaggagaggagggcatcttcccactggaccacggcgacctggacttggagcagattgagaacaactgactttggctgagcaggatgactgtggttgctgtctgtcaccttggtgcctgaccagtggaaataacttgtgtgttattttgaaaattgaggcgtaattttgattcagtttttcctaaagaagtattttgcatttttatggcttctacagtttgagagagcttctctattttgaaatgggtttcagagggcattctattaaacatgattctgcctagagattctgcctagattctttttgtcagagcctactgtgaaaattaagtatggttttctggacaaccttggggctgatggtctgcaggctccctggggagggatcacagcctgagagcttggaatgttcttgtctgacacacttacttggacagttgtgacaggaccgtcagggtttcctttccattgatgtcccagggggctttttttttttttcgtttttttagttgttgctttgtttattgattttcgtttttgtttttttttaatctgggctgcatctgaagagccctccgagacaggccttggcccagctagtttgaccacaccacagcttctagaatttggtt

SEQ ID NO: 29977 - DNA, 1172 bp, Mus musculus
tgcatctgcatgtagtgcacacacacacacaataaaattaaagtaaatcaaggtgtttgagagtccatgtggtggcacgtgggccaggagggaccacttgtcattactcttcttgacagaagaccctgcaaagcccttaccctgttagggcatggctcagaggttgggttggggctttcagtttagatgagcagcgggccagactgcccgtggccctgcgtcccagctggctctgtctggcttacggaggatcagcacttctcctaggacatggctcgttcagattcaggttcctttatttgaaagaaaggaaaacaggctgaccctgctctgtttgctcctcctctagtctaaattggagatggtattcactgtgctggggtagactagactaaatgctgttgtctttaggcatggtagatgagatttcaggtcagagagactaaacaggaatagtatgtgagtggtgtgatataccccgggctgagaacatgtgttagtgggaccttttattgaactgagctcacatgtgggcctgggctgggtacctgcttcctgcatccactaatggaaactcacaagctctaggctagccagtgtgtggttggtatgctgttggtgacatgaggccctgattcctgtgcttgctacgtgtcaaccttgccttgttcagtcacatgctggcttttgagcctcaggtttcaaagtcacagggggaagtatttgttgtttctgttgacagaatgtatatatattttcaagaatgaaaagttggtatttgatcttatttgagatctttctgatctctgtaaaaatatccatatgattttctcctgttgacagagccctaggtttgtaccctctttgtttgccagcatgacccctaccaggcttgtgatgttacttccagcaggtgtggatgttgtggtcatacccagtgatcttgggcaaacactcccaggattgctctcctttggagtgccttactgggtggaaggaggtgacttgaacctcagggtgttttttttgtttttgttttttgggtttttttgctcatggatacaccctgcagaggccctgaggtagttctgttaggctaactcttttgagtaatgtgcttgttctggggtgttgcatgacagtgcatcatgttgaggcacagctgactcctg

SEQ ID NO: 29978 - DNA, 1241 bp, Mus musculus
ggaaagcaaaacggtgagctgcagaaacctcttacatttcattagggaagagttctcatgatgtaataacactgagacggcctgagatatagaagggaccctccaaatagtaacacccgtttaccctcttcctttttttcttttcctcctggtactagggagtgaaacccagatccttgggtgtgctaggcatctgttcctgtggggttttgtttccatctatgtatgtatatttttttaaagatttatttatttattatatctaagtacactgtagctgtcctcagacactccagaagagggcgtcagatcttgttacagatggttgtgagccactatgtggttgctgggatttgaactcaggaccttcagaagagcagtcagtgctcttaaccgctgagccatctcaccagcttctatttatttttttaagatacaatttttctgtgtagctctggctgtcccagaactcattctgtagaccaacctgcctctgtagactcagagatgcctctgcatctcaagtgctgggactaatggagtgcaccaccacctgaccctgcttgtgtgtgtatgtgtgcgcgcgcccctctgtctgtctgtctgtctgtctgtttctctgtctctctgtgtgtgtttattacaaataggttgtctcctgcattttatcaagtgcttcttggcatctcttgatcccaaagtgtggtttattttattttattttatttttgagcttgtgagggagtacatgaattgatgtttactcctctacactttttacatagacaccctgctggccaagtcagctagtcatgggttttcatactatcaagaccttgatttgccttgctgggggaggttttgtccttccctcattttgttttgaaaatgctttccaaaaaaacttgtacagtttatcagtaagaccagctttgtggcacccaaacaaggctttgttccagacactccagaatcagcatgacatctaaatgtaacatttcggccccagctgatcagtgactgccaaagaaggacggtaatctaagttggtagtctgtactgttttcgtttgcaagccttgtgtggcacatgagattccagccctccatcttccctggtttcctgtaggagtggtgactggccccaggagaagaacagggcattgtttgggctactatggcagcataacaaatcacctccacagttggtagctggaaacggtaataatcattgatttttgt

SEQ ID NO: 29979 - DNA, 1128 bp, Mus musculus
agcctcctgggctgagctcgggggctaaggagctaccttcatgaaaagaggtggcaagagacagccagagccatgagaggagggataaatccacgggagaccacagcaagtgaaacagcaagaagagctgttagtgaagagtggcattcaccatgggccttctaaaaattaaaggaccccacccctcacccccagtgtagtaagccacctgtgggctccctgtgtgcagagctgggtagccctgtaataaagacagctctgtcatctggcctctaggtcgccaagatatatcactcctggagggttttgtggggagtcatgggggttatgcctgagggtttttttctggcaagaactgcagtgtgggctgagaaccccagaccctctatccagtgtttactaaggcccagagactgacagcatccagggatcctctgagttaagtgggatgagctggggcggagcaggattacagaaaagttgtgggagccccccaccccacccccaccccgagaaaactctctgagcctaactgtggtaattccagagctgaacccatgaggccagcactgcatatgttttaggtggggtctgaagcctgataggactagccctctgcctgggatatctggcccagccttggggctattcttccacacaatatcaacagcgtctcccacccagccctagaacaacttactcacagtcacataaggttggggaatgaggggactcaatgacaacgactgttgggtcttccagtcttccagctcctgtccaccagagacatatcagcccatttaccattgtgctaagtcttactaactaccctggcctagaggacctgggtctagagtcttcagaaagtctcctcacactcctcaagctccagggtgaatgtccagacagcaaggctggctagagatcagaaaatgtcaatccttgtccagggctggaatcagccagggccaggcatagaccctcaccagaaacccagtgttctcgtcataaatgagggctggaccccaagcctctatgtatcctgacatgtttgacctttgttcctgtgtcacttgtgagcaccccctctcttccaggctgagaaagaagagaaaagcagacaccttt

SEQ ID NO: 29980 - DNA, 1506 bp, Mus musculus
gcagggaactgaaactgggtcctctgcaaaacacggtaagtgttcttagcactgagccgccactttagcccacaggttaaactcttaagtcaggcatcctgccatgttggttggtggtgatatacctgtcccgactactttcccttttacaaatgattccttgtcttttcagctgtattattttgtgatattaaaattactttgtacagactaaattattgtataaaacattgtaaattgtctcaaaagacaacactgaataaaactcaacatcttcagaactagagatactgacatacctatactaggtataaaatgtaatatgttgccttttttcttccttttatttattttttatttttatttattttttaatgctgtagtgttctaagaaccaaaggatctaggctggatggaatttagcatcagaaaaagtcctctttctgttcagaaagttgtaaagtgcatgaagatgaagcagacaccagaaatccttggcagtgcaaatggaaagactcagaactgtgaagtgaatcatgaatgttctgtattcctcagcaaagctcaactttctaacagcctacaggagggggtcatgcagaaatttaatggccatgatgcgctcccctttcttccagcagagaagttgaaagatcttacttcttgtgtttttaatggagaacctggtgctcatgatactaaattgtgttttgaggcccaggaagtaaaaggaattgggacaccacccaatactacacctatcaaaaatggctctccagaaattaaactgaaaatcaccaaaacatacatgaatgggaaacctctctttgaatcttcaatttgtggtgacggtgctgctgatgtgtctcagtcagaagaaaacgaacaaaaatctgataataagactaggaggaacaggaagaggagcataaaatatgactctttactggagcagggccttgtggaagcagctttagtgtccaagatctcaagtcctgcagataaaaaggtatttgtgaaggattctgttggattatatgacaattaatggtgtgcatgagacctatgtagaatacataaatgtttgacagtaggtggaagggatgggaaacaaccctgatggtggcagttgccgtcttgccttggtcctgtgcaggtgatactgattaaggcttggctcctggttggttgttgggcttccaaatatctggacattaagtaccacagccacaagttgtgccacttgagaaggctagtgaggttaaccattcaggattaaagtggctaagaaggctttgatcccagcactcaagagacagaggtaggcagacctctgagtacaaagccagtcagggttgccaataagactgtctaaaaacaacaagaataataatttctgaatgtaggtctgtcagttttcatgaccttattaggtctactgtttttatgggttccatctctcaggtatttttaggctaactgctcagtggagatatattaatttca

SEQ ID NO: 29981 - DNA, 1223 bp, Mus musculus
ggagaaactgagcttaagagagctttgagcacttacagcacatgctcacgcataggtgcaaacacttgtttctacactaatggtagggctagggcctctgcttatgcataggaggtcaatatgttgactgaggtgtatgttctcaaagactatcagataatgtatgtggccagggtagggggcaaaatgttttgagggttctgtgaataaagcaccaacttagtaatattgagaacttgttatttgtcaggacttatgataatgctttaggtgagaatgagagaagcaattgtgagaagcgattgatattgaaggtgaaatctaaaatacgaaagggaaacattctctgaagatcaggcccttaaacatgaagacaagtgctcttccagtgaattataccccagtcctctcctacgttttgaacccttagactttttattttaaatttctgattaatacttgttcttttatagatagaagattgaatttaagggtaattactgaatgttaatatttatcttttgttgttcacttatagattccagttaagaaggagtcctgtccaaatactggcagagacagagacctcttgttaaaatacaacgttggtgatttggtgtggtccaaagtgtcaggttacccttggtggccttgcatggtttctgctgacccactccttcacaatcataccaaacttaaaggtactaaatttggactctttttttcaatcttcctcttctgcaccaaacctttctaatttgtttgtttctttcccatgctttgctaagtggtcttactagctacttttacagctttgcttaaggtgtgtgattggttcagatatgacatatccatttccgaaatacagggtttatctgattgggctggtactaacaggtgaataacttttaagaatagttttttagatttatttatgttttatgtgtgtttttcctgcatgcatgtacatcaaccacatgcatacctagtgcctgtggaggtcagaagaggtggaattgtatccttttaaactggaattacatatggttgtaagctaccatgtgggtactaagaactgaacctgggtcctctgtaagaacaagtgctctaaaccactgagccatctctctagctggggaaacactctttaccttgtatttgcctcaagttttatgacaaaaattattacttaaatattaactttgaattataaaaaatctcca

SEQ ID NO: 29982 - DNA, 1107 bp, Mus musculus
agccatgatggctagagactgttttctttatgctgcacaacatgatcaagtttttaaaaatcagctatttttaaaagcatttgtaacatttgtgaatgattggaaatttgagcatatgagtgctattttaaaatatgaaattagtaatgttttacttaatttttttagaagtatactctaggctttttatgcatgaaattatagtgtttgtgtcaaataatcctgtagtgggtcggggatccggtgtgcaggaaactgcattggcctgggttgttggttttggggcgggcaggtaggatggggatgtgggattcgttctatagtttgccttttttttaaagtcagttttccatgataaaaagttagtgacagctaaaggatctttaggactttacttgcttgagggagttattcaaaacagtaaggaggtgggaagtttaagattttaaactttataaaataaacttactttacagcaacgaaaaatttgtctgatgcttgcaaaccactgaagaagcgaaatcgggcttctgcaacagcgtcttcagcacttgggtttaacaaaagttcatctccttctgcatccttaactgagcatgaggtaaaataatgatgattgtgatacggtggcgttcatgggaaggccattatttactcaagtggcaatgtgagtgataatcctgctttaaagaattacgttgttctccacaggcataggtgaggttcaggtattcttagccatctaaaaagtgttcttagccatctaaaattcacagaattgacaaaatggtgcactattttagactgagcactttgaatatgagtacatacatgcacatggtgaatgtgtaggtgcacatgcatacatctggttgcagagtaatcgttgttgcagtctgttttaaactggtatgttctgtaaacctaactctgttttctcacatgaaaggaaattcacactggctctaccaggacatgctatcttggccacactgacatgctactgtgcacccaccctggtggaatggaggggctcatagcctgtgggaaaaccaaaggtttcttggtcctcatgcgttgcgtgtttctggttctttgttctggcat

SEQ ID NO: 29983 - DNA, 1136 bp, Mus musculus
aaaatccaagttgtcttttgctagaataaagcagaagggctttcctaacatgctttagagcttttattgcttcttactgatactgacttagaaagctttctgggttttgtatttgttttaagaaacattggttcctatgtattttagcatttttggtgatttcaattgactttgtttcttttaggtactgtttttattgttttacttagaatattaggattttttttcactaatttttctgccagtgaaggaaaatggtcatccttagtacacagaaaagtatgttttcacttttccttgttcgggaatgataagggcaatgctttttgaggtttaactaacaaggatttacttccagtaacctgacatatctcatcttgtcagagccctatgtgctatatccacatttatatatattttttctagcctatgtagttgttcagcttttaacaaataactctggcagtattttaaacatgctagcatttcaggggtattctacttaaaaacaaaacaaaactgggatcagatggcatcctagttttggtaccggggcattgccagtcacctgagctaaggaagcaggcaggctggtggttcttctgttctcaagcctttcaggtgaggacacatggcctggtgatgcagctggctggaccaggctcccccacagcctactcccaagggctggctgcttctgaggacacaactgggacatggttgagtcagtagactatttagagactcatgtaacttggggtatgggcatgcctttatgggagcagccactctctgactaagtggccactgctctcacttagactttgctgtcctctatgctaactatgtagaagctggctttagattaaatgactatgaagcacaatgacattctgtggactaaaagtttttttgtattttgatttttttcccccctttttcatgtcctcagtaactcatacctggctttgaattaggagtggctaggagggttctagtctgtgcaaacattaataaaaattattttgaattttaggattttaaaatggttgaattaatttaaaattgtcttaattctactcttaatacttcactgtgatgttaacttggaagacctgctgaagattagtctttta

SEQ ID NO: 29984 - DNA, 1173 bp, Mus musculus
gaaaataatgttggttatagaaatatttactgttcaaggtctgtaattgtattttaaaatgatgtagtattcaacttgtgaagggatttgttttgtcaaaaaaaaaaaaaaattaaaactcaatgtgtatcagcccacagaagggcaggggtctgctttgtggccacagtagggtaaaccccagttgcatttatcgagcctttctgatggccacatagctcctggcagtgggttggaagatttctactgggtcacatgatgtctggtaatgccatcttgaactccctgtaatagttggagactgcacttcctgtccctaaaggaatgtgcgtctatggcaggtaggcaactcggtcctatcacataccaagtagtgagtggagaaagtattttcagattcaagaaaactttggaaagtcaggaactaagctgcttggaaatcagtgccacaagcatgaccttggtggacacaggaagccacaggaaaattcttgacagtctgtgtcccatcagtcactgcatttttctttttccaaatacatcctgttggatactgaatagatcatagatattgtagactgagatctgggactgtgttgggaccattcaggtgatatgtcacttccacaaatggcatctccaagtaagctgtcacctggtacacatggaggtggagcctgcagctggagtgaggcgcacacttgactctacttgcaggtggtttgctgagcagagagctgagggaccctcttgactgggtaggggtcttgtccatttgtgggggaggatgtggtgaaggtggaccttctacaatctgtcatgaactgtgatattgtaaggtctatattctgtatgtggataacagacccaatcaggaaacgagccttatgtgtgtcgttaacatttatattttcattcaaaatatgtattcagtgtttatttccttaaacagactttgttaatttaggaaatatctccaagtggaaacgtgctaactttctgtaaatcttaaataaaaggtgctgttccttcctctgacccaggactggtttgtgttttctgtctttctttccattccttctcttttatagtttcaaaatttgttttatctacactaagggaagaagtgggttggtggacagaacatgggctctctcatggatgatgtgctaa

SEQ ID NO: 29985 - DNA, 1118 bp, Mus musculus
ttgggtttgtggcagttacaggctgagggacagggcctagccaggcagtggtggtgcatgcctttgatccctgtactcagcagcccaggcagaggcaggcagatgcacaggaaaaccctgcctggaaaaaacaaggaaaaaaaaggcctaatttgagctggagagacaagctcaggctggcctgttctctcttttagggggaagccttctgtgctgtgaggcctgcccagcagcctttcaccccgattgtctaaacatcgagatgcccgatggtagctggttctgcaacgattgccgggctggaaagaagctccactttcaagacatcatctgggtcaaacttggtaactacaggtatgcagtacaagccttcttgttcaaatgtgtttgttctactttatagtaataagtattgaaaattttgtcactctgaagaatatgtgaatcctgtttttaatatttataatagatggtggccggcagaagtttgccatcccaaaaatgttcccccaaatattcagaaaatgaagcacgagattggagaattccctgtatttttctttgggtctaaagattattactggacgcatcaggcacgagtgttcccatacatggagggggaccggggcagccgctaccagggggtcagagggatcggaagagtcttcaagaacggtacggagatttcccaatggagcatagatggcactctcttatggcttgttaatcctaacttctgttcttttgaaatttgctattttaaaaaattcttggactaaatattttatctctacctttatactagaaaaaaagaaggtttgtaggctgacgtatttatttaagtatacttaagcttttaacttttacagtattagcttgtagttaattttattaaatggcataataattatttatttttgttttgagacaaggtttctttgtgtactccttgctaccctagaactcattttgtagaccaggctggccttgaactcgcagagatccacttgcctctgcctcctgagtactgggattaaaggcgtgcgccaccactgcctggcataaaagctcttacacgtgttcgcgaccggccaggaagaacgcagcaaaccggaatc

SEQ ID NO: 29986 - DNA, 1088 bp, Mus musculus
agagtgtgtgtgtgtgtgtgtgtgtgtgtgtgtgtgtgtgtgtgtgtgtgttttctcaacagagcagtgaacgtggcatttgggctgctgactttttatatccaggttgtagctattagaaggtctgtcagaaactaagtctttgagtgcaatgatggttagtaggatgcatgtctccaagtgggtccttgaggggcagtatgagtgtgcagcgtccagggctctctgtttacaaagtagagccatgacatcttgcttttcccctacaggtgaataaaccttatggtaaagtccagatctacacagctgacatttctgaaatcccgaagtgcaactgtaagcccacagatgagaacccctgtggctctgattcagagtgtctgaacaggatgctaatgtttgagtgccacccgcaggtgtgtcctgcaggggaatactgccagaaccagtgtttcactaagcgccagtaccctgagaccaagatcatcaagacagatggcaaagggtggggcctggttgccaaaagggacatcagaaaagtatgtaatgtgtcgtcttcttcttgtagtgtgtagtgattcttaattgtgtgtgtactagactgtatgtggatgtgcatgtgctgtggcgcgtgtgtgtgtgtgtgtgtgtgtgtgtgtgtgtgtgtgtgtgtgtgtgtgtgtgtatgatgagaggacagtgtttgggagtcagttttctccttccagttgggtcccagggattgaactcaggtccatcctcaggcttggtggcaaggtctttacctactggatcatcccactagccctcccttccccccacaagaattaatggcccactgcttattgtgtgtgtgggggggttgttttgcatttatataaaatattttaaaatagtattcagattgaattattatagttaaaagttgtaagccaagtatgatggtacatacctggtatgtggcaaagactggcaaatgtttcttgagttcaaggccagtatagtctacgtcatgagttccaggccaggcagggctacacagtggagacaccccaccccccaaaaagaaaaaaaaaaacaacaaaagt

SEQ ID NO: 29987 - DNA, 1380 bp, Mus musculus
agcacttagtacctgcctggcctttgagcaccaattacaagcttctctctggcaacggaaatgaaaagcaggctcttgtgttaatttgtatttatttgactagccaaataaaaaagtgattttaagttaggtatgctgatatgtcccagttggcccaccaactcaaggctgaagcaggaggatggctagttataaagatcccggtcaccttgaggaacatattgagatgggtatctcttgtaagaaaaataagactatggatggatatcagctcaatgctacagcacatgcttgtggccctgggttcagtccctagtacccctcaaaaaacattcttctccaccctgaatatactgaaactttgaatctgttacttccatttgctgatagtgtgctttattgcagggaagtgggaatgtccttggcatcactgtgatgtatgtggcaaaccttctacctcattttgccacctctgccccaactcattctgtaaggaacaccaagatgggactgctttccgttccacccaggatgggcagtcctactgctgtgagcatgacttgagggcagactcttcaagtagcaccaagactgagaaaccctttccagaatcactgaagtcaaaaggaaagaggaagaaaaggcggtgctggcgaagggtcacagatggcaaatagcgcttggtcagatcctggggtggtgtggggcagccagccctgcagacagtgggaaggcaagcacggcacccaccccaaggacccagctcctagcgctgtgtataggcctgcttgggtgggaggcagctcctcccaccactgagccatcctcagcagctgcgctgcgtctgcactgatgcctgtcagctgcaggcaggcttggtgggccaggataaacaagccttactacacagcgccacctctacacttgaatctgagacccagcgtcaaggtgccctcccatttctattttagattaaagttatgattgaagattaactggcatgtgaaatgcttttatcttacctgaaacaaagaattttctaaaggtcaccattagctctgtcctgatggtgcaggcttctattcacatactgcccacctactcagggcagactgggcctccagccctgggctccttccgatcaggattggtaattcttctgtttgaaatagcctatgttctttgtattaatgtgaatttttcctcaaagtgctttgtttccactttgagtggttgtggtgttgtaagattcctctcgtggcttccctgtttgtggacatgaccagtgacagcagtgtggcctgtggagcagagcagctgcctttgttttgcctgtttttctctaatgtcttctgaaaaccttgtacattttcgtcactt

SEQ ID NO: 29988 - DNA, 1178 bp, Mus musculus
aggtcactcggccggagaaggccctcatcctgggcttcatggctggctctcgaggtacggtctgtgctaatgctaagcttgggaggtgcccctcatgggttgggggatgggttgcttggccctaggcacctgcccagcagtccctgctccctacagagaacccatgcccggagcagggggatgtgatccagatcaagctcagtgaacacacagaggatctgcccaaggcagacggccagggcagtaccaccatgctagtggacacagtgttcgagatgaactacgccacaggccagtggacacgcttcaagaagtacaagcctatgaccaatgtgtcctaagtgccatctctgctgctgaccctcatcagaccagaggacaaggtttgctggttgtgctgagtgacctgagcagataccgaaggatgtgctccacccagcacctgtgatccacaggctcctgggcccagccatttctctggagagtttaggcttattttttatattctaatgagttagttttctgtgtgattaagatacttttttttattcaatattatgttttgaatgcaaaccaaaagttacttcaaaattttagtgcctgttcgacttttaccttttttatttcttctttaaaaaaaaaaaaaaagtactggctgagagggctttctttctctctccttgtgcatgccctccctcatgaggttgaggggaccaaaggtgacagctggaaagtctagggtgtgaggggggctatgaccagccttgatgccactatttaccagggatttgtatgtcttttgtacagttgtaaacatttcaaacctgtgtctgggttcttattttcattgtaaaatgacctgagtattaaagtttagtttttctaaagaaagcccacagagctgtgtttcaggcgagcttgactccctgctctgagaccaaacccctgcatatacagctgtcagaacctgggagaggagaggcagggttggaggtaaggctacctgaaaataaaggttggtaaatgggtagagcaactgtgggcacccaggaagttgtggagtcagacacagttacatattaaataagtgtaagaaaaaggcctttaaagttttttaataaaaaaatactcattacagttttccaaacacgattttccactttaaatgctattcttcc

SEQ ID NO: 29989 - DNA, 1175 bp, Mus musculus
ctcccacacaggctgcagcaaagacttcctaagacttcctggccccctctaactctctggtaggtgtccatagctcataagctgcatgcatcattccatgtgcccagctttctaaggtttctcctatgcacactgtaacttcaagcatctatctattactagcagtggcagttgctcatggtataagctcttgtccctgtccctcctttgcaccaaagaaatgatgggttacccacttgccttggtgctccatgttactgaacctgagcccaattctgcctgccaaaagaatgcccattaaaggcacatattccgtaagtataggcatggcagccctgtttccttgaatcttatgttttgttatatctgcccaccagagagagttaggaagcataggcacagtctgaaaagccatcccagcctacagtcacggcaggggacattttaagctgtcactgttccgaaggccaagtggggctgctgacatgtacttggtgtcttctttcttggcagatgaaggcggctctgatggatatcatccagctggccacgctggactcagacccctgggtcctcatggttgctgacattctgaagtccttccctgacacgggctccttgaatctggaccttgaggaacagaaccccaatgttcaagacatcttaggagaacttagagaaaaaggtaagtagccaactttattttgcagtggcaagaaggtgctctagttttagaaattatgttgtcattattatacccttgatgtagtatgccatggctccttatacacatgactgcttcggtctgacttgccacaaccctgtccccactgcatgtgctgtgtctgcagctctgactcatcatgatttacttgaccattgctctctctccccaaaagttccttgagggtgaaaaccctacaggttatgtttcctgagcctaaaaaacattctctgtcctttagtagatactcattaaaaaataccaacaaatcagtttctagactatgagatgaaaactgtggttttagagaggtgagagtaggaatatctgtgcctctgacgctctctcccttgatggagaatgaagacctatgcctcagaaagatggagttggaggctcgaggtcacacactcctacaggcctgcttgtgaggccctaggaggtttggggg

SEQ ID NO: 29990 - DNA, 1204 bp, Mus musculus
tatcaattttcagtgccttcatcgggagcatctcccattttacagcttgtctctgaagttgaaggagtgtaaatctgtgtttcccactgttatctctttcctataaattcatggcaatatctgctacacatagtcttaattcttatctggttttttgaacctatacatttagtccattttagagttggttttatctgagacagtgtcccaatccctaggagatatatagatatctttcagagtgaccaggttagagtttaagaatcttgtgaagttattgggggtttttttggttttgttgttgttgttgttttggttttggttttgtttgtttgtttttttggtttttcgagacagggtttctctttatagccctggctgttctggaactcactttgtagatctggctggccttgaactcagaaatctgcctgcctctgcctccctagtggtgaagttattgttttatctgctccagtatctactaggccttcaatcctctccctatctaagtctaatcctgtgaattctgaggaggataaggaatttctcttcccttctttattctgatccttcttagggtgtagaagatcattactgaccatattataattagctccatgatgataactaaatgaaactgtatggggcccaggtaccctctgctgtagtggtgtccattttttttaacaggtaacattttttctgtaccagctccagcctccagttctttactctgcaaaagcctcactccttacttacttagtgccgatcagcagcaggacaatgcctaatccatctttctgtattgccttttgggattgagggctacttggccttcgtgatggcagcttgatatttaacatgataattctagagaatcatcttttggtcaggtaatacataagtatgcgttttcatctagaaagcaggtaatggaccatagaaatggcaataccaaatatcttgccagcacttagctctggggcacacctacatagccatttgatacaatatgtgcagatgcaggtcttccctacaaaaatgccttagagctggatcttatggaggcatttccttgattgaggttctgtcaggtttacataaggcacacactattccctcctcctggatttgttggatgggtgccatggccttgactgcagctagatgcaggataggatgcttgtcttacatgtacctt

SEQ ID NO: 29991 - DNA, 1953 bp, Mus musculus
tcagagtggctcatcatgccttgaagagcagcattgtggaccatctgaactatccacaaagctgcccagcctgcctccatcagggaaggactagccttgcccatcaagcacagaacctctacaacaacccccccccccccaaggagcagaaccctggcccccagccaggctaaggctcaactattggcctctggaagagtggtctgctgggctggccagccactgccccatgggaggctgagctggtcccaggccctgctttgccctgtgcatgctaaggacatggcctggctgcagcatgccgcatgccacagccccctgccccactatcctgcccagcctggacctcaggcctgagctggtgagctcccttgtcctgtcctgagctggcctctggagggcctacctgcctgaccctgtctactctctggtgaggcctggcctggcctaacctggctctatccactcctgctttgcttcgaaatcatcttacctctttccctttttggtccccgtgcctccttgctctggctgacttggctggtcacccgggtttggttcctgtagcaatccactgcacagcatggtggggatttcatgggggtgggggggacacctcccccaacacctgttagaccaggtggccacctcccagctgcctgaggtcctgtggcctcatgctgtttgtggggtctgccctgtgaatgtaactagcccaggctgttgttggcaatgcctgccacagcttctcccagcctgaaacaacccattctctaataagttacgtagacagaatagcactctgcatgactttaattactgggacaaaatggtagtttgagcctccagacacacatctgtgtggtgctagcatacgcatggtctctggccccatttgatgggggtgggtggccgggtaggtggaagatttcagtttgaagtatggaaggagactctaatttagtgtaaacacccctaaagtgccctcacaacacagtctgtgaggctcaggttgccccttgattccttgtatgcaggattgaggggactggagggtcctaaagcctcataggaagggctgggcactgcctcgggggaagaagctggtggttggggtgggtccaggtatcacccactacagactactctgctaggtcaactgttcctggcctctcctttttgaggttctacttcagatccagcctagatgggggtgggtatggcctaggacagggaaaggcagtagctggcagtggtcatgaggccagctgaaacttggacttagctttagtgcagggggtgcataaaggcccgtccacattcctctgtgtggggcttggggtgaggagtggcaggctaggtagaccatagagctgggcccctggcaccaaggctacattattagaaaggctctttagagttaatgagttggtggaacaagcccagcttcctgaggggccttttgtcctgttagcaattgaggcatttgcagaacactgtacagaccccgctctcccctgtacattcctccctggtggtgcccggtccccgcttggggatgggagttttgtagactgtacagaaattggcaccctattttcttgcagctctcagattttgttaatctggattatacagacagatgtaaagtgttttagcaaaatggaaaacaaacagttgtgccttttttctcttttctgtttggattggtctcggctcggggctagtcttagttgttgtgggggtatagggactgctggtgtctgaggcctgtggggtcagagactgctggtgggtctgaggcctgggtaggcctaagtgggagccaggtctactggacaccaccagctgccaagacttctctgatcctgtgcctttggggcctgcagtctggggttggaaggtgtggcagggcactgggatcacttgggccagggctgagcttggggatcc

SEQ ID NO: 29992 - DNA, 1213 bp, Mus musculus
tagttactacaacagaaacattttgaaataacaagtctggtaaatctgtgtgctataatcagctcatggactaagaaaatactatataattttaagaaaattaaaatattcatttgttataatgagtagtatacttattaaagttatgataacgatgagatcttctagtttgttagccattattgtttgtttgtatgtatgtatgtatgtgtgtgtgtgtgtgtatatatatatatatatatatatatatagtgtactgaaattcagtagttcatgctggcctttctcttgacttagtccttattttcctttaaagttagttttggcttataccaataagttagtttttattcattgcatatattatctgaccatctaaaacaaacaatgaaaatagttagaaaataaaagtttaaacctacattttaaaatgttactgctttctttgtgtaggttattgataaagaaaatttggatgcagaaatttctagcttaaacagtgagattctaaaacttgaagaacaaatcactcatataaaagacaaagttttgcctgctgtggtaaaagaatatgctcagctattgaacatgccagttgtaaagggcgattttgaactgcagattgctaaacaagattattatacggcaagacaagagttagtgttaaatgagttgataaaacagaaggcatcttttgagcttgtccagttatcatatgagattgagttgagaaaacattgggatacatatcggcaactagagagtttggttcaacaactcagtcaaagaaacacggtgctctgccagcacttggcagtgttatcagacataccagcatctgagcagttaacctcaaggactcccatcgacaccaaagatcattccactcataggtatgtatgtcattgcttccttagcatttttttcttttatttttgtgaaatactagagagttggaacagaaattttaaaggtttaaaaattacttgtattcagatttggcctttctgcttttcttttttcttttatcctttaagttttttgttccctttctgttcatgttaggtctgaatgtagccactttagagctgaagtcaatgagttgagggagtaaagtgataaaatagtttactcccacttagatacctagatttgggttaggaaatttaaatacagctttgtatcataggtattgctgggcatgatactgatt

SEQ ID NO: 29993 - DNA, 1115 bp, Mus musculus
tcacctagccaagcgtctcagccttccaatcctcccttgactgaagccagcctcgtcatgggcctactgctgtgccattctcgaagctacagctgctgtctggtctgcctgcctctgcctgcctacccttcggtcaggactcaagttgcctgccccttctccgcagggctagaccccatgcagggaagcagtgtcaggctcttacatcctggagtccagcgtagccacccacaatctgttctcagattcctaatcattccagaagtattaaatatcatttctacaaatctcggcaggatccgtgtaggggccttaatgaccaccatagggagcttgaaccccaacatcggatcccaagagaaaggagtggactgaagaagaaaggaaggaaggaaagaagggagggagggagggaagggaaggagggagggagggagggagggaggaaggaaggaaggaaggaaggaaggaaggaaggaaggaaggaaggaaggaaagagctgctgtctgtctatccatctatccatctacttgttggtccacatagtgtggacagagggatctgtgaggggcaggacttggatgagcatctagtgggtggcccccttttccatggtgtcagcagccatggggatgctcctggggtctggctggaccacctcaaaccaagttgggtggcttctgctcttttaggaccatcagacgtatgcacacacgcctaggctcacacccacaagcacaaatacacatggacatcagagaatgtatgtgttgagatagttggtctgaggtcacttggaaatggtggcccctaacctgtgcctgactctcactcaggccctggatcacctgggccagtccagacagctctgcctggtctgcacaggaaatagacagggcttttcttcctggcagaggactggaataagctgggtggcaagctgaaaccactgggtcctccaagctttctcaacttcctttcttaagaaaagaaaaaaaaaaaaaagaaaaaaaaaaagtgcgacagggagctcccagaaggggcctcgcgaaccctgcccagggcagcctcagctggcagaggctttacccaaaacacaaaacagaaacatttt

SEQ ID NO: 29994 - DNA, 1217 bp, Mus musculus
taagatcccatgccgtcttctggtgtgtctgaagacagctacagtgctaacaaccatgtggttgctgggaattgaactcatgacctctggaagagcagttactgttcttaaccatacagccatctctccagccccgtgatccatagtttaagaagctatgtaaagaaggatgtgtaaaggtcttttgcttacagagcacacatttcaagattgcacatatgatccaaacttagaatacgtgttttgaaacaaaagtttcttatgagatgtaaaaatagcattctgacttgggcaaagtgacacagacctttaatcctagctctttgctccctgtgctccggaagtgtcacagattttgtggtgatagagtgcacatcctctgggtgagcgtttgtgcttgcatgcacacgcaggcacagacaagtatgacgacaaccaagttgaaccattacccaacctgtgtacttttttactcttgaaaccctgtcaaatctggaactcatacaaccccttctttctcccttgatgaccttagagaaatcctcaaagaaagcggcgtggtggaactgtgaattctagacaaacccagaagcgaactcgggaaacaacttcgacccctgaggtttccttggaaacagaacccatagaacttgtggaaactggtaagagagctagaaatacttgactgtaatgttgacaagtggacatagtgcagtattttatgcttgtgaattggatccagtttatgcatattaatttgccaacttgaggccttagagaaagttacaccttttttcttcccaatttatgtatatgagcattgggcttctgtgtatgtctgtgccccacatgtgtacctggtgcctacagaggtcagaagatgattgtattccctggaactgtagttacagatggttgtgagttgccccgtgggtgctgggaactgaacttgagtcttttacaagagcagcaagtattttgtagcccctgaactgtctctctagccccaggccacaccttcctgaggctgtcttcctgttttagggaatgatgttagtataaagggcaagttgaatttgtgccgtaatgcccttgggaccatgtatggcaagcagattgtaccctacaaatgttaagtgttggaagttcttgtactttatattttatatgcacgtgtaatcttaaaacttactattcacagcttacagcaacaatga

SEQ ID NO: 29995 - DNA, 2745 bp, Mus musculus
tgtgtcaaagtggattgtgccagttggtggtgggccctgtacattttatctttaacccttgtgcaaatcgatgttttccaacccagccctatctagaagctgctgatttttttctgaggttccccatagccactttgtactgctgcacctggggaagtcctgtctgtcacctgtcacacagacagcgttcaaaactcttgagtgtactgctttttctgatacaacccaggcccttctttgtttcacttgtctctttggtgatgggtgggttcgggtctttgtagaaaaagggatactttaaggctgttcttttaatgtcttctagattgtgcagaatgggcgtctcattgtttctacagaatgtggccacgtcttctgtagccagtgcctccgtgattcccttaagaatgctaacacttgcccaacttgtaggaaaaagatcaaccataagcggtaccaccccatttatatatgaaatgttcacaactgctcaggatagaccaatggacagacagccaggctggccttttctgcatggtatctgcctccagtttcctgagctcaaaaagactttcaaaaatcaatgtctgatgtaaactggtcttttgttttccaaccccttagatccttttgttatctcgtttgatgctatggagcacggtccagggatcctcctagatcagctcagcatcactgcccctttgggtggtctgagcccagagtagggaaaaaaggagtcgggcatattggggttgagcatcatggctccagcctctttatggagcttacatgttggccaagtagtttccctgttgggaaagtttgccccagctcttgtgtgtgcagaaccttcccaaggcacctgtcagttagctgttctgcctgccagacagtgacctggccagacagcccaaatagcccaaggataccagtgcatgagctgcccacgaaaagccacgaaaaggtggacttttagtttccttcccacgagagcagaggtgacctatgattccgcctgaaactcatcattggtgtgcagtgttttctgcaaatccagtgactctgcaggacgatcctgttccctaagaatgagaaagtgcaataaaacccgttcttcacctgctcttcagcaatctggaagctgtagcactgctggtatcctcagcccagtgtcgcctatgggagcagtgctcatcccaccccatgtctgttcaccagctgttctcaggaaccctacccatgctccaaagttcttttactggcacagaacattgaaggctaataggacaagtgtttgagtgtcctctctttaatgctaagatgggtcctgtgttgtctacagtgccctccaaccctcagtttttcagttcccactgcctaatgtctgctcaagcatagtataataggaggtggtagcagtagcaatggccttatcagctgttcacttacatgcttttgcccaagtcaccgttgcccatttgtcagaggtgttgccctactcaacctccactgccctagcttttcccacaccccttgaatagataggtatttccaaagctgcttgctcttctagccagttgagctttgatcctctggacttttgactgctcagtgggttttggtcagcaaagcatggtgcctcttccagtgggaccacataacaatgtctgctccaccgtatatgtgtgggagactctggtgctcacggagacaggtggaaaattgcccctggggacaccaggcacagggcggcttgtagaggataggccttgaatgccagcctgcctccacctccacactacttcctcagagggcttcaagccaaaccaatagcctttttgtgtgaaacatctttgaggtgggaaagggaccactggagctttgctagcaataactgactttcagtgtaatgttctgaaggagcagggactcagcacagaattcactttaaatggagctgaaggagtggccctcctctatgtgaaaagaaaatagttttattcttcattctgactttctagctgtttgacttcagttagtttgaatgagagtaataggttttttttttctacatggactcagagggtaagagcattagctctcatcattgtgatgtgtgtgctctcctctcccccttggatgtcacagccattgatttctttgtgggcctcatggacttggtcttgttagtctaatgaaagccagacttcaaagagacaaggcaaccatgcagccagttcaccagtaaatgtggtaacacccacttaaaaatttgttttctcctcaaggacggtgtatgaagttgatcataaaagttctattactttatcctaaattaaattgagaaaaagatgtgttcttctaatcagacactgcattaatagggaaagattggtatagaaaagattttctttcctttttacttaatgtatatagtttaactcttttctttgttacatttaaactatgctcatgggtatcagtctgttttggactagtattaaagatggaaataaaacaatttgaactaagtatctttcatttattcagttattctttggaaccttttagctaaggtgtgtgctgttcattcagtgtgacttgtactgtgtgtgggttggagaatttcagctcatccaaatggtagcatagaaccacatctcaggcctggcaatgtccagtaacaagaaaaactagaatagtttactctgagaagtgttgctggctggaaatgaaagttccaga

SEQ ID NO: 29996 - DNA, 1186 bp, Mus musculus
ttatgcctgggaatttgggtcttgggtatgcagctgccatatccaagagattgttttctggagtttaggccatggatggccctcttcagagatactgctgccttggtgcaagaccttgtgtgctgatgcatctggtatgatgtttcatgcctatttgagatctgaagatccatgctgatgagttttcctggacaaagtaatacaaaagtctaggtgaagggggaagtgcttctttatgatattcttattttatttaaaatatccagtttttagagtatgaggttcagcttcatatgtttttagttactatttttctatataaatatacatatgtataatatatatatatatttttaacaatcttggcttcctggctcaggttttgaacatagaattttttttctattccagactccttttagttttggcatgaatcataggacaccaccctaccccgctggggattattgtcttctatgcagaagtgaacgaaaagactcttcattcttagagagtggagttaagactgcgagcaaattggccctttccatggctcccaagggcaacagcgtgctgcacctgccgctgtgggtatgcccagactgccggaggactgtggagaaggaagagaggcacagcggtcttgaccagccggtgagtggctgcagcttcagtgggcttcttgcttctctcttgtgggtggtgggctaactggcaatgaaaggatttccgtctgtcatcagaatgcttccttccacactatcttttgacccgtgccaacagggatgtctctcctggcctttgctggccacaccagcagtaggtggagactatctgcttccttatctgcacagtcagcaacttggccactagtttgttacattctgacttttccatctgacatcagggtttctttaatgataaagtttcctgaaaagttagtaaggcattcatgtgtttagttctagacaatcctgtgtactggtaaatatctgaaaattatttctgtagcacattttggaagcctgaccttccgcacccctgattccaggccttcccttactggagactattattaggcttgatctaatctttgacatagtttaaatcttagtggccactgttccctttaggctttcttatctctttattggtattctatgagatggctttttcaaccattccc

SEQ ID NO: 29997 - DNA, 1111 bp, Mus musculus
cagttggtatgcagggaaatgtctccgcagttctggtctcatcttctcagtctgtctgaggtggccagtggctgttcatcctcttcattgtcagcccagagtcatgctcgttccatgtcttgctaagaattcagatcactttagcaagcaattgaaagtttgtgttttctgtactcccacattataaagaagtgcatttcatattagcaaaggggctgaaaactcagttgtgaccctgttgcttgcagaggcttcatacactaatttgcacatgtgtataactttttttcttcctttcctgtcctttccttaccttctttttttctctccttccttccttccttccttccttccttccttccttccttccttccttccttccttccttccttccttcctctttttttctcttcctttttgtttgtttttttcaagacaggatttttctaagttattctggctgtcctagaactcactctgtagactagactaacctcaaactagagatccacctgtctctgtcttctgagtgcatattccaccacattgggctgtgtgaagtttctcttcccctccccccttcatccaaatgttgccccgtcccttccagtctccccctgtattctgtttcttaagtgaagtcagttgaatatgcaaccatcactagtcctttgtaggtgctcatgagggattgctgactgtatctggctgcacttgatcctcagagtcttccaacaatagagatgctcatcacacatttcagttggatttgtcatggtgctgcttaggttttcctctttcagagttattcctagtctttcaggtctcaatttttatggtactggggatagaattcagggattcatacatgctgaacaactattttaccactgagtcttttccccaactccaaatctaaaataattctaaaggccttgggttgaagtccatggttgactcttcattcggcagagttctgctgcttctgctctcaggccttaggcattttaaggagttttgtctcctagctattgtagcttctaactgaggcatatggaagtttaccagacagatgaatccattgaaaattgaagttagataaatgcaaatg

SEQ ID NO: 29998 - DNA, 1102 bp, Mus musculus
gattacatttgagattggaactccaggcctgtgaacactggtgtgcacagtggaaaaacacagattatctataaaactctccagtctcaagagctcaagctagaacacagcttactctagatggcaggaccagatctagtgtgtgtagaaaacaaagtaaatgtgaccagtcatatgggtggccttcaaagtttctccaggtgtgaacacccccagtccccccccccaaattaaaagaaagcggggggggggggagtaattaaaggcaacaaaaatgtttgttttcttcagccaatggcagtctctcttgtatctctacatgtaggtgatgtttttcatggcctcaacaaagaggatcacagacattcagcacctgctgctccaaggaacagccccacaggcctagcccccctcccagccttgtctccttctgcgctctctccagcctctacacctcaccttccaaaccttgctgccccatcatttcccaaaactgcaaccacggcccctgggttcgtggatacacgcaagagcttctgtcctacccctgtggcacccccgccctccacaacagatggctccataagtgcccctcccagtgtctgcaggtgagccacagaacccaggtccctgagtggagggttgggagccatgctgcactaacatagctacagactgtgctctgggtccaggcaggtaaccagtccagtgcagaagaaagagacctcaccaacagaggccaaggccgtggagttggagaggctccagtctcactctcagcctctagttcttcagaggaaagaacaatggcccgactgccaagaccagggtcagggatgctgactatctccactggtggcattaagggtgtgctgtgccttgcttgtatttttttttttttaattgtatctgctatacattgggtagaatctgcagaaattttccaagatgtacatactaaaactaataccacacacagtgatttttataaaagatcatttctgttacctttgaacttgcctgttagaaacatgtcctttgtaatctccattgtggaaccagtggtctcaaggaagtcagaagagtcctgtgtccatccagt

SEQ ID NO: 29999 - DNA, 1093 bp, Mus musculus
aaaccacagaggtacagctcaaaccccgggcccagccagagttgaaacctaaagtagttgaccttgctcttctcacagagcagaagagggaggagaggaaaaccaacagcaacaacaacaacaaaaagcagctgagccacatcaaagaggagaagctgagcactgtcactcctgagccaccctcccccagccagctcctgcagaatggcaggctgattctggccagttctcctcagcccaagggcaagaataagaaaaataaaaagaagaaaggagacagaaccagcagttcacttggtaaataaagatcacaagggaactgttcccagccttggctggtgtggtctgtgtgtgtgagttctcgacaggcccctgcaggcgggatgttgctcatctgtgacttttccaacaataataatttgtagctgctatattatgattttgaaataattttagacatataaagtgcactttttttttaaaaaatttgatttgtggttagttgaaaacataggtacagaactggagagggtaaggagagtggctgctgtaacatccctcctatcctgggtcatctttgggtgaggttatgttcacctgtttctaataccgttgtgttgattgttcctatctcataattagtaagtttccatgtctgtgtcacagtgagtttccatgatatccagtgcatgacttgtgttctcagacatccttgattactaagaacttgttccgatagtgacttacacaggtctagaacattcttgaagtagttgcaaaggtttttgtcttatactctagagaagtctgaacttcctgttttgtacataaaggtgacatgctgcttactggcttactcctcatggcttactgaacttgctttcttacagtctccaagaccactatcccaaaggtagtaccacccatgcagtgaacttgaccctcccacaacaataagcaatcaagaaaatgcactacaggcttacccataggccagtctgatgggatcattttctccacagtgagattccctcttccaaaaattactctagcctatatcaagctgatataaaactatccaacagaccttttg

SEQ ID NO: 30000 - DNA, 1213 bp, Mus musculus
tgtgcatggtttttttcttccttttaccaggtagcatatttgcagcttgagtttctaggtgggtaggcctattgttgctcatttttaggtcgtgtcccacccacccgcctctccccgccccccatcatggttagtgtgtgggcatttctttctctggaaatgttcagatctccacttataacctaacatagagctttctactattagaacagaatacttgagataatcagtgtctaaagagggaaggcttgttttgctctcagttcttaagattttagtctctagtcagccccattgctttgggctttgggtgaagcaacacataatgacagaagaagtcagttcaccttaaaatgactgggaggcaagagatgagggcgcggccgcaaattgccactcttccttcaagaatgtcccccagtgacttaacttcttccctaaagtccccactggggaactcttcccatagtcccttgacctttgtgggacccctgcagtcctaactattgtgtgtcagcttttgtgaaggtctcatgtgaacttaaggtacagatgtatgtctgccttctgttatttgtgatacataaattacttttactgaaagtactttgtcactaagatgcatctccatttttttggcgggaggcaaggtggaatgggatggataaaaacgttgtccaggctagcagtcctcctgcctgcctgccctcctgagtaactagaattacaggatgcactaccacataactccaaggttagcacagaatatataatggggccctgtcagagttgggagtcagaggaaaaaagaaaggttttctttggtgagttaaagccattcacattgttataataactttatagttggccttagtgttatcactatcttgataattactttgagtgtcttgtctgtattggttttttctttgtggtattttgttcaatgcttttatttctaaacatatttggtacttaggaaaaattgaggttttgaacacatatgtatgtcttaatttttttttctgttgctataataaacacctgggataaacttgacaaaaagatttagtttctctcacagttctagagaatgagaagtgcaagacccaacagcacttatctgttgtaggccttgtgctacttccagagagagcagaaaagtcccaagaaaaccagatgtgttcttaggaagatgggataatggcccact

SEQ ID NO: 30001 - DNA, 1196 bp, Mus musculus
ctcctacagtaaatgctgcttttcttatactttcctggctgtctcctaatcacagtatcaaacgacaccagaagatacacaagccacttaacttggccagtatcctgaaggtgggaccactcttccaagcatggagacttttgagctcaaacctcactgagcctccatagtgaattgctagcaagaatcataggttggctcggtggttgccaatctgggttaagactctgtcctgtgacaatttgcctttttgttttggcagattctgcttggactctgcaagacagaaccgacaaagactatccatcaactggtccaactttagcttgaagaaagccacctttgctgcccactgaatgaggactgcctggagagggatgtgtgggaggcagctgggctgcgccactcaagagccaagcccctcactggctcccctaagcttcagtacccacccagggtgtgtagggcgggatgctgtggcctgataccccgagaccgagaacttgctgctcgacctgcgttgttagcttgtgtgcgtgtagtctgtgagtgagacttctttgattgtagctctgtgctgtcggaatggaacagtagttcccgccaattcctccaccaccacggcctcagaggcctgggccgtggccagagacgagtttgcatcatccacgtggctctgtcacctctgcatctcgacctgtcctgtcatctgtccccgccagggtgtcagtcatccctcagctcccatgtgccctgtgtcccacccaaggcgggctgggcgggcaggcctcctttgtcctctttcacaatctactgtttctgagtgtacacgttgcgctgtttgtgtttgaccccctgacttgtagccagcttgtgtaagaccccttgcagaatgagaacgttaaaaacaagaaacccacccagtactcacaccatcaagtctgttctagagcgtacaaccgtattaacacggaggcctgcctggctacttttttaacatattgttaagtaatattaaaatcatgtctttctttttgaaagatggaatacattagtacagcaggagacccagtctggttgctttctgctggggatgatgggtgtggtgggaggtatcaaatgggtgatatttgttcccagggagccacggccaccaaccccaaaggtgttcctaggtctccaggttcctggttccc

SEQ ID NO: 30002 - DNA, 1205 bp, Mus musculus
tgtccaagtttgtatcactgtaaccttccccttgaagatctcaaagtagcctcagaaggctactgggtgggtgctggcttatggcgcagaggcatgtcatgtcagtatcatttctcagccttggacttggctgattcatctggggcttctcagcagtctgggttaggacatgtacttcctgtcattcaaggggatttcttaaaaccagtgtctgtgcgttaccagtccctctgtagtgttgaatgtctgggatttctgagatatcgagtatactccagaaaagtttatgctgctttccctttgggtcagccaactgctattaggggttagtttggggtgtggcttctgggattgaatgccctggttctgaccctgtgtgaagcacaagttaggttgcctcatccagaaagttctcttgtctataggcaggatttctgtcttggtgactctgcaggaggtaagatggatctgtggccaggcctacaccaaggacctgaaaaagcctcctggatgctgggtatgtgtctgctagagtaacactatgttgctgtcttccctattgcctgtgatgataaataagttctggtgctgtgaaggttttactacagctcatgtacttatccctgtagacttgatgacaattgaatgtttagtccagatttaaaatacagacagctcatgttggtaggtaagaaggaacaaggacagtatcaagagtgataaacctcgagaccctccgccaaggctgtgtcctggcctcagctggcagtgggtagggtaggagctggatctgcaaagtttatttgtttgttttttgatatctgttttgcttcttcactaagtgaacagtcatcacctcctacagtgcagctgcagtgacggtctgtgacctcagcctctggctccagcttcctctctatttctgtatgttatactcacacagtggcatggcttccctttgtctcttccttatgtagctagagcaaacaagcagcgatgcttctggccagagtgttattaagaagttacaggaagaaaatcgactgttaaaacagaaggtgactcatgtgagtatctaacatctcattgaagaggaacattaaccctgacaaatggtaaatggaggcttttttttttttaaagctggtgtctagaggtgacttctgcccccctggctgctttaacttgattcacagtctccagag

SEQ ID NO: 30003 - DNA, 1158 bp, Mus musculus
gggtctgaggctgtccaacctcattacagaggaggggtggtagacaagggcactgacagagaccaccactgaagaaatctgctctgaaatccttctttcatttaatgtctgaattctgtgtgtaataccttttgctttagactaagttggatattttaagtgttttctgttaaaacatgtaaacatgttacgcttacaattagaattgtatattgttatcttttgagaaagggttgcactccatagctctggctgacttggaacttgctatataggtcaggctggcctcaagaaaaaaagaataaaaatggaaaaaaatcaatataaaatgaacaaaatacaaaaaaataactttatctttacagaaatatggactattttatagcatgaaacttgtccacctattagtaaccaggaaatcaagtctccccattgtctcctctccccttccactccctttcactccctctataaacactgtacccaagcttagcagatgtgtaccatgcttatgtctccttcctgagcctctctctctctcttgctgtgtctgtctctgtctctctctctctctcttagacagtcttacctagggggctcctagacttaggatcattctattttagcttcctgagtgctgagatcacaggcatgtttcagcatgccttccttgtagaagcatacttaagtctatctgaaaaccctttcttatcaaaatgagatctctttttttcttttcctttatttttttaactggggaagatctcttcttttttactgccatattcctgctgttttgatatacgctgggtatattgttcctttctgtgctgaatgagttggagagagagaaagagagagagagagagagagagagagatacatacatacactgtgaatgatgcagagaaaccagaaggttatgatattttggtatcgggactttcagaactgtatcaaacattgaggaaagattgtactcatatgtgaatgttcttctgtcttcccattgttctccaggtttgtgtattatcagaaatttctatctattatatgtgtgtgtgcctgcttgtctgtgtgtacaccatatgtgtgcaggtatccacagagtccaaactggggttggagctcctgaaactagagttagaggttgttggg

SEQ ID NO: 30004 - DNA, 1185 bp, Mus musculus
atcatattttattatggtttagcctactaactataaactggtagttcgttaagactttttagtaagacagcactcagatacacatgaagacagccattttgactgctatgaaaaacatttgagctttagaacaataaacaacattctcaccagattatcgagcatccgcataagagcttcaaattcctgctccccaatctgccacttgggaggtgatccagagccttcccctgctggagtccctggagaacgggatttggctttgtacttcccaggatccagcagaactaagttgtctggtcctccagcacttgccagagtccgaaccttttcaaaaaagaacaaacaatctggcttgattccacagagataaagagaagcagatgagcgcagagaatgcagagcagtgcagcgctccacagaaagcagtgaagcacatggagcattttcagagatttcctttgcaatgacaaaatatggacagtagtaagaaatgggaacgttcccttattccatgacaaatgtcaggactgaaggcagggccagcagggactggaggccaagtagagcagtatgaggaatactgacactgagaagcaaaacacctctaggtttctgctctagctttttcaaaggatagtgactgtcagatgcagtaatagagagagaatatgcacaaagctatagcacacaccaaacctccataagtaatgcatgcatgtgtgcatgaaaaattagaaatgaaaatcccagcaatctttcctaagttccaaaccacgagctcaccatggctaaaggactgctcaaagcttcactcttgcaagacaagtattagaaaacccacaggaacaccagagacatccataaaccattagctaaatggaatggcctacctggatctcacatgcaaccacaaggttatggatgtaatagaaggcctcctccacgctctctccaactgacacgagtccgtgattccgcagaatgaggacctaagggaaggcacgggagctgtgtaacaaggcaccaagacttagccttccaggctctacaactgaataccacaagatgacactcaccttgcttttagggcccagatttttctgaatcaaaattttttcctcttcatcaaccagaatgccatgatagtcatgataagcaacatctccaagggaaagtgcctcc

SEQ ID NO: 30005 - DNA, 1936 bp, Mus musculus
caccttcaagccgacgccccctgacctctcccctgatgagccttcagaagcacttgccttcccagcagtggaggaggaagcccatgcttccccagaccccactcagccccctgctgaggctgaccctgagccagcctcagccccaactccaggagctgaagaggtagcctcccctgccacggaggaggggtctcccatggaccctggcagtgatgggtctccaggcaagtccccatccaaaaagaagaagaagttccgtaccccgtccttcctgaagaagagcaagaagaagagtgactcctgaaggcccaccctgcatactctcatgtctacaggcctggctctgtcaggattccctcttcttgtcttgtgttctatcctcctgtgtaatggaatgcaaacaaccaaaacctccatgtaactagagccccctcccatgtatagtcagcccctgcaccagtgctaacccagtgtgtgctcagcctccctaccctgggccttgggttctgtggggagctgggcttagcctgcacctgtgagttgtgcccccctgcaggagggggacactgatcctggtcctggctggaaggcattggaggcttctgccagctctggttacagcgtcaccctcctgagccttgcctctcactctcctttctgtcgtgagtatcgaattgtctgctcagtttccctccactctgtggagtctcaggtggctgatttggactcggcttttgctggcatcctctgcttggtgatgtcagttatcccatacacaggtatccacataccccagccatggtctgagaaaacactctcatgtccatcagcggcccagggcactgtggctgccttaaagaaatgggttgcagctgctgcgctagcagtgagcaaccctgtgtatacccagcacaacgctatgcatggtctaactggtgaccctatgaccaaaaccacattcaggcgctcatagttgatcttactggggtcttggattcccatcttagggaacagataccaggagggtgaagagtccgttctaaaactttctttcagcaggtttgcaatttagcttacattttaactgtgaatttgaataggccactctttgcgttagtttttgttgtagagcctgtgacagactgcagcagaacactcttgacttgtgtggggaggttttacataaagggtaactcatggtagaagccagccttggaggtaccatctaatgtgttgcatcattcatagagcccatgacctcttgatccatcctttatgaatttttacttaactttcatccctggaaaagggcttagtggggagcgccgagtgtcaggtggaatcctaatggggccttgttcaggagctgccactgccagcctggctagagtgaggaagcctgctggagccctgctggagccctcgacacccctgctgcagttgggcctgcagagcaggtgctcaggtgtggacagagccctgtgatcctcccatggggcaccaagcagggccccacagcctcttgcactgctagtctcaccagtcaccacggtggcctgagctcttacctggtccccagtcccctcatccggactcttcctcatccttccttttggcccttcctttatcccacatatgcaatgactcttctcacttttgtagtctaattctttgtattacacatgaaatatcgttgcatatatggacagacttggaggacaggtcctgtgtgtcctctcctcattgtaacaggttttactcacaaataaaagtctttaagcagtttccttgtctaaggttgggggcaactttgcatttttatgcctttgttcccttagtttatttagctgtgcataggtctgaggtacgcatgtctgttctatgttgtgtgcatgtatgtcagaggaaaagctgagcagtatgttttctaccatat

SEQ ID NO: 30006 - DNA, 1191 bp, Mus musculus
gggtgcttcctggcctgaagtgaccgatcctgccacttggcctccacccattggcagacaggtttggccatctcctatgcagtgtgggctacctctcggagctttaaggccttcttggcctccagggtgatcggaggcatcagcaaggggaacgttaacctctccacagccattgtcgctgacctgggctcacctccaacccgcagccaaggcatggtgagtgaacagacctagggaacggggattgatgtctgggcttcagactccatgcctagctcaggtcttttccctaggcagtcatcggggtagccttctccttggcctttactctgggtcccatgctgggagcattcctgtctgtggaaatggtgccctggatcagcctactttttgccatctccgacatgttgttcatcttctgtttcttgccagagacactgccccaggaaaagcgggtaggcccgggtccccggaggggtgagggctcctgagggttggaaggggtttcctttcttatctgtaccattggcaggggagactggcctgccctcaagctgctaacatcacaacacctcttgggtttctgggatctgacaggtcctggtccctaagctgccaggctgtgtgctcccagcctcctggccagccctcgctttctcccacaggcatcttctgtcaccctgggcttccacactgctgcccacctgctcagccccctggccctgcttcgctttgcggctgtcactcacagtcaggacccgcctgctgagcacagtaaggaggcttaccccggactgagctctcagagtcttgaccaaccagcatgaacaacgatcaacctgtggtctgtgttgacttgcaggactcagaaacttacgccgtttgggtcttgtctacttcctctacctcttcctgttctcaggcctggagtacacactcagcttcctggcacatcagcgcttccagttcagcaggtaggtctccatattagtggcttcgaggttctcagaccccaggtccaggaagcctttgtggtacccctcccagcactctggctggtggccttgcccatcccccaggcagttggtggcctagggggctgggcgctcaccctccacctcctagcctgcagcagggcaagatgtttttcttcatcggcctcaccatggccaccatacagggcacctacgc

SEQ ID NO: 30007 - DNA, 1208 bp, Mus musculus
gaatggccctgtgttggttgtcggagtcttactaagttcttcctcaagtgtagtgcattgtgatctgtccttgtttcctgttagtagttacttccttttcttagatacgtttccattgtttggctattgcttttgtttatctttcagcaggtggatgaggagcgcttgctagatttccattctagcattgctgcagtgagcttcttatgaggatgggaggtgtgggagcctgtgcttctgaagatgataaagggacccacgatgctgccgtgctgctctgcactcttcttattgtctttatttatataattgacactcgagtgttgggcatgtttgttctgattggaggaagatagcttggacattcagatacaataggaattctgtatatcacttgcattcccaatacatttatgggaggaagttatgtgcttgtgttaggcaaattttggtgggtgaccagcagtttacgtgaccggtcagaaaaagtctctttctgggaagacataagctacttttttttcacatgtctgacttttctgagtgtcgtgtgaggaagctcttagtagacctcatctgtcgtcatcccttcctcatgctgccctcttcccagcatggagtttatgattcactagtagtagccaaaacgtacttaggaatgaatgaaatatagaaacaaacgaagtagtcacctcagtggatgctcatttcttttcctcttgtttttttgtagaaagaaggaactctcagccaccaagaaagaccgtgtgaatcattgtctaacaatatgtgaaaacattgtggcacagtctctcaggtaattggctttttaaaaaaaagatttatatatttatgtatatgagtattctgcttgcatgcatgcctccatgacagaagagggcatcagatccctttatagatgggttgctgggtagccagtgctgagccatctccccagcctcttcttttctttttgtttttggttatttttgttgttgtttttctttttttgtttaaaagatctctctggtaattactgagttgggtggtggtggatatacctgtaacctggcattcaggaggcagaggcaggcagatcttggtgagttcagggatagcctggactacagagccagtaccaggacctacacaaagaaacctttaactcataaaaaacagaaaacaaagaagaagaagaagaagaagaa

SEQ ID NO: 30008 - DNA, 1194 bp, Mus musculus
catgcctataaagttgcaggcttccactcacagaggcaccagtctagggaggatgttttagtacagcagcacttctgcagaaaagtcttaggccagattatcactgtatttgtctagtgctttttccttattattgtcaagttttttaaaaactttatatagtgttcttactacctctgttctggtataccacgagtagcctatagacactgagactgacacagtgaacaagttcctgatgaatgtgtgtgtgtgtatttcttattcatgtgggttctgaggatggaacttaggccatcaaccttggctacaaattcctttatcatttgacctagcacacagccttcctaatgcgattaataaggaagtaaatatactgctaataaatacttggtgactattgaaaatttggtattttttgctccatctatgaaaaatgtgtcatcttgtcacagtttttgtcctataagttttagaattctgtgaaatgtgtaataagctccatgggagcttcagttttcatcatcttggttttgtttgttctcaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtaagagagaaagggcctgctggcccagtcttagcatctgctcaatcttctaaactacactgacccttgccatcatgattagaccatttgcagctgctgactgctaaatgtgaagtgtgtaggggatgttgcaagcccataaatggtctcggagacttttcagctgcggctgtgtctctaggacacccagctggtacacaacctcatccaccttcctgtccttctgtatcagaggcctgaggctatgcttcagcacgctgtgggtactctagggaaactgacattcccctaccccctctctcctgtcaaaatcaacatgaacaagtcttgctggaatgagcatatggacatttgatacaactctctgaattccacatggacatttgatacaactctctgaattccacatacagttccactccctataaggtcctgccaagctaaggatatattttatgctgcaaggctgcttttgatctgagtgtgcacagcctgtgtttctcag

SEQ ID NO: 30009 - DNA, 1116 bp, Mus musculus
atggcttgccacagtatatacattgaggagccatatttattatagctacacattagagacagtctgcctgggaaatactattgtgaccttgtgcgcttaaaaatttgcctggactatgagcagaaactgttttactgctgtccttgttaaagaatttttatttttgtggaaagtatgtcatacaccctggtaactgtttccaatgaaagcttatgtctggcctatgcttgtccaataatgtgagatcttacagttttaatttggcttttaaagagcagtttatatgagcttttttgacattctagtcatatctttaaaactgtgtatttgaacatgagtgtaattttcacctttaaagtgtgacactgtggtgtttaaacatgtcctatggaaatatgtccacattgtctgttttaggatttgagttaagctttttgaggatttttgaatttcttgcagattttagcagcttgtaatcttactttcttgttactttctatgatttacagctggagggggttcctcgtgcagccctgtcctctcaagaaagcagaaaggtgattatctcaaaatctgagtcttgtgttgagttgaactgctgtttctgtgtttgcataatgcactagattctgcttatatttcctctcaggagatgaagtgtatggatattgctggaatctgacattttctgctgtttaaaaattgtttatatcacattatgtctaatgttcgaggtcaaaggtcagcaaactctataagggaccagagaacaaatattttaaacatgcaggctatagactctttttttgttttgttttttgtttttttggatttttgagacagggtttctctgtgtagccctggccgtcctggaactcactctgtagaccaggctggcatcgaactcagaaatccacctgcctctgcctcccaagtgctgggattaaaggcgtgctccaccaccacccagccatgctatagactcttgcagctgtttccctggcttgtgactgctgaagaacaatggtatagaaactgctgtgtctagctgttttccactaaaatcttaaagatgcagctgggctcagcatcactttagagagtgcaccactatac

SEQ ID NO: 30010 - DNA, 1149 bp, Mus musculus
aataatttaggccagatgaaatggttttctgtgaaatgaccatttctaatggaatgaattgtgtcattattggggattaaatggagtttgtgcacttggatcttaaaatttatctgttttgcacacattacaaatacgatggctaggattatgtaattcagtggtaaagcacttgtctagtgtgcacaagtccctaggttcaatctctaatattgccaagaaaagaaagagtagaatagaatagctttgttagcggttatatagttcattgcctaatggaatgttgagcataaatgaaacttctggaaaatatcagtgaggtataaattttggtaatttaaagtaactagggcgtaaatgtgcatcatgactttagaatgttgaagggaaagtccaaaacctgttgccctgtcttaagaagctcctagtgctccttggtattacatgtttctagaactcatctgtgcaaaaactgagatttcaaaccaaagaacaaactactctggcttttttattccagacaccaaaggctctattcactgctggacagattccgactctctactgtgcaggactcacttagccccttgcccccagtcacttcccacccactggatggggatgggcacacatctctggaaacagtgagtccagacaaagtaagtgtcccgaatgtctaagtgtgatgaccaggaaccctgtggagacaatgacagcctctgtctacaatgaggatagtggtggctgtcagtatacatgggacctgacactcagctcaggtcattagatgccctgcttgggattagagtgcaggatggaggccaagaggtcctactgagaacaggagtgctgatgtgaggcttttgtggaggactgtgggggcaagtcaggtggctagtcagcaagtcaggaaaagttggttgtggtccaggacctatgactgcagacattgtccagcacatgctgacaaaacttggcctgcctccccctctgaaccttctatctcctataaattgatgcacctactgccaccagctatataatgtattgtcatctgtaccctttctcattcacacttgagaattagaaactgttagggcctttgccttttaggcaaggagatgagattttagaagcctgcagcccatg

SEQ ID NO: 30011 - DNA, 1149 bp, Mus musculus
aacctcatccctggttgtggctgacctgcactgtagcctgcccacacaccagctgaccattgtggatgctgtctgtccctttgtatcttctgcatggttgggacctgagaagtgctgacctgattaccccaaaggtgtctctgagctatggtttgttggtttgtctcagtttctcatagtcaagggaaagcttggtgtcctagcaacagttaagaatggacccagagcctcttttgccccttcccatcttgccttctgtcagcccagtagagtacagacctatgcctgtcagagcccagggaggactcagctgacaagatgaggcaccaaagggaaggttcaaaatcaggtcagcctctggcctcagacagcttcccatgctggtcagagccacctcttcccaaagcccaagcccagagtaaccaggtcatgttaatgaaaatgagctaccttcatttcctggcttggtttgggaactctgtttgctgtttgactatatgaccaagcagattttctgctgttccgctaagtcatatctgtatttctcagctgtagagtaggggagtggaatagtttggagatgtttctaggctacacaggaggaaagagcttgcagcctgtgattaactaactgtgcttcagtccatggattgctttcttgagacccttgaatttccctctatctttccatcatgacaagtagccttgctgctgggatgcaaggttccctaccaaacacaggttgtggggagcctcacacttggcctgactctcctcctatctgccctggcaaaaaccaccccaaggcgtggtaacaggaacagtggacatggattaggtctttcaagaggacgttaagggaagctactgaattttaatgaaagaaattcaccaatgcccctttgctgatttagggcttcttcttgtcaccctcaatttcccgcctagaagtgctcggggaccatgtgaaagttcttacagtgctgctgccacactctgaggttggtccaaccgctctgagatgagcatggtgcaggcctgattactcctcatggtagatgttcataaggaaactcaatataaaatctagagccattcaccaggggattatatcagtgagctcaacctcaagtttagttggcctcttgt

SEQ ID NO: 30012 - DNA, 1050 bp, Mus musculus
gcacctgggtacaggcaggtatgtatttgtgtacacacataaacacacacacaatcctcaaagacatatgcaaggcctctaaaaatgcctgcctgttttttctgaaagcagacttttcttgcaactgccacatacagtcagctttgtgagtctagcatctgagaatgggactcaatttttaaaagtccatagctcattaaagtctcactggagacattgccccacctgtctaactgcaggagggactaaaactttttatcaaattcctcaaaaatctaaagatttccaagctttatttaaaaacaaaagttattttgactatgaggttttaggggtaggaggtgggatgttgtttctgtttccatggtggtactgtcaggaaagattttaataaaaccagggtagaacttttggcaatgcacttcagcatgtttcttctccaaaatgtgcctccctccctcccactgatggcccccttgacatgtaggtgacttagccactgccaagtgccctttatggttctctcattttgtctgcacatgtacccttcaggagggaagaactggagtggaaccacctcctgccctgtagaatgcagtgccagggaagggaccaatcctaacaggtgccttccctggcaggaagtaccttcccgtgagtgagtgaagcagctctgcttccggctcatgggacaggttttatacagcaatagcttgtctcacagccacgtcacaaggagtcttgcctcccattgtggggctgcagaattggtctccttgccacctgtgagcatccttccccacacagtctccttccctccctccttccctccctccctccctccctccctccgtccctccctccctccctcagcattgagcactaggatcatggctgctaccaggacaggcatgaagctgtcctccagggattggtatgtgggagtcgaagacactgagctgctgatgctgggtgtgggctcaggatatcatggttgggaaaagaattgttcctcagtgggtctggagcctccaggaaagaagaaccaat

SEQ ID NO: 30013 - DNA, 1151 bp, Mus musculus
atgtgtaggccatgtgtgtctatgggtgccacaggaggccagaaaagggtatgtagcccctggaaccagagtcatagacggttgtgatccacttgacatggatgctaggattcaaaatcgggtcctctggaagagtaggaagtgctcctaactgctgggccatctctccagaccataggcctgcttctatttgcttcccaagtcatactcattttgttagagcctaaggaggctcttctgagcctctcaggagcaggtgtttgaattgagaggaaatagcagcatgacattgtcatttcctggaggaagaaacccaggccttttgctgaaatgatcctcagacactggctagggcgtccttggcttcttaaagtgagctaagctgacacaaaagtacgggcaggtgaagacagccttcatgggctggttcttcacacactatcagtccgttcctagaacaggctgtctgcatgcggtgggaaagcagggtgggccttatcatctagggcacacagttggtagctaacaacagatagctaaagatcctggggggactcttgcaattgtttgcatattttgtggtaaatattttaattaaagtatactgaacaatgacttcaagtgaccctcccacagtgctgctgggcttggctcttccttcagtggagcacaaaggacagaacagatagtgtcttcccaggagggtaacctaacacatctttttctttgtttttagagttcaaaattggggcggggagttgccctggcccagacgtctcagcgcacctcagctcgcaggtcctttggaagatctaggagattcagcatcacgcgctcccttgatgatcttgaggtaggtgcaatggccttgctgaccatgtgtgctactgccactatttcccctctcttcccttccaaagatttgtccccaccctcttgggatcccgttggactctgcctctcagcaggagcttccagggcacatggctggaggtttcctatatctcaaagtgcctgagtctggacccccacactggggagccctgatcagaagggagtatgtttaatcctttgggacagttgaggtaggactgacccctacccttcctaaagacctgatcatcccacatcaaaggccattttaagaatag

SEQ ID NO: 30014 - DNA, 1146 bp, Mus musculus
ccctgcctcagcccagagcccctgctcagcctacagtccaggctccgcccacagccccggctccgcccacagcacccctgggcctcctgggaccacccaacctggagagaagcctacaaagccctcctgtgtctccatggtgcaagagggcactacacaggcctggaggaggctatcaccagaaatggaggctgggggcatccagactgtggaggatgagcaggtggctgatctgaccctgatgggggagggggacatcagcagccccaacagcacgctgctaccaccaccccccacaccccaagacacaccaggacctccaagaccaggtacctccaggttctgactctacacctttgacctgtccatgattaataaagggaacactgaggcaggccgcccctgctctacagattctgtggattgaaatggcctgaggaatggcctccttctcttatatttgtggggcctcctttgccttttctgaaaggaaagcaggtggcagccaaggctcagtctcccagggagggtcactgaggctcagacagatattccacgttgagctggtcctgtgaatgtgccatgggaatggtgagccacgcccagtgaccccttgtgaaggctcaggtctctgagtgtggatcttacctttaaaacctgcttgctgccactttagcgttttagcctcaagatggaaaaaagtagtatttgttttgagccagtcagcaagggtcccgtgctgacatggatcaggttctcagcgtcagcctctctgtccagccaggactcgctgactgccctccacactcggtagtgctcactggctggcctcacgcgcgtccaggcatttctcttagtggaagcatgaagtcccgtgggtgtgaatggggacagtgtgaccgagtgttagggatgctactctagtcccacccaaaacattcatgatcccacacaggtgacagggctccggctgtgttcagtgtcctcacagtgacagtgatgggccttccagtgcatgttgcttattgttcctgtctgacgccttggctgtgatgcagcaggcaatgtggccgcccatctgggtccagcttcctgggcctggtcttttcaggcctcatgcatgtttcatgtgctctcacacaccat

SEQ ID NO: 30015 - DNA, 2142 bp, Mus musculus
gggtcagaagtagagttctctgtgaccgcccctgtaggcatccaccactgtgaggaagagtcacctccttcaggagccaccatagagtctccacagtgtcattgtcttttggggtgatctgcttccagctgtttgttttttagcattccttctgtttttgagtctgcgctgagctctgtccttacttatgacatggtctgggtggctatgtagtggaagatgagccagagtgtgtagtactggatttcagctgtctcatgtgatctcgtgatagcaggcttgccatggtgtccccactgacaggtgtccccttatacaggtgaagaagcatctacaggacctgtctagcagggtctcaagggctcggcacaatgagctctgaggaccagaagccaccagcagcagcctagagagaacacttgaagacaccgggagctgtcagcatgtcatcggcttgcatagacctgaggtgactggtgtggctgaccaccgtggcaaggaggatcccttgaaataccaagctgatcctacagtggctggcaaggacttattttctttcaagcaagtgtagttgtcaccaccctggacgagggccttgggtaccgctaccagtgagataggactggactccgagctgcagcacaacagtttatattgaaatcacataaacctgcctgccactggaaacattctgtacagagtccttaaatacatggcagagttttgagccctcgagtccttgcctggtatctcgaaggatgggtccattgagccatggcaaattaagttacagatgaagggggaaggcgaagactagtctacccactggaagcatttccctccctgcttcacgcaccctctccctctctggggatctggccccagacagttttaaatcaagagatttcaggacaaagatggcagaggtgaaagcctgcaggtcttgcagggcgaacgttttctggccccctccacccccaaagaccctgatcagcttccagatccagtctctgttccctcacacagaatagccaaaattttgtctgaccccagcagctgatcctggaagatcaggccattgagtttgttagccgctgaatctcagcccagaaattggaatctgcctatcaggggtgcgcagttaaccatgtttaagaatatcacagccggaaagaggctcagtgagtaaaatgttcatacagcaagcttgaggtctacagtttggatctgcagagccttgctgtgtttacttacctgcagtcccagcacttgagaggcagagaaagtttatcccagccaaataaacaaaggtggagtatatgggagaaggcactctcccactctctgatgtgtgcatacacttacatgtgtacctgtacacaggtgaccactcatagatactcatatatgggtgaaactcccagggcatcatcgtgcaagaagcccatgggttaaggacagcagccgcaaggaacagtaggcagtgtggttccctcacccatgctgtgtctgccaccatccaggccagctgggatgtgtccctctgagcactagtagatatcttcccagaaccctcagcagtgtctgaggctcagagaaattcttgttgctagggtctcagctctgcctttctggttcagcccaacaccaaagcctcctgtgcctcacagcccaggggactcaggctcagagtcaactgctgggggagtgcctggctgtcagatgcaccttcactaatgtttgtctccatccctagagccagaggccatggctgcatgctaaggcttagaaatgggcacgttgaagtaacatagcagtatacagcccagtgaaccatctcagagtgagtgatagagagcccacagctatgttagggagaggtgtgacctgtgtgggagctgcctgcttctggagcagatctctagtcaggaggccactcctgactaagctctcagatatcagatcctgcaaacttccctgggtgagtgtgactcccaccgcaagggaacctcaagctacaaacttagatgcggttctggctagcaggctctgccacctagcaacagtgactgaaagtcctcaggctgacaggtcaccagtcacattatggtaaaggagaacaggttcatgcaagttgtcctc

SEQ ID NO: 30016 - DNA, 1196 bp, Mus musculus
tctgattggccaattaggtgatgccgatttgatgtctgtgttggtgtccacctctgatgatgcctgcttcagctgtttgactgagctgaggaagaagtggccaagtcgagctctgaagaattgcatggggattcacttggcaaagggtttgggttctctgggcagaaatagcagcctctgtacagaggctctgctgtagtaaaaacatggctgacatgagggactgaagatgtgggtgagatggcctgaggtgtggaagggacaagcagaagtctgctcaccagactgtcctgtgatcacctatggcaagtgaagcccactgctggatcttggaggtgctgggtaccctggattgccagtctctgttcctcttgacctggctaacagcatcattatgcccatcactctgctgaccactgtcctctcttcacagaaggccagcaacatgcccagctcttggccttgaggccactgtgcgtcatgaggagcttcagggaggaggaggaggaggcgacttctgaggagctgttcaccatggggcggggccctgaggagcctcggggaagctgtagccctgaagaccagattcagagtgtatccatgggcttgcccactggccaggagagaacagggtctgcggaggctgaggcaacagtgagaggtggtgagtgaaggagctgaagcccaccgtattctcatgtccacctgtctgtccatccagtacatatccgaatcctccatgccaacagggctgacatgggtaccctggcactgctcactgggcccactgggttagccacactgtgggctaagcacagagggccagcctctggcatacagatactgccctcccccgccacaacagatgatcagtcctgaagtaatccaggcttctaggtggagtaccctgcagctagccctagggagttctcagctgcccggggcctctttaggaacctcagtgatagcaaagttgcccctgggcaacttgctcctctggatggctgagcctgcccagtgctatctcaccttgtcctcattgatttctccattcctcagcgtggagtgcaggcccaccaggcaaacagggcccagactctttagtgatcccgggccacaccaggattggagtcttttcctaaggcctgggtggtgacacctgctatgtgactctccaggcaagcagcaatgatgtg

SEQ ID NO: 30017 - DNA, 1217 bp, Mus musculus
aggtcttcaaagcttgtcccttttccgggctcaaagattggctggaacagtggaattgcaggaagaaatgccttcctggagggcctgggacaggggtggggaccgtagcagaacaatccccgtggctccaacttcacacgacgatgactctcccctctgaagggtaggcccacaaggctcatttgtgcttggagtcctctgcctccctgacccgaccggtcccctcacagggtccagcctcatcagcagtccacacctttgttcctggctccatggcagatgacaggtgcctctctgagtttaggttccactctgtagagttggagctctatggaacctctggtactagagctggtgccttccttgacttccagattgtcacattatcctgtatagtgcctcctaccttttcctcaggccactgtgtgctgaggcacacagcgcagggggagagccatgacccacaccccttctcatgttccagagttctggctgtgaactccttgcagcagccccaccccacaccttcgtcctttaggctaacttgactgggctcggtatttgcagggaagaactaagacatggaacatctgcctacgatgaccggctcggtggagcttgacttcatttaagacatggatctgttgcacaagtcctaaagctgctcttagcctaaagagcatatgagattactggtacttaaaataaagccaagagctgggtgggtgcatgcctttaaaaaaaaaagatttatttatttatgtatatgagtacactgtagctgtacagatggttgtgagccttcatgtggtggttgggctccggtcaaccctgattgctctggtcagccctgctccagcccaaagatttatttattattataaataaatacactgtagctgtcttcagatgcaccagaagagggcaccaagtctcactaaggatggttgtgagccttggttctgggatttgaactcaggaccttcggaggagcagtcagtgctcttacctgctgagccatctcgccaaccccaggggtgcatgcttttaatcccagcacggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagag

SEQ ID NO: 30018 - DNA, 1150 bp, Mus musculus
tgccaggccttggacttccagagtctgctatccacttgaaggtggcagtcattatatccagatctcttctcattcccactgtcctgccctgccagggtctcccttagggcaagttattgtctcttcttgtgactttgtgtacttgcgtgcaatagcagagtcaccttggagtatgtgatcctgcctaaccgtgacatctgtttctgaggctgatatcatttcgagtaaatgtgctgccagcattcctcatctgacatctttaccatgtcaccttctggggaagtgtgttggatctcatgctttggttaggattaggatctggaagtggggggattctacagcctgacatggaggaggcacctgagttgcatgcacagtaactgcctttttggctccaggggaaggattcgggcaggtgtggggtgggctttcattctgagaccctcacttctgctgtctggctgatcacgggggctggtcctagatgctttccatttgggggcttttggctggtggtgaactggtatgtcccaagcaggtactgtgtggatgctatatcaggggtctcatgatacctgcccgatggctgaagagttcccagtctgtgagggcagtctgtgctctatggagagcataggggccccttggcacagtgggactccagccctactgttagatatgcttctccaactgcccttggccacagttcgcctacctgtgagacagaggtagcacctgctttgggggattcttcaagacctggcaggtacttggaagcaggagaataggaacatctggaacaccctgcaccactagggaaacacccaaatttgtcctctgcgtgaggtcagcttatctcctcagccatttttgcaacatgcctgtctttttactgcttcttggtccagaaccaccccagacttgtttacatctctgatctctagggagctcccagtcagtgcatcagcttatcctcagagggagaggcacggtatactgtattgagtcatggctcctgaattgagctttctaggccttggggtcttgatacccagcagcagggagaggcagtgaggcagcatgctggcagagagcttgcaggagtctggcctcaggacacagaggacctcagaatccttctcagagcctc

SEQ ID NO: 30019 - DNA, 1197 bp, Mus musculus
gtcaccttgatgaaagtgggaagaagggtgttaggagggaggggcgtgctgcagagatataaccagtttccagccttatcctgctgtggacatccagtcaatatgaattcatgaagctggactggaataaggcagccccatctagtctgattgttgtccttagaagagggaaggcagatggtagacagagccaggaggccatgtgggtggaacaatcacagaccaatgacagcctggtggcctgtgaccaacaaacaaggcaggatggaggtggggtcctccttgggtcccaggggaaatgtggtcctggcgttcattgccatggggcctctgctctctgtgactgtgtgagaatcaatgcctgttattcatgggattttgcaccagttggtctggatattgtcagaaattggcagggaaagcctgtcctgagggccagccctgccctagcatatcttctcctcaacctcctgcagcctaggtgggccacatccccgatttacagatggtcagacaggccccaaggcaaggtctctggaccaaggtcacagggcgctgggtaaatgactaaggcagctgggcaaggacaaagctgtggtgactgagaatacaacagtgagctgtttcctggctgtgacagagtgtgggtctcccagggaggcatccagcacgcagctgagctgggggcccagtacttaggactgacattccttaccaacaactaggcaaggtctcttgcccctcaaatggtgagttttcttatccttgaaggggcatggatgtcttgttcactttaaagtcacactgaaagtctccctgtttctggtgaaagaacctagtgggaaaacccccactcacctcccgatttggtgtgcacccaagaataatgaacaaacagactgtcttgatgtaaaaacatgaggtagtttaatggcggagctctgggtcgaaaagtatctcacgcaggagacagtggatttgaccaagaggcttggaagctaggggtttttatagaaaaggggctgggactgggggaggaattgatgcagtttcacatgattggtccatttaaacatcagccaactgtacatgcagataagatttaacttaggtcagaagagcaggagatagggaggcgcagggccagtccagcatgtcattctctttatctttatggccaagcagcctcaggaatgt

SEQ ID NO: 30020 - DNA, 1184 bp, Mus musculus
gggaagaagggaggaagggagggagggagggagagagggaggaaggaaggaagggaagaagggaggaagggaagaagggaggaaggaaggaaggaagaagggaggaagggaaggagggagggagggaggaaggaagggagggaggaagggagaaagggaggaagggaggaaggaagggagggagggagggaggaaggaaggaaggaaggggagaaggaaggaagaagggagggagggaggaaagaagggaagaagggagggagggagggagagagggaggaaggaaggaagggaagaagggaggaaggaaggaagggaacaagggaagaagggagggaggaaaagaaggaaggaaggaaggaaggaaggaaggaaggaaggaagggagggagggaggaagggagggaggaagggagggaggaagggagggagggcgggccacattcttaacccttcattctttgacccctggagagttcatgttgagaaagagttgtctcttgttgccatgtctatggttatgtcctcctggcctgtcagtcatacctgggagtactgagggtggcagccaagcaagcacctggtggtagagctgtgaccaagagccctatgtgacagaatctgcaggtatcacaagtggaagatctttggcatttccagtactgattggggttcagacaagcaggagcagtccagtcacctattccacaggccttgaacaccttctgtgtcccagccctgttctaggcatgggaccagagctgggcctgacctgtggagctgcagtgagatggggccagtcaggtggtatgtgaagattggcagctggagcattctgggaagggtgccatggagatataagaagtctccatggaagccagtgcctagcaggactcaagatgtggtcctggaagcaagcggttcttgggaagggatgaaccagccgaaggcagattcagggctagcaaactgtgtggccaagttactgttaccagtcccccccaccctaccctgtgcaatgacagccctagaggacttaaggtgtctcccatgggaccaagttggctggaaggtgacaggatgtggctgccagcgtctgtgttagagaggtactctggccaatgcacagtacgcatgagcatttgtagattggcatctgcagagcctgagggaaggagacacag

SEQ ID NO: 30021 - DNA, 2021 bp, Mus musculus
cagtgacctggaagttaggcatctctgcagacttgtacaggaccagttatacatgggtgagaacctggtgatgctgtaccaagggcacgccttcccatcacagcccagaatgtccttagcacacacataaggagtctcccaggctctccgtagtggtgcctttagggtcttctctgggcagccttcatggccatgattgatgctctgtgcttgagccctgaagcagctaccttggagtcaccaaagagcagcaaggtggccaccagggtatagggacatcacagtgtacatggaagctgcttagctgaaagtctgtcccagactagcccagtgtaagacacttgccagctgtctaatggtgctttgctctagtgccttcctccaaagggcagttaggattcctcataccagcatctgtgtgggctagtttctgccaggaaactgtgtaggaccaggatgagggatgcagcctccacacacgccagcctgttcatggagccccttgggtcatcacagggagctgtgaccattccatgctctgaaagggaagagacgttaatgtgccgtagacttctgctgctttgggtctcagagcagtgcttttggccactctgatagcagcctgctttgccaggaaagctgttccaggctttgattgttaccaaaacaaggagaaaatgtccagtttaacagccaaccctggccagcatagagggacacagtgaagtatcatgtccagcaaataagcctcagatgagtttatcctgatgaagacacagcaggttctaggctcctggtgttcctaatttgtgctgaaaaacccagccttgtcatccattcaactgtggaggaactgtaagttcctcagcgccatataaagtaggtcccggggaaggtaaggctcccaacacagggctccaacatcctgggctcccattaatgttcttagatttggtcagaaagctagttgagagagcatttgtttcaaaataagttatttatttgtatatgttcaataaatagagttttaatttatatatgtacatattaggcacccatgatcctgtcaggattctcagtgttctcattctatgaccctcccaaagccactagcatgaccccagccatcgatgacacaggtttgccttgtgtggagcccggtaagcagagggctgaaccctttttgtgagcaatcaggtcctctggatcatgggagttgctcctcctctctttgtctgaggccacaatgtttctaggggtctactttttgttacaatttggcaagttgtcatcagctttcacaaacccctctactttttttttatttatttatccccccaccccacacacacacaaagggtttctctgtgtagtcccggctgtcctggaactcactctgtagaccaagctagcctcaaactcaaaaatccgcctgcctctgcctcccaagtgctgggattaaaggcgtgcaccaccaccgtcaggcaaacccctctacttttatgcccgtttactaactaaccatttgcttacaaatatcctgctggcctggggacttgctatggtccctatcttgggcatgggggtgggaccctcagtgtcacacaatctcatttaccagtgttcttgcaatgatgagcttgggtcacatggactcttccagaatgcttgctgctcccctgcctcgtgtgtcagtgtccagtcccttccccatgcatgccttggtcctgcctcacccacccttcctcctcatctgtccactaccccaattttggctgtttctgtgtccgcatgtccatgctgatgggacttttagaaaatctgctttggaaagcaatgtcccaggccctgaggccatggaggaaggtttctgctatgtgggggactgcagttcccaggtagaattcaccagcaggcagcagcaggggtgtctctggcctctcctcccaaaggccagggacagcctcccctgtcactgacctccaccctgtgctctggggatacttgagccaagtcattta

SEQ ID NO: 30022 - DNA, 1195 bp, Mus musculus
cagtctctgctcccccaaagcttctctcttaatgcaggagaactatatcaatctctcctctcttcacagtgtaaagttggtggctcccccaggatgcagggaaaggcatgacatctccccaggcatcgacacacagacttccctctgccatcgtgaggatgggatggcagtatctttagggagcttggagctagagttttctcatttccgctgattttaatgctgctgccatcccaggggccctgtgcttgagaccagcaggcacttctcgagacggtattttgttcttttataaacacacagactcactatagaatatacaggaaacactgaagggggggatgctcacctgcaatccccctcacagaggggaatataacttgctccttacagcagctatgtacttgaagtgacattggtgcgctctttgcagacctggtggatgcaggtcataaagaagtgaagcgctcagctgctggagctggtaagtccccagatgcaccctcaggccatgtcccaggaaggccactggggctcctcccaccctcagatgagagcttcaaagagcagaacggtcaatgctgtccaactttcagaaccctctttggagagtccgctagggatgtccacctgaatggaaatgatgtaaatgtcatggatgcctgggacagcgtccttatgacccaagctcagcactatcctttggggacagagcaccagcttgtgatctccactgaccaagtaaaagcttcaccccacctctcctcttcctcctctccttcctcctcttcctcctcctccttcttcctctcctccccctcctttttcccctccccttcctcctcctcttcttcctcttctcctcctcttcctcctgtcctcctcctccttcttcttaatttatttattcactttacatcccaatcgtagtcctccaccccatcccacattctcttaagtcccttgctgccatggcactgggagcctgtcttcccatgcaggtttctactctgtggggccagagatgtttcctgcactgcagatggaacaaggctatcttcaagcttcagcttcccagagctgttctagccccgtgactccaggatccaagtctgagccccaaggcctgcaggtccaccccagtgtgagcacacagctgtgctccccagatggcccgcctcacgtctgtgtccat

SEQ ID NO: 30023 - DNA, 1117 bp, Mus musculus
atggggatatgagttgtgggaccagggagtggtggaccctagctaggccaaggttgcagcataagcctaggggtgggggtaggctctgggtgtttgatcctggtctagcctggccaggaagccatagggaggtctctggtgttctttcaacttataaacttatattttaattaattaattaattagttaatgtttgtgtatgtaggtcatagagagtctcttctactttggggcttctaggcatggaactcaggtcattgggcttggtgacaagtgatttcactgaagccacctcactggcctggtctctgggcttttaagactcgcagaatgtgttcattaacatgtgtcagtgtgtgtatgaacacacgtgcacaggctgggggagctggaggcctttgaggatcatggaagtaattctaggtaactttggatgggccctgttgtcctaggtaacttgcttaggtccttcatcctggtcactgaagtctatctagaaagcctctgccctcattaccagctatagtgacaagtgtgtcacagctaggcgaggacagaggccagcaataaaagaggtatagtcttgccttgcctcctttgacttccaaagactggatttcatctgcactgaaaccctcagatgtaccttgaaaccaccattatgcgattgccattgagaactggcactgattaaaaggcatattctcgctttctgagatgataaaacaggaaataacacaggtccaagaatcaattgtctatgagaataatgggctgcacagacaccgcctggcatgcggcttctttgtaaacgtgctgtttgtagtttacattctgcagagcctggaggacctcggctcgtgcgtgcagaggccaccacagaggccagacctctgtgtttgtggagagagctggccctgagatggagcttgggacttccagctgatagacgctccaagaagtcatgccatctggggcccccagcctgggataatggcaatcagatcctgtgtttcaggcataagctgaactcccgcagaggtgggaaggaatgtaccctcaagtagaagcctgcaaaagtttccagagtattccagagtgcttccgctccagtttc

SEQ ID NO: 30024 - DNA, 1182 bp, Mus musculus
agtatgcccttccatggctgtctgtccgtcctcgatagaggcctcaggcccctctttgctcctggccaccacactgcatgttaattaatggtggagcaggaggcctgccaggccctttcaggggcttgcattcccaggggtgagtagggagaaggcaatgtgggtgttgggcctggcccccacatcgctggctctgagccccagggccgcattgaagcactggggagctcctagctcttcagaccccctctgagctgttgctgggaccacccccctcctcagcctacccactacccaccctcttgttaaacactcaaggaaatcctttggagcaattagggaagtgtggagccaacacaggctgccccagcaggcttcattcttggtggtggtggtgtgggggctggcagtgttgggaagggaactgggcactttaatatgcaagacagaaccactagggtggcagggccaggctgcccagtcagccttctgcccctccttggccaactgggtgggaagccaggggaggaggggaaacagtcatgggaacccaggtggctgcatgctctggccctgtgaactcagcagctgtagacaggtgctgatggccacagcgggtctgaatcctgtcccctggatgacctgatgagctctatctactgtgaagaaggcatggaagctgagccgcctctttttttttttttttaaacctcacttagaaccctagaggcacctagaggcaactcccttcctgtttgccatttgacccctgccccagggtttcccagcggggctttcctttctgagaagggaacagaatcacagcagcgaccctggtcccactgaggtgggaggagggtgtttggctccaaactcctgacttctgagagtacatttcaaggtcctgcagctctctggtaacttcataccatatggttggcatccttggtaaatttggtaaacactgtcaaaagctacagctgggcacagatgccaggaggacatgccagctccttcagtggccaggctctctgtgacccagtacaggcctctcaggtctgatttctgagcagtgggtcagaactcttcaccaccacctatctctttccttggtggaacctgcattcctgcctctatccagaggcgccgggatctgtggctgccatcatgtgacactataga

SEQ ID NO: 30025 - DNA, 1233 bp, Mus musculus
tttaaattattaaagtactgtggtatacttaatgatttcaccaggaatcatgaacatccctgtgtaaggagcccatgcaattgagacttacgtgcagaccatcttttcctccatgcaggcatccagggtttctgcaaggacttgctggaggttgcagacatcctggagaaggcaacccagagtgttccaaaggaggagatcagcaacaacaaccctcacctgaagagtctttatgaagggctcgtgatgactgaagtccagattcagaaggtgttcacaaaacacggcttgctcaggcttgacccaattggggccaagttcgacccttacgaacatgaggccttgttccacacccctgtggaggggaaagaaccaggcactgtggcactagttagtaaggtgggctacaagctgcacggacgcaccctgaggccagctttggtgggggtggtgaaggacgcttagctccctccctcaggctctggactttgtaggtcacttgctagaactcgaagggcgggcttgtaatttctcatctgtgaattcatctgacccttgcccagccttgttggaaatcttaagtaagctaagcagaacatgaagctgcttgcacagtcagggactctgggagtctggtcactgaatttagcattacctacttcagaagagggccatcaggacctcgggagtagtatgctaacattgtatctgttccacctggtgattagtactttacacaaataaaaggtctttggctatatctatgctgcacagtctacctctgagtaccaaggcactggaagggaagagccagagcaggaacacttgttgccagcgaaaataagaccttcaagagtgcatattcctttacaagtcagtgtaaaagtcctgagatttggacacctgccctggctctgaaatgacacggagtcctggtatacttagtgatgagctgcttgcactatacctgggcagggttctttcttatctcttctaacccgaccatgctgcctaccacccagtcatgtgcccagttacctgctatcttagtcttgccctggctgctcctgctccgttcaacctcatagtgacactctgcccactttctggccagccattggctgatcaggtgacagaaagcgattttacacaacacagacgggagatgcttgatgatgccagcatctgggctacaaccagatctccagcacagtagtcagcatctgaacacag

SEQ ID NO: 30026 - DNA, 1600 bp, Mus musculus
tcctggcacattcctgtaccctttaaatgggaaagcagttaacggaagggccacagggtcagatgagggctgcctttcgctgctgtgaacacttacagtacacctgacttggaagacccttttgagttcaaggcagagtgtgcaatgttgaaatggagcagtaggtgctgaggacttccactaccattgtagatcccctttcactaaatataagacatgctagctagcctggctcagtgagctgattagcgtatggcagggggcctaggaagtacagagcatcctgcctgtgccttggagcctgtgcactgcttttgtatgtgatcttgcaacaaactcagaaatggctccttcccagccctactgaaaagcttgtttctggggcctccttcacggattcatatggtaccttccttctaaacttgaggaaggcatttgtcttccggctgctcagggctctcacgcccagaccctgctttagagtcctggagtgaccacagcccctgccccctgtccctgagaggtacaagagcctgtttacctcatagagtgtttgggctcggaagtaaaagtgaagttattttgaagaaaacaactcatttccaaggacgacatgacgacgtgccttttcattttacatcctctgtcccctagggtaagtttttcagcattaaataaaacatttcaaatatactgtaaatggctttagttgtaaagtgcattgtgggccagcaggcccagatttctcttgacaccagaagatgctgagcaatggtgtcaaaggaccagctccacactgccccctgcagttgaatagtggacagtagctggtgtgactgaacagcaatggggtggttggtactcaatgcctaggtgagccagtggttctcaaagtagggttccccaggcactgtcagaaatacagtcataccccaggttaaatctcgaagcagagatttgggggcttcattaacagggactagcagggtgtttttcaaaccatcccggtggctgggatgcaagctcaagtttgagaaccactggttttgtcctggtgtttccagcaccagaatcccagcttggtgaggtttgaagtttcagtgtgtcttctacaaaatgacagccacatctacattagcttgagaagcagaggattctgtcaacatgtggccaagggctgttggacaaaaagctgtgcttaagcaggcatatagtgtgtgtacatctttcgatgatataaatttatttgggcgtgactgttttaaaacaccataatgaatgtataattaatttatgttcaagtattaatattgttacaagggaaaagtaatattaggattgtttgctctcctgtctgccccagctgtttctggcatattattttttgttagctgagacattgacatgtttgtatttaattctcttgataaattagctactacaaccccatggaaccaagtcttttcaaatttcaacaaattgtctttgagtcagaaaagttagataattcttcaactgtttgaaataatgctctctgggaggccaacattccaagaatgtatgaagaactgaaaccctaccatttttattcttcttttac

SEQ ID NO: 30027 - DNA, 2452 bp, Mus musculus
aagaacaggggctctttccatgttggatttctgatgctgaagttggccttacaacaaaacagaattacatccaggtttagccttaagcagctcagtgggcccatgcactggcattggtcatggctagccactgcattttctacatgggttcaagaaagggcaggctgtctccttgaacctttattccagcagcagttaattaaattgtgatgctattatgccaactactggaaggtacattacaatctttcttagccaggatgcatgagaaatgttattaggaaacctcagagttgtttttggcccatatgcttgtaagaaaggaattacttagttactgagataatctttccagagatgaaaggtgtgttttaaatctccctatcaaggacattgtaaggaagatgggcccttgcagggtagttgctggtgaatctcataggctcctgggaacgcacctgacttttgtgctgacattgacccattgttgccttgacacttgatagcaagaaggctgagagttcatatcaggatcctactctgcaaaggagcactcattgcatcttgggagctagagtggttggagcagggaagccatatgctgtgaagggacagagacaggctctgtaaagagataggaaggacgagactgcagagtttgctcctctttaacctgcttgcttctggggaggctgggcatggcagcctctgaaaacaccattgtgtaggagatggcttccttgctttagctgaatgtccctttttgcctttgtcacctgagtagctggatcccttctaagtgccagtgattctcccctgtccccgtctggctttagaaatgagttccacgcactgctataaggacaagagtaaggcagccttccaccctctgtgtcctgagcccttccccattgcagctgattcctctcagttcattggtgaggtgcttgttgccctagcttttccttgacttgagaactttgtataagaaattttattttccagattcacagaaatgaacagtttctacgtagagtagaacagtccagtatctgtggaaactggttaccttctgatatccattggcattctggttcctgagggtgcaggaaggccagggttgagaatgtattttccagcaaatccctgtgtggtctgtagtccacagccctccacagccgtacctcccacccccagaactcaccctttccatctctgtgtttctgagagctgtgggggagcccttgactgattacagcatgtggcagggaggcttggggtcagcctcatggcgctgtgtttgcatgggttcccttcatctgctatgcctgttggtgaccgtccagtgtatctgcgggctgtcgtatttgtgctcttcaccccatgctctcactttcctcttttcttggagtctcatttgtagtctgtgacttcttcagggaggccacagagcaccctccatggagctctctgccttagtgtgaaaggctgatgtctgacctcttggaggaggatgtcttcacagccatccatggcctccaaacccagccattcctgacatcagacactgaatgtagcccaggcccagctggccataagatgcgcactacccagccctgtctgctgtccttccttgcagatgtgtactgagttttctcccacaacatgggcatctgttctctcaagatgtatatattttcttactgtacataaagacattccttacgtcatacagaaagtgttgtgacaaggggacttgggcaccttgttgtgaatgccattgtgggattctctgtgttcacaacccagcccttaccttttcttgtttgacataaatctgtgggcatgcatgaagttctccaacaagactccatgccagccgagcactgactgcatctctagtccaaacaaggtctttatagactgactgggacttgtgtgagcctgatgtaccctccttcgaggctatacagttccacgttcctctactttgagggcgtctctcatacttctctcatactcctgttttggcaaactggaaactgaccctgcagaggtctgtacctcccacctcaattgccattgactttcagtcccaaacttgagggtgctgggcagctggcactctggagggagcttgcaggagagttcctgtcaccttgggagcagtgcttacttcagaggtacttctaactgctcagtttgccaataggaaactcctgataacacttgctacatatcatgttttaattgcttgtacagttaacctttaattttgtttagtaaagtgtatcaaactaggactttttgaattgtaaatatgtggttttattaaaataaagtcatgtaaaattgttacttatgttcactgtgtactttggtttaactgacatttttgctttgaagtgtagcagaaaatattttagaatatactcagggcttgtgagacaca

SEQ ID NO: 30028 - DNA, 1186 bp, Mus musculus
atgcatatacctgtagtctcagcactctggggtaagaggaaaatactaagtttgaggccaaactgaactacatagcaagaccccaagttcccacagtaaatccataggttatgaagtgagtgtcaagagcagacatttgctgcctactcacaccatccatctgtctctatctatcactctccctctctccctgctcccaaccccctgtgtatgtgtactctcacaaacatgcactcaggctagagggggcatccatcaggtgtcctgtcgctgtccatcttactcttgctgaccttgaacctggtggattttgctggactggcagtccgcaatcctcctgtctaccctgctcagtgttgggggcttacaggcaagcactcatactcagcctttacgggggtgctgagatctgaaccccagccccatgcttttgcagcaaacactcaactactaagtcccatctccaactcgtccttctctgctatttttctggcatggtgagtactggctgctcagcgttttctttcttttaatcacaatttacagagcttaaagaagcccagcgtcggaggaagcagctggaggaaaggtgcaaggttgaagagagcattgggaacgctgtcctcacctggaacaatgagatcttgcctaactgggaaaccatgtaagcactgcctcactggagctacttagtgtgaccactccgttctggagtctgtgggcagaagctggagttgctggatatggtgatagcctcttccagtttatattttgagggcctgagccatgtttgtaaagcttatgcctgtgtcactccatacttaaaattttggtagcttgttgtgagtctccatatgaaactgagtgtgagatggcctgccctgtctctgcagactgttcccaggattacccagtaggaactgctaatctgtaacctctggacctttgcctgccttctccctgtctacagtgtcctgaacctcttcagccttctagatcctgtttcctctggcttagtcttcacagggaagaatttcctgcccccacctgtggaagactcccttgagtctcatggcactgtctgtttgagcatctgtctctttctgagggtgggaaccacttgtctttgatgtcaacctgcagtgtcagtacaaagtggcaccccacagtgcctggcagctgtggc

SEQ ID NO: 30029 - DNA, 1350 bp, Mus musculus
catggtgactcatctgcaggctcattcagaagatctcatggacattgctgtaggaacacaagggtgtgctttagagacttacagaatactgtgctttctcttaggattcccctaaagtaccatggaagttactgtggcttgtgactttcttgctagctgaagaagccaaggatttgaggcctgggttagatgggtgagttctgctactgcagtgtgtccatagcaggcatagtggggttctctgagctgcctctccagtgcatagttgaggaccttacttgtaaattgttatctggtgacgacactgaacttaattctccaagtgaacttcaaaacattggacatgcagtgaggccacctcttaccccaaagaaatctttggctgctgcagctagctgctctcgtggctgtgatgtagtgtagcttgtatctcattttgtgtttgagagaatgctctgggcaagttctgcttgtgggctggggttggtagaggaacttcccacacacttccctgtgtgattgctgttctgattatcgactcgtgggacttggtgcagcaggcaggcagcaggcctcacacagttgcatctaagcgtgctgatcacctcggatctctctcgcagcactgccacaggtgctagtagggccaattgtgtaaaacctaaacatccaaaatgatttttctcttttaactaacttgttgtttttaaaaacaccttgtctgtgacatgagctcagcatgtccagaacatcaggagtagcggagaggtcttaagtagttgaactggcctcaccagcaagtgggacggcactgggcatgcgtgtggcttcttagctgggagtggagctgcccctcgggccttgctggtagtacttgagtttgttgcctgtttctcaggaacacaggaaacaccgtggagcctgtgcaggcactgtcgttctggcttgctggctggggcctcttgccatcttagggtctgtttcatacagcacatcctgacactgacagtggtgcgtgtgcgtgtgtgcatgtagaagggttcatgttgctcttatttatttacaggtatcagatacattttatgtatttttttcttctggagcttcctaaaatctgattaacatctgcactgaaatataacctatcatcaaaggcaaaaaggattggaagttgtaaattcctaaaatcaatgccatcaagattaccctagaaattgttgctatgaccaaatggatttcatactcagccatgagcttgggtgacctggacagccaatgtttatcaggaaaaggctccaggtggcaaagaagcctccctcctcagctgtggttgtggggagaggcccccca

SEQ ID NO: 30030 - DNA, 1914 bp, Mus musculus
ctgcagggtgccggcggcgccgagccccgcggcccccgggcggagaaggccgacgagaaggcgcaggagatggcgaagatggccgagatgctggtgcagctcgtgcggcggatagagaagagcgagtcttcgtgaggagccggccgcggtaagggcgggagcctggcggggcgtgggcgacggtgggggaggaggctggcttgtcgcctcgggagtaaactaggccccccctggggaaggagtaatagcaaatcgtcggcggggagaccgtggaagtttccagatggtgctggagagcatggggccctaagtgagacagcgtccagaagggggccgggtatttgctttgctgtccggacagcgtgattaacctctcggtgatgaatctctcccgcccgtgccttaggtttccagccaatggattctggttgagtgatggcgattggctgacatgacaccctggagaagctgaaaccagagagccttttgttttcctttttttttttttttatctccttcttatttttttttcttttcccctctgtcttccctctgtttctcactgacactacgtttctgctatggtctgcggttgacgacctcgatatgagtttttgattattcggtggttccttttttttgtttgtttgggggaaataactttgatttggaaaatgcgctcacatacgggaattagggcctagattgtaagccctgtggcagttgaataacgttcattcctggcctttggttgttgttcctaaattttgaggtgctttgctctttcttgggtgacctgatagctccctgaactttgaatctctgtgacacttgagactcagagttgaagctcaccgcctctgaaagttctgaaggagctgtgttaattctcgaagactccatgcagcaatggcagaagagaccagacttcatccgggacagtggatgggccttacatggctaggactgatgacctgggagaagggtcggaggatagtattgtttctattgggggactttaatttctgtgtgagaccaaaggaggagagatgtattttgtgcaaaatttaaattttatgtgctacactatctattgtaacctgcctggtgagtttgttgggacagcctaactcatttctaaaagaaatggaacctcggatgggagaagaggtcttgttagtctgtacaagttggtatccccatatattcgaggagatcctggccataaaatgaaagatccttgcaataccctgtgtggcctaggaaggaaaacctgcaatggacccaaaacttaaaagaagaggcgtcttaaaggttcatatgtagtcgaactataaatgtatgagtggcagacctgataagcgtttgaggtcaaaacccttaccatgttgaaaacaaaatcttacatgttaataaaagtattcgtttgcttgaaaagatcagcccggagagttactaagaaatattaagtgaagtcttccttcagtggcctgtgtttagtttaaatgaacattctccagttttgggagtctgggtaagcagaaggggatttcgactgctgtaggaaacgtgagaataggaaagtcttgattcctagtagcaagtccacagtcttagcctctgagaccagtccttttacttgccttttacttgactcctgttctttaccagtcttgatgatacaacagcaacaatgtattgactcccttcagacaagaagggctgggtccccaactgctgggattgaccctgtgtggccatcatctcattcctaggtggccaaagtctagggccctcccttttaaggacaccccaccctagacatcttagaattcttgtgtctgctgagggaactgcagcccagcctaacttctgactgctctgcatgttcctatccgggagtgaccattgaac

SEQ ID NO: 30031 - DNA, 1119 bp, Mus musculus
ttagatcccatgtccctagcaactcatgcctcctctattatcacatcccattttatggggatcaaagagattaaacatctgccccagctcaccatccaagaccccagatttgattctgaacctaccaaccctgaccctttcgtcgctgtgtctgtaaaaagccagtttcgcttccttaaaatgaactaaaaaatttcaagtcaagccaccctgaggctagaggtctgcgtcggagagcgtgttatcctggaaggtttccctctgtgtagacaacagcggtctccaagtctggaggtagtggccttgagctgcaagaccaccatatagggacgaaagctgcaatacacactctagccgacaaggggcgccgtaccacacaaagctcgtgccctgcccgtggctggcagcgctcgcgcattcctgccgacaggcggcgccgcgggtcccggacccggaagtggaccgctctacccaggacccgctgccctggcagcgtcccactgcccagcaatggggccgctgcgctggctgccgctactcggccagctgttgctgttgtggccgcgggcagctcagcccgccggcccgatccgggccttcgtggtgccccacagtcacatggacgtgggctgggtcttcacggtccaggtaagttggagcgttcctgagctccttgcacagtaactgcctcctgcggagtgcacccgacccagccgggaagagaggcgacctgggctgcagcaccccaccccaccccccagcctgatcccctgcagtctgagcctcagcctcgggctggccacttcctgcctcggagtcctgatggcatctatcttattagacggtccctgcaaaagttaaggcagaggagtgtgtccccaaagtgtggattgacaggtagccagtctcaggaataagcctggagtaccttgggtggggtaggtttccaagcaggtggatgtcagctgactacaggcaactgggctggccctctgtggtgctgacatgagggctagccagttcagcttcctcttcacactcctacccagccagataagcttggtatggggcctgtaacctcgaggttctttctgttcaagaccttggacagagcgggca

SEQ ID NO: 30032 - DNA, 1099 bp, Mus musculus
cttatgtgtactgatatggagaaggatgtgaggcccatgcctgcaactggctgggactctcttaagtggtttcatgatccatattttaaactgccaacctgctgaaggcactcggtatggccttgttaggatcacagtgtcacctccatgggtccatgccaaatggtgagaagtctggctcaaccccaactggttcagacttgctcagtagctaaagggaaggccacacttggtgaccacatggaagatggagggagagtggtatggatgacttccctttgaggtgtggcaggtgctgtgtggggtgacacataggacagcccggcagagcccagcacagagggaatgagccatcttttcccccagggtgagagcggcaaaaggactagcccatactcacctgtgtatgctcctgttgctgctgagcggccttcaccccagcactcgtcagtgggtggggaaccagcactctctgggagcagagggtgggctgtcatctagaatgtggtaatgccatacttgacaccagttccatagaagccccagacccagtggctgagtgtcgtacctgcctgtatgataaatcattctgacagcaactcaagggagacagggtttatttggggggctcagttcaaagtacagcccaccacggtggggaaatcagggctacaggagcttgacgtagctggttacctcgtgtccgcagtcggaaaaaggaaggtaaatgatggcgcctcattcggtccttttaagccaatgtctgtgcctcattcagtccacaaccccgcccatggaatgatccaaccccaggtcttccgatcttcagttagcccaactgagaagatctctcctaggattattcagagaccaggacaccaggtgattctagactctgtgttaatggcagttaatcatcacagatgtggccagcccggtggtgggcagcattatgggggaccagacccttccacctgtcagctttctcctcccaaatgttctttgagatgctgtgtggatgtagctcactggcctcccagacactttggctcacaagtggtacctttcactgcccccgtggtacctttcactgcccccg

SEQ ID NO: 30033 - DNA, 1201 bp, Mus musculus
gaagcagttgtgtggcagggcagaagggaggtggtggtggcggatttgcaggcaggagagtggcagcacagttagtgagactcagtggtcaggatcacctggtatattcagtgttgtggagccattgctagttggtcttggaggttctaggcaggcatggtggatcctagagggctgggatggatgcttcttgcaagaggccagaaagtcacagtgaggtggtcagagctggtggtggaaaggatgtggaatgccgatctgtgctagtcagtgggaaccctggatgtgggggagaagaaaggctgaactgcctggcctgattcttgtcaaacaggaggcccggggctgggaagttggatgctgcagaggagggtggtgtagttgttacttttggctgtgactaagtatctgagaaaagcaacttaagcaagggtttatttgggcttacagttagaggttgtagagaggcggctggtcaagtggtgtgtaaggtctggaagtggagagagaagaatgctggaactcagctcaatttctcctctcgctttagtgtgggatgggaccacccacattcagggcggagttgtgtcccccccccccccccccagtctgctagacctctgtggaatacacagccacatgcaagaatgcttccctggtgatttggaatcctatcagtttgaccagatttaactgtcactgatggagacagcctctcccctgcctttgaagccctcttatccagcttttgctgtcttagattaattgctgctgagcattgtgggctatgctgagcatcatgggaaggtctgttggcctgcatcccaggctatcttgatgttgccactctaggaatttcgagtctttttaaaagtgttgggtgttctttatgagggcttgaataaaattgaacatcatgttgcctgccaagctaaacttcactggccacaagatcttgttctgggtatatttctgggtaggcctttttaacaactactgtaggagttacctagagaacctagctgcgcacctctcaaggtttctctgcttgatcaaaaaaggatcaactcttagttctgctacgtgggccctgtggttcatgctcactttgtcttctgaggtggggctggggctgtgcccttggtgaattagggtgtaactaacttgcccatacacagaggagctaatttgtctttgtagc

SEQ ID NO: 30034 - DNA, 1171 bp, Mus musculus
ccatgcgcctagtaacttccaccacttgctggccttattgttacccactcctagaaaatggcttacctccacccaggcaggcacagaggagctgcatagcacttgcccagccccaggtcctgcctgggtggtgagcaagaaacacagcaagaaacaacagtccattagagagggcctctaaggggtagatcagcacagtgattgttaagatgctaggggcccaggctggcacagaggaaacattcttgaggacttgaagcaccgaggaggctctctgagaggagagggcagaaggatgggtggtgaactggcccaggtcaagggacagaagggagaggacacacagttggaaagacagtggctggttttacagagtaaggatgaaagcctgtgttaacatctgatccttgggctggcgagatagctcagcaggtaagagcactgactgctcttctgaaggtcatgagttcaaatcccagcaaccacatggtggctcacaatcactggtaatgagatctgatgccctcttctgtcaactacagtgtacttatgtataataaataaataaatctttgggagtgagcaagcggagttgactggagtgagcagagaggccctaaaaatttagttcccaacaaccacatgaaagctcacaaccatctgtatagctacagtgtactcacatatgtaaaataaataaataaatcttttttaaaaatttgatctgggggctggagagatggctcagtggttaagagcatggactgctcttccagaagtcctgagttcaaatcccagcaaccacatggtggctcacaaccatctgtaatgggatctgatgccctcttctggtgtgtctgaagacagcaacagtgtactcacatacataaaataaaatggactatttgtttaaaaaaacaaaacaaaacatttgatccttaaaagtcttccaaacaattcgttggggaggggcagaggtgcataggaatgttttgatagaacccctagagtgtatcagagcagccccagattctttgggcaacccaacaaatacacatcagggcctctgcagagggctacccatgggggtccccttggggtcagcagactcagctgcaggtcataccttaggacagataatgacttgaccctgcctggaagtgggccatca

SEQ ID NO: 30035 - DNA, 1225 bp, Mus musculus
gtcaagcatggatcttcaacgtgtgtgtgtgtgtgtgtgtgtgtgtgtgtgtgtgtgtgagagagagagagagagagagagagagagagttctgggcacttcagttcacacgacgtgggttgggtttacctcctgagccccttatacaggttgggacactttgaaaacctcacagttaagcagccatgtccaggattcttcatgagcagggcaggtgagggacgtttaccagctatggctgctcatttcataccctgctttgaatgttgcagtctcccattgagatttgtgtcctgtgcccctccccatcccctgcccttgtgctgctgaccgcctcttctctgcaggtgcctgtgctgaagcccatggacctgatggtggaggtgagcccaagaaggacctttgccaatggccacacctaccacatcaactccatctccgtcaacagcgactgtgagacgtacatgtcagcggacgacctacgcatcaacctctggcatctggccatcactgatcggagcttcagtatccttggccttgacctgggggcgaggggaagtggcttcagggtgttatgtaagcacactggcttgggggggggggtgtttgtcctcgactgctcccttactgaagaacctgtctcatctccggtgtaaaagaggatgagtgtgtgatcgcaaattgtctatttatgatcaccctaaagacacagtggcagtgatctccatcaccttgaactctctaagaaaccaggaaggagcaagagagctagcaacaatgcgccctggaggaaaaaggaaggctgaccaacccccaggacagtgacctggaggttacatccctgtgtgttggtccagtgttgtgtcactcaagatgtaaagtgacaactgcagtgtcagaagctagggtttcagaagccaggcagaaatggggtcttggtgtcagaataagtcaaggactgggcactgcctctcctccagcctgcttaggaaggagctacttccaggacattgagcatagtgagctggggaaggtcagggccgacccagggtgggcaggctgctactgtgtcactgtacagctgtactgagtgaagtttcatgtgttgggctctcagtgaggtaggcactgtcactgaaagaaactagtggggaaacccccactcaactcctgattcggcgtgcacccaggaatcaggaacagaacagaacaccttgaagtagtt

SEQ ID NO: 30036 - DNA, 2977 bp, Mus musculus
tcaccaagaagatcctgcacacggcctggcacccagctgagaatatcattgccattgcagccaccaacaacctgtacatcttccaggataaggtcaactctgacatgcactagctggcctcagtggccctcccggccacctctgtaagaggacaggatgagtgtggtggccatttgtggggacatgagtcccaaggctggagttggcttggatggtaattgccagtttaaacaaaggaaagggggaagccccagttacaggcggataaagcagatgtgcccggtccagggctcctttgtttacggccctcctgtctctggctgggcctttcattattatcaggactttattcatgtccagggtgggtcagttcctatcagggaaagtcaagctggtccatgatggggctccagagaaagttcatagggcagtcaggatctgcagatcctcaagggagccagccagccatgtgcgctggctcagagctgctgcttcatgttggattttggacagaattctcactgagtgctggttgtggcagcttgtcacttgggtgtttggaatgtctttcggtattctaggtgccaggcctgggcaggttctgagaagcagagccaaagtcgtagggttaatcgtgaggcagggccgggtccctcgggtgggtttttccaggctaaggcaagtcctgagaagcaggactggggaccctgtgtggctgtggccctcacctcactgccgtccgtttgtgagcccactgcacgctggacatggtgctcagcccatggtggctgtggctggatccccgcagcccactttgtgatggctttgctgtcacccttccatgctagccagtcatcttccccatggccgacagccggtcctgtccctgactgtagaatcctcatgcccacgagacaggtgtccgctcatttccataactcccagctgagatccaggctctgctggagctggggttagtaaccgtcccctctgaatacaggagggaaccaaggctctgagcagagaagtggggtgcctagggagtcataccccgagggctgagctggtgtcccatttccaacccgccacacacgggtgactggttttcaagcagcattccaagggaaggttttagaagggaaacatttccacgccaggcattcagtgcaggcgagctggtgacaagatgtcacaagagagagaagatggagaagagtggcatccttgcttgcctctcaagatgcacgtcaccgacactgtacctgcagctttctcctcacccttccggctgctccccaaggaggttgcatgcagccaggcagccccagaggacgttttctcagacctcctcagggccacaggtgagtggccattcatttcatagtgacccctactccatcctcattcctgaaatcccagaactgcagggcttggcgttttgaccctggaagcagagagcagaggggctttggtttttacaacatggactgccacccaggaaacagatgtgatggagttttttttctctctctctctctctcagtggatcaaggtatccttgtgtgtgtcaaagcacaaaccgcatgcacactcacttctggccatgtatttacacagaaactgggtccattacattttttggctttttttttcctaagtcaacgtgaatgaagaatgtttatcactgtaaaattcaggcgctctggacagtattatatgtacatattgaccctgattcaagctagcaattaaaagatcggcgactttcccctcttgtaaagaagttgaagaatgtggccagtcgtatttaatcccattgaagccaaaatcctggtgagagggccttacacactggcctggatctctggcacacccatctgcctttgcggtttggcgttagagaagattcgccttggaggctggaggctgctatgaggtcataggtttcacacataatgtcttcaaagtcaaatcttacacggtcttcaaaaggaggggtcttgcacatggccctagtttccagacttctgtttgaaatgtcgggtatcaaagtagaaaggaaaaagagagacagaaaaagatctcagaagaaaaaaaaataagtctttgggacccgaagaaatcacccaggttcagagcggactgctaataataatgtgtgtattgatcgaggaaaaagtgcggaggggggaggggcggtgtgaaaaatggcagaaggaccagagccttgcaagccacagactttgccactttactctgcttaagttctctggtcttgagtacgtggcatttcccataatcattacgacattgttggggttttgagtttgttttcttctgctttgattcttctctgagggtgacgcccttggagggtgttgggtatctacgtgctggtaacatagtcaggcccagtcacttggggttctgtggctcataggtgcattcttttttttcttcggtgtctcacaaattatccaactgttgaataaaattataaatatgttaataccagctttttccaataaaataacaaatgttacatctaagatgaggctcgcaaggctgctgattagtgaattgaccagggtggggagcagcctcggggagccagtggggtgggcagggcagggagcagctcccatcaagattgggctgtgtctggctgtgtcttcgactccaaccctaacccagatgaaggaggaaatagagtcagtggggacaccaagcttggcatctgcctggaggagggggtccccagatggtacctgcagagcccactgcctggcacttgtttcatgatgggtggcctgtctccctttgcagcaggtgtgtttaactcaccacaaacccaggtaaggacactaaggctcacacacaagcatccacagagtatcctagtttaatgcgctatctgggggcagcctccactctagtgccccctggtgggctcaccctgcagaggctgcaagttctt

SEQ ID NO: 30037 - DNA, 1234 bp, Mus musculus
gtgcacggtgccctcaagtttgccttcgacttcttcttcttcccattcctgtctgccgcctgaggagcgtccgccgctggaggaggctttggtgcatgttgctgtgaagtccttccgtgtggccacccagccagctggagcagcactgtgccgtgtgtgtgtgtgtgtgtgtgtgtgtgtgtgtgtgtatgtgtattctgctctcgtgtggttagatcccaggctctctgctcacctgtagatcgcagatcctgctggagggtggttctctttagcactgtccactttgaatgccgagtgtcataagaaattgcatgctatcttcactcacaatcctgcccttccctcacagagctggaactccaagcctggccccaaagaccctccatcacgaagagcactttacagataagaatcttcctccccagttcttcatgcctccttcctgccctttccttactttgtgttggatttgttttccaaatatgtgtgtatgtagacttcatggtagtgtttcttatttatttggttgctgctaagccttgacagtggttcaccttcctgggctgtccccagtggtcacgtcctgcctggcttcctacttgggtatagcatgtccaaactgggctctgaacactacagcctgccttggagctggcctatctctgggggtgttagagagtttgtggggatctcttctgagtaccccaggacttgggaaataatgcaagagtatccctttcagtacataggtaagcttggctatgttcaatatggcagagccaaaagccaagttctaaggcagccgaaataaaaagctttgaaacctatagccttgccttctggtttgattacagggagccttgtctggttgtgtgtgtgtgtgtgtgtatgtgtgtgtgtgtgtgtgtgtgtgtgtgtgtgtgtgtgtgtgtgttcacacgcgcgctcgagcaacatagtatgtatgaacccagattcagtgaaaatgtgccagttgggtgactgaggatagaactgatatcccgcacagttgacaccatctgctatatagctgattggcaccatccaggtgtgagggtccccgaggtcgcagcagtaacagcacatggctgttgaccctggccttggggtgaaaagtgctttctttgtgtcgaggatcactgaaacccaggtcaccaattgggtcgtctgcatgagtcacagtctggggtttgtgctgctctcttcagtc

SEQ ID NO: 30038 - DNA, 1221 bp, Mus musculus
gatgcaataggcttgtgcaagtccctagtcaccttagcagaaggtgggtgtcttagttactgccattgctatgagggacaccataagtaaagcaacttataacagaaagcatctaattgggggcttgcttacagtttcagagtgttggtccatttctactacgatgtcaggcaggcatggcgctggagcagaacagaagctgagagcacccatctagatctgcaagttgcaggtttagaaagagaacacgactgggcctggtgtgtgctttcaaaaccttaaattccacctccagtgctccgcctcttaaccctgcctaaacagtccacaaactgggaaccaaaccttcaaatatgggagcctctgagggaacattctcatttaaaccagcacagtgggaatctcaggatggaggtgtagggcttaggggaaggcaggtctctagggactgtggagtatggggaacactggagtggaggggggttgctcctggaggacggatctgttaggatgaggcccaggagtgggaaagtctagggtgtggctttgtacagaaccagggaactagaggcagtcatgttagatgccaaggggctcctgtcccagttggtttccgctctctgtcccccactaggtggtgaagtaccctttacacgccatcatggagatcaaagagtacctgattgacgtagcctccaaggccggcatgcactggctctccaccattgtacccacccatcacatcaacgccctcatcttcttcttcatcatcagcaacctaaccatcgacttcttcgccttcttcatccccctggtggtcttctatctgtcctttgtgtccatggtcatctgcacgctcaaggtgttccaggacagcaaggcctgggagaacttccgtactctcaccgacctgctgctgcgcttcgagcccaacctagacgtggagcaggccgaagtgaacttcggctggaaccacctggagccctacatccacttcctactgtcagtcgtctttgtcatcttctccttcccgctggccagcaaggactgcatcccctgctcggagctggccgtcatctccaccttcttcacggtgaccagctacatgagcctgagcagctctgctgagccctataccaggcgtgccctggtcaccgaggtggctgccggcttgctgtcccttctgcccaccgtgcctgtggactggcgcttcctgaaagt

SEQ ID NO: 30039 - DNA, 1187 bp, Mus musculus
cctcatctcttccaggttctggtggcagctacctgttcttgaagctccttggagtgtggctgactccatcgaatctctgccttcacccctacatctccccatatctctgccctgccttgtcttaaagacaccagtccttgtatttggtgcccatcctaacctgtgggtgtcattttcatgtctatcattgtatctgcacagatccgatagccaaggaaagccatgctctgactcagcaggctagcatagcatttgggggacactgttcacctgtgagaggtgccgagggtgacagtgataatggctgtagtagtagtggcttctgtctctgacttttgaatcttccaaactttgtagagcagtggagcccacagagcttcaaaagacagaggtaggttgctgcccaactgtgatttccactgccttgcacatccttggctctgccttccagaaccaggcttgcagtgtgaggaggaggagagggctgggaggagccaccagtgttctgccaatcagggcacacttgcctctctctctgagattgggtttgtgggtcatggatggaccaggtctattccacaggattctgctggtggtcacaggctgatgacctgctagtaagaacccaggttctatctgtggtcaagaggaaactccccaacgattggacccgaaagctttaaagccttcttggtctcctggggctggggctgtgagctcactaagtgctcttagttccagagcgagccttaggatgccaaacctgaggtgttaccaggaccatgtggtttgaaggctctggaggagggtcctttccatcttccctagttcttgggttgcccatagttctttgttccatggctgtgtgacagctgtctttgttaaaaaaaaaaaaacaacaaaacaaatcaatcaaacaaacaaacaaaaacaaccaccaacaacaacacatccagagatcctagagaaggtgtagattctgggtgacactctaaccaggaccgtgtcctcacagaaatacttccctaatggttggtttcccatgagtatgttgaaggatggtctggggttcctctgcaaacctctttcagtgtggttccctgctctatctggcctgccaggctaagctctgtcccctgtttggtgtgctgtcccagggaaggctggatttgactggactggagaaa

SEQ ID NO: 30040 - DNA, 1529 bp, Mus musculus
agatactgcagaaaggaagcaatctgtagctccagctgagatgggtctgcacgcacctcacttcctcttgggaccgggggacagaagaaaaggccagtcttgagagaggggatgccacctgccttagagagcgagacaatagcatcaagtgcctgggatcattggagatggtggggacatgccttgagaatgtaacatctccactgtcacctctttttggtcctcttgccttggtctcttgctccctcagaacggccctcttacccacaccctccagtttcacacagtatcttgatgctgtctagcagtctgattggagattgaagacccctgattccagcatgcatgaagttctgcccatctgggtcttagcatcactggtattttcctggcctgaggccactggttcacctccactgctccacagtcatctcctgtccctggttctggctgtcagggtcccaaccaggaccaacttttggccttggtatttctatctgttggctctgatagaaggatgtgtgagtcccaaggccaatgttcttggcatagccatggagttcccctggctatgttctgaaccactcagaacatggggaccacacttgcctgtcacataccacaagaggtcctctgtgggcagggagggcatagaaggatgctgttcctaccatcaggcttcactgaggagaggaaactttcatctgaggagatgcccacaggtcacctgccccttctgagggatgataagggcttccgtaagctttcaaaccagccgtacttccataggccagagatcattcccactcaggctatctcttccaggagcagcatcaaggattccccgtcatcactgtcaacatttgggtatgatcactcattgttcaggtgtgaacgttgctgatggcaaggatggagtctatcatgtcagaggcagacccatttggagatgggaggttgtaggtggcacacactgtttcacttgagatgagagctgtcactcagtgaaaacacaccttcaggttagctgttcttaggaaacacctctcgaggaacaccatcgtgtctaggagtgacgtttgaggcttttgagagctcctgactaaggacttggctggggcagcaaccaactttccttcttcctcccctacttccatcccccagcctcctgtgccttaacctcctgcacgtgagccaaccctggctcagcctgaataaagagttctactccaggagttgttcttgcctgtttcgggcatgtgggaacccaggctgtcctgtgcattgaaggacaatgggagcaaccctgggctctacccagtagatgccaactgtacccaaccattcatctcagtgacaggtcaatgtgtgcctactctggcaagcccagaacagcacagcccactggtttctgtcacttaggagtcctctcagaaatcttctggacttcctgggaattttaggaaaatgacaactggctaattagaaagcagctgtgtgtgtgtgtgtgtgtgtgtgtgtgtgtgtgt

SEQ ID NO: 30041 - DNA, 1240 bp, Mus musculus
accaattgactaatccatccatgcattactatacctatctacttactcacctcccacttttctgtctgtacacccaaccacacatattcctttctgtctacatccatccatctatctgcccttcctgcctcccacctgtctgctcatctacacttttactaattcactcatctatccacacacttttatacccctatctattcacctatgctatttcactcggatttatgggtaacttactgcctctttcctttaggctagaaactacagatactgagttgaattcaacctcttaccttcaagaagctcatgttctcttgaatcgacctcatatttgaaaacctgtgacacaagtcagccatgttgtgctacattcccattcgtggtgccatagtggtcatgaagagggtagaaaggcttcattggcaaaggacatgtccagttcatgatgggttgtgacatcagagtacatgtgtccgcttggggactaccttttgctaaatcacagctccgtcttgaacaggtctggagccaggcaagcctagacagttgtgcgacttcctgtgcaggcctgaacaaatgtctactcccgtcaaacagggtaccaatgatagataccccctccagaaaaatctaccagtcgagtttgttgaagttattatgggagtatgggagcatcagaagcatctacatcaccattaaaaactcacagcagtatgactgatgactcccaatagcatcccttgggctccatgctcaacttgcaggcaattccatggaagagccccctctcccaaacaattgttactgcttatgtaactttggggaggagccttgtgagtttcatttactctctgagcttagctgcttttgtttacttcttgagtcttacgagcctctctcctccctctaggagggagtgttcatttggaagacattgttacacagttatcttgattctccacatggtgcccttatatcctaagtcctctgagcacctcctcagagtgggaagagaaaagtagtcagggcaccggttgccaacctgagagatgtggtctgccaggcacagccaagcaagtctaaattgtcttcccagtgaaagatggttgtctagaccatgtgacctatgcccgcacacatctgaacacctgtgtcctctacaggccccgcagcctagagagagtgtctgactgctgcctccagactccacctgccatgcaaacacaggctatctcct

SEQ ID NO: 30042 - DNA, 1190 bp, Mus musculus
aacaagttcagtgtggctgagctatgaaagggggctctggcctaaaagctgaggactgacagccatctttagtcataccccttctgtgtgttcatcctccagagccctgtggaccaacacaggatagacctgacccaaggctacagctctgcttggcctgtccacatctgtcctggtggtgtgttctgtttagcccattccttagacctccttaggacctttgtgtctcccagcctaggttcagcctctgcttctagggagccaaacacaagatgaagcccttgcatccctgcttcctctgcctgcaacatgttttgtagtctagtcaagtgtcagctctatgtggcctctgcagaaatccacttcttatgcagcacctgtcacaaaactgtgtgtctctctaccaccatggcctagggttgaaatttgccgttctagccatgcacacacatcccttttggcttggaaagaagccagcatctcctctgacctgtctcttcccacagtccaaggcaagaaagctgcgttccaagggcagaggcaaggccgatcttctgaagaagaacctggaggataagatccgactattcgaggagcgggcccctgtagaactggctgaccaggtagggctgggctcgcttacccctcctccacacctttctcatcctaacacccagcacactgtccatcctcttctcaaatatgctgtgcaggcatgctggcattccacagccaggaccatgtgcaggagcattcacagggtaccctatcgctgtacccacagggcacacaggttggagtgatggatggattctgcatacttagctaaggccacagactgattggggccattgaggcagtggaagaaatgtacgtttccagcaccagtgcccccagtctgtagttctctaggagaaggaggacccaccagagtgaggtcagatgctttcaagagagttgtggctagagaagggagactctgtggaagaaaatgggtagccctggcttgactaaaggctactactgcactggtacagaggcagcccaggggatgtgggacccctcagaaaggatgctctatgggtgtgctgagccatgaggggtgtgtgtgtgtgtgtgtgtgtgtgtgtgtgtgtgtgtgtgttgggggtgtgctgagacaggaacttggtggagcttgtcagatagta

SEQ ID NO: 30043 - DNA, 1109 bp, Mus musculus
ggttttgtgaaagaagcccctgagagccaccactgaagacccacagcaggtcccttctataccccattctactgctgcccagtgaacacagagcctggagccagagcctcgttatcgggaaagaaatgaagacaataaatgtaaagcattcaggaatagtgtccaagctcctttgtgtgttgggactgtcgataaagggcgtgtagctttacatgagcgtgcggtaatgctgtcatctactttaagggtagaatttgcttttaaacgttatggcttgaaaacgatgccccgctggatgtagtgtttaagagaggagtctttaagtcaggggaaaaaaataccatcaggataaagatggtcctggttacactagcattgccaagctcgagctcagatctggagatgtcacaaaaggaacaaagaggaatcagcacacacccagtgaggcaagtggagctgaaacccccgcacaaggaaagcataaggaccagctagctccctaagatcactcctgaccccccataccaacaagcaacgctctcacaagactcccccaaatcaagagggggacttccactgaggagtcttgccgagacaaaggtgtcatctaaggcgggggaggggggtctccagcatcaccaaacccataatcacgagggtacattgtgctctccctgccttcctcctcctggctgagcccgcctccacctctccacgcgcacaaggcgtttcttttgtttcagttgcagccgaagatttaggggtgcacactcagcagcgcgggaatgtcgcggggggctcataccttatctgggggtgggaactgcagctggttgacatcgaggggcgtcatcaaaggaatggtgtcgaagccatcctccagcagtggctgcttggtgcccttctctgcgaaattattccccaacttcaccatggttgcgaaagacacgaggctgcggcctgcggagggagggccgcgcgggggtcagggcgagccgtggcccgaccgggcggggcacagccagaaggactccgcacacccacccgctgtctccgcggtcgctgtccccgccttatctccccagagaggtagcagggacgcggcgatc

SEQ ID NO: 30044 - DNA, 1241 bp, Mus musculus
ctcagaagggaaagctgtggtggtagctgcagtttaaagagttggggctgggtcagcacacacatccccagtgcattagaaggcgctgctattgtgagtgggagatctcacagcacgttctcttttctccactcatactgggtcttgacgttcctagtggtccacagtgagcttgcctgcagccgcactgtttgctgggctcggttcaagccaaatatttgctctctttgtgcctataggcaggttattaggcaagagaagaccaaaccattgttgttgtccactttgacgacatcctttgagctgacttttgggcatatggagttagctcatatttattgtgccttgccgtagcaagtactttgttggcacttggagacgtcccctccacagaaggtgcccagcatcataatctggctctgagcagttgctgtttcctctaaaataggactagcgtatccctctgttcacggtcacgttcaggggtgggactcttcaggggaaccagccaacactgctctcctactcagagcagtagctccatagtggtgcactgtgagattctgctcagacaggacatggctttgggctggtccatcatagtgcaggggctgatgaggcggggattaggaaggaagtcccacggagcatggaagcagtgagtgccattttgttacacacccttcccggctcttccagggtccagtgagggtgtcagttccctcttctggtgcacccacccccactatctagtttactcattcactcttacttctccatcacttcctgcatcttcttgtgggtggccccttcttccctggatgatgactttgggacagtctcttgtctgtcacaatactaacaggagcccccagccgagtgtacatctgtcagtctgtctgttgcatggggttacctaggagctagtagcccaccctcctacttctgggaatgactggagcgaatggtggtgttcacagtggattgtgatgtccttcctgatcttccagagtacactggactactaagttcctaagggctttttctttggagaatttgaaagtctgaaaaagtctcccagtaggaatctctgatcctatttcctaaggatgtagaagggttagcctgtctgtcctagccacagctttactaacgagccagatgactctgtagcagtcagccagcatcatctgggactgtggtgatgatatgctcagctgttcatagcgttacattctcta

SEQ ID NO: 30045 - DNA, 1147 bp, Mus musculus
taactgtccagtgcccagttccttcaccgagttggttatggttctttatgttgtgctgcagatggaattctcctaatgttcacgtctgaattggtttttttgttgtttggttggttggttggtttttgtttttgttttttggtgtataaaaaagcagcttgttctttaagaggtgagtgtgtgtcctgcagctctgctgaatgcgttgttaattctaactggctgtgtcctgtagcactttctacatgcaagaccacattccctcaaatactgcctgtacacgtgtgacctgattttgttctttctgttaggggggctttggcttctttttcttgcttaaccactttggccaggactccagtgctgtgctgaataggagaatgtttgtcactatgcatagatgtaaatatagagtcttagtttaaaatgtgagagccctttggccatgccaaggacttgagtttggcttcatgtaattatgtcacgtgtttattttcttctatcttaaatagaaaattaatgagttaataaagaaacccaacgtcagccccaaggtgcgagaacttttgcagcaaatcagtgcttttgataatgttcccagaaaaaaggcgaagtttcaggtatggatttaaatgactttcctaaaccatggtgtgacccatctgtggcctgcagaggaacagtggctctttgtcttgtgtccacagaactggatgaaaaacagcctgaaagtgcacagcgactccgttctagagcaggtgtgggatatcttctccgaagcatccagcagtgtgagtcaactccactttgccactgcaatatggcagagaactgggaataaggaaatggggtgccatgtgtggggatcaagatggcatttccagggaagctctgtgctctctccctgatgggcaggaatgatctgggagcgcctgtggtgcagagacagccattcaccctacatgcttggcaatggggcctgtgtttgtggaatgattggcacagcagtcaggctgaatgcaggggagtggtccaggattccatggctggctgacctgtttctggcccctgtgtgttaggtcatggtcacatcatttagcctctgagcctcagcttcccgatctgaaacacgaaggctacattgcac

SEQ ID NO: 30046 - DNA, 1265 bp, Mus musculus
atcctgttagcaagccgggtggctttctgactttggacctgagtgaagactgcattgcctacaattggctgtactggaaatgatggaaagtgatctttccatgcaccttgctctcctgctgatgtcaatgactgctgatgctttttccagaaaagttttattgcatttatttacgtgtgtgtgtgttctgtacacacacatggacacatagaggtcagagaacagcttgtatgagtctgttctttcttctagtatgtagccctagggaatgaacttgagtcttcagccttgcaaggcaagtcccttcacaactgagccatcttgccagcccttttctctttgaggctgtagctctgtgtggcatacagttgtgtgcacactgaggcagctgcttatcttcatgagcattagcagagctcacttgtgtgactggcatctgaatgtcttttattttgtaatgttggtccacatctgggcctttccccatgtacttcatccccttgacgtgtgtttctttttgtcaaggttatagctcagtaccatgcggtgatgaacgaccatcacacatcggaggaggagctcctggccatcttcaacaggaagatcagcaggaaccccacctttaaggtgctgaaggacagagtaaagcttctgaagtgaggctctgtggcttcacactctgtcatcctattggctgcttccctctactatttgtaaaatgtgtagtgaattataacaacctgaagattgctttctgaaactgtttttaagttaagggaaaaagtatatttttgttaaaactttcatgaaaaaataaaatatatccttgtcgaattctgtatctatgataacaaattcttgtactttaagaaaatactgcagggaaactttacacagtattgtaatgataaatgaaaatagatttccatttgatgaggttggggtgttgtttaggcctctggccagatgctgcctgctggagatccagtgcagatccctgaatggtggtggctgggattttacctgtggtgatccttgattaggcaggggtgacaacctgtagaggaggccttactgtgacaggatgcagatgcagccaagttgtcaggacgacagagagaagggtgactataagcacaagaaagctggtctgcgtgtctactgacaccctgtgccacctcgtactgacagttgacattttacccacaaatcccttaccttcagcaagaattatcccttggccagtgtcattattcactcatccc

SEQ ID NO: 30047 - DNA, 1228 bp, Mus musculus
ttctcccccctcccccttccctgtggctggcgatcttgggttctgactgtttggctgtttctaggtgtttgggtgccttggacttccatgagcctggtgtgtggctggcggtgagagcagcatggtgctgggagccaagcatgtcctcttttccttttgaaatacatatctgtgtgcatgagtgtttgcttgtatatatgcttgtttgtatatgtatatatagatatagatatgcatcacagaggtcagaagaagccatagcatcccttagaactaggttaaagaggttgtgagctttcatgtgagtgcagggaattgaatcccagccccctgcaagaacagccagtgcccttcaccactacaccatctctccaggcacaccactttgtttttaatgggaatccatgagcctaaggtgtttcacttggcacataaatgctgttttcttccagacttcagaacatgaccatttaaagtgaacaaagcgtccagcttgtcggctgacgtgaaggagaagctcagtgtgcactgctgtctccgcagtgagttgttccatggagaaactgtgactctctagatctgctgtcgaaatcagaataaatgatctttctctctgctgttcaaaacaagtgattgcttctcagcagtttgtgttagaactagcgagtgttaacctgtcagcttttagagacagtagtagctcatcacaggagcacagtgccaacagttttacagattctggcctgttctacttgaaggctagctgcccttgtataggtgactggacacaagcatgacagaatcgtgttgtcaccgttagtagtcactggatagctcgtatttgtcatagttttttaagaagaggaccaaacggaagtatcttatggtttcttgttactctgggttttatcattatataagttattgggtttttaacatttttcaacttatgttcttttaataatgtttaagtatatataatttttttctgtaacatcaataaaatatttttataattttcttgtgcatttggttaatgcaaatttggggcttgtttctgttttttgctgttcatatttagttaaccagaaataatgtagcctctttttaggtaggttaactctgttcttaagtggcttagtagcaactgctgtttgtgccctgtaggctcccatgatgcctgtcataaacactgtgactcagagatacctgtgcatttgtttacctg

SEQ ID NO: 30048 - DNA, 1208 bp, Mus musculus
tccagaggttttggggttacagacacatgcttcccagccaggctttccatgtggtgctggcccagcgggcactctctggttgacagtcgccccagtcctcagtattttaaaccaaccagtcttgtccttccctttccctccacaagcatggagactgtgatacaaataagaaattcccccatatctggcaaatgagtggaaatggatcacttgggtagagtgaaaaaaggaaagccagcagggggatagcctggctgggtgcaagtggagactcacagaaggactggggcgtctccctggggattgagtggtggagtgatgtgggagaggccgagggaagacacaggtaatgcttggagctcgggatgatgcatgtgggcggaaggcaatgctggtaaggggggaaatgggaaaggcagggtaaattgagatgtgcaccagttgagtggccagtgggaaatatgtgcagggctccagagtgggacaggttaggtggaagtcaaaggtggtgacagctctagagggcatatacaggaagaagagaccgactcataaagagtctgagcaaacaaagagccagaaaaggagcagatggtcagaaaaggtttgagatggaagaatgaaatcctgtgaagtctaagaagccagagaaaaaagtgggacagggaatacaccagagagagttctgagtagagatggaaatggagtcagggtgtattagtcacttgctgctgggtaacaaataaccccaaacagagcgacctgaaaccacagggatttatcttgtagcttctctacggtctgctcatgatcctagtctgactgtaggctgttggctgaaagacattcctttgggatttgtctccagctcctttgtgggttgctgggtggaaaacaggagttccttctggctgctggcctgagacctccctctgttcttgtctatgtaagctcttcatagggcagctaagctagaaggtgccggcgctagcccaggaggcagcgagatagaaaccatgcacgaagtaggagaaaggacccaggaccagagagggggcccaggtatcccagagtggtcagtaggaaggaagaaaggaagctgctgaggaggggagggcagtgtgtaggatctttgagtggcaagagcatctgctcattgttttaagttttgttgacttcctttgctggttgctctcatcagcgccctc

SEQ ID NO: 30049 - DNA, 1311 bp, Mus musculus
tgtatacatgtgcttatatatgtgtatatatgtccatgtgtgtttatatgcatgcatgtgcatgcatgcatgtgtgtgtgtatttgtgtgcacactcacacatgtctgtgtccatgaatgtacatgtcttcctaaggttcagaaaaagactcatttcagtgcagctcagatttcccagttttttttgttctcaacatcattctggcatataatacaaacaagaggaaaacagatagtttcccaaggatagtagtatttaaaaagtggtgtgcctgctgggtctcatgacctcataggatctgcacatcatcttggctattttaacattcttattcgcagatgaagaaagatggagcattgtttattatatagtttattcccccttggtgggtattggtctgttgctatgtatacaaatgctaaattctgaaccccaagatctggtagccttttagataagcacaaccttacaaacacaggcctttgttgtgtaaaccttgctctccaaattaaaactattggttctgggaaatggccccaaattcttgaagtctggtgatgctgccattgttgatatggtccctagcaagcccatgtgtgttgagagtttctctgactatcctctacttggtcattttgctgtttgtgatatgaggcagatagttgctgtgggtgtcatcaaagctgtggacaagaaggctgctggagctgacaaagtcaccaagtctgcccagaaagctcagaaggctaaatgaatattacccctaacacctgccaccccagtcttaatcagtggcagaagaacggtctcagaactgtttgtctcaattggccatttaagtttaatagcagaagactggttaatgataacagtgcattgtaaaaccttcagaaggaaagaatattttgcagaccattttgtgcgtgcgtggcagttttaagttattagttttcaaaatcagtaatttttaatggaaacaacatgaccaaaatctgccacagaattttgagatccattaaaacaagtttaatgagaaaacaaacaaacaaaactattggttaatgaaaggctagagcctgtgattgggcagaagagagagaaaggtggggcctgagaattgagtgatgcatctggaaagagaacacagggaagaaagagaaagagcctgaggtctcaactggacggatggacagacaggatggagcaacaacagcccaggcgggactgtgagtaacaagggacaaatggtttggatataggtgagaagagcacagaacctggccaatgtaggcttacagcttgtaaataaa

SEQ ID NO: 30050 - DNA, 1499 bp, Mus musculus
ctgtgaaggagtggacaatcacctactgaggacgccgctcaccccaaggaccgaatcagggactagagtttaactgcctcagagcacccttctcttaactatttctctaacgctccccttcctgcctgctctgggagtagggagggcctacgagtaccctcctctcttcagggtgtccgtgtctgtacgcgtccttctgagagctttagacagttacagtttgcacatgagaaataaagcaagcacttaaacagcatgtggagcgtacctaaaaccttacagcccaccagaccatgagagcgtggaacattccagaggcagcagcctccaaagcacagacccaagcccctgtggctcttgcagcttctcaggaggctgggtagggagcaggccagggctccccttccccatgcaggatgcatttgcactggagaggaggagccgctctacagccgccagcattctgtgtagagcaggtctgtttctcggtgtaagtcatgtcacatggctgcctccctggacccatccccagatcccatggggacatgtgaaccttgatctcattgtcagattttgtgcttgatttttaagaatggaatcatgggaatttttttctttttttttttttaatgtatcttgactgttgtctgtcttgttcctgacctggcacgctgacagtaccttgtccagataagtagagcccttgttagccagactgaggtgtcctggtcacgtgattaccatgcttcagtgtttccctgtctcttcccaactctggccccaagagcagagattaaggacaagaagatgttactgtaatttgtcatgtttttacctttttttttctttttcagtgcagaaattaaagtaagtataaagccccgtgattggcagtttctttgcgtgtgtcggaatcactggtaaatgttggctgagaacaatccctccccttgcacttgtgaaaacactttgaacgctttaagagattagactgagaaataattaaatatcttttctcttgattgtggatcactggctctatgtggcggtgcatgtgggaggatggggcggggtttggggaacccaccagccagcttctctggtggggtctttatgaacccacattgtggccatgacatggaaggacagcccaagagaaaccaagactcctagtcatgttcccatccctgcttccagaccccacatggtcttgtccacccactttcttagagcccaatttcatctgtaacagcgttgggcctgatgctgtccggatcctagctcaccctcctgccaggaactgggtctaggttgtttgagaaaacttgtgcagccaaaacaactcaaaacactgtgcttgggtacaggttttagtccccataaaaactttcctctctggttcttaatactgattctgccatacatgtgtaaaaggataacagaagtcaagaaagttagttacaccgtgggagatgcagaccacagagcaaggtcagaaa

SEQ ID NO: 30051 - DNA, 1160 bp, Mus musculus
tccactttgattttgctttactcttccagaatagttgctgcgtaatagaaattacatttttctacttgatgggtcatcttaaatctggttagagagctgtacttggcccctcccactgtgagttctagctgtgctctgcggagccgtgagctttgctttaattgggcgtgtatcagcaacagtttttaggagaagaaaagacagatttccagtatttagcttttgcttgcttttaaaatataattggttgataatagttgggtaggggatacataattggttttttggttttgttttggataaagaaggaaaaaatatatatataaaatcaagtctgtcctttgcatctaatactccaccaaacataaatggccattttaaattgtgaaggagcagattcattaaaaaacagattggcctcaatggtgccattccaggtagacttgaaagcaggctgtgtagggtctgctgtgactggttcttcacctggggactcagtgcaaagcctgagagtgtgccagcacacacttgagcataggatcatagggctgctccccgggccagatctgttctccttttgcctgttcctgagcaggccttcctggggaagagcctagtctccgtgcacatttttcctcatgaacactagcaactgcaggagtcaacaacatggaaagaaaaccacaattgtctgtgggggctttaagaacactacccctgttttcagtgataggaacaggctactcctagctcagccacagatgttcctctcttgcttacattttctaataggactgcccctccaccaagaggtgttaagactcagcgatctacaaggcacctttgcacattaggagaaagtttatctcctacatgggtagggcttcctgggcaagagcagctcaggcaaagggcactaaccagtgaccagccagtgaccttgagagtgtacatacatccttggggggacttagtgatggatgctgtgaggggagcagggggaggggtggttagatctgaaaatggtaccagtgacttcttatctctgggtgacttccggactttgccttttcacgtggcaagtcttagttcatcctctcacagttgggatactccttttaagctcgttttcattatacatacttggcttttcttgggta

SEQ ID NO: 30052 - DNA, 1150 bp, Mus musculus
atggaacagtggttaagagcgtctactgatttggcagacgagctgagttccgttcccaacacccacatggcaactcacaaacacctgtaactctagcttctggatatctgatgcccttctggcctcctgggcacctgcacttatgtgtgtatacacacagctacccctacccacagataattaaaaattaatattataaaaggcttttaatatagtggttggcagatacctattcactgcatttaagagataaggccactgggtctcatcattggaccccattttgcaaacccatgcaccttccacacattctccattgtccttctgatatatactatggtgttggcttggatgttcctaaacaattttagctgtcaaatgttttgggacctggcatatttattttagttggatgcttagaatatagttccctacaattaatctatggaaccatgactccttttcccccctcaatagacattagaaaaagttgattcctttgccattccccaaatctaaacttaaagggatgctcagggctggatggcgcagtgggtaagagcacttgctactcttgcagaggccctaggttctgttcccagcacccacatctgatggcttacaaacccagttccaggtgatccaatgccctctgctggcctctgtgggcagctgaatgcatgtggtacgcatacatgtactcaggtacacatgcacacatacaagtaaaagaaataaaatttaaatgatgcttagtagagaatagtaacacttgagtgcaattgtgaaagtgacctcataaccattattatagcaaccatggtgcgaaacaagccaaatggttacaatctgattatgttgctacatcagctaacagattttatgaatttgtttcagaacaatcggtcactgtttgtgaacatagctaaatgcagacattagcatttcccgttaggtccattactgtatttcgagtagctaagtgcccttgcttatgttttctaagggttaaagagagtggaaaccaggcttcagaacacttggtgacagtgggtcactattcttctctagtgtcattctgattgaggctgtgatagggtgccagtgacaaggtctaatctggacccaatctccccatgggaatggagtg

SEQ ID NO: 30053 - DNA, 1687 bp, Mus musculus
tgcatgaatgatttaacttgtactaaaattataaccagggtttgaatattcatgttgagttgagagtttttaataaaatttgtgataacttcagtaactattaaaattcataactgaatggcttccttaaaaaaaaggagacgacaaacaagaaaatcccaaacctatttaataaattctggccaattatttttaataccaactcctgtttcatctgtgatgtttgtttttagacattcaccagagctcagaaaacaattgctcagggccttttctgatgtcttgataataactcttttcttttatggcagagagtggtgaaggcagatattgtaaactacaaccaggagcccttgtcaagaactgttaaccctcctcggagctccatgtgtgcagtgcagtgagcacacactgtattgatagttctggctgctcttcccctgaattgggccccagctgcctaggaacgtgttttatcagtgactgtctccgtagccagctcacacttcctcctgctctgctccttcatcctttagttgcctgagggatcaggcagctccctggaccggaaggagtgcgatttggaaccacacgttttgaaatccgaatggagagtccattctctggattgagactgcctcctcactccagaagaaccatgttgcttccttctctcttcacttctttgtttcccagatataaaaaatttaaccagatatgaagctgctccaagctttgatgatcattttctatctgaacttgtgtatgtgaaagtgtacttcagagcgctgatggtgaaagcctctcaagaaggtgttcctttgctggctattgagagtacaatatacaaagctgtatctaattgaaagtgcttcaaatgaggctgtaatagaaatattttttcatttttaaaggagcctaatgtgtttatattgtagtttataactcacaagtagtgagtatttgatattgtatttttattactgtatcatggtcattgcatattttatcatatttggcttagatggctttatggattttgataaatggttcagctgatcctccacatggaatttctcctacagactgtatgagagtgcttccagatgagtcatgatctccttggatcattggggatcgatcacactggacctgttgtgcagatggttttctcagataaataaatttatttaaaatatgttttttgggattttcatttattcatcttccttttgttacagaaaaacaaagtatatttgaacacatggctagcaatcctgtgaagtcttgtgtgccgctagtttcttaagcattcctaggcattctgttggcttgtttatagttgagcctgtagcctgccatttctaggcctctatcagccccagcccatttttttccctaacccatgccactcttggttctgtgcacataaaactgtgaattcattcctatctattggctgcacacgtcccttagccaggaatcctcctttcttgtcctctcctctcccctcccataccctcttctttccctctcccttcttccacattgtctgcttcctgctctgtcttggtcataattgttctgtgttttgtgcaaaggcccagtgctcagtgcatacttgttactaaagtaggaatgacccccctacatccccacagtccacacatatgtgaagctcttctaa

SEQ ID NO: 30054 - DNA, 1177 bp, Mus musculus
aaatctgatttttctgttttaaggactgagatgatgatcaaagttctttatataccagaagccaaaactcctaaagtttcttttgcattttgttgttttgttttcatatcagctttccagatatttctatataacactgaaagtcaaatccagtaataattatgatagtaagaacaaagataaagtagttagttgtttttatgtttaattgtgtcaataatatttgggttagaggatagctacgttagtgaatgaagtttatttatttttatgagtctaaaagaatcttttgactgagagatatggggacacattggtctaaaatagggattggcaggctttcttataaagagttagatgtaaatatttcagggaagacttgaggttattatctcctttgcagtgaatcaggtctgcagttgtaatgctaaagcaaccactgataattcttaagtaaaacggcattaaatagaagcttatgaaatatccatggactggaacctttcttggagatccacatgcctataccttctgaatccttggcttaaagacatgtaccactgtgctagccatcagtacatggtggcatatgtgttctacttgcatgtgttctgtctgactcagctattgttctaccttgagtaaagattttcatgcattaatcaaaaggttccataatctcaaggattagttatcacatattggcctttgtttaatgagtattaaacacttcaaagttaccatgagtatgtgattgacattgaataataaaaatcatgtacagtgatgctaagaagatgacttagcatgtaaaaccagtggatattgttccagaggacctggcttcaattcccagcacccacagggcagctcacaactgtctatatcttctgttccagggatgtgacatactcatacagacatacatataatattggtgtacatacaaataaaataaattactaaaaagtcatgtacagttagcaaattgctaatttcacattagctatttggtgtgtgttcttagtctcttaattatatagctgtattaaacattcttaaatggagatcacaaagaataattaaaggtgtgtccaggcttagaatccaagggtagaactctttcagcagtaccatcactccctacagagagaggtcaaatcagtaagttggggag

SEQ ID NO: 30055 - DNA, 1190 bp, Mus musculus
gttttcacttaggtttgactcttaacattttcttctttgtcttttgtacattatcttgtttcttttgcaaagtctttctgcttatggttcatagttatatatatgattatatgacctaatagcatagatgtattaactttctaaagctgtatgtagctcatatttttttggttcttttttacaattgtttagagctttttcttctatggtgctggaacattaattccacagctttatacataccagactaaagctataccactgagctacatccccagcccttgttgtctcttattaaactgattatgtttaaaatagatattaggcagaagagaaatggctgggcagaaagatgcagagagccacagtccttgttttgcttatgagagtgggtagattggatttgaaaataacagatctttttctccttgtcacataaaatatatctacaggccacatatcagttttgatttttgtttgtaaataaaaattgagatggtctctcttctagtaatatatgactcactgtagcttactgttttaaatttaattgtgtttatgtatgcacaacatgtgccatggtgcacttgtagaggtctgagaacagcttcatggagtctgtttttgccttccacctttgtgtaggattatctgttgagctgtattgtctgctcagaataggtttattggtagacaaatagaagtaatttatgcattattggacagataatactaaagttgattcttctttgttttaaaattatacaatatactgtatgagttggattttgttagttttgctttactttaaattatgtaaaatgtatcatttaaattatttaaacatttattacttttacatgaaagtaaatattgtagtgaaagctacaaaatatgctatctcaggtgtctaatttactatattcataatattatgcaactatatccttaagccagtatatattttatattgttatatcagtgcttaaaatgtgaagtgtatagaacttccttcaggtttttgtttgcttgtttgcttttgattacttttttcttttttcttttctgagatatgatttttttgtttgttttttggtgtagttgggttgtcctggagctcactctttacaccaggctggccttgaactaagagatttgtctgcttcccaaggctgggattaaaggcgtgc

SEQ ID NO: 30056 - DNA, 1134 bp, Mus musculus
tgcaggcctctgtgtgcttcccccagagccctgtctgctctattcaaggttgctggtgaagaaccagacgttcaagaacttctggtattaaagaccgtggggatttccctccagggtactgggttaaaaactcccaagttgtttgaagcaactgacttttaactctcctcattaccttggcttttgctcaatacagatcaaaggcacagctctccccttctgtcaagcgcaagagagaagtcagccctcctggagctcgaacgagaggccagcagaaagtagacgaaaaccctctgaaaaaggcaaagcggtaatggtggctctagctttctgactaacaacccagtggaaagaaaatggacaagccttgccccatggcctttttctttttttaaaacaagagaaggatctgcatgtgctgtaagttcctaggtgcaagcttgttcattttatgttttaaacagctttacaaaccattgttcatggacggtattatgtacattcacttcagataaaggaagataagtttactttgtatcagaactcagcaaagtagttgtatattttaacagcagaaattggggtttccaatgtgacacatcaagaatggaatccttccagcccatcagacaccaggctgcccatggggatctgtgtatagtatataaacatgtaaaaacaggctgtattttactcaatgtatgatgctaatcaatgaacactttatttattttacagagaaatcttatctgtgaactttactatatatctgtttattttattttattaattttttttaataaaaagagggttttaaatgctatgcagtcattaatagaagagttctaggactccgagtgccctgtaactattagcatatggcctggcaggagacagaaattcacgcatgcatccgagtaaagtaggttagctaaagaacggactctgctgcttccgtccaaggccgcgactgttttgtctttcgattacccttgcccctgtggctctacctgccagccccattaacgtaagttacctggcccaggtaaagccacatctttcactgcaggcagcaagctctgtgggttcattgttttcatctgtgttcaccccaagcctcagccaccatctcca

SEQ ID NO: 30057 - DNA, 1301 bp, Mus musculus
ggacagcttagcaggtagtaaaagtcagggcaatggcttgatgatttctactagtacaaatgcttgcacccctcagataagtgcagtcatagatgtgagaggagggcatttgagcactctgagcactgaagaaattagggacggcgtcagagtacacagggaaggattcgaggctcctatgcccagtgcagtttcaggtgagaatagccagctcactgctagcagaagtgaagaaaaggatgagtgtgctatgatttccacaagcataggggaagaattcgaacttcctatttctagcgctgttacagtcacatgtgctgaaaggcagcaaccagttgcagcagttgaggaaagcactacaggtccagccttggtaagcaccgaggactttgaggtacctatgcccagtgctcccactgaagctgaaagccctcttgcctccaccagcaaagaagagaaggatgaatgtgctctcatttcgaccagcatagctgaagagtgtgaagcttctgtctttggtgtaagtagaaatgcaccatctgttacagatgggaatgcagtcatctcaacaagttcagtggaagactgtgaaggctctgtgtccagtgctgtccctcaggagtccgtctgtccctcagtcataccagtagaggaaacaggtgacactgccatgatttccacaagcacttctgaaggacgcgaagctgtcatggttggtactatccctacagatgatgaccaggccaccactgtgagaggggaagatttgagtgatgctgccattatttccaccagcacagcagagtgtgtgttgacgtgcactagcctaagcaggcatgaagagaatcagcaagccacgcacaacccagaaggaaatggtggacatttagctacaaagcaaagtaagtgtgaattacccatgcccagcctcgtggctgagcgtaattgtaagtgccctgggccattcaggatgggcaaaggagtaggtcctttaatggcagtaggcaccaggggggagcatgacaggctgccagtctgtgagccctcagtgggacaaggccagccaggcactgctttgtgcttaggagaggaagaaagtcatggcatggactgccctggtcaagacctcaatgcaaaagaaagaaatacattgctgagctctgttcagagggagagcaaaagtgcagaggcagaggcagcaggggacagtagcacagccaggagaacagtgagaaaggactcagagaggaatgccaactcactgtctgagacaaactgtctgagagaaccagaacagaagc

SEQ ID NO: 30058 - DNA, 1824 bp, Mus musculus
ccaggaagtaagtgtagactctgaagtgagtcggaaagcactctctagggccccatcagaaaacgagaaggggcagaagaatttgaaaggcatgtccaaaactaccgaggaatgtggcactcacagaaatgcttctcttgaatactctacagactcagacctcttgtcatcctcaggctctgtgactgttgttcctcagaaagaatctcacaattctaatacaattcctgtaattgacagagaagccatatcagaaggcggcagagccagtacctcccttgcaaatcattctgatgtccctaaccaatattcgactgttaagaagtcagaagtacataaaacaaatggcagcaaagaaggtaatgatggcttcacagtggatatgccaacaaaagcaaatggcggtagcaaaaggcatctttctgaagatagccaggccacattgctgtacagtaaagaaagcaaaataagcatacctcttgctgacaagtcaatgagtgtgactggggacaataagaacattaacaaacaaaggagcctgatgggcacagccaagagagagagtgatctgaaagtaaatcctgatataaagcaagacagtgctgcaggcgagcatgtcgtagacctgagtacaagaaaggaggctgagacagtcagacgtaagcataataaagaaataccaactgatgttgaaaggaagactgaaaacagtgaagtagacaccagtgctaggcgcgattctgctcctgtgccacagcaaaggcacgggaaaatggagaggggggcagctggatctggtagacgagacaaagcttttattgctactagtactgaagggacggacaaaggcatcatgttaaacacagtcaagactggagatgccaccaccacttcatcagaagtgggagagaaggggacagccttaccttgcaccagtattgaggcggacgaaggcttcatgatgggtgcttgccctaaaaaacatcccctccaggttggggcagaagccagtgaatgcactgtttttgctgcagctgaagagggtaagggtgttgtcacagaaggatttgctgaaagtgagattttgcttacaagctccaaggaaggagaaagtggagaatgtgctgtggctgagtcagaagacagagtagcaggtcccttggctgctcatacagttcaagctgaagccaatgtgaacagtattacaacagaggaaaaagacgatgcagtaaccagtgcaggctctgaggaaaagtgtggtggatctgcatgtacagttgaggggacggctacttttattggtgaagttgaaagtgatggagctgttacaagtgctggaacggaaataagagcaggatctctgagcagtgaagatgttgatgggtcccaagaaaataggatacaagttggtcctaaaaaagaaacagaaggcactgtgacatgtactgaaaccaaaggaagaaatgataacttcatttgcttggtaactagagtagaaacccaagagcaacgtgtagttacaggtgcagatgtggtccaagtaaatgctgctaaaccccaagaggcaaatgccaatcaaggagatggttctggaactgatggtgcagaaggtgagagtgcagtcaccagcacaggcattactgaagaagatggggaagcatcagcaaattgcacaggctcagaagacaacagggaaggctgtgccataagttctgaaacagaagaaagtgcagagagtgccatggacagcacagaagccaaggacattactaatgcacctttggtggctgctggtccctgtgatgatgaaggcattgtgaccag

SEQ ID NO: 30059 - DNA, 1178 bp, Mus musculus
acttactctgggctacctcatccatggagcagaagtgcctcagatgttctagagctcacatagtagctatacccaaatgttaagtttgtatctaaaatgtgttttctaagtatcctttgttttccaacagtactgtgaaaaagaaaaggcctcttccaaggacctcaggcacactcatggaaaaggtgaaccaagtagacctgccaggaggctgtcagagtctctgcattcagcagatgaaaacaagactgaatcaaaagtagaaagagaatataagcgacggacatccactcctgttatattggaaggagctcaggaagaaacagataccagagatggaaaaaaacaaccagaacgctcagaaactaatgtggaagaaacccagaagcagaaaagcacccttaaaaatgaaaagtatcaaaagaaagatgatcctgaaacacatgggaaaggcctacctaaaaaagaggcaaagtctgccaaggagaggcctgagaaagagaaagctcaatcagaagacaagccatcgtcaaaacacaaacacaaaggtgacagtgtgcataaaatgagcgacgagactgaacttcactcttctgagaagggcgaaacagaggaaagtgttcggaagcaaggtcaacaaacgaaactttcttcagatgatagaactgaacgtaaaagtaaacacaagagtgaaaggagactgtcagtattgggtagagatgggaagccagtttctgaatacactataaaaacagatgagcatgcacgtaaagataacaaaaaggagaagcacctgtcgtctgaaaaatccaaggctgagcacaaatcaagaaggtcaagtgactctaaacttcagaaagatgctctaagctccaagcagcacagtgtaacctcgcagaaaagaagcgagagctgttctgaagataagtgtgagacagactccactaacgccgatagcagcttcaaaccagaagagcttcctcataaggagaggcgacgaacgaagagcttgttagaagataaggttgtgtcaaaatctaaatcaaaaggtcaaagcaaacaaaccaaggctgctgaaacagaagcacaggaaggtgtcacaagacaggtgacaactccaaagcctgataaagagaaaaacacagaagacaatgacacagaaaggcagcgcaagttca

SEQ ID NO: 30060 - DNA, 1455 bp, Mus musculus
gtatcttcattatatttagcaattctttcatgtgtgtgctgcctcccctttaactgcttacttagtgtacaggaaactaaatctctcctattcatttttttctgctttcttttttccttctttaattactcgtcttagtatttttttcttatccttagcacttaacatattccctgatgattgaaattccagaaatgttaaagtatcgattttgtacttacagtaatgctcttacccatctatctgtatgtatagtttaatgcttttcaggaatttaatagtcttcttccctcttgtagttggtcttggctcggttgctgccagagtcttcggcatcttgatctgtctggatgtgaaaaaatcacagacatggctctagagaagatttctagagctcttggagttctgacatctcatcagagtggctttctgaaaagtgcaggcaaggctgcttcaactccatggacaagtaaagacattaccatgccatccaccacgcagtatgcctgtttgcacaatttaactgacaaaggcattggtgaagaaatagacaacgagcactcttggactgaacctgtgtcttctgaaagtttgacttctccttatgtgtggatgctagatgctgaagatttggctgatattgaagatgctgtagagtggagacacagaaatgttgagagtctctgtgtgatggaaacagcctccaactttggttgttcctcatctggttgttacagtaaggacattgtgggattaaggactagtgtctgttggcagcagcattgtgcttctccagcctttgcatattgtggtcattcattctgttgtacagggacagctttaagaactatgactacactcccagcgacttctgcaatgtgtagaaaagcattaaggactacattgcccagggggaaagacttaatttattttgggagtgaaaagtctgaccaagagactggacgagtacttttgttcctcagtctgtctggatgttaccagatcacagaccatggtctcaggtgggtgatcagccctagttgttaggaaatggatgtatttgcacatgaaatattacattactgatctaagtttttcacttggcttttttaagcaagaaagttaaccaaggtttgctacaagtattggagtaatagtgcttctgataccaacatgaagtttcattttagtcagttcaaatacattgtggaatatagaggaatatacatttagaagtttaattgcttagtaattggccacattacatttttataatacagtttggtagataaatgtataggttataatctcaaggatatgttacagaagtaaattttatattgaggactttgtcaaccatgtctgttgtggtttggtgtgatttttataccgtgaagtacctataaaccaaattgctgttgatctgtgtccattcgttgctgctgttgttgagac

SEQ ID NO: 30061 - DNA, 1106 bp, Mus musculus
tcctacctactgtacattgctgactaatcactatagagaagctagctgttctcagaatggggctatttctggacccaaagtgaagtcacagcagggaaaaaagattaggttatttctagtaatttaaaaaattgtacctataaatactgataattacttcttaaaaatcacattatgcttagaaacctcattatactatgctttttataacctgtataaagagtaacacagatacatggcaggtatacagcagactgtaagcttctcaagttcttttttagttttaaagaaagattactttgggaaatactgttggttagtaattagaactattaattaaactcatatagtcatagttattttttatgttttaaattgaatcctttgcctatatatgtgtaggttttttttttttaattacaggtatttccaaaaatagctattgcctgaagttcaaatgtgaataggagattataatgatctatctaatttgactttgttcctctcgtccattcatggtataggtgactggtatagtggtcctgccactgaacttgatactgagcctgatgaggaatgggtgagaaataggaaagatgaaagtcgtgctttccaggagtgggatgaagatgccgatatagatgaatctggtatttcacgcttggaataaaaattattacatggtgtttaaataataggcattctgcttaataattattaggccttaaagttcatgtatcttatgatttctaaagactttaaaagcctacttctctgaagaacttgaaggaacaataaatttagaatttcttgttagaaatatttttaaaagagaatgttttcttttttaatattaaaataacaaaatcagaaactgatggctatttttgtgtggaaatgaactattttcattaaagtctttagtttacaatatgtgattaggagtatttcggttaatcagttcatcagcatttattgaatcatctgggttgagaattgggaggcaggatgatggtatgtgtgtaaagtcatgtcacttgcctcaaggttgttacacagttaagaggtaatgtgtatgagagactttgggtgggtgtagcttaggg

SEQ ID NO: 30062 - DNA, 1132 bp, Mus musculus
tagtgcatgaatcgaaaatgtgagcatgtgtgtcatttaataatgcgttgtagagctcataatctggctgagtatacgcttgctgatttaaagcagtgtaacctgtttggttcctttttcaaatgatgctgcttatgctacaaagtgagtattgttctgtctatgatgcctctgtaagaggaagtcagttctgtgttcattattgtcgctcccactgatgaagtatgatctgggctgtgatagtttaactcacgggttcttaacaagttcaacatccccatgttccctctaataggtgttatttccttttcacatgttgcaagcaggaaggaatcgacttcaggcactggcttttactcgtgattgtaatttcttaatgcatttatttgctcatgtagcctaactgttaaaggttttcttttttatttcagaagcggaagtgtcagaacactccacaggtataacccatcttcctcctgaggtaatgctgtccattttcagttaccttaatcctcaagaattgtgtcggtgtagtcaagtcagtactaagtggtctcagctggcaaaaacaggatctttgtggaaacatctttaccctgttcattgggcaagaggtaggtaaatgggactttgagtttgtttaaaaagtattccagtctgcctttttagacaaatagtgacagccattactatgtaatgccagggaaaggaaggaaactttgagggtttgaccaaaacatagattttttatagttgatttggttttagtatacagtttagaagagcaagtcaatggtgaagtatttgtgagtaaattattaatggctgctactacctttagaataatggggaaaatacgtcagagagattgtaaaaactactggtaaaatgttgataattgttgaagataaaaaaaatgggtacacagaaattcattgtactgtatctttatacatatgtcagttgtaggaatttttcatagcaaaagtttaagatgaatataagtgattttttttaaaaaagaactgttaaataattatattttttgagtattttaaacatagaatcagttctgtaaaatataaaggtgagatatatacagtttccttttggtcatggcttaaagtaaccg

SEQ ID NO: 30063 - DNA, 1214 bp, Mus musculus
gatttgagaccagtctggttaaccaggactatataataagaccctgtctccaaaaacagtgttttccaacgtttaaactgtagaagcagtaagtttcttctcatgtatgtgcctttagtgtatctttttttctttatgacacccagagagtaatggaatttcaggcttgcagggaactgggtctgataggttttatttaaataaagtatgttattctccccccaccccctgttttctgtattaccaagtactcgagaatgcagccttcagcttcctggtctagggtacttttaaatcttacaactataagttgttattgtatgattttcttttatttgtagtttaatgtaatcataaaggaaatatcttgttatgagcaaaaatttaggtgtacatttgaattgtatcttgttacatcatttcatgtttacatctattaactatatcttttaaaatttttattcagctttctaaaaccaacttttccaacaacaatgacttccgtgctcttctccagtctttatatgctactttcaaggagtttaaaatgcatgaacaaattgaaaatgaatacattatcggtttacttcagcagcgcagtcagaccatatataatgtacactctgacaataagctctccgagatgctgagtctctttgaaaaggggctgaagaatgtcaaggtaagtcgcagaaattgatatgtactgattctctaatttttattagccacagtaataagtgatgttatttatggaaagatacttcatttatttgagacggctacgaaggctgttcatgaggattggttacagtgaaggcttatagcaagttgaacgtaagagagaacatcaggaccaggagggttcttgttgaatcagctctaccggatttttgctgaagataggtcagggaattaatcccgggtactctggacgcagaagaaggggaatctttgtgagttcaaagtcagcctggtctacgtactgagttccaggccagccagggttatatagggagacctgttttcaaacagaataaaactatcaaaatagaattggaagtggaaaatgtaattcagtggtagaattcttgcctagtatgagtaaggccttaacttcggtctgtagcagtggaaaaaaaaatggaatggcagctatagtgttcacggtattttatttttccctattgtaggaaattgactggttaaagaag

SEQ ID NO: 30064 - DNA, 1148 bp, Mus musculus
tgtaggagtcagtgcttcgttcaagcacgtgaactctggggatcaaactctcaggtcactgggtacggcagtgagcacctttgccccatgacccatcttgccagccctcatccagtccctgacttcctttctttcttctctcccacaggcctgccaggtttcttcagtgtgtgaagaaccctgagcacccatcgtgtagacttaatacgtgaaggatctggatcttagatcacctgtagcctggactgagatgaaggggctcagaagcaacactggtggaaagctgaaactgtcagggagaagcctctactacagtgttaacaccagagatggaagaacttcccaattctctgtgtactaccaacattcaagaaaaattactccataaaccagagttaaacttctatattgttatattagtctaactttctcatgtggtgcttctgtattgtttatatattgcttacatccttttattcctcttttaatgatctctcttttctctctctctctctctctctctctctctcaatgaggctgagaatccaacctgagaactttcatacatggtggataagcctatataccactgagctaaatcctcagcacagctgataacatcatttttgctgaaaaatggccaatcaaacttcccattagacaaagaaagtcaaatgtcaagtatatcgaaatgaatgacccttttttttttttatgttttttcattcttcccacagatattcacatggtaaacctgaggtcatagggtcattatagggaaggtgctgtgtgggaactacccacgtgccctgtgctttaatctttaactcaacacatccctgataactttgagcattcttttcttttcttttctttccttttcttttcttttcttttctttttcttttttttaaacagaagaaaatggagtttagagagataattgattttcctaaagtcacattcttaagatcatggttacatctagaattaaatcagttctgtcaaagtccacaacatatgatagtttttttcttttccgagcttttattgccaaattggtagtagcctgtgttgtcgtctagcaaatgctattgcattagattgaatataatagaatctgaaatgtgatctttatggaagatcac

SEQ ID NO: 30065 - DNA, 1194 bp, Mus musculus
cagttaaactcttaaatgagaaagtcccagaaaatctttttctagatatctatctcgaaataaactcagccgcctttcgtctggcggcagccatccatcagatgagccaagatgggtgcatacaaatacatccaggagctatggaggaagaagcagtccgacatgatgcgctctcttctgagggtctgctgctggcaataccgccagctctctgtgctgcacagggctccccgccccacccggcctgataaagctcgaagactggggtacaagactaagcaagactatgtcatttgcaggattcgtgtccacggtggtggtcgcaaacgcccagttcctaagggtgcaacttatggcaagcctgtccaccatggtggacagctgaactttgcccgaagccttcagtctgttgctgaggagagagctgggcgccattgtgggactttgagagtcctgaattcctactgggttggtgaagattccacatataaattttttgaggctatcctcattgatccgttccataaagctatcagaagaaatcctgacacccagtggatcaccaaaccagtccacaaacacagagagatgcgtggccttggaaagggccacaagttccaccacactattggtggttcccgccttgcagcctggagaaggcgcaatactctccagttccaccgttaccactaatacacgtgatatttgtaaaattcatatccaatgaacaatttaggacagaaaaagaaagagagagagagagagagagagagagagaggaagagaagagaagagaagagaagaaaagaaaagaaaagaaaagaaaagaaaagaaaagaaaagaaaagaaaagaaaagaactcagccataaaagcaacatccatacatacttggctatacagtttttgtgacagtgaaatctggaaacaacttcaaataacatttactactgaagcagtaagttagtctcatccagccagccaggtcttgccattgagaaaagttatataatcagccttatgtgctcctataagaccaaatccaaggggaaaactaaaaactcaaatggtttgtacaacaaaatggtcgcatttgtctaaaaatcagtgaatgtcttcttttgtaaggagtggcacaggggtactttcaaagggggtcgcttttgagacagggtttctctgtgtagccctggat

SEQ ID NO: 30066 - DNA, 1192 bp, Mus musculus
agagtgtttgggacactgtaactagcaaccaaaaggtgctctggggttttcatctgagataaagatgttattcctgcttcattactacctattagcatcccaggacaaattctcgacaccctactttatcttaagagtctgttctgcacttctcttagacagaaagttgaccatttctgatctgaactgtctaaaagatggtactcttaacttcatttcctatgctgtcttctgaaactcagctctcatgcaaatatttgggcacagatggcaaattttaaatggtttgctgtatcctggataagtataaaactagtttggatgctttggcttatgcatttgagattcaggagggtttctaatgttttgcactaacagaatctaaagatagctgttggagatactatatatttatgccttgtaaagccaggaagcaattttaagtttaaaatgaacatttttattcttttgtgtatgttttagtggggccccacttttaaactattctttttaccgaaagagagtgtccatggaaaccaggagccgtgtggaaaaagctttgccaaacgcagccctggtcagaacaagagcacgacctaggtgtatctttctgttccgcttgagttttctgtttccgcgctgttctctgaagattgcatttcctttgcagatgctcttgggagtgtggatgatactcacttctgtcataatggcattcagtactaattttataagtgcatcttgtgtgaaactcaataaattcaattttataatcttttttaaaaaggtcactgaatttcttgtggcaacgattactattatatttgttggaatggatatctcattgagagatttcttatttaagcagaacttatttctagtttacaaataatagggttgtgttaagtatgtttagttactcttgccctaaatgataaaaaaaaaattgctcttttgtctttgaaagaatagcctgcatgttggtcatagaccatttagtatctcttatcacatgacaacatttgcattctatggtgcatcttgatgtcacagtgtcttcttgtcataatatgggagtcacagtcaagacaatactttggtttttaaatagtcttagtatggtgcacggtacatcagacccattttagcttttcctacaggtcaaagtaccaaatgctattgatgaatgtat

SEQ ID NO: 30067 - DNA, 1238 bp, Mus musculus
ggtggatggttgatatgggaggacttaggtgacactatggctaggaaggagctggacaggagccagggagtcagccagtaagcattgttcctccttggcctctgtattgagtcggatatgctaatttacatgatttgccgggattctgttccctctcctccctggcaccctagggagggctgggtggagctgattttgtattattccccatggtttgtggtttacaagtaatgagtgctgagtgaggctgtaattgctcttaaaggtagacactgacatctgggtcttcagtctgaaggacctggaggtttctgaggtaaatctctgccatggaggattgagcatccacatcattttgttcatactgaccctgttaatcagtcacccactttgtatggtggaaaagattgccacgttaatacctcagtcggacgtccgcactgaaggctcatttgccactgctggagggcaggggtcttccataggccggccatcatctctacgagcccaagcgttgtgaattgcgaagggttttacatttttaaatggctttataacatgagaagagtaacaatatgtggcacatatagtttctatttccgcgtctgtcattctcagggtggcccatccctgcccctccaactccatattgtttgtagctgtctcccatgggagcaggtttaagtattggtggcagagatcaggtgtctctagatacagataaggtttggccttcagagtccagcagggaaggggaaggaagtgttcagagcaccctgggctgcagttagtggtccctgaaggatgtctgggaggtcggttgttattacctttctctagtgggtttttgtttacatggtaaatatccaaagatctgaaatgtttctaaatcttgcgcttttaaagggctatatgataccccagatgggaagtttcatgccatgaatgaaacctgttgcatgttcaagattattaacgtactatgtaaaattacttttagattgagtatacagattatatcaaacatgtgaattttgtgtttagactttagtcccatccccaagataagtatatgcgaacatttcataataccaaattgcaaactggaaacgtttctggtcttgtgtagttcagtttaagtctctccactaaattttctttgctcccatttctgggggttgctctttagagaagtcacaagccaccaattcttgaacaaagctgtttttcttgctcca

SEQ ID NO: 30068 - DNA, 1130 bp, Mus musculus
gagcgtgtgacagaaatgtggagccacaccattaagtgcttggcagaaggccctgcttcttctgccctctctgcaaagtcacacactttccctgattgacagggtactaaacaatgtggacatccctgatctgaaatttgaagcactccaaaaactgagtgttcactcacttctgaatgtctgtaggaagtcctgcagctaacccttgagtggacagagtcaaaacacaagtattttaaacgaccgaaccctgagacagtagatctgaaacaagtgattttcaggtttagggttggcccaagatgtctcacataacccagttccagtcttgccctggtagggattttagctgctgcggtggaggctgctgctctgctcttggcctctgcggaaaaagacagttttaatgggattgcttgccccttctgcatctggacagccaatgctttctgggggatctactctgattgtatttatctttcttgattttttttttttttcagggccttgttttaggaatttatgccaaagacaaagatgatgacctgccacaatttacaagtgcgggagagagttttaataagttggtgtctggaaagctgagggaaatgttgaacatgtaagtgttactataattggggttcctttttgtttgtgtgtgtattttgcattgtgagacagggtctctgctgtgtagctctggctgtcctggaactatgtagatcaggctggccggcttcaaactcatagacatccacctgcctcattccctggagttctggatttaaatgtatttgccataaaacagggcggggttgtagttcttaaaggccccaagatttaaagagagtattctccttgtatcaggtaaacttaatggaaccctgaccagcaggttctctggaaatgaaagtatgttcttgaagaagctgggcagttgtttgagtgtgggtgggtctgcagttctgggaagtcatgtggtttctagccagtcacaaacctattgtgaaggattgacgcggatccagaaaggaatagatttcctcagcccactcccaaggctcaggttcacaactcctactctcctgtctggcaccagcctctaaatgcactttaactgagtaatttaa

SEQ ID NO: 30069 - DNA, 1502 bp, Mus musculus
cccaaagatttattattatacataagtacactgtagctgacttcagatgcaccagaagagggtgtcagatctcattacggtaggttgtgagccaccatgtggttgctggaatttgaactcaggatcttcggaagagcagtcagcattcttacctgctgagccatcttgccagccctacaaaaatgatgaatctttaacagtatgtttctttctatttttttattttagtttaactatatctcctcccctttttcttcttcttcctcctccttctcctcttcctcttcttgtttgatttttgagacaaggtctccctgcattacccaagctgttattgaactcactctggccttaaaattcacgattctgcccccacctctggagtagctgggcttacaggcgtgcgcccccagggtcctccttagtgctcctgtctaaggggggcctttcctcatttgctcgtgttggggatggctgacctcactttctctctccccgttaccactttcgtctgtaggatgtctcggaactaaggagtgaactgcagcggaaggatgcgctggtccagaagcacttgacaaagctgaggcattggcagcaggtgctggaggacatcaatgtgcagcacaagaagccggctgacatgcctcagggatccttggccttcctcgagcaggcgtctgccaacattcctgcacctctgaagcagacctaagcactcctgcctgtcttgcagccttgcagtcttgccagacacgtttccttacagacctggtgtgttggaaggactctgttggataatgagtttgtatcagtttctgtccctatttataaggtagggtttcattatgaagccgggaagggccttgaatctatgatcccctgcctcagctcctctagtactctaaactcctgaatactttataaaaaacctctgtctttgataaagtaaagtttggctttgtttgttgttgttgtttgtattcatctttagcactgtttactccttagactgttagagtactcacacacattcttatttggcctttgccatttgttttgacaacattctgtgtcttcatctccctttttttcttaagctatgaatttggtgaaaaacctgaaggaaacaatgtttagtagtttgagaagccacgggatgtacagtttggttatcagccttaataggctacactagtggtaggtagtgtagacagagatgtaaatgtgctgttccaaaactgtgagctgcctcgtgaggaatctggcacggcagtgtgatgcttctagggcggcacagggcgagtgtatttcacaggtagctcagaagaggttagaatatgctgctaatggaagatacttaccttcatgctgggtgggtttttgtctgggctacgttccattctctgagtccttattcactctgccttgagggcacacacatgaggactatggcatgctgagtgctcttgggctgtgctgtgctggtcagggtaaggaat

SEQ ID NO: 30070 - DNA, 1197 bp, Mus musculus
cattatcaaatctctttatatacatgttttagatacacatgtaggcttcgtttttgaaaatatagcatattgtatatatgctcttttctggtttttaaaatttttgaactctgtaaagtcctctgttggtatatggtgttgcatgatattgtagtggctcatgtgtgctatgttaagtgctcgtcctccgatttacatctgctttattctgtttgctttagttacattcagggcttcccagtagttaatgaagagcagaaaggtgattttaccttcattggagatttgatgaaaagagaattcataggtcagcaattaattctaattatgaaatctttggacactagtgaagaaggaggaaggtatgtctaaatgttaatatttgattgattccctttagttttatatatttaggaacctaccttggttgaatttttaaaagataatgattctgattttaattttagtgtaactaccaacaatgaaagtgatgttatatcctttggtaaatcaggtttttaaaacaatcatttttatttgataattttatacatatatacaatatatcttgatcatatctacctcaagactcttcccactcctttgatactcaacatgttcctccttctaccttaagctcccccttcacttttttccattacctgagcccaattacagttgtctgaaagggccagggtatgtggccttccaccagagcatgggcagcctactgccagctacaccccagaagaaaaaggattctctctcttctagtagctattaactgtcaaaaccttctcagctggggtatctggcctcaggagtcacattcccatccgtactggaatgttgactggcagctcttatgcagttaaccatacttgctgtaagttcttgagttgtgtggagggtggtattattattcctcctcatttggctaatttcttatatttaaatacagttttgttatgatatgacgagatgtaattttcctagctctccaaaactgtatataattgtttttagtatacttgtatacatatgccaacgtgtgtttgtttatgccagcattaccagagaaatgcactgaagtacagcattactagggctactatatcattacatattttctagctccattatgattttctaggacctccatcagattcgtggtctaatgtttactgaaacatcata

SEQ ID NO: 30071 - DNA, 1158 bp, Mus musculus
aggctggccttgaactcagaaatctgcttgcctctgcctcccaagtgctgggattaaaggtgtgtgccaccacttctgagcagaactttaattttctgtgttttctaaataattacatggaaatgtatatgattatatatactgctttgctgtccatgccttaattagctagttctactacttttaataatttataaatcgcatgtattgtttttgtggtgaacacctaaagtttatacagaggaactaagtcttaaagggactgtttttttgtttgtttttgttttgttttgttttttggagacagggtttctctgtgtagccctggctgtcctggaactcagaaatccgcctgcctctgcctcccaaatactgggatcaaaggcgtgcgccaccactgcccggtttagagaatgcagtttttttttttgtgtgtgtgtgtgtttgagttctagacaggaaaccggtcaaccctgaggacatgtgtaaaaccagcacctactagtcctgactctacttctgatgaagtaattactttgtaaacgtacttggtcatcttagaatctgaatcccagaagtaattgtgcttacctcctttgtgaaataaatgccagtgaacagatggtgaataatgatgacagctttttaagctgacctctcctagatagatggttgtctgccttcaggagacctttctagggaatgaatcaggaaaaagggatgggaggatcatgtgacacttatggatgcctttgtgtttggcaggggaagttctagtggagatgcatttcagacgctgtggtttgttatttggagccggcctgcagaagatgcagttggccaattcaaggtcccagagaggaggctccttgcttgtcactcagtctttctggctttggatattgctaatattgaattttaaacgaaaaggggtttgtttttacaatagatattaagtattcctcagaattctttactggccctgtgtgtcctactttatattttagtataatagtactaaattatgctatcattaaggtttattattgggtagagagatggctcagcacttgttgcttttgccgagaacctgggttcagttctctgtactcactgattcacaacctccagttaagcggacatgacgctctcttgatg

SEQ ID NO: 30072 - DNA, 1140 bp, Mus musculus
tgctgaggacctgaatttggtctctgcagctcacaagagaaaggaaagaagcaactcttgaaagttgtcctctaccctccacatgggtgctgtggcatgctccttcctcacaacagccatacaccgaaagaattaacttaaaatttcaaagaaaaacaacaacaacaacaacaacgaaatcaaacaacaacacaaaaaacccaccaaagaccaacgtaatgttccataggctgctgcactacatttgtgtttttatggtgacacaaataaaacatgttttaaaagaactatgtctggacaagattaaagggtttttattattatgtatgtatgtttgtgtgtatgtgtgtaggtatgtgaacacaagcatgtgtggacctgcaaagtccagaagagggtgtcagattccttggagttgaaggtacaggccattgtgggaatcctgatttgtgtctggggaagaaaacttcaggtgagcagcaagcactcttaaacaccaagccacctgtccagcaccagaaactgtcattttaatctatgtggttttgcgcgtcagtctgtaatgattcctccctaaaggttttcagaaacaaagggagtgcacaagtaaattttgacatcagtattatgtgctattagactggatgtgtacataaatccgattgttttcaagtaagaagcctgtctcattagcttatacacttgatttttatttttcccaatttatattggctaataggctgtgctcacttggagctgatgctaacaaaaaggatagttgttcttacttactttttggcaactttcaatgaactcatctatggtaacgacaccatctttatttttgtccatcttctgttgagaaagaaaagaataaagcattgtattgagtcgccttttgacagcctccccatacccagtagattcaaagagataagaatgaaactcattattttgtgttacatgggacagtttcactctaggaggaactactgaattcctacaatggggaagcccaatcattttaggttgtgtgttttcccccctgtgtaatgccacctaaattgttttctaaatttgacagtactcgcagagtttcctgagatgtagagccttggatttttcatctataaaatagaa

SEQ ID NO: 30073 - DNA, 1170 bp, Mus musculus
cgcataccctctccccgactcccctacccacccattcccactctttggccctggcgttcccctgtactggggcatataaagtttgcatgtccaatgggcctctctttccagtgatggccgactaggccatcttttgatacatgtgcagctagagtcaagagctctggggtactggttagttcataatgttgttgcacctacagggttgcagatctctttagctctgagtatattagagtattattttgaaaatgggtagacactacacttgacaatgccattttaggcaggcagacaagttcagtatcaacagtcataaatcattttgacagtgtactcattctatgtgataaaatgcccccccccctgcactcttcatttcccaaactcataatcccaatttaatcatgagagacccatcatacaaatctgaactgaaaggtattctaccaaatacctgaacaatacttcttcaaactgtcaagatggttacaagtaaaagaagcctaagacagtcagtgctaacaagggtctaaggggacgttatgactaaatgaactgtggacagggctaaatgaaattctatcctacatggggtactgggtcagaaaaaaggacatccagtaaaacccaaagaaatcggaatttagcatgaaagttaatagtatggtatctgtgttagctccttaactggagcaagcatgccctattaacccatggggtgagttacagacgaaactgcatcccacatgagagctctgctctctgcatctgtttgtaagtataaagcatggcgaatcctaaaaaaattattataacatgatttaaaaagaggagactggtcttcagaacacgggaacaattaaagatatttgttgtctgcctatttctcttgtcctgcttgtttctgagatgtctgtgcatacgaaggcttttgccataggaagtcacaggacttgcacttggagagtatgggaagtggaaaaggagcgcatttgagtcaggggtgctggacccctgatgatagaagaggtgcaggctcccatgacagggtgacaagaaaagctagggagcatggtgcaggagtccagtcctgggaaatccaaaggatttgtttgaggctcaggtgaggaagccttacgatgagaacatgtgtgatctatagaaatt

SEQ ID NO: 30074 - DNA, 1196 bp, Mus musculus
acagtctgaccgaacactcgatggacaacgatattaaaatgcatgtggctcctttagacgtgcagtttcgaacaaacgtgcacccaagccgccaccacaaaaaccgaagtaaaggacaccgggccagcaggctcacagtcctgcgagagtatgcctatgacgtcccaacaagtgtggaaggaagcgtgcagaatggcttacctaaaagccggccaggcagcaatgaaggacattcaaggagtaggagagcttatttagcctacagagagagacagtacaacccaccccaacaagacagcagtgatgcttgtagcacacttcccaaaagtagccgaaatgttgaaaagcctgtttcaactagtagtaagaaagatgcaccaaggaagccagctgcagccgaccttgaaagtcagcagaaatcttacggcctgaacttggctgttcagaatggaccagttaaaagcaatgggcaggaaggacccttgctagctaccgacgtcactggtaatgttaggactgggttatggaaacacgaaacaactgtgtagcattgcaggggcttccaagacaaggtgaaactgtggtactcacattcctttaagctatgaactcttagaaacaaactgtttacagccaccttggggatacaaagccgttctgagtattcttgtgagctttgggatttacttattttatattcccaaattgtcccccactccccccaagagttaaaaatgttttaaaacattgttttacttgtcaaagcaccaataagatattttggaagttgaaaatataatttcttagaatctgttatatctgcgtaacatctgagacttgtatttaataaactaaatagaagtttgtcattgtgctggtggcttatgtttacactgcagaacacatgttaggagctggggagatggcgccatgggataaaggtgccgactgccacggctcctggtgtgtgagttgtaatcctagcatccatagggtggaaggagacacctctcataagtggtcctctggcctgcatatggcttccaccacacatatatacaaacatgcatgcattttgagagcattttagctacattttaataaagtttgtgatggtgattttcaaggtgatcaggcataaataatcagatgtactgttggcttaactatactgatggtaacatttgtatcaaaag

SEQ ID NO: 30075 - DNA, 1165 bp, Mus musculus
tccaaatcaacaatttactcccattcagcaatttaataatgattatcagtttacgacctctcctcattagtatatgctgtcacatcacgtacacatttgaagtgtcacttggaagtcagtgacagacagcaagtcactgtcgcctctgagaagtgtttaatagcattgtgtgagatccacgttcttaacactgtctggcttggtgaggagctgggtggcttttgaggctttctctagctgactgatccttgtataggtaggtacaggttgttaaggtactgtctcagctttgctttattgttgtatccattcatctgcctatgcacaaaccctctgtagattgggcatctcatctccctaaggtacagtagcgtatgctcttgcaggactcgatgttggggacagaaaccagtggctctattgtgccagagaggctttctgccagggactgcatgcctttctagactcactgcagaatatggccacagtagatgaaagtgggaaggcttgagtgtgggggagacagacagggtcagggtctcagggaactttgccagttgctctaaagactgccttcttttttcctcttcaactgatgggaacttttggaggttttaacagaaagacgtgatcaaaattctgctcaggaagatgagtagcagtagagaatagctgaggagataggatacatgtgcaaactgtgttaaaatcctcgcccagataatgccatgggggttgaacaggacccaggtgacttgagacattattatcatatacaataatttatttttcaacttcattttcaaacatccagagaggttgaaagaatattacctccagcaccttgatttaatgatgaccaacttcatggcgtgtttggttatcaatttttcaattgctctaggtataaatttatttagttcctttaatgaattcctactgcatgaaaaatgtgcttaaatcctgacatcaagaacctgaccacattttcttcgtttttgtgcatgagggtttgtatggaggaaagattgatttttgccccatttcaatccaggtgaaagttgggtgggtgtgcaaaagtgactcacagcttggcagataggaagcagagaaaggaggggctggtggctcactgcttgccttccaagcccctcccttagccctg

SEQ ID NO: 30076 - DNA, 1146 bp, Mus musculus
tcaattcgcattcttctatatgataactgccagttgtgccagcaccatttgttgaaaatggtgtcttttttccagtggatggttttagctcccttgtcaaagatcaagtgactataagtgtggtcttttctgggtcttcaattctattccattggtctacttgtctgtcactatagcagtaccaagcagtttttatcacaattgctctgtagtacagctttaggtcaggcatggtgattccaccagaggttcttttatccttgagaagaatttttgcatcctaggttttttgttattccagatgaatttgcagattgccctttctaattcattgaagaattgagttggaattttgatggggattgcattgagtctgtagattgcttttggcaagatagccatttttactatattgatcctccccatccatgagcatagatctttccatcttctgagatcttctttaatttctttcttcagagacttgaagtttttaccataaagatctttcacttccttagttatagtcacgccaaggtattatatattatttgtgactattaagaagggtgctatttccctaatttctctctgagcctgtttatcctttgtgtagataaaggccattgacttgtttgagttaattttatatccagctacttcactgaagctgtttatcaggtttaggagttctctggtggaatttttagggtcatttatatatactatcatatcatctgcaaaatgtgacattttgacttcttcctttccaatttgtatccccttgatctccttttgttgtctaattgctctggttaggacttcaagtacaatgttgaataggtaggaagaaagtgggcagccttgtctagtccctgattttagtgtggttgcttccagcttctcaccatttactttgatgttggctactggtttgctgtagattgctttttatcatgtttaggtatgggccttgaattcctgatctttccaagacttttatcatgaatgggttttggattttgtcaaatgctttctcagcatctaacgagatgatcatgtggtttttgtctttgagtttgtttatataatgtattacattgatgaatttccgtatattaaaccattcctgcatccctggattga

SEQ ID NO: 30077 - DNA, 1198 bp, Mus musculus
gatttctatgaataatgtcatggatttatgggtctttatgtggacattttttttatttctcttgagtgaagcttaatcgaggtttttggattatgcaataagtcatgtgtaactttgaaagcttccagttttaaattgctacacgattttgctactgggttgcctgatttcacaattacccattttcttaaaattccagtaggcaaaaacaaaaagtacaacattttagcaagtgcctatcacaaaacagactactgtagtgaaggctgtgagttagaactgctttggacttaagtgtttggttttatgctaaccagctaatttaggtttgagattgagtcaacaggcaggtagccaagggattcagatgtcgactacccatgtgtgtatgaccctcatgagatatttttagacaaataatcattttaatatccaggaggaaacaaatttttctaaacatgcacaggttaatcatctgatctctacaaagtccagcatgtgagagtgggcttatgcctgcagaaataatggacataaagaagaaattttgttttactcaaatctgaatagagcagaatgaattaagatgtggctgtttaaggggtaagatgtggctgtttaaggggatgactgagactgtcagtcaacagaaatgtaatgcctaatattagctgcatgtcagtttaaattgtacaactgttagcaagatgagtagctaaaacatactttcgggtatttggatatcagtgttcagtgtcttaacaaagaacctggtatttcatccaggggactattgatgagtgttaatagccacagtctcataaagggaaacatgtttatttttgtgtagtcagtccgtttcagaatgttttataacttctggttcttgatagtgagaatactgttatgttacttttagtgtactttcaatgtgtgatctgtactaatgcgtattgaagcctacttggtctaaataagattgttaaaactttgtgttttatataacttagatcctgtgtttaatcatttctaatgaaactttggacttgaaataagtatattttattattattatttttaatcttcttatacctgcaaggagctgactttgaaggaactcactaaactttagacaggtgcacctgcgtctcttagggcctttgtacaggaattctattttcttgtgtaaaagatttca

SEQ ID NO: 30078 - DNA, 1324 bp, Mus musculus
taaatagcttttgtcttttcatattaatgtaaataaagtattagaaaaattaatcccgatcctgtttccaaggtggtaagtttacagaaggtttatacttttgctaagctgatatttcttaaactgtgttaataaagatatgattttaaatcttttatcattgatttgtatttgaacatttgtcgtcattcagcagcagtataattattagcaactctagtacttaaatcttgatttcataactttccccctcccccattctggacaggttggtgaaaattgcccctcaatattatgacatgagcaatttcccacagtgtgaagcaaagagacagttggaccgcattattgccaaacttcaatccaaggaatattcacagtactgaattcaatgcttagaactgaagttattcagaggacagctttaaaagatgaatgaagtcaagttcaagttgtgctcttcatgttggttcaataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttctgtagacacaatcttctgtctccatacagaggcactgacttcaataaagtctatttatactaatcttggcccaagtccttctgtatcttttattctaagagtctctatagtgagtggctgcttttcttttttcattgtaattatactgttactacgtatttagcgttttttaaaaggagtactccttaggtacagtagccattaaacctgggttttaaagagcataaatgtagcactttcttaggttaatcagtatgtaatctaatgggataacgtgtgtaatatttttttttgaaattggatccccagagacagaataatggaagaatggctttgtcctcattcttaaagctcatttcataaggctgatagtttattaccttattaaatgcgttgtgtcaggtcttactgtactgaggcgaacagtttaatcactctagcccctagcatgtgtttgtattggataggagggaacagtgttctggatcaccgtcagtttttactaagtattgactgttggcagcttttataatgtaatttgtatagtgtgttaa

SEQ ID NO: 30079 - DNA, 2037 bp, Mus musculus
actcaaagccatattgttgtattttaaaatttctccattaagaatatatgtagtagatatcagaaatgacttcttaaaataacttcagaaaagtgaattacttagtttttaaaacaattctgtattttgtgaatgtttttaatttgactacatttcatttcaattggtctaggtattcacagagacccccttgcctctgtgtccaaatgcagggtttttaaaggtgtatgccactatacccattttcaggtgtccttttcattgttgttttgtttttttaattaccttgtattttgtgttgaggatgtgtcttgtgtattcagttaagactgtcagacttgggagctgagctattgtggtggcctgtggttcagtggctatcatgcttaaggttttagaaggatggaactagagacttggtagtaaagagtgtttatgctgttatgtaaagaatctggtcgtaatttttaataactaattgatgtttttgaaatcactctgatttctaaatttttgcattatttctaggaaagaccgggaacgagatcgggatagagaggaccgatctaaagatcgtgaccgagaacgtgatagaggagacagagaacgggagagggaaaaagaaaaggaaaaagaattgagagcttccaccaatgctatgcttatcagtgctggattgccacctttaaaagcttctcattcagctcactcaacccactcggctcattcaacacattctacacattctgcccactcaacacacactggacacacaggacacacatcacttccacagtgcattaatccattcaccaacctgccccatactcctcgatactatgatattctaaagaaacgacttcagctccctgtatgggaatacaaggatagatttacagatattcttgttagacatcagtcatttgtacttgttggtgagactgggtctggtaaaacaacacaggtgagttgttaaataccatggtaaatgtgttatgtgcatgtttaaacttaagatgctgattgggtcttggtagttcttttccattgtctgtcaactcatttccagttgtcttgtagagtaccttgaagaatagtactttgatgagtactttttaatgactttaagagtgtgattcaagtagagagtgtttagttttttctgagtccacataggaaaaaaactggtatattctcatcttgtaagtatgacagaaataatttccaacacattttaccctgggacaatacagacttagaaatacaaagtttgttttctagagcttgagtagagaaatctgaacaattggagcagttgcttctactcccaagtatttgttagaatattttgaattatgtgaatagtgtttaaaaaaaaaaacttgaacttgccagtcatgataatgcataccttttaattccagcatttagggatcaggtaggcaagtctctgaattcaaggtcggttttatctatataatgagatcctttcttaaaagaagaaaatgattagaaacgctacaaggtacaaagtgtggttgtgacctgcatccatctgcctctagcatacagtactaaacactgttaaatgtgtctcaccaggtgcccagtttttaaacatgaacaagtcgatcttgttgatagacatgcagcctgttttatattttgtatattattgcatctatttatgtgtgtatgtttgtgtatggatgcacccatgccgtagcacatgtgtggcaatcagaataacttagagttattgttcatcctatgggtattgagaattgaactcaagttgttagccttaatggccagtgcctttaactccctcagctgacataccaacctcaggctttgtttaatgacttcagggataagtatgtttgtagattttgaaatggctagatttattacagttgtactccatgtagctaaatcttctttcctcatggagcatagcaaattactcttgaaacatctataaactttttggttatatccctgaactgttaatctgatggttgaatgaagtacttg

SEQ ID NO: 30080 - DNA, 1143 bp, Mus musculus
attgcaaattagattaataatggatatctagccagatgtggtggcatacacctataatcccacactcagaaggtagaggcaggagaaacaaggctagccttatctacatagtgagcttgatttcatcctgggcttcatgacactctgcctaaaaacatcaaataaaaatacccccactaattgtgaggcattatattacacccatgagattaaaaacattcaaaagactattactattgcagtgtttgtgaagctgtggactgttactgtctatggagagaaaatgtcttaaaaacatctattaaagaatccacacaacctttgacccaatgattcaacccctgggcatgtagaaataattaacaagccaatatggaaggctttgtgcaaaatggtagtagcaaagaattaaaagcaaagtgaatgcataaccatgagggaacagtttaataaatctctctttttgctgaatttgcaaatatggctgaatagtgtctctgcttcataaaatactaggcttctacttccaaggtagaattggaacttcttgtgaactaggattctcacgagcgtagagtgagaagggaaagccactggagccatacggctcctggagatagactgatgtacactggtgtgtgtgtgtgtgtgtgtgtgtgtgtgtgtgtgtgtgtgtgtgtgtttacatttgtaagcagacttctatctgtgtgtggtcacatgagcttaaggacaatgtaagatatgaacgacatagggttaacagtgtctctgcctctctggggtaagatttgggttgatgcagtagtgatttatgcctttaagcactcatgaggcctcgaggtcaccctgttctacagagagagtttcaagacagtcaggactccacagtgaaaccatgtctcaaaaataaacaaaacaaaagaacaagaacctattgtgataagctatccatgcatctgcgtcttaatgtgtttatcatttgcctttcttatccctgtgaccaaagtcaggacaagaagcaactaaggaaggaagggtttggtttgaattgcacttggggtggggcgggggcggggtgcattatggcagggaagtcatggtgggagaagcagctttcagttttgatgacaggatctcttg

SEQ ID NO: 30081 - DNA, 2686 bp, Mus musculus
taggccagcctggaatgtgcccaagatgaagggatttccctgtgtgtgtgtgtgtgtgtgtgtgtgtgtgtgtgtgtgtgtgtggtttaaaggtaaccctcgaggtggctggagcaatcatgtgtgtttgatgttatccgttgagcgctcaaatctctgagccgttccttttagtttgtgggtaactggcaggcaggccaaaggctgactggtgcttttcatctgtcccttagagggatggaacaggtgttcccatctcctgggcattgggtagggtttttgaagtgagattttacggagtcagagggcacttaactcagatctccatgtgctttgagacccagagggggtcctttgattgttgcatgtctttgccctctggacaacttaatatttcaagtaattgattcaatagcagtctgcctacctgcccacctgcctcccttcctcctggaacagtcctttgttaagttgtaggtgtgcacagtggctggctcgtgcggccctgcagaagtttctgaacatacaaaagtcaaaatcacgggaacacacctccctcctccagcacgctagcaataggaggcaggtcgtgcgctagtgctggggtatctgatagagcttcaggcgagaccagctggaaccagatgagcgtaatctcataggccaggtctgtgtgtgggaccaggtggcttatttcaaaataggcctcctgtggggacagcagggaaatgcttggggtctggttgtgtagatggttgcacagtggatattctgtctaagcagctgctttaggggagtgttttgcagagtcccactgcagcacgatgtcgttttaatggtcatcctcgctgtagctaggtagagggtaccccacaaatgcgaatgagtctgttgtctcctgactgtaagcagcaggggatgattggtacgccatactggagagctatgcattgatggtaatcagcactcctggctgatgcttccagcctagggggaatcaaggactttaatgaactctggctctatagtgtggttgcttagactgctggtgctaaatgccaagcaaatagaaagagcggtctgttttaatgctctaagcgtaaatgacacgtatgcgttcttcgccttcttttgtcttcttggttcatttggcttgcccatgagttcctggctctccctattggaggctggaagtgtgatggttgcttttcctttctctgaagaactggtgagccatgttcctccatacatgggtcctgcagacaggcacgtagcactaatgtcaggcagagagaacacctttgcttctcaccgcttgtagaggaacccacaggggcatctctcagagtgccacctctacagagcctggtaccagcttctctgtgcttcctcacagggtgaagccatggccattgcttagagttcaaaaagccaagatatgtggggtttgacttgggggtggggcaggctgtcagacccggatgaagcatttggggagtgaaaaagaccctggtgggtggtgcagcaggggtatgagaggaccagcaatcgagttttctttttaagacaagtttataccagactggagtctgcagccttctgagtcctgcgctatgggaggagatatttgttctggccaacttaacgaaggaacatagatgttcttggcataaggtgggaagctctgcttcattaatcttactgctctctcccaagaatccctgaagttttaagcagtttctgcaaaatgctttcttccagtaaaataacaaaacccacccacacagctataacaagagcccaaggcagagaaatgcataggactgtccagctgagggggactggtctctccttccccctccttcctgctctcccccttcctccctccctcccccctccctctcttccttcctccctcctcatttcttctttctttccttcccaacacccatgcactgacatctgctcagcccgccctttgtccgtctctgcagctggcttcagaagatgatccctccaatcagtcctgcggctttaaggccataacctaaagcaagggttagtcctcagactctgtaggatccgcagtagatttctataaagactaaaaataaaccttagggctgacaagcactttgttcctgggctgtggataagatcagctcgcatcccggaagcttcctgtcattcccgcctgtgcatctgtgttctgctcacgtgtcacatgtagctctttggtttacggagggcaggtgttattctaatttcatagagaaggaaatagacacagaaccgaagtagatggcctgcctgagattatccggttttaagcagcaaagctagaactttcccgtggacgacaggtgctgcattttctctttctaatgctctgctgtgcccacccaaagtcagactctgttaccatgacagtgaagacagcagcagttcttgtagattacgtacaagcagaatgaagagccaggggtgaaagtcatgcctgacacacaccgttcaatcgtcaatgccatcgaacaactagcaagcacctcagaactgtggggcatgcctagccaggcttgagaaagccttccagaagtggtggatggcttcagttgtctagcgaggatttctagccggcatgactgtgtcttctcacatatagccatggagggaatactgaggctag

SEQ ID NO: 30082 - DNA, 1097 bp, Mus musculus
aatatttttctaataacttggcccagcacttaattattcactgattctatttctttacccacaagacaagaagaactgtcactgaggccgtagagacagacaatgtctatgctctggcttccatagtaaaactttgacaaattctcatgttttaaacaggtggtgatactgagtaagtgccctcatcctgacaagctcagctttgagtcttttcactaaagtaggcaatcaacaatcgaaaataacagtaatgaaaaccagtgctgagactcattcatattgttctcagagaaaaatttgaaatacacacacatttggtgcagataaaaattggatttacgttgcctcccaatctagggcgcactagtttttgccaagctggaaaatggttttgttttacgttgatgagatcgactttatatattgagttggaagaaacccagttttacatgcgcagaagttggttaatttcagatatttttataatctttgaataatttggtaaccaattggccatgcaagtagcagaagtgcatgtatgtatgcatgggcatgcgtgtctgcgtcgaggactcgtcggacaggtgctaggtgcctccttgtctgtttttgttggttctgctctttggccaaccttagtctgcaggtctgatttgatgccttctttatgccttacattttacttttattttggcttcatggtctgtgtgacataaaatgatgattttacagctaatgaatattactttgtaactaaccagctaatattctgcagttcaagctaaggccacagacaaagtcagattctgtttataccatagttttgttttgttttgttttaaatcaaatatgccaacaggagcctttggggaagaggtgaaggaaggctaagtctaaccgtgtaagtgggtgtgggggttaagctatgagactgtgatgtggacatcaatctcctgacctgtatattaccaaagggagaaacaattccagaaatatttttggtatagactgtttaaaataaaaacaaattgtataatttattacatgaaataaatttttaataaatcattgactacagatgaaatctggaagtgcaa

SEQ ID NO: 30083 - DNA, 1364 bp, Mus musculus
tgggcaactgcaaactttattccacatactgtctgggctttaagcagcctttgtgactacatatatatgaatgactgaaattctaggccccatacctctgtgttttttgttagttatacacaacaaaacaaacaaaaaaacaaacaaacagaagaacaaaacaaaaaaacaactagactgggggcttagtgaagcctcttgggaacagccatgccaaagctatgtttcttaggcctgctctgtggagcgtcactctacccaaaacatagccatggggaaagggcccatggaggaatcattcggggaaatgcctttgtaaatttgctcatggtgtattaaatgctacaagaggatttctttagtaaaattggcctgcttttccaaagaggagccggttctctgaaatgaaacactctttgtacatactctcccaacacaatgggtcaaatgtgttaacttctggattctactcttgtattggtatgacactgagctgtatatgaaaagggagtcttccttgcctacgatcttagaaggtttgtacacatgagcttagccagaagctgttttgagtgcgtaagttgggccatgtgagccactgatgcacctgcaagtcgaggctggataaagaactcactggtaaatgtattctacctttggggaccagacactaaaatggctcttaggtagctgtagtaactcgttacatgggagtaaacctggattgaaaggctctgtgctgttttctgtgtggattggggactgcaccataaatgagatgtagccacaaaggccccgtctctgtggggcctgtgagggtcagatgctgctgccgatggaattgctggcagtgcagcttcctacgcatcaggccaaaatgattttctagaacaagtgatctatattgtgtgatcatcattttgcttaagaaaggccagagtccagagactggagatgcttcctcatctgccgagtatcagcagttcttggcttcagctgctgaatagataataattctaattgaagataaattacatgaacccacatgtgaatgatagatatggtacaacattttattgctggtgcataaaatccgctgcagttttggttattaaccctttcctttttaagcacttttaaattccagctctgttcttcctagctccggcttgagcctaaggtcaggtttttctcccccaaccctgtatgacttacctaagtctctctcctgttcacatctgcatgttagaaggactgttcctatctctgcgggaagcacggacagtccttgggatgcttcctgatgttcccgtgttgccctcaggctgtggcagtggagggtaccgggcaggcattgcctaagg

SEQ ID NO: 30084 - DNA, 1301 bp, Mus musculus
ggacccagtgggtagagcggacagtgatagtaaagcaactataccttcagtttaaaagctgctgttttaaaactggaatcaagtgcccaaaggtggtcattaccgggaacctgaaagttaagttctgcctaagtgacagatgactatagtaagttttgaattttgatatatttgttgatgaattattctgttttagtgaagggggaaaaaatctaaagacatctcccctcctttttgaaaacaagaaataactgaaaattgaatggaataatatgaaattaaggtagatgtccagtattttaaaattacaatattgcccaaaaaaaattcttggtttttttttttttctcatatgggatcaaataatttaaaattagtacttcaaaacactaatcttaatcagttctgtactctagtcagtatggaacatcacttcaaagcaagccattccctgaagcttatactgaagtcaggaacacggtgctcagacacgcctggggcgactggaagctgatctcaccattcactttaggttgctgtcttaggggttttttaatgagctatttttgtatgagaaggtagttacatccaggtggttaaattaaggtgtggtagtcaccgtcttggtgcaggtaaggagtgagataccactgccctgaggagtcagttggaaactcgtcctcctacctcttctgacccacctcccattagctggggtttgagataatggcaacctgactggagtatcaaactataccaccagctgttggtaaatactagtcattgatttgtgcctttcttctgcagtagagcgcatacttgcctctgctgtggtacggctttcacaaaggattttcttttcattgttttgaaaattgctatattaatttttataacagagaacctagtaaattgctactgtttatagtctaaaattgaaatagttaaagactattttaaacatctgaccatgttagaatagttggggtatttaaaaattacaagtaaaagtacttacgctgtactttgtaagcattcatgaacttaattcttatttaaatagtgaggagttttttaatgagcatatttatattgtcaaatatgataaacaaaaggaataaaaatcattgtcttgaagctccattgttctgtgtattgaatgtttagaatgcttctagttatgttctaaacgagaggtaactcagggtgaaagggctgttctgacttacctgtggggtgggaaggcatggacaccagaaatggaggcacttggtcacactacacccacaagaaggaggcaa

SEQ ID NO: 30085 - DNA, 1201 bp, Mus musculus
aggcgtccaaggcctttctttgtgtcattttatgattcatagtttctgctaattataagcatggagtagcctcaactgtattagtttcttattctgacaaagcttactaaataggtaaaaataactctggattttgctaatcttataaattgttttacttagaggttattttacagaaagtgaaagctgagctgtgagtggctttgtgataaatgatcaggaactcctgtgaagccatcctttaatttaagcttctgattttaattcctcaatatgtgatgtgtttgttaagccgtgcatttaaacagtattcctctgtccttgttttcgttagttaagttcaaacctccggcatgtgagggtgtttgaaatggacatcgatgatgagtgggagattgacgagtcttcagacgatgaggaggaggctggcgggaagcctgtgaagatcaaggaggaagtgttgtcagagtcagagacagaggctcaccaagacgctgctgccctagacccggacgtagtcatcaaagtggagaaacttgaccctgagttggactcgtgacccagcttgacagcattgtgttagttaatgtggcaaaaagacgtagtggatggactaagaatgtatcggtcacactgagttgtctgtgtatcaaagaaataaatggtaaattttattttttcatactctgttccatccttgtggaggagtgtcactgtggcagacccctttcttgctggggttttttcctcatattgtgcagagccaatgtttaaagaaaacaaacacagctttgatctgaagagccaggcaagccattcctgtcaaaagggattctccttattcctgttgcaggagcggtacacttgaatagaggacacacgcttgtgattcagcactttggaacctcggggaggaggctggcaaagttcaaggcgagcctgaactaagtttaaatagctatttgggtgcatttcgggtactttttaaaaatacttaaataattacttgtctcagtgtgtgtatgtgtgtcctagctttgtagttttatttccttccaatcgtagtcttgaaaattttatactcatcacatgctaaaatattccatcttttaaaatcagaatagttgagtaaatccaaagggacaccatgaagtattaccttgggtctatggttacatataaaaagctgagtttatgtatg

SEQ ID NO: 30086 - DNA, 1151 bp, Mus musculus
ggttccctttagaaaaatcccagttctgaagaagacaggggtgtggttctcagccactgtgctatctggaggtgttttgcttgtcacagctaaggaagaaaaggggaggtgagagtaagccattgtactagataggatccaggataaatttcccacagtgcacagaagcatcacactgtgaaggctaccctgctcttagtcagccggttaccctgcatgtcttccaggaatactccccagtctttggctgaccatgttgctttaggcgggcaggtcaggctctaagactgtctacacctgcttgccttttagcttattttaattaattcgaccaactttaaccaaaggttataactaaaattttttaaaaagtaaataatactgaacagctaatttttatcagaagttttggttttggtgggttttttttgttttgttttgtttttttcatccttccaagtgcttcaactctgctaagacatttagtgctcgtcataaccctttgtggtggctgttagctggataacatgtaggcaggtatttcctcactctgagccttgcctgttccccccgctgtggtgatggtgtttactgaactgaatttgtaagtttagggtgaattaagtgaagtatagtctcatattaggaattgtaccaaaaaaaaaaaaaaaaacaaaaaaaaacacttttaaaaggaggtcttggtgaggagtgagatacaagcaggtgtgtgccttaggccggcaggaagcatgcccagctagctcagtgtgtgctcaggagctgggagcccattccgtttccagtatttatagtatttaaccgctttccttccttatactcagagcctgcattttagctgtcacttgtgcctggtgcagtttagatgtggggcagccctgggctggcctgggcctcgtcccctgccacctcattctgtcctggccctgtgcattttgggtagtgttttagcccgtgcgtcccctgcacctgtagtcactaacatcactgtttttctttatttgcctgctcttcatctttcccatatgccccccatgcttctcttgtgtgcattttttttctaaagcttagaagaaatgtgtgttgttgaggggtgcacatacggcagcttatgtgtggtgagatcagag

SEQ ID NO: 30087 - DNA, 1197 bp, Mus musculus
ggatacctcatagctgccatggctgcctcgttgcagggttccagtggctgcactcacccatttcaatgtctcagccacatggaaattgcatggctcaatttccacatcatcttgtttgtttgggatcaagggggtgtgttcagtcatttagcaatgaatcctgatagggtatttgtgtttctttccatagggttgaaagtgtggtctgatccatttggcaggaaatgaggctgtcagcaagtctgatgaggaaagtggacgtctttatcctgtgcactccgcagtggggacaatagatgcctcactgtggcagcatggcatggagagggaactctcatgctgctagccagaccccttgtgatagagactgtgtgcaaagacagtgcttcccttaactccctggagaacctgaacagatgccaccattaggaagtgccttgcggctccattgactttgcaggagcagagccagcctgcaaggctgtttgtggaagatctgctgctcctgcagtctttatcacttccaagctgtgatgtgaacacaagcaacctgtgggctcaaggtccgtggctgctctgacaccttctgaataagcgatttcagtgcaaatggccttgccaagctgcctcgcagggctcttggaggatgtttcagttgataaaactgtttgaagacaggatccttggcactgtttaagaatatacactgctcagcttaaccatctcattgaaagtcactgtgtgtggaagtgaatagggagcgagtcacactagactataccacacacagtagactcctgcgtgaggctgcaggtattaaaatggtttctcttagtttgctggtgtgtactgtttttatattttgtgtgtgtatatgtttgttttatttggatgggtggtgtttgttggctttggattttgttttttgagacagggtctgtcagaccagtcaagccttgaactcccagagatccacctgtcactgcccagtagaatttttttgtaaattgaattctgatgtgaagaagtagaagtagtgctattgtctagattctatttgagtagatatccgtgtagtaatagctatttgtagacaaggtgagcggcacacttcttgtggcagctgtggcattaggttctccagagaaacagaactgatgagatgaatatgatttacatcagtgacttacaggctgt

SEQ ID NO: 30088 - DNA, 1113 bp, Mus musculus
gggtgagagaaggccatcagctgggcaccccttgtgcaggctatagagaaaggctggggtgggacccagcattcaaactggaactctccggaaccatttgtgtgagtttaggaaagttacttcatttctctgggtcatgacttcctttctaatttctccgagccataacttccttaaaaggggacacagactttataggaataaaggagccacaaagattatgtcctataaaaccacttaagttaatgcttaataattcccacccattaattttttttttctttttaaagataagctggggaaatggttcagtcaagaaagcacttgccaagaaagctggaggactttaattctctcccaagcagctacataagaaaccaggtgccatggtgcttggcccacacctgtaattccacagctgggaggcagatgagggtggatgcctggggtttgaagaccagcaggtctatcccaaccagtgagctccaggttcagtgagagactgtctgagaaaatgagatagagaatgactgagaaagatgcctgaggtcaacctccagctccacctacctgtgcgtgcatgtccaggcacacacaccactaaggtcacaccacataagaaatgttaaagagcaatctcaattttagtgtgagcatcagggatggatcaacaaagtgatgactgttcatgggttttctgtggagttcattcctttatttctatctatctatctatctatctatctatctatctatctatctatctatctatctatctatctatctatcgtaccattgaggcaaacttcatatcaacatttttaaatcatttaactgaatgaagtataactattccctctttcctttcttcttcttcttcttcttcttcttcttcttcttcttcttcttcttcttcttcttcttcttcttcttcttcttcttcttcttcttcttctcctcctcttgctcctcctcctcctcctcctcctcctcctcctcctcctcctcctcctctgcctgtctgtcttcttaacaactttagtgagttctgttccccaagctatataatttaatgatttaaagtgaatgttcagggctagggtatagctcact

SEQ ID NO: 30089 - DNA, 1141 bp, Mus musculus
cgggaagccacttggaaaacacccactcgaggaggcgtctcctctaggcctgtgagacgctcgcattttcccaggacccctcctcccggccccggggccccgcctcctgacccctccagtcccggtccccgtagtaatgccctccggttttcctcagtctccacgtacgtccccgagggcgcgtcccaaaacccggataaccggagcgctccccatggactactcggagggcttgtccgcggaggagcggcctgcgcatgctccatcggcggggtaggtttctagggaaaggcagtgagcagatcccttagtccgcgggcggcgcgaggcggctggctcccggcggcggcggcggcgaagcggggaaagacggcgcgggggccgggtggcagcgatcggcgaggccgagggaaggggcgggggagaggagcagggaaaggcggcggggggaatctcgcgagggttggagttttggcgagagtttgtggaagatggcgcctgttgtgacagggtaagtctgagggggcagcgagtgctgggaaccgggaaagttgcgggcgtctgaccgccggcggcaggcggcgggccggggccgcgcggcgcgccggggcctcgggaggcggcgcggggcggcgacgcgatggcgcgggccggtgcggggctcgcccgtgcgccgcggtggagcgggctccgggcgcgtgagggcgggcggtggcgaggccggcggctgcgggcggagtgcggccggcgcgcggggccgtaggcaccgtgcccggcgcgcgcccccctcggcgggcctggcggggatcccggcgcagctttgttccccgtgcgtggcccgcgtcgcctgtcctcccagccgctgccctgggcgccggagcgctttgtctgtgtgcgctgccccccgcgattctgcccccagccctttgtttcgccgccttaggctctctgtgggagccgctgcgcgccccgcatcccgtctgcacctccactccgcccgctgtccctcctcccgtgcccctttgttgtatccctctcttcagtagctgggtgacctgccatagccctggcaccagattactgccgttctctttcttccattgtctttctcgtgtgtatcccctctcacctttttctcttt

SEQ ID NO: 30090 - DNA, 3054 bp, Mus musculus
catctctgcaggatgatttattgtatgttttcctttttttttagcctagccagaacatcattataattttaaagaccataagatggcttttattagatgataactaaataaactgaactaagtagccagaagacagtaccttagagactgatagttgtaagtttataaaaatacaaatgtaacttatatttccattttcctctttgcccctttgtttattttccccagtagaaatgttctgtccagatttttttccccctttttagttaagccttgcttgcattcaggcttgtgtgtcagccctgtgtgccaatatgccagattcattttgtttccatccctgcactttggttattccttgttcagtttcttgggaattgaagcagactcattgggctacatttagtacaagaaccacatgtgtgatgttaaaggacacagtctagtgatgccatcatccttgagtaaaaactacctctagattgtggtaagcttttactgtcccttaaaacaggagccactagtaccttatgaatgcagactgtaacttctatggcattttctggtgtctttctggctctctgggcttctgaaagttttcacgtagacccttagactcctctgtcaggaccattgctttccagcgttgctgctttcactcgctgtctcgaagactgtaccactgtaagtgccactgcgaacatctttaaacggctcctccttggcttgtcaaggggaaggccacctgtaagatgtggtggtgacagccttcctgtccaccccaggctgctccttaccagctgttctagccgattctcttcagatcagctacagcccacctcctccccgccccgcctcacccctccaggctgtctcagtggtccagggcagagctcactgtggccttactgatctatctctgcagtaactgttctccctcagttgcgatggaagcaggcccctgcgatctgttcagagcctgagcagtttgcagttccgttgtgctttctgaggtcctagattcaggatgtagttaagtcgataactgagaacagatgagatgcttttaaagaacaaactcttccttacccagctttgtagcttaaagtaagttttcaagttcatggctttattaaaatgaactttgactttttaaaatgcttatatctcatttcggttcttttgtttattttagtaagaattgaaacagactataagtagttttcctgtttgtttgtttgtttgtttgttttttacaaagttcaagaatgtaacaataaaggcattttgctatggttctatgtcagactcctaccacagaatagtgtgaacagatatgtctgtctgctttaccatgttattgatagttcttttgtcagctgcttttattaaaagtcctcttttgtgaatttgtaaatcaatttcaatatatgatgtacaggagtcttgtcccccgttactgtggaatgttcccccctgttgatgctggtccctttatcctcttatcttcttagaaccgggaattcttcagttgtggtgtgtggctgtatttttctattctgtttacagtgcgtctacacagcttcttaaaacatgtcgaaatgcagaatccaagatccaccatgaatttgtcaagagattggaaggcaggccaaaacctgaaaatgtggggtgccctttgtacaattgcagagtcaagcactagtgggagtttgaactggctactgaccgctcttaaactgtggcagtgtccttgggtacagttaactagcagaacctgctgtcactcttcctgccaccatcttaaccttgacagttttgtttcttttctgtgtggtgctggggtcaaatccagagccttaggcttgctaaggctttttgtttgtttgatttttccttgagacaagtgtctcacccatggagcccctcagcattcttgaaagtctctgccttagcctccaggtcctgtggtaccaggtgtggcaggatgcttttgtcattagagaaactggtctgtgtccaaccacagaaaaattccaatgcagtttttaataattaatccactagttatttaatcaaaatctttttgtagggagagattcctgtttgaaagaaaatgctatttgattattaaccaaggtaacagacactgctttccaaagcagctgtgtttctggtgagtactgaacaaatgtgtggttttctgtgccacctttgattcatttttcaagcactgttactcgggatggatggttagaaacatgatattttagtgtttctacttaaccctttcaggaccgagctgtattgcctttctattaatttccccctgtgttgtgataaatgtttgctcgtgttcagtcctgtgtcagtccagacgtaggtttgtgtaaaagctcagttgtagcttatttcttgtaccttgcagcatgttctacgcatccagtccttaaggggtttactctacaaactgtgcacctgcgtgtaagggtcattagcaataagatagaaaattgagcaagtttataccataattttgtagaaaaaggaatctgctcaattccatatttcatccatgaaaactctgcaatacgggcagtttctaggaataaataaaaaggagatgcaaaccattgtagatgtcttctgtgggatgtgcccgatgcgtgcatcatcgtctttgattccaggtacttcataaagataaaattaaattctatattacagtttgtgggctaggattttaccttgtgttttacaggacattgaagtaataatgatgctaaattagtttccttttgagtgtttttaaaaatgattttcttttcttgacagtgttaatgattgggagttgttactaaaagggtttatccccctagccaaccccagcaaacctggagactgctttttagcaaaggcttccttgtctagtacaccaaagaataaacataacagcagtttatgcctttaggggactccccaaaatagggctcatgatacttcatgtaatattaagacaaatataaaggaaggaattacacggtttcaaatctc

SEQ ID NO: 30091 - DNA, 1563 bp, Mus musculus
caaaatcaaaagccttttcaagaagaagtctaagtgactcggctgacgtgatggaattccattcaagtggcatctgtaaactgttatctcccaccctccactccgtttttattttacttttaggaatgtaactccactggggctttccagacttgatgccatagtggaaatgtccgtaagggcagctgtctactgtctgcttatatctaactgactacgcaatcaattcatcaagtcagataccaccaccggagccatcggcaggaggcagtttacagttctttccgcctatttatttctgcattgatgttagtgatgtacacacagcattctgtcgaaagccgccatggacttacaagctttaatggactgtaagccagcatgggcttgcaaaattttcttgtttaccagaatatcttcttatctttccacagagctgtttccatcatggactaaataacttaaaagaagtaaaactgattgcactactgttttccagactggaaaaaaaaatctctgcaagtaaaactgtatagagtttataaactgactgtggatagggaattgttttcacttttagataaaatggatttttaagtagaaactagggtttctaattgacttgatttctgaaaatgaaaacccacacttttattatgggacgcttcctcaaatgcatttattattataaagtttcaagtcctgctgtaaagaccatgttgttttgttttccccagggctttcactgtgatttactgcactgcaggctgtatgataaaatataaataatgtaaaggcagaaggctcttgattccttatccaagtggaagagtaaaacttgatcgaaggacttaaaacattcacatgcttaaactgcggtctggggcgtggggacccaggcacttgtttacagactttgaataaatgcaaagaatttatggtttgtgaaaaatttgtactgtggaaaagataataaattggagacattattgtgtggggttgtgctgatttttgttgataacactccactgaaaacactgttttctggagagccatgtaagctgtcttgctgctgaattgcagtataagaaatagcgatgttttggaactaagttgtcaacaaatttctttgttttatattgtttgtcatatttttatgtagtttgaaatctttaaatgttctcatatcaagattaacaaatataaattgctggtgcatttagattgtgttgaatgagtttgtaaagtttggaactggttagctgctgggcaggtcagagagaagcctgagagtagcctcgcataggacagcagtgcacatttcgtttccaccttctcagctcttaagacctcaggcagaactatctggaaatacaggaagatgggtggttgggtgaacacggatatgttaactagaatttttttttggtgctggctatctgggaatgctgatggataagtaagaagtccccttgagatttgcataaaaggagtgctttattaaggatccaaatctcaaagcctcctgtgagttgtgattatttacttccattgctctggttg

SEQ ID NO: 30092 - DNA, 1238 bp, Mus musculus
ctaaccagtaccccccagagctcgtgtctctagctgcatatgtagcagaagatggcctagttggccatcattgggaagagaggccccttggtcttacaaactttgtatgacccagtacaggggaataccagggccaaaaagtgggagtacgtgggtaggggagcagggcggggggagaggggagggtatagggaactttctggatagcatttgaaatttaaataaagaaaatataaaaaaaaaagaaaagaaaaaaagaaaagaaagaaattagtcatactagtgacttaatagcacacctgaaatctctagaaccaaaggaagcaaacacacccaagaggagtagacagcaagaattaatcaaactccggattgaaataaaaaaaaaaaaatagagagaagttccgggtgcagggctgccactggaggagagcaagttgctgctctagcaagctttggaggcagagccgccgcaatgttccggatcgagggtctcgcgcccaagttggacccggaagagatgaagcagaagatgcgtgaggatgtggtctcctccattcggaacttcctcatctacgtggccctgctgcgagtcactccatatatcttaaagaagctggatagcatctgaggacaggcagtcaggtggatgcatggcatgaagacctggtgacggcttctcctcctgtctgcagctgaattggcccagaaaggtgtaaggctgattaaacggacatataaactacttgttgagaacaagtaggactttgagaactgacctccatagctgaaatataaagccacttgggaagtgcaaaaagatgtcttgtgttcatggtgcctttaggcccatgaactccatccctgtgagtgttgatggagtggttaataatgtcaggctctaaggggagtcatttctgtttaccacttctgttcaaagtgttatttgtgaagtctgtttggaagtcagcatacacccacaatgacatttaagcacagtctatatttttaataaacattctgatgaagaaaaaaaaaatagagaaacaaaacaattcattgagaaaatcaacaacatagataaactcttatcctgatacaataaacaggataaagacaatctccaaattattaaaatcagaaatgaaaagaaggaataacagcagacaacaaggaaattcaaaatgaagtattacttcaaagttaggaaatttaagtgaaatggacagtttccttaa

SEQ ID NO: 30093 - DNA, 1263 bp, Mus musculus
ttgtagcaagtaatgtttttggtgttgatttttaaagagaatggattgtttacactgttaaaattggattttgcttcccaaaattgtggttgtattctcgtgctacaagagaaattgaaggcttctcctgaattggagccaccagctctcctaccctttttgctcttcagggttagaaacacccctagacagtttagacagaccccctatgaattactctaaggggggccccctccactggtaaaaatagcctctgtacatagtgctgacatgctgctttctcagcctttgttctctaggctcaaggcactgaagtgagtgagacagtgagcgtggaagcagctccagatggcctactaaagaggagacctgcaagccccacatcgcttccaagtttgagatttggtctacattagatgcaactgctcagaaaaccttcagactccctggaaaggcccttatcttgtgctcttgaccaagctactttctacccttatgggaccccttttgattttgcttctgctttttaactataggtccatgtgtgttagatagttgcctttattagagcaagacttagtacagtgaagcttttagttttgagacaacagtaccatgccctaaaggatcaagtgtgtcagggacaagatagtgtctagttctaagattagaactactaacaaatagaagtggggaatgaaaaagtgaaacataaaaacataaaaattaggcctttaggcccaggcttgagaatgtgacctttgtgtctcaatgccccaagatatgctaatcataaaacagatagtgacattcctccacccacctgcttcctgggttctgggagtgtttgctcaaaaaggaccaccctgaccattcatggaaccttctatgcaaatgtgtgtatgtgtgtgtgtgtgtgtgtgtgtgtaagccaaatattgacttttatttgctgcagatggaccttacttgggtcctctatccacgggcaaaactcagggttcaggttacaggcaggcaagaagttggcaagaaatgacaaatatgaacacaagggagtgtggtatctgaatgtaatttgtcaaattgagcaccagtcttatattgcagacgaataacaagaaggctaggcaaatacatttgccaaggtacactggttcttacataaaacaaagagaatgcatacataaaaagatagtgggagccaggccatgtttacaactgagaataggaacaacccttaattaagatcagctaaacaca

SEQ ID NO: 30094 - DNA, 1169 bp, Mus musculus
taaataaggctgctatgaacatagtggagcatgtgtccttctcaccagttggggcatcttctggatatatgcccaggagaggtattgcaggatcctccggtagtactatgtccaattttctgaggaaccaccagactgatttccagaggggttgtacaagcctagtttgccataatttactacatttttaccatttagctgtatttttctgattaattcatgaattgagaattcaattttttaggattggtatcattatgtaacaaacaaattttgtaaatttattcattaatttatttgggtgttctctttgtaatttccatttaaatatcccagtaaaaatgaacacctaaagggggggaggggacagtggggagtggagaggggaacatcatctggtactgggtaagagaaaagggctgatgcactgagggccaggagaaagaatggaggtaagaggttgggggggaccctaaagaatgtaccagctggtagtggtggcgcttaccagtaggatttgctgaaggaggcaaaggctggaggatcacgagttcggggccagcctgggctacacatttgctgggtatggtggcacacacctttaatcacagcactagggaggcagtcaggtagacttctgggtttgaggccagcctggtctacaaagtgagttccaggacagccagggctacacagagaaaccctgtctctaaaaacaaacaaaaaacaacaaaaacaaacaaacaaacaaaaagaatgtaccagagacatgggaggtgagagactcagttaaaatgccctactttggggagagggaacttgtacagccaacctccagcagaaagacatggcattaagtgaagggtgggggtcccaacccacagtaaaaaaactggcccatcttcttgagtttcatgtgttttgcaaattgtatcttgggtatgtcgagcttctgggctaatatccacttatcagtgaatgcatatcatgtgcgttgttttgtgattgggttacctcacttagtatgatatccttcagatctatccatttgtctaaaattttcataaattcattgtttttaatagctgcatagtattccattgcataaatgtaccacattatctctatccattcctctgttgaaggatatctgggttctttccatgttc

SEQ ID NO: 30095 - DNA, 2091 bp, Mus musculus
tagtgtttcttggtgacaaggaggaggtccttaggtgttcttagactgaattctagccggatggtgtaatgagggcagggatgagcgggtgggtccactggggtctggagggattgcagctttcctgtgtcattaactcaggcagatgagcacgtggtatgtctccttttgtcacagctttcctcttttttgttgtttttctcttgtagcagctgctggctttcttgaagagttctaagagactccgaacttgcgagataatgaagtcgcctagggaatatttttatatgttttatacagtttctatcatgaagtcaatgggcatgcggatcaaacccaaaagggcatatttttgctacgctggacacagaattcagcttgctttgaaagaagctttgggcttaaaaggtgtgatgaaagttttagttccgtttctaaaagggaaagagctcttccttttagacaaccgtccccaggtgcacattcctggctgtccatacccaggcagctactcccttggaatcatggcattatgaacaaacagaggagccatttccagcctgagcttgtgttggcatgctgacatctgttcctgaaccccagattccatgttgactttggccctaagatcttaatacacacagttgggctgttacagaagactcttgcctgcaaaaggtccctggaaaacatctagtgcttagaaaatgatccgctaggacgtcatgggatccaatggaaccacaggcgccctgcactaaagattcctggaccaacaagaattcagcactgactcctgctcccgtcagcctgccccctgtcattctctggtcacttagaagacacagagactatgactgttgttatggacttaatctaaacagctggcttttagtctgattgagtaaaagggaaaatggtttaaaggcaaccaaaggccaaaacaaaacactcctcttatgcaaacacgcccttgagacttccgctgttttactcaggatcctgctgtagctgatgcttagtaaaggcttcctaggaagatcgcaagttgaaggctccccgtgttatagagtgttcaggggatagcctgggtgactgagccagatcctgtcttccaacaaaaaaagtgaagagagggctgggctatcactcagtggtagagcatgtgctctaccagtcttaggggcttcttgcctggtagggctctctcttggccttgttttataaaacgcctcaaagtacataggtctgggatggggagggtggcggggcggcaagctttatgccctacttccattggtgtgatgcattaactactgggtgtggttttggggttttttgtttgtttgtttcttttttgttttttgcttttaatttggctgtacaaaaataaaatagaaaaaagtggggtggggttttaaaaaaatataccccagggcattttctgttaaaaaaatttctgcttctggacacaaactaacttttttttttcaaacattttatgcgtgtggtagatgcagtttgatgtgaacccacactggcagctagtgacttggtatgtgtgttgtgtctactaagcagagatgccagtgtggatgccaggttcactgtggtccaggaagcagagtgagtgctcatgggagtaatgtttgtgcagctaagccagtatttttacttaaacaaacaaacaaaaaaagtatacattttgcaaaaaaaaaaaaaaaatgacgtcctttaaatggtgatgggctaatatgtaatattcttcagttttaattattttttaattttattcaatgtagagcactttctatagcaataaaaaaaaacaaaacaaaaaaaaataagcaaagatatttaagattgtatttatatacccagagtacattttaaacattttctaatacttgagcagatgggtgactggcttccagagatgccaaaaattaaacattcaatacattcaacacataagctttgtcctggtttgcacagcctggtgagaatcctgagggttcccagcatagttggcgtttagggtccctcctcctccctcctccctcagaagttctgaggatcctcgacaaggtc

SEQ ID NO: 30096 - DNA, 1215 bp, Mus musculus
gagtgcgggccctgctgaaagagctaagacacatcttcctggaccacgggtcactgagacagagtagggcaaaaccacagacgagggggatactgcatggtactgaaatgggacacaagatgctgagtggcctggcatgatagtagggtgatacaggaggatgaatggctccaaacaacgtacggtgggcatttccgttctgcctaatctttcttaagaaccgtctcctgctcggtttagccgtacaccgtgtcgcacctgaaactctgcgcaggcatcatgatcactgcctcgcacaatccaaagcaggacaatggctataaggtaaccccccccccagcctcccccaacccccacacacgctctctcctcacacagtggaaccccagcccctcccagccccccccccaacccccacacacgctctctcctctcacagtggaaccccagcccctcccagcccccccccaacccccacacacgctctctcctcacacagtggaaccccagccctgtgttcttcgggagtgggtgctctgcatcctgaacctgctaaatgcattcctggcttctctaggtctactgggacaacggagctcagatcatctctccccacgatcgcggcatttctcaggccattgaggaaaatctagagccctggcctcaggcttgggaggagtctttggttgacagtagtccccttcttcacaaccccagcgcgtccatcggtaatgactactttgaagaccttaaaaaatactgttttcacaggtaactgggccgtggcttcacttcagctaatgtgattcagccgaattctatcaatgtctgggttttgatttgatcccctctgcctggtgcatacatggttagctgcatttgtatggggcggcagcagagctggccaccttttcttaaagaaaccggtaacaaatcctcacggcattgctggctacacagagcctgacttcatctcctcagatgtgctattctagtgtacaagcggcacaagtgaccagtcaggcaagccacactgagatggctttatttaccgaagcaggtggccaacccacggtgggctaagtttgaagtgttgtaaatatatatatatatatatatatatatatatatatatatatatatatatacagttgtagctgtgtctatatatatgcttgtatggatacaactatatgtatatatgtgtatttaaaa

SEQ ID NO: 30097 - DNA, 1179 bp, Mus musculus
ggagccagttctgtctcactgtttctaaatgtcagtaaaaatggataaatagttttccttcaggctacttagcatttagctacttagtatagaacaattcctgagccagattaccactcaagcacgattcatcaacgccacctcattgcatttgtgggtagagaagaccgcagttgcctgttctgtttcttcttttcatttacaattgcgaccatcattattctctaatggtggtgggacttgaacctagggccctgtggatgccaggcaagcactctacctgtgagctacagtctcagcttttcctctccttaaacatgaggaaaatggagcccttcatggctgaggtgattccagctaggatgtcttaggggccagggagatggctcagtgggtaggaacacttgctattctagtgtgaggacatgagttcaaatctcccaacacccatgtgaaaatccaggtataccatgtgtacacctgcagccacagcacagcgtggggtggagataggagcattccctgggaatgcagctctgggttcagtgagagtccacatcagaagcagagggtggagaatggcagaacagaacatggcacctggcgtcctctaacacccgcctggcttctgcatgcatgcactcactgtaggtgctcccacactcgcacttgcacacgcgcccattccctcatccacgcactggcagctgagtcccgaccagtgctgtctgtgtctttctgtgcttgctgctgtcctgcttaggtgctgtctgtctgtcgcttcgtcaggcggttctggggttaaacataagctctgtaggaccgaacaggaacacgatgctccggtcaggcatcagctcattcagatgagataagaggaacatggggggaacgtggggcagagaaattacactgctctctgcctcctggagcctgaatgtcgtcgtccaaggtcacaactctgggccttcccccttttgctgaaccaggcagagtacgctacagtttctgccctttttcctctccatatgccgtgaagaattttttgttgtcaagatttttaaacaagaaaaagttggccaaccaaagacataggcacaccaattttggaaaactataaaaataggaagtttatttgttgggtgaagtttactattgtaggcctgctaaaggcagaga

SEQ ID NO: 30098 - DNA, 1117 bp, Mus musculus
tcagtgttctttggggaccatttacagagtagcctgtcagatgcttggagatgggctagcatggtctagcatgggctagcggggctgccctgcttgtctcctctcagctccgtgcctggtccctatctcagctccttgttgtgtcagatgtgttatggtcactgtggagctgtgagggggcagcattgcacagctcctcagagctcaggcctcccacacaaggcagaagtgggagtcttcagaaaagaacggggaactttccacacacatccacacggagatgctgagctctggactgctgtgatgtcaaagtgatgggacctttgggaggccgcgggcttacagaagtcttcctcatgccgggcctcttcctctcatgccctcctccccttcccagctgtggtgctccagaggggaatctgtaggctctttccactgccccgttccagcctgcaagcctttgttttcaaagcaaagcaaaactctaggcctggtgtgagagggcactcccatagtctctggaggctgaggcaggaggagcagagagttcaagggcagattgtaccacattgcaagacttgtttaaaaggaaaaaaactaaaaagtaagattccatgctggttactaagacccgctgtgataataatttgcttctggccatttgagagaaagtgggtgaccttggaggtacttgggtgaccttggaggtacttgtgtgaccttggaggtacttgggtgaccttggaggtacttggtgaccttggaggtacttgcgtgaccttggaggtactcgcagatcagagtagtgccctggcattggtttgtgtgtaaaacacacacttacacctcgaagcggctgagatgctcagctttggttgtgagtttcctcttgtaaaagtgaaacccttaaagccattagcaccctcccctgtccccagcccacactaacctttgttctactttctatttctatgaatgtggctactttacatggttcctgtgaaaggcagcctttgtcttcttgtttcaagtttatttaagtagtttcctcttgctagctcatagcaggttttccctttcaaggtcaaattatacctgcagtgttttgtgtgccacg

SEQ ID NO: 30099 - DNA, 1151 bp, Mus musculus
gggctggctttgaatgtcatcctcagaactgtcctgactgtagcttctccgcccacaggccaagcccacccttcctaacccacactctttctccctggtactcaactactgcagtgattattattattattattattattattgctgttattgtttaatgctaacacttaactttaccttgagttgaatgttgtatgaaatttactcaatccatttcttttcattttcacaacagtacacatagacaagtgcagagaggttacataacttgttcatgatctcataactaatttgcatgagaactgtgttcatcccctcctagcccctacctctgctcagcaggatggtgccctccatgggctgcacttgggctgtattagagtgtactctcaactccaaggacagtgcccgacacatagtaggtactcaatgtatctttgccatgttgatggcgaggcactgagcagtcaagtggcatggccatcagcgcagaggtgcagggacctatccaccatcattctgacagcctaagacttccaagccctacaggctccatggtgctaagagatgccagtactgggcaggtgaagggggaggctgactggcatggccaatcgatctccagccaaagcccatctggcctggtgaccctgtggaggatatttgtacattatcagcagctgaatttgttagtgtggtaacagaacagtggcatcgtgttcctgttctgtgaggtgaactgaaaactgacctgggggtaggggtgtggaaaggagtggcaggtctctctcctgccttctccactcccccatggcacaggaggagaggaaacacaagaaattttgctccctgttttgcattttcttcctttggcttcttgtctgcattccccttactcttcctggacaggtcagccctctgcctctgactgcttgaatgtcatcccttttctgcagaaagagaatgaagtccagattggccacactcccctgcccctgccccctccctccccagccagccctctccctaggaagcactgtttgtctgagccccagctcactggcctttcccctagaaaacagcgcctgattcacatcctctctgcccctgttcagccccaccctctcccttctgcttccaaggccagctgc

SEQ ID NO: 30100 - DNA, 1879 bp, Mus musculus
aggaaactggctgaccagcctgcagatccttttgagctcagaacttgggattggaggacaaaagtctcagagttattgttgtttttggttctaatccgtcccctttccagtcctggttgttgtagctttagatggcatggacatgaataaattacatttatggttcctcctccttcttgcagagacacagtgtgtggaaagagcattcatgactgcagtgttccaaaaacaagatgggtctgaaataattcctcaggcagaagaaacgtgaccctttgtcagtctgcaagaaaggttcctgggagggtgcccttgatgtcacctgaggtgcagtgggcccttgtccatttttattatgggacctaaggtgaccatgaggaaggaagaaaggggtttatttaaatcagatatattggttgttcctgaatccacggtcactcccattggtactgaagagagctcatcttttacaaactcagtgttttagtatggtttttgcttaccctttcaagtcacaggtaaatgtttcataaggaaatcacagtttttagattccctgttattgctagtgtgggacctgtagctgtggggtctgacatatttatttctttttgattgtttcatatccacactatagggtcacatatttatttttgtctgttgataaatgatgtaccactgccacatcttcctttgagccttgaaccccttggaaatctgatttctcatagaaggaacaaaacataccaagatttccaggggctcctaagatgctgaaacattgcaaaagaaaccagattgcaatcaggtgtatggcagctgacagcttttcagaagtaggaagtgtgttttgaaagtactcaaacacacgcacgccttccttgggatggcgaggaccctgtgccttcaagcagagtgcagctcacactcaccctgcttctagctggtcctgtgtagagcatcacccatgtgtgcaacagcttttttttttcttttaacatacacacaaaggcttaggttagggaagaccaccagccaggagccctggctatcggaattggtcctgccttgggctctgttggccctcctgttcctggaggtctgctgcagcgctgttggtaggaaaggagccttgtaagtctgggctgtaaggagagaccatcaccgttggggtcatttgggatctcctagccctatcaaagggacactaaatggccaggagggatgtaagactcccacatggtcttgggtcagaggagaggtctctccataaaccaacatgcccagtcccagttggttggagcaggggttgtcagaggagggtgacagtggacagcttctttccacattgtattttattatttgaatgttttaatgttgaattttggacatgttattactgttcaaaaaacactgactctacagtaagaaaagagcaataaaacagattattcacacctgtgtcttcgtgttgtctgtttttcaaactctgaattttggctttacagctaggagtgcaggaggctttggtatgcatgtcatcccatttgcaagggcatgtttgagctatcagttctgcttccagtatcagtgccagagtattgatgatgtcgggacacctttccacagagatgtgaatattagtatcaatgacactggcttctcccattgtatgcacaccattcatcagcacaagattccattgggccagagtagcatgcttacatactcctataggtaccgcaccatgtacctatagtaaacctataggattggttggaaatggtcacaactggtgacctagcaactctgtgacttcatgtacacttgggggttgtcctcctttgccactgtttgtcttgtacacttgagtcagtcc

SEQ ID NO: 30101 - DNA, 1182 bp, Mus musculus
tttgttggatggaggtgttaagcacaagctggggaaacaggaagaaggtggaggggatgtggagtatgagaagcaggctttctgaaaaccaggagagagcttatagcttcaaataagctccaaagatcaggtagagctcactccctaccttctgctctaacaaaaccctccattctgggcgacttaaggccacagaggttgggaagatggctctgtggctaagagcacgtgtcccgtgagtataaggacctgagtttgaacccctagcccctactgaaaagccaggcaatggctacacatgccagggcagagacaggcagatcctgtgagctcgctggccagcaagtctctctgaagtgaggagtttctggttcagtgagagaccctgtctcaaggaagtaagatgaagtgatagagcagagatttgaccttcttctttgacctctggatgtgcataaataggggcatgcagaactgcacatacatggtgcacgcacatataccacatactacacaaagcaacacaagtgcattgcttcagagttctggaggctgagatgcaaaaatcaaggtatgtgccgggccgggctgtgctctctctgaaacctccgtgaggttcctcctgccatttcgcagccactggtggtttgctggtgatactcggagtctgctggcctgcagccactcagatcctctgtctgctcttactgacacaggcattcctcctgtgcgtctccgttttcagatgccattttcttgtaggggtgccagtcatattagctgaggggccctctctactccagaatgactgaaacctaattaataacatctgcaacaaccctattttcaattaaggttctatattaagagaccaaggggttaggacctcaacatatcttttgggcagtaaaacagttcaatttgtaacagtgacatttaaaaattcacagcatttgttgttgttgttttgtttgtttgtttgttttgttcaaaaagaacaagtgttgatgaggatgcaaaaaagtggaactcttgtgctttgctgaggagaatgtaaaatggtcctctaaagtgaagtgtagaattgccactggacccagcacttccacttctgctgtatcatatcatacaatatcataccatgccttataatatcatatcatttatctatataacatgtgt

SEQ ID NO: 30102 - DNA, 3039 bp, Mus musculus
ccgagagggaacttctgtttttagaacatagagccttgaagcactgtccgccatggcatcactcacagggatgaaataagaaagtgggttattgaattctttaaccgatggcaaagtgtaagagaggcccacaagctttcagtgcacaggaaggcttaaggcttacacacctacacatgcagaatccacaagctccatgcttgtccctcagaatggctcttgctgcttttaatagttctttgttgattttccatggacaatatgtttgtttcatgcagcaccatgttcattgagagttgtgtatgatgttatcccgaagtctgtattttccgagggcatcagttcaagtatcgtagcttctctttttattcccaacaaagacaacaattaaactctgccttgcctttttgcaggagaaaagccgtacaaatgcacctgggaaggctgcacgtggaagttcgctcggtctgatgaactgacgagacatttccgaaaacacactgggatcaaacctttccagtgtccagactgtgaccgaagcttctctcgctctgaccaccttgccctacacaggaaacgccacatgctagtctgaaaacctgtctccagctcagtgtgattccccgctcttcctggcctctctctctttctctctctctctctcctatctctttctcttctccttctgcccgttatctaactcatttttatatgtacattttaatttcgattcagctggtctggatctctgaatttatatcattcaagacttccatatggtcagtagttgatactctaaccctcccctccttaccacgggtcagacctaaagaatgtgaacattattttttccggggatgctaagcaaaccctccttacagatacatttaatgtaacgagaacaagggaacatgtaaactaacgaccaatttgtcggtttctccatgtattcctcaaaagaatgtcaaagtaaatgtattagaaatgcagtatccagcctattagtccttgccagagaccttcgactttctgccacattttgtgtttgacgacagaaagaattctgtccctgttaccagctagcgagacctacaagatgtcaagctggacccaccgtctcgccttcgccctccccacgattcgcctgttgacctggctcacctgctcagctaaatcagctcctttgtcctctgtggcacctgaagctcatgtggagggctttgacatccctgggagctgagcaggagctgttgccttaggtgggccatgtgctcccatagtgtgaggaagaaggagaagatattggaaatggaggagggagtcagcgattcctggctaggaccggctggaccatcaacatctgggaaattcacattagctgtgcagtgcatttgttaaatgtccatccccaggcacaacttggccgagcacacctttgctgcaaagctggataccgagagggttatccatctgtgccaccaccacctccgttcctgcaggatccttcattgtcgatcatgaagccttgagagtaaggaatccacagaaatatttgttcagtcatgtaaaaaaaaaacaaaaaacaaaaacttttgaggcagtataaaatggtctcttctccccccaccccccaacctactaagagtgtttttgcaaacaggaaaacattgagtggtactaatactcccatatccaatgagccacatagctttcatatggagcttttctgtgtgagctgtatggtgccaaaccagcaatcatttgtgtctatgacacatagtataaaagagcatccactaagcttgagcagagtcactcaattaagacctgagtgacactatttgtaaatatacctagtgtgaagcacatagatctttattttggtgacttttttttttttttgaaaaatagagaaaaccacaattcagggatttatatatgtagcttgaagattcccacaagtttctgccagagctagcaatttcctgtcaggtaccctgttaggacaaaccagaagcaatgactcgtgttgatgttgcagataaatagcaccattatttggggggaaggttttttttgtttcgttttgtttttcaaaagcaggcttttgaacaccacagtctaaatgccaatgaaaacagttcatagattgcagaaatgtcactggttccaaatctgagaaataaaatgggcacaatggtcagatatggctgcctctgaccagtagtcccttcatcccctcacaaaggatggaggagaagggggggaggggaatcctgaagagttatcccagccacaactcaggatccaacactacctgaactgggaggaacaccctaccggattgttcttggatgtcggggagtgagaggtcttggagccctgcacttgcagggaacttgatttgatggcactatgttcatagttgtgggggctgcactcgggaggccctgctcagccctgtgaaccaactgaggggggaatgtgggtaaaaactgcaaagaaatgttatcttagctcttgggttccttttctttccctttttagcactgaaaaaaaaagtctgtttgggctattaaagcatgctaattaggctcttgcctttctttttgtttgcaacgatgacatgaattgaggagtgagtgtctcttgggaaagcagggtctcccttgtcagtgttccttagcgttcatgccaccaccatcgtgtcttgaagtggttcttctgcagggcactgaagagtcccgtttgtttagtgtttgttccaatttgtatgctccgacccagtgagcagcggggtagggtgcaaggaaggacccttagctttgcttcaaaccaagaatagttaatagcaccatggcgtatttaaattttgttcaaaagtctttattatattactctttagcttgcttagatcatgttaacagaaagatccattttaactctgaaagaaaagtaacccagagaagccattctctagtcccatgctagtctgatataattttagttaattggcccttaccaaatttcctatatata

SEQ ID NO: 30103 - DNA, 1133 bp, Mus musculus
caatctcagagatcaaaggttttataatttggtttgaaattagaattgtcttgaaggagttgctaacgtacatgaagtcacttgagttctctttattctcttcttggtcaaggttaacagtttctaaacgattgcaaattcacttaagtaatacatttacaaagccattttacatgcattaaaagagggctacaatgtgttttacaaatactagcacttttttttcctgttatgtacctagtgttagagggtcagaataatctttctgcttggcatctcttaaaacctacctgcaagcatagcaggcttattgcatttacagttctttaatacttgtataaactatgcagaaatttttaataaagtgtaatatattttataagctaataagactgaatgggtaaaggtttttagcatgcattagtatacttgcaaatactgaaacattttggtaatctttcttactaaagatgtgaatgtttaatgtaccttctgtttctaccctgtagtccaatgggaattcagtaatgacattttgtcatgtcaaactgtgaacataaatttgtactgtacagtcctcatatactatatacagtatgcaatatatgtattatatacttgttaataaaaccatctgaatattacacataatcatgtgattactataggtagtatttaccaggaacaaagacgtgagagatgtaaagtttcaaagtaagtcactgatgagcaataatttttaatggttagaaaaggaagcccatctagccagtaggtacaccacaggagtgaagagtcttaaagcaatgacccagtaatgtccaggaagaggaaggctcagtttaagccatagaactgcagacattcatctgtaaatacatccagtgcattttagaagagctttgtttctccatcctatccagaatgcctccttgctgtgtgtgatgttcccaaggaaactcttcccagaagagtctgcctctgtaattctgctcccttttcttattcacagctgattctccagctccattagcccagcaaagcagacttttcactccagtgatactggatcttgctaatcacagctaattctggttaagaattaaccagagaccacagattcataaaatatc

SEQ ID NO: 30104 - DNA, 1160 bp, Mus musculus
taaggtgtatcagggaaagtccttgtgattgaacctagtgtcttctatatgcccagccagtgatcaactcctgagcccttcctccagcctagtgagtgcttctctccagacctggatgtttggtcgaaacagtcttatgttgtggagtaaaagccgatgggtcagaaacaaaagtattattcacagaaatgcttgccagctgggtgtaatggtgcacacctttaatcccagcactaagggggacatggagctcagggggttagaagccagcctggtctacatactgagttcctcgtcatcgagggctacatagtgagaccctgtctcatgaacaaacaaatgctgatttttcatggcctagtaacagtagtgctcagcctatcataaagggaatatgagagatgtaatagcttccacaaagaggggagatgagttaagatgggaagaatacagaggaagagaccttaaacatccattttgatatctgaaaaataaattaaaatgaaaagccactcaccgttactcataatcaaatgtaatgtaaaaacaaaactctatatatcccacaaaaaaagaccaagagtaaaaggcctgatggactggagatgtggctcaggggtaacctgtgtgcagtgttctttagagaacctgagttcaattcccaggacccatggcaggcttcttaccagcaccttaactccagctccaaggagtctgacaccctcttctgttctctgcagacactgcacgcacatacatattcacacagttaaaaaaaaaataaatcttaaaaaaaaagactgatattgccagtgttgactggatagaaggagttttcaggcactgctttaggtgtgtgaactgatggcaaaggccagagtggagcacatgtgttcctataaagtaatagcccccagatacccacataactgtgatgatatacaagagtgtacatagcagcagtattgacaaatgtttaaaaccaggaacaactcaatggtcttgtcaccaacagaagggattttagtggccatacacacgtatgtatgtaacatatattgcatatgcacattatatatataatatgtatgtatatgtatgtgtgtttggaatatcatagttcatatattcatcaagtggctcagacaactgactgtttt

SEQ ID NO: 30105 - DNA, 1202 bp, Mus musculus
tctttgtttcatggtgttcatgttatcacttacagatagagggaggaaggaaggttgaattgtgatataagggaaatggtgggtagagtggccacggattcttaattcaaaggcagaggcagaacacttgagtttgaagcaaggctggtctatataatgggttctaagactctttcagaggctacatagtaagaccctggctcataaaaacaaaaaaagaaaaaagaaaaatagaaagtaatttctgcctaagctcttatttcctcaggcccacgtgctaagtcctttgtgttagtgtttgttgtaaaggcctgatcgacacagacgtggaaattgttttagatagctatagcaggtatcgttccatcttctatcctagtgccatcagcatgctacatcaccaatggcatttaaagtcagcgaactgtcacagcaatagcctgttgaccccagcactgtgccttctttgtcacctcttttgttcctttttccagactctatgcagttggtggtcgcgatgggagctcttgcctcaagtcagtagaatgctttgaccctcataccaataaatggacactgtgtgcccagatgtcaaaacgaagaggcggagtaggagtcacaacctggaacgggctgctgtatgccattgggggacacgacgctcccacatccaatttgacctccaggctctcagactgtgtggagaggtaatttcctgtggaggaaagcgaagagcaaaccaaaacaaaatagtttcccacccttccagccaaagtcataagactagtgagtgtccatcagtgtggtctccacacagtcctgccaacactgggctgtcttctctggctggctctctcccggactgccagccgtgcactgagattcctggatctcacatattccctcgggatggagcctggaatgcatgcactggacaagtatttagtgttctgctgtttagtactggattctgccttcccggaaatgtaaaggagcttggtgaatctcagaaagaaggcattggggctggaagcaaaggacagggccatggctggcccattttgatatacaatgaaataatagaaaatgataaagaaaaatgacaagttcctacacggcttaaaggcttaaccaagtcgtacttactggtcgtaagaaatgcagcttttaggccaagtagaggacctaacagcagtgaggat

SEQ ID NO: 30106 - DNA, 1173 bp, Mus musculus
gaggtccctttctgtgtttgctaaaggactgtagctaccctgtgaacttgactatctggaagataaaactgctttaaagggatcatgacgcacaggcggtgacattaagtgagtgacctcacaccacaccgtggcattgttgaggcacacctaagcggacagtgcataactgacagtagccattccttcctggttttgttctttgaacaatgctgttaacatataaggggaacgtggtctttcttctccccaactctgggtcagataaaaagcccaagaagtgacacatcaagtagaaaactctcctagcttcttttcatgtaagcatgatttgttttgcttgtgaaacaaatatgttactgttttgttcctcttgggccactagggaaccccagagagtaaacttatttggcagctaaaagaggccttgtctttagagttgctgaaagaaggttcaggcgatccttgctgaatatacattgaacaatcatctgcagatgcatagatgaagtatttttgcctataatttaatgtgtctaaatgtttttgaaattgctacagttgtcaaaaagttaaaagatgtggaatatctgggaaccgtggccagcatctgccttcattctgactacgccgctgcactctttgaaggcaaaatccagttacatttggtaagtatcacccccgtatcctggaagcctaaatttgatgtcccattaccaagacccttggccaggggtcaaggggtaaaacgccctggctgatgatctgcgtctagatagaactacagatgagctgtgagtacttaaagagaacgcactcactgttataactggccatgttgcacgtagggatccaccaaactatgcctccagagctgttccagagaccggcacctgtgaggacaggattctggaccagggtatctgtgcatacaccgatttcttgactttatattcgagaagccaaggaaatcggctactggacagcagttgagctgctgcacataaacctcccactaaataaaggatgctcgtgggccaactgttttgtgcagctggcctaagggagtagttgaacttgagaaaaagacactttccctagctgtacacctgatttacttagataaatcaatgaacccctaaatgaaacatctttatgttttagatagaaaat

SEQ ID NO: 30107 - DNA, 1331 bp, Mus musculus
gacgggacgcagtgggcatcttttgtagcttaagtttatcctaatggcctttagaggaacaatgctcaattttttttttttaaacatggtagttattttatggtgaaattctgtaaataaatcttaatccaaagcagctaccacctggagccgagtattcttggtgtattatcaggtattttgcaaagcgtgcatcaggaatcagatatccacgtagcgcatgggtcactgtcaccttgagtagcagactgttatgctgtatattactttccttattaatttggttggattacagtattcagcagttcttactaactctgtgaattgcagttctgcaggtgaagggtcagagctcaaattcccagcatccccttgtcctgaccacattgctgctataggtagtctgagagaagccacttggctagtcagggtgtgcacacatgggactgctacacattcctgtccccatgcagtcttagccatcaggttgaaaccagtagtggagtgtaggctgggtcagacccacaggctcattctggccgggagatgctgtcctgtgatggagtctataagccctactggaattccagattgtatctagaactgtgcttgttgagggaccctgggccttggctgtaacctggcctttaggtgtttagttctttttaaatcagaaagtgctcagaggtctatgctgcctctgagaggtatatgccaaaaagattataaaggaagggccaagctctgtctttttgagttctcatggccttgttgggagaagaaacagaagtcctggagacattgaaagtgtattaaccagcatgaaagatgtgtttcgtggaggtcagtcggttattatggaaataaaacactgccttaaacctgagcgtactgagtcttgcccctctcttctgtgttgaaacttgcctgctgcagtgaaggcttcctcacccagaggagatagatggttttttagtgcatatttttccatttctgttactttgggacaaaaaagtcatgtttcccgctgttggatatgcattccaggaaagggctggtaatctgcttgctttcagaacaaaacacagtgctcctcacagttcacttatgatttaaatggtgaatgctgggaaaacgttttaaaataataaagtttagaaactgtaaatatgctgtttaatacaggaggacagcaacaggagtctgctgggtttctccttgaagcccctaaacatgaagtaagggtgcaggggaagggtgggagcagaagggggacccacacgtctgcattggtattgaacctcctagcagctcctgaaatggcctgtgga

SEQ ID NO: 30108 - DNA, 1155 bp, Mus musculus
agcctggagctctttatgtagaccaaactggccttggactgacagctcttcctgtcacttctttcgagtgctggttttaaagcatgcaccatcatacttggctgaaatttttttttatatttcagtccattgattgagtggtgcgaatgtgtctatttcagtgactcattttgaagtcagtattctgcttgtgtttctcactgtgtgtgttcacgtgcgtgctacagagtgcttgtgaaggtccatttgtgggataggcatgcaactcaggtcacgaggcttgcaggacaagtaccttacccctgagccatttggctgccctaagagctgttctcctaggataaaatactattcattaaaaggacctgtgaaataacttacatggtataaaatgactacatgcttaaaagataaaaacttgagctgtgcctgattcactggtgttgatgatctaatgtggggaattgggagatagggtgccattcacatgatttaaaaaataaagatttgtgtccttctgtttcagaacttactccagcaaaaggacagtgaacatggattacctgtcacacatcagagacgcacttgtacgacccttgacctcacaaggggtagaaggggctcagcatgtcatcaaacttatggacacatactatctgatgaaagaagattttgagaacatcatggaagttagcagctgggggggcaagcccagtgccttttccaagctggatcccaaggtaagatgcactgcccactgtccacggtccttggaaatggccatgctgtgctagcagcgctcgagggatgtgctggggactgtagacagtttgttcctccccccgagtgtttgctactgtcctggacagtggccagagaaggctgagaccccacactgcctttgtggttttatcttggcctcaaattgagtgcaaaggcgagaggataagtgtgggcagtggggcgagcctgagtgtgagcgcgaggcagggctagagggctaaaaggaagaatgtgttcacagcctgagggtgtttataagtttttctcttaccaggctggccttgcgcgcctaattctcctgcttgtaggactgtaactgtgtgccacatttcctgtcttagtctacctgctgacctagtgtgtgttcctggt

SEQ ID NO: 30109 - DNA, 1213 bp, Mus musculus
gaagagagacgcctggtcagctcttagattagctgtcatctttccgcgggtgggcgggtgatgccttcctatctttatgtttccagcagttctcagcgttactctcagggaatggggagctcacacttgataagctttctagagccaaagctgccctttagcagcagcaggcgtttcagtgggcaattgcatcaaggtatgaaagctaattgctggtttaagtatggaaagtggagactagcacaagcgggtaattttaacgtttgcgaacggtatgtttctctttgttcttttggtagctgtgagatgttagcgtgtaaggcattcatcaggatttgcaccggggttcactgaggctctgctgtgattccctagccaggtttcacgctggggttatttatgatgttgggagagaaaagtcagtttgttgcagcttggctgccaaatatttctttggaaagctaccatataatttcttctctgcttgaacactgtggttttgtagggagctgaaaattgcttggaaggcctgacgtttgtgatcacaggagtgctggagtccattgaacgagacgaagccaagtctctaattgaacgttatggggggaaagtaacaggaaacgtgagcaagaaaaccaactacctcgtcatgggccgcgacagtgggcagtccaagagtgacaaggtgggttctgctacctcttctcacagtgctgcctgtctgcagcggcatgcgcattgtggctgtttgtggtaatgcccctggctgcatttcagggaactaagacttgtcctgcagatttgtcttctctgcgtaccatatgctgtgttgtctgctgggactgactacaagattttggttattcagttggaaacatagttgctgtttacttgactttctttatatattctaatttaaaacttaaaaaaaatttaaacatacatagtttcattttttgtttttgtttttttttttgtttttgtttttagtttgaagttttctgatacaagccactctagatcccatcttaatttttcattattggaagtgtgtgaggaagaagcagaggtcagtgggaaagtaacacgatacctgactgatgggtttaacttgccctaagaagacagtagtcactaggatgtttcagcagctcaggagcttaacccagagagtcccagccaccaattctgtcagccttataggcatcaaacc

SEQ ID NO: 30110 - DNA, 1814 bp, Mus musculus
gtgtgtcctggttccttggcacaggactgtgccacgtttacattgatttgccaatgtcttagactactttgacaaccaaagcactaacctatatatacggtgcgtgtgcacatgtatgtgcacacttcttttgaacatttcaatagaacaaaatgagagttatctgtctgtagagtatctagtctttatgagattggatgtaccagaacagccacaaacgactttgggtcgactttgggcttgtatggattgtgacctatctctcagtaatgtgtttagttagtgttgccagaaaaacaaaccaaccaaaactttaattttagccagatttctgcttatcttgcttgattttctttggaatacagtcttctcaaaacacagaggattccagattaaatgatgaggccatcgccaagcagctgcagctggatgaagatgcagaggtactgccattccacttagttatcactgttggcttgatggtctgactttggacttctgttagccaggcaaacagtcaagatggttttaatccttttctctttttaaataagttctgcctgcctccctgtcttgtctctgtatctgcctgtctctgtgtatgtgtgtccatccacccatccatccatccatccatcactccaagacaggaccagaactcactgtataggccaggttggccttgaactcacaattttgccttagttttctgagtgttgggattatagtggtgcacagccatgattagctcaaaatgagcctcatcaggagtatggtgtaaaataaattaaaataaagtatatgagaatataagtttctgtaaaatataaatgatgagactaacagataattatttatgtaaacattttgaagttctgtgaataggaggctctgtagtgtatttgaaagaacttcattttctcctgtcttctttttgctttcattctgagcatatacactctttccctggccctttactgtatacactgatgtcttagaaatctgcctttggttcaggattctctcttgagctgtaaacccatatctgacagggatttattgatcacttaccgagttcctagcatggctgttggtagtaggtgattatggtttaaagagaaaaccaagaaagaaaacaagatgctgggaagcgacagacgtgcagaatgcaagtagagttctggggcaggtagggagcgcgtggtgtcggagagtgacgcacaggcagccactgctgaagactcagatccacactgagcccaggatcgcaagggtaagcatctgagaaagtatgcgcaggagatcagtatggccacacagatgaatgagaaggcagttaggggatttggaggagtagccatcagcaggtcttgtaggtcacaatgagtctttggtacctaggaaaaggacattgattggtcaggacttcagatttagcctctgtgagatggactcaattggagtccttagtaaagtggcatgacttggtgggtcctggaagtatactggcttctgtagtgtacacaggataacttgaagtctttccctgtagttgggcatgagcagactggcgtggagattgttaaggtgtggcaagtggcaaatgttagctcgcgtcaggttggaagtgagaggtgacctcagcagctggatgaacagtggtgctgttacgaagatcagaacacaggatgcagagcctgttggtacaaagaagttagttctgttctggcggctacagggtggtgccggcaggtccagtctagaggagagagaacctggtccctctggggtctctctggagctgagcaggatgg

SEQ ID NO: 30111 - DNA, 1243 bp, Mus musculus
aacttgattggttgcttggggttttaaatggagttgtattggtgagatgtctctcctgttaacgctgttgaatacacacctctttcaggtgtggcttgttctgtctctcaagcccagaaggatgagttaatccttgaaggaaatgacattgaacttgtttcaaattcaggtgtgtatatttgtcataacagacagtaacattttatctgagccttgaggttgaatgtgtgtctgatttctgtttccaaacttctgagaaacaggaagaaatccattgtggatctgttgtgtaggtatttgtatgctgtgctttgtatcatgagtacaaaatggttgtgtgtgctctgctcgtagatgttcaaattgggtggcacatggctggcttggttgggaaagtattattcgtttttatgtctatattggggtgtgtatgccactgctcagatgagatccaaggacagtgaaggagcccctcctgtgtaggcttgagggattgagttctagttagttgggcttgtatgagatgaatttggctatgtacttttttgtgtcctgtgtagctgccctgattcagcaagccacaacagttaaaaacaaggatatcaggaagtttttggacggcatctatgtgtctgagaagggaactgtgcagcaggctgacgagtgaggaggcctcaggtgggtgcccatgtctgcagctgactgcttcggatgagcacagtgtgattaaaaaggattaaaagaactttctgagcaggaatattggcagaagattttacatgtgtgtttgttttacagttcctggccccagaaacgagatcctgaccacatgaacaatttgggctcttttgggagaataaaagacttatatattgatttgtgtgtccttgtcttttctgattacttaatgggtcagcgatactcaagcaacaacgttacttggggtttttttcccccgtggaaacaattggcttaaaatagcaatgacaggcaactttcctagtggatgttgagtgagtgtgtcactttgggtaggtcctagaggtgcttgactttgacctaggcatgatactgactgttgggtgggcaggtgtgtctcagtagtctttatagagttgtaattctagcacaagcaatgaacctgtggtatagtataggattctagatgtaacagacttggtacttgtgtgaattacttccctacccacctgggagtgacttgtgaatgctaggcaaacacatt

SEQ ID NO: 30112 - DNA, 1158 bp, Mus musculus
aaaaggatatctggaacaatttccctagttttgaacttaggataagcaatggcgttcccgccgctcacccgggaccccaggctgcgagctgtatcccagcagcgtagagccatccccctcttttaggtctcaggagtgtcaagggatcgagggaacagcacccccggcaccggacgcgtccaacaactcgtcgcttgagtcatgacgcgatacgtcgtcgccgaccggcgcgactcgactagctcggcaatcgagtagttccgccttaaagccgtcgctcgggtcgtgacgcgacacgcagggccctgacggattacaagaacgtgatgacgaaagacgttctctctttgccccatctactgcgaggtgaggagcttagggaccgggtgccccgggaatctgaacccatcctctgtttggggaccccggcggcatggagccgatgccccaaggctttgtcccgactgtcccccagcacgacgtgcgtccttgggacttggtggcgcgagctggaagtggcgttcgggctttcaggcccatctcggtcgtagcccttccgccatggcgcaccgagccgggcttccttactcttctccggggcccccggtccagtccttgtcccggacacacctgggtccttgttgccggctttcgtagctggcgattcccgttgggagcggaacgctgccgggtctcgggtgtagagcgtcccccgccccagccgtctcacccgggtgtctgtgtttcaggatgaagaccattctcagcaatcagactgtggacattccagagaatggtgagtagatggctccccgccggccgctgacggctttcctgcatgctctaaaccccggcctatggtctcaccagttcactttctcgtttagtcgaaatcactctgaaggggcgcacagtcattgtgaagggccccagggggactctgcggagggacttcaatcacatcaacgtggagctgagtcttcttgggaagaagaagaaaagggtaagaacttgtgtcttccgatgcttcgggtgcttgcttgtaacaaaacccggtaaccgatgttaatcccccaccccatgcgtggccgagtgggttactcggactcagttcttttatgagtgaacttgggtgtgtgtgtgtcgtccctctggtgt

SEQ ID NO: 30113 - DNA, 1172 bp, Mus musculus
ctttgtgacagataataaagatgccactccaaagaaaagtcagaaaaattataagaatcttagaggaaaagaagggcctgtgtaggttaccccacgtgtgtgctggggtcacttccgtgtgtggaggatagtctgtggtttttttttttttttttttttaattttttttttttttttaaagatttatttatttattatatgtaagtacactgtagctgtcttcagacactccagaagagggcatcagatctcgttacgggtggttatgagccaccatgtggttgctgggatttgaactctggaccttcggaagagcagtcgggtgctcttacccactgagccatctcaccagccctagtctgtggttttaattgctcttttagtaagtacgtttttactactgaggaataaaaatgatgagtccacaaactatttaaacaaaatacctgtatttggagttattcgtaatttttttgtttgtttttgttttttcgagacagggtttctctatagcgctggctgtctatccttgaactcactctgtagaccaggctggcctcgaactcagaagtccgctcgcctcagcctctcaagtgctggaattaaaggcatgcgccaccactgcctggctaattgcttttctttacacttcagtattgccatatgagttaaacatcttgttcaactcctgtatcatttgatagcagggacttaaccaaaaaagaattgtatggcagaaagaattgtaatcagaaagctgttgaaggatgagtataatagtgcattcctgtaatcccagcacttagaaagttaaggcaggggagttaagtttttaaagccaccctgggctagagagtgagactttgggatgtgtaagggaggggaggtagttgttgttgaaagagcctaggtgaaatgttcttttttttatttatttttttgagatccaaatgcataccttcacaacagaggggtatggtaaatttggaagggcccctgatatactgacaatgttcgatgatgttcaatgatggtagtgtcactagcacatttcttctatgtctcttcacacatgcgtatgaaaaaaatgatataatgaaccctttaatgaatgaaatgagacctctagcttaaataactcagtcaataatgtgacaagttgcttttcatct

SEQ ID NO: 30114 - DNA, 1190 bp, Mus musculus
tgcacacatggtaggtatcactgaatatttactattttgttcttgaagcccttggctggtttgaactgtctatgtaaaccaggctggcctccaattctcatagaaatctgcttctggattcccagccttaggattaaagatgtgggctcctatagccaccttgagtttagttctttaaactctaaactgaagtttctcagtagtgtttgacacattgaagtatctctgcaaatattttttgaattatctggaaatgttagagaataatttttatagaaaaactaggaccattataaacctttggtatatacatacccatttttctttgaagcctggtttgcaccttactatcatttaatgtttcttaataatatcataaaagtgtgtcatgtaatttatcttgggataccattttcttcaaggtatattttacctttatatgttgggttttttgtttgtttgtttgttttctgtcctccttattacttaaaaactcaagtgtgctttatattctaggtccggtttatcactaaaatatggcaccctaatattagttccgtcacaggggctatttgtttggatatcctgaaagatcaatggtaagagatctctgaatttgctctttcttctctgtcttataggagtattaagactacaaatgttgtgttaatttccccaaaccataagttttaccttaggcactaatttataaattctcttaattacaatggaaagtatatattaattgagatcatgataagtctttaaatggacacatttttgtaataatatcaaatgctaattttatatttaaaaaatcttatttcatttttattttgttatatttccttctttgttagaaagctatttataatggactaaaaatgtaagttgaaacaattatctttgagataaaatataagcaagagatgtccaaagttgttttgttcttaggtgttacaggtacttttgcaagtaatattttcttttatatgagacttcttcacttcacttgcctggttctttattttatttacatattttggttttgtcctgcatgcgtgtgcgtgtgtgtatgcgcgtgcaggcatggtgcagtacattatggagaccagattacaacatgcaggagtctaggagctgccctttgtagttctcaggagtgatctcaaggtagcagtgggaatcag

SEQ ID NO: 30115 - DNA, 1422 bp, Mus musculus
caccaaaaaaatagaaaacctctgtgctatgggttttgatagggtaagtaccgaaaagaccaccctgctaagcattaggacactctcgagttacgagatttatccccatttaaaggtggtgacctaatcagagctttctgtccctgtcaccatccagaggaattgatttcactccccattttaaacccgggctcccagtccttgggagaaggggactagccattttgaaaatgtagttttggttaatcctgtatagacgctgcaatcagtggtgactgtgcagtcattggtagagggaagaacgtgtgactctggcgaggaggatttggtttccgtgggatgtgattgctcttgtcctcctctttacagaacgcagtaatagtggccttgtcttcaaaatcatgggatgtagagactgcaacagaactgcttctgagtaactgaggcacaggagctgcgccagcatcgctctcgcctcttgaggagcatcaacacctgttatttttaggattctgcataaagttcttttaaactggcattcttgcctaatgatgttacctaggcaccattggagactgcaaaaaaaaaaattccctgctctgtaaataaagctaattaaacgtctgtgtaaatttaaaaaggggaaatacttttaattttttttcttaatagtgtaaaaattctttgagctaagctaaaaccatgggaaaacatgctactttagtgtttagcagtgtaacagactcgagagtttgcttcagggttctgttgactaactaggataacactcgagtgtcggcccttcacattgtggtgtagaatcacagctcccttaagtctgaacacagatcctctgtgcctgtgaatttacttgcatgcttgtacttgacttcttagaacgggtagccgaaaagaccacccttttaagcattaggacattcttgaattatgagatttatcctgatttaaaggtggtgacctaatcagagctttttagtccctgtcaccatccagagcggagattctcatggtcaatttattttgtgtcttgtgggaaacgtgctgaggaacagtgtcccttgttccacttttagctcataggtttggaatgttttgtccgagttcttcactttgtaagtagtaatgtaaaaaggggctgccaattttatttctctcacaaaaggaataaatacttgatgttgcagtatttctagatttaataaaaggacactgcttagtttttcagtgaatttgacattaatttttaaaatgataaagtctttggaaacttgaagggtgcagtacctgttccctagtgctcagcctgacagtttcctttgtcagacacttgacttactcctcctgctccccatggtgacccatgaaagctgtgctgtctcactgtatataccagatgcacat

SEQ ID NO: 30116 - DNA, 2046 bp, Mus musculus
tatgtttttctccatgtttgcggatgcacacatttcctgttgcagctacatccttttattgctgtaggttattttataaagatgccaaaggaaacaagtttttctttatttattttaagtagctaaaactttgtactgttctttatattctcagataagaaggaaatgtgtgaaataaccatgagtttacctccatagttcattagaacttttaatggagggtggcttggtaacactaatatttaggtattggaaagtataacacatgttcttggagtttactctctgcctgtattgtcagggtacattgtctagtagatgagagctcagacaacaaaagtcaggcagtacctactttgtcttggtggcagctgtgttctttttttgttttttgtttttttgtttttttgtttttttgcatattggcttcagactggctccactgaatacttactggagatgtatatataacatgtggtttcatagatttgacgtgattatgccatcgcctcctgtcagaaccgtgtgctcaagactgtgtgggattcataagcaagactgcttggggtttctcatgttcatttaatgtgctaatcacccttttggggtattttccctcacacttctcgtttgttttttatttttcttttgtttcccaactcgtaggtttagaaagaagcagcttggtccttatcctggtgtttcatacagttaggaaaacaatgcgaaaaattaagatttagtcaaaagtaccctgatggaaattattttttttagtctgcgtttgacagtttttcattttaacaagtactacacaggttctgttttggtgtaggtgtgatggcgcttttactaccaggttcttgaaagagaaaggcaggcagagtctgtgagaggtgtatgcccagtcttagccccctgttcccataattttagtgaaatcgcgtttagagcaggctgactccctcatcctcgctgatcctctgatcagcttttctttctgagcctaggcctgacttttagtataaaacttagagagcatgttgggaacttgggattcaaaaaacatgtcagtgtttggaattgaatattttacctttgagaagtgtaactaacctatcatatgaattaaaccatcctttttgaaatttttttttatatttctgattgttggtggcatttaacactatgcaaaaaacttaagtatctgcagaaaggaactgacagtaggttttgctcacgcggttagacattttgcacagcgtgttatacgttactggttaggctgttgggccagtttacagaggttaggatgttgggtaagtggagcccggatgtgattgtaggtctcatacagcttttaaaactgcaggagaagtagatgttcttgcagcctactgtagcagcaccggaaatgacgttttggtggggtaagggtttgaaatgaatttgggaattgagcagtggagtcaggtatattgtataaagatgggatcagtgtttagataagaaaaaggtaggaaggtgtctggtcatagttactttatttcatggactttgataagatagttctgtattaatcactttttctagtttcaaggagttgatgttggaagttacattttcatctttcagtacctgtcttagtgtgtacccatcagcctgttggtgtcactaagggatagccttttctcaagcaagacttccagtgtctacacatgttgtgacaaacctacatacagcataaggtagcgggtgatgttggtgtctccttacctatcttgtgactgcttccttagactgctagaaactccggcgcctgcagtcatcactggaaggtgtcatgattgtgtcgcctttggcgtagttatccccccaccccacccctagccgtctatgatgaggtgtggccaggtctgtttggttctgaggcaagtggatcaggtcatagcactgctttttctgatcgtgtctcctattgtcacctactttttacaggcatcataacaaaagctagacaatttctttgggggaaaaaaaagactt

SEQ ID NO: 30117 - DNA, 3208 bp, Mus musculus
ttgtttaggtctgcctagcacattgagtgtaggtctttgaggagctcaaggatctggactgccttttttgtgtttgtttgtttgttttgttgttgtttttttttctttttctcccccccccatcaaaatatacccttgttttttgtaaatttactgtctaatgtgtagtattttgtcctataatttcatttttgaaagaattgattgaaaatctgtagttttttgagatgaacggtgttagcattttaaacagattagtcttgaccacagaacttggctatcgaatagaaacttgcatattgttctttagttttatgtagcttaatgaagttttatttcacaaacttagatggttctaactttgtgttcttctgttcccaaggtaaaaggagaaaacgaaggccaaacagaagcagagtccaggttctgtaaaaacttggattccaatgtccccaaacagaaaacgaagctcacttcaaatacacactttctgccttgaaaactgaacgaagctagccttcctttttacacagcctaagtcctctggtgaaatgtacagcagactctagagaggctaagagcatctctgttcttcccctcccccagacttttcctgggaaaagtcaataattaagcaaattgcttaacacttggttccaggtcctgcatatctggaacttaaaggcatagtaaccattttttccatgctgcagatttcattttagagaggaacagggcgtccattcactgatgctgagaactggtccatcctagagcccagaaccccgtgccacacaggcgagcaggtgtctactgaactgaggctttacaagcgagagagcagatgacatatttcttcgttttccttttggaaacttatgtattattctttctgcctgtctacttttctgcaaaaaatgagatgtacagatttctgttccctgctatgaaaagtaatgtggcaattttataaatgttgctttctgatttttatcagaatgagaaaataattaaaattattgatctgcaagtagtaaacacttcatattatgatttctcccattttagtttaatataatttgcaataaatgtacatattgtttcataaggcatatcagtttagaatggtttttactcctgtgattatgatggaataattgggttttcagggagtaaagactgtccaggatttggttttataattgtcaccagatttttattattaatgtaaaaaaaggttggttttgtttttagggtttgttttgtttttttggaactatcagtagatggacactggcagctttgtgagggacagagatatgctctcgacgtctggcaccgtgctgttgggaaataggccttttatttttgtctgataattggggctcagtttttatttttattttacagacaactgttacaatattgtattccttggcattcattgttcagcatagatactgtgtacagtatttctgtgcacataatcctatttaatttttgcataaaataaatgcttttagatgtcttatgtaagtcttatctttttatcatgctttgctttcttaggaatttttatgtgaaagggctaaagtcacagaaggacatgactacagccaactctcccttatctatgtaaaatagtgactgtgcctcaggtgctcggtttgtaggactatggacatgtgcaagaatgaggagacgtttgaaattaattttctcttatcctcctcaggtgttttgcctgtctccactgtttctgcttggcttgtacccaaaatcctagtgggacgagctgctctgtttgcattatgacttggtcttgctgggatgtgtaaaatcactgaagtatcaaaactctccagaatgaaattctttgatagtatgtcaattaggttctcatagataagtgagagttggctataaattgattctgggtgaaaggtgggcttcttttaagtattttacatgtacatgtttaggtgtcagaagatggctagagaacagtgaataccaatgatagaaacaatatttcttgaaagggcgtaaaagccctgctcttcctgttgcctccaatctgctgacagagcatctatgcataccgtcagtcaggtccctcattcagtcagtgctatattctatttacaagtttgacttagggccaccagtttgtcactaccaaaacttctttgctggaacccagtgaactctatgttgagcagttagtcacacagtgtaaggaagaaggttcctaaatgttaagggcactggtcagaatacagcagaagcgttcacatctgttacagctctttggagttttgcattgaaacagttactgtcagggtctgttcctcatgagtgcctggtctctggcaccaagagtaaactggttggggattaagcaaattgagagggacttgtttactggaaatgtgtcaggttttctttgaaaaagaaaatgttaaaatctcttaggaatttggtatttacatctcagagaaatacaacacaaaagtgcagacttaaaattgagaattaatgttaaccctttgtgtctagtttgaagcttcttgtatttgtctaaaactacaagccagaattttgtatctcctttgataaaaagtgtgtatactgtaaagtagttttgcatattcttgtgctgcacatgggctggatttttagaatttttttaaagactttaagccgaaccttgtaatttgtgtaaatgacaagtgtaaaatccttccataaaatgcttaaaatatgcactgtttcaaataaaaccaagaaatgcagcattatgtagaagtgtggaaacgtgaatattcatgtgcccatgtgaagggctgatgaagggaccatcgtgcactttccatttttcaagcctctgatgtagctcacagtgacagtacagggggatcaattctgatggatctttgccaaagtttcttaaagatgatcattgtttcctactattctctgtgtcacaaatggtggacattatatactaggttttttgtttttgttttttttgagacagggtttccctgcctcccgagtgctgagattaaaggtgtgcaccaccaccgcctgaccattatatactagtttaataactttaatcggagtgaaccgatgtctaagattcggatagaataagaggttaagagaggccatcagcctatctatgtctgatgcctcccatagt

SEQ ID NO: 30118 - DNA, 1135 bp, Mus musculus
tattgttgattttatcagctgaaaagtagattttataatatattagagggtggtaattgtactttggacaatatgaaaaactaggaatgaagtttatttaagtgatttctcaggcacaataaacgcatggtgcacttaacacaggtggaggcaaaatactcatatacataaaaataaaataggtgttgctggtttggaggcccattcctttattcccagcacattgaaggcacaacagtgagtttgaggcctatctgatctacatagtcaattccaggacagccagggctatagaaaaaaaccatgtctcaaaacgaataaactaatgaattaaaaatgtgaaaagtcaaggatatcatgtctccagaaagttcttgccaaggctgtgcagttctctgtatagaagttgcaccatggagtggaaagcacacctcctgcctttgtctagtctcagcagtgtgtgagcagagtgcatggccgtgcagcgccgagctggagacactgagatgataacactgctccctttgcttggctttgttctttttttttttaataggacttctgtaatgacaaaagctatatttcagaagagacaagagttcttctgttaacaggaaaggtactgtatacgtaattgcttggggtttttgtttaatgtgtgttctttctgctttctgccccagggttgtggggatgcattgtgtgttggtattctcagatcttttctgcaattaaccactgttcagaattgccacttaatcttaaagtagtgagaagctcaaatttatttaaaattcatctagggcagattttcataagtaatagaagtagatgagaatgacaaacaagccaggcgttggtgactcatgaatttaatcccagcactcaggaaggtagatttatctctgtcagtctggtctacagagtcagcgagggctacatggagagactcagggaaggagaataaagagattaatatgaaaggctaaaatgataggaagattgtatttcataaaagtaaggtgatataaaagtatatattcagtagtctactaagttaagtgtgtcattaatttctatgttttggaggtatattttgtttcaattaagaaataacagataaaaaaagagatag

SEQ ID NO: 30119 - DNA, 1164 bp, Mus musculus
tggcatgaaagtctcatctatccatctgcctcgtagcctgccacatactgtgattacagatgcctggtaacatgtttgtaaactatcttgggaaagagactggaacgtacccctcaggattcttgttaaagtctctgagtaaaagtaactgtagttggggctaaatgatgtaatttatattccaagtgttacagctagcgtttgcacaccagaagtttacattctatttattgaaagaaaactcttttttaaatagaatagagctgttgtctgtattcctaaaggtgtatctattcctccaggttctgtctttcacacatcctacctcgttccactctgcagagacatatgagtccttgttacagtgcctaagaatggaggatgacaaggtagcagaagctgcaatacaaatttttagaaacacaggccacaaaatagaaactgaccttccccagatacggtcgtgagtattttttttttacatggttaatgtaaaggtttctgtgtgggggagtgatgatttctctgtctcctgccccatcctatcacaggtaggatagatgcagtcggaccaactgtagagatgcaagggacttgaaagtctagtaatcaaaagccatcacagaatagtatggttcatgtatctttctaatttttgtaggctataaatgaagtagcgaccaacttcctgtcccaaccaaatatatatatatatgaattaaatggtagtgttcataaaatattaattagttgctttgtaattaacagtgatcataagagtaaaatacagtttcatagtttcatttaacattttgggattatacttgtggtaaggatgggaaacgtgaaagaacacattgatatgtccattgcatcatatgttcattggtaacataaacatgaaaaattcatggtaaacctaataggaacaatatttgtctcataatgtaataaaaatagaacaaatggacttgtgtaggttttattaaatggaatttatgtggaacaaagggattatccagttagtctctgtcttcaaggaactttgtggtctaaaaatttaattgtttatatagcaatacatacaaatcaaaaagattattagggccaggcttggtggaacaggtcagaaaccaggcaagaatgactttgtctcaaaattgt

SEQ ID NO: 30120 - DNA, 1195 bp, Mus musculus
tctgtgatgtactccagtttccatatacctcctcccagttatatactctctacctggctttttcattcctttgattttcctgttttatctttcattacaccagaactctgtagcttcccttgtttaggattaaatagtctttaagtcaatttttgacctccccagaaagatcatattgatcctttggaacttaaccattccttctcattgataaaatgccctcctaacatgcttaaaattccagattttatctctagcattacaaaaatattagttcctattatgataagccttatattaaactcccttaagtgctaataaactgttatatacatttttcatatatgaatatagaaataacacataagaaaatttataaagtcaggtgtggtggctcacgcctttaatcccaacagttgggaggtagaggccagatggacctctagtgggtggccaccctggtctacaaagtgagttcgaggacagccagactacatagcgaaaccctgtctcaaacaaataaacaaaaagtttaaaaaagttgaacagtttgtaatgttattaaataatgtaccttttcatatttatacagagctctcaatgaaatgtggaaatgtcagaacatgcttcgaagtcatgtgcgtgaactattggacttacacaagcagcctacagtaggtttatgatttttatttaaaatcatagattgtaaatcaatgtttaatttttttgtggtataatgtaattaaattatctcaaggggttttaatttttaatgtcagttaagctgttttcagagctaaatttccttttttgttagtttcttaagcatttcttgtttgtttgattggttggttttgaggtttgtttttttttttagctcaaactggtctagaaatcactgttacccaggttaataatctgcggcaaattccttgacagccttcctttctcagcattgctaggtgagattttagtcatatactagtcactttccttactatggtgacagagtactcgacaagatccagagaacttacagaaggacggtgtgttttggctcacaatattagggacagtccaccacagcagaaaggcatggtggcgagagtttcaacaagcttgctggtcatgcagcctaggctgactgacttctgcctttaagcagtgggcctacctcagcagatgaatgaca

SEQ ID NO: 30121 - DNA, 1225 bp, Mus musculus
aatctttttcttattatggaagagaattttttaatagcatttctatataaaagaaaaatggatgccgggcattggtggctcatgccacattatctgcaagtctgcaagggaagaaagttcacctaagaggacaagaaggctctcaccaacatttctttttctagattcctgatcctgagctttgttatctacacagtacagtgaaggatgtgtagttaactaaggcaccgtagccgccttctgtacagggcaaattatataattcataatcttcacttatgccttttattcatcaatatctatttaaagaattgaactgaatgaaatctgtactatattttgtttaaagggaactaagaagttggtaggtcatttagcagtacggcactgaaaagtgtatacagtaatctactgtcttaccagaaataggtgcaaaatggttattagtaaaacagtttggcaaagctgcttgtgagaagatccaatgtgctgcctgtgcatgcacacagtgactactgcacagctacttgcaggttgtagatttgaatagagttttggtgtcttgccccactcacagtgctatattttctagtggcgagtaagaaaagaagccatgatgggtctggctcagctctataagaaatactgtcttcatggggaagcaggaaaggaagccgcggagaaagtcagctggataaaggacaagctgctgcatatctactatcagaacagcattgatgacaagtgagtctaatattttcctaaaactgcttatcatttttaaagattctatttaatttttacacagttcattttaaatatagaaataattttctgcacacatgcttacatatgattctttgagagatgatagcatatcagtcgtgaaagaaacatgggcgtgagagtgaggcaggagagacaaatcatttttacatatgtatacttcagcttcataaaataaggaggagtaataatggcattgtcatgtgcacataggtatgaagtgtgtagcactcatgcccagagtaaagcactgtttggtagtccttctcatcactggggtgtttgtttgtttgtttgttttggtaatactgttgcaaccagtacagaaattgttctcattttcttaatggcaataccagtgctcacactataatcccagcactaaggagagctgagtcagtaggagctccatcattccaggctagccttgctacagggt

SEQ ID NO: 30122 - DNA, 1109 bp, Mus musculus
aattttaatttaacaatttcggggttggggatttagctcagtggtagagcgcttgcctagcaagcccaaggccctgggttcggtcctcagctccggaaaaaggaaaaaaaaaaatttctcacacacacacacacacacacacacacacacacacacacacacagaccatctttaccctcaggatacccaccttatgtccttccttttcataccccccaccctcaccccagcaatccagagtcctgtagtccttcctgctagaatactgaatgttactgttggcttgatcttgtgtaggtaaccatagagcatcgaactatagttcatcagcagggtgggtgctccatgttcagaagatagcatccacagtgcttccccctgcgccccccacccccatgcgttctatccctcttccttgatggtcctcaagccttggtttgggagggcagtggatgctgcaggtatatttcacttagaactgggcatgcagccatcacttattgtcaggactttgactggttatgagtctgcagtaactggagcctaatttagaaacttcccaggtcagggtgtaaagcagcgctgatctgtgggtataaacataaagtctgaggccacagtttagcaaaacaacaagaatgggttcttaccacctatcatcctcagggcttatgaatttctgagccatgtgctgcaaaccagatttattatattgcatatgtattctctccttggaacaggcctcagatccaaccagaaagcagttgaccaccctcataatttttatgacaccattgcagcctttaggattcaccactgtataataacactggtgacttttctctcccagctgtctgcactatgaaagctagctatggaggagggaagttttcacatcaattccaacttggatttttccccccccttcaaccaaggtatattgagtggtagagttttaccctctagttgtcgtgggcagtcaggagcagtggaaatgctctgttgttagacatgactctagggcttctgaaaccctaactcagaaggaggtatctcaccccttgtttgggaggaacaactggtataagcaatagtgttgttgtagtgta

SEQ ID NO: 30123 - DNA, 3672 bp, Mus musculus
atgctaaagtgaaacctagagccctggactttgaagcgtgaggtttgtgggctgacgttggtttttacttgtagaaattcagtcagttctattttcaaatgtattttattaggaatgtaaaacaagaaaagtgttttacagaatccaaggaaagttgtttgttttttacttgatcaaatgccagtccgttacttgttgaaacattaaagggaatttttattaattacaaaatgtctaaaaaaattaaaaaatgatcacctgcagtttaaaatctttttttttttttggtttctctgtgtagtcttggctgtcctggaactcactttgtagaccaggctggcctcgaactcagaaatcagcctgcctctgcctccccagtgctgggattaaaggtgtgtgccactacgcccagttgcagtttaaaatcttaagtgctctatcgtagttaggaaacaaccaaccaaccaacaaacactgcctttgtgttatggttcacatttagaaagtcctaagggcggctgtgagggcagcgggcctagagcctctcaaagaattggttaaacagtagaggaagagggcgagcagcaaaaaccgagttcttcctgctttcagagcttagcacaaaatcacttgattttgttgttagacaggaggacacttgattgtatttcctctgtatcgcccatcccttcccttccgagctggtctgtatgtttttctgggaggaaagttgggtctgagagtaacttgtagtctcataggtacaataggtaacgttcagagaaggagagccagctctgggtgtctcctgtgagtcctagactgtctgcagtgacacggagcctcaatggctggtttagactcagacatcatttctaagctgcagggagtcagttctactgacttaagtgcaaaaccatttttgctataactgtaaaagaaacccttgtaattagaaagaattttttacctttattttgaaaaggagccaactttctgaaagaaaagtctcattgatgtttttgagctagtgtcctgtttgtgtgtaaattcttgtttcctttctacagacttagtgtggcaaagtataatttttctagaatgactcagtagttaaaataaatctaactttggacatacagagtattttcaacatatacggtgttcacaaacaattgtgttgcatttataaccttcatcaggaatgcggcagtgccctcctctgaaagattctgacggacagaatgagctcccaaagagcattttaatgggaataaaacttagaaccacatttttacgtcttgtgaattatgcttttaaaaaagagccttaccattgaattttatttccataaaaacaaaaatctatgtttgttacctacaaatagttagtgattactgatactcaagtatttatatttttagacttgtaataatttgttttaaaaatttcggtagtatagcataccatttttggtaatgcttagaagtgttttatatacatatatatatatattacaaataaagcagttcccttttacaacttagtacaaaaaccataatcagtagttaataaagtaagcatattcctgtgttcaagttaacatgatacaaaaaccgagacagtttacaacccggagtgtgtgcagctgcatactcattttctgtgttttatattttttcatgttttaaaaacacatttgaatatttcagacagatttatattatgactgtgattctaattaataagagagcagtgagacgaagtcctagtatgcctgccgctggaggctgtggctagaagcccccagaaagcagaagtctggcactggctctttatgacagagcaaacccagcgagcgcagacctcagaattgctatgaagacccagttggcctcaaactcacaatccttctgcctcaccttcctaaatattgagactatagctatgttttgccatgcttggtttcatatcctttaattattaactataaatacacaaagtttgaacatcatatatatttatagtcccaaatttccttccccaccctcctatctggtatcattgaagcagttacaattataaaagatcattttctgaactttcacttactgatctctaaatcttgtgtcctagccagaggtagagatactttgtcaatcaaagatttttcttttgatcacttctgaattttgtatgtctattttgtatgtcagaggtaaagatggtttagagatgacccaggttagaagagctctttgtaaaccaagtattttaaaacattttaaaggtatagtatttcttccccaaaacttggaagagcttagtagcagttatatacatttaaaatctgttactggagacaggaaacagaaaattgttaggaatcacatggcagtcagtgtgagggccaggcctcacagccattttcagtctttttgcttatcccgtgaaacagttggagcttgctttctgacatttattagctgttgatctattggtgttatttttgagttgaagttttcttctgtttgttagtatttccatactgcttctatactgtgacattttaggtatcacccatattatatagtggaagctgtgactgaatggtgtgcattaaaacagatttgagaagcaacagcttccagttctttgcggtggtttcctgtcctttgttttggtctttttctttataaattcaagtgttctgtttgctttagaagggcatgtgtaaggacatgttagttagttctgagctggcagttggaaacttttgaaactcaagaaattgctctgacaatgttttaactgctttcaattaagaaaatgtaagaaatggacaaaaataatgtgtgctgttttttctgagtgctttaccattgtgcaatgaggtgacactgatgatgtcctgtgctgtgcttaagtgtcgcttatttttaaatacttgtaaagaaaacagacttaaatgtctgcgtggccaaaaccaagtgccatttaaaagcaaaagtaagttgatgtagaatgtatgttaatggtgctgatttttaaagtgtgatttaagtttacagtattacttgatgcctccttacagaagcgaatagagaaacgaggctcgaacacacctgtgtcctgaagccttcgtaacctcagttagatgatgccggagttcattcactgtcctcacatttgagcttgacttccgtggtcaggtgatgaacctgctttgttgaattccccctctgtctcattaaagtgccacattgcagctagcagttgaagaatagactataagattttcagatggtatatcagaaacaaaatgtttttatttgtactataaaaatgtgatttttttgctgtcaactctgtacttttttattgaaaatgtttataacgttgcttttaaaatttcttatgaaaccatttacaaattacacaattaatttaataaaatgctttcatcacagtccagtgtgaagaaatcctttgtttgatgtggtcggtttagtggcttaaatatttaaagatgtgtctttgtgattctctgggaacagtgtcataaaatctacacttctggacaaccgtgccagcttgtgttgcttatgcaagtgggttcacttttggacaagaaaggtgggctagcttctctcttcacacccttgcatcttt

SEQ ID NO: 30124 - DNA, 1170 bp, Mus musculus
actctagctggtcttgagtttgctacatacctaagactggtcttaaacttatggatccccttgccttagccttcctgagatctgggtttagaggcatgctccacctctggcttatttagtgttgacatagtgggattttaggagctgggctatgtgttgctcaatagaaaattacctccacccccccaaccttaaaggcttaatgggacaaacactaagtgttttctaacagtttctgcaggtcagggatggatgtgcaacttgcctcctgcccctgcccctgcccctgcccctgcccctgcccctgcccctgcccctgcccctgcccctgcctctgcccctgcctctgcctctgcctctcggtcacagtgggctgcagcctcggaaggatgaagacccactttcaagcttcctgccctacatcagtctgaggacctttattctttgctggttgttggctggcagccttcaggtgtttactacacagcatttccaggagacttactggtctctgctcttaaaaatctagaatctgccaggccgtggtggtgcacacctttaatcccagcactcgggaggcagagacgggcgggtttctgagtttgaggccagcctggtctacaaaatgagttccaggaaagccagggctacacagagaaaccctgtctcgaaaaacaaaaacaaaaacaaaaaatctaaaatctattcttaacccaacagtgtgagagctgctggctgtggtgagctcaattgggcccccacccaccaacgtgactatactcagaggtagaagctttaaagaggaaggctcgataatgtcattagctgtgtgattctaatctactactgctatgtctttataaaaagggataacaggctggatatagtgtcgtatacagttgatcctaacacttgggaggcagaggcaggcgatctctgtgagttcaaggccagcctggtctacagagtgagttccaggacagccaaacctacatagtgagaccctgtctcaaaacaaaacaaaacaagacaagacaagacaagacaagacaagacaagacaagacaagacaagacaagacaaaacaaaacaaaacaaaacaacaaaaagcccaaaacccaaccaaccaaccaatcagtcaaaatccccaaaaggtgtgcatttgtgtga

SEQ ID NO: 30125 - DNA, 2029 bp, Mus musculus
ttcttaagccaacatggaaaagactcctcacatccagagtcccaacactggaaagctctgacctgccctcactaccttgggctctctctcctgagtccttagtaactgtgccccgcccccgccccgccgtgccccgccccgcccttctccttccctagctccagtgcaactttggcatatctaagaaaaatggataattccaatagagaagacaactgatgccttttatacttcttcctgggattgtgttggggtctttttaattatttttggtttgtttagggcgtctttttaattatctttgttaattatatttggtttgttctatgtgtatcttcagtagcagaatacacattaaggacaagattttaccatctttgcctaaggcatctctgcatagctatttaattgttcagtatgaaacctgacctttctaattctttgactttttttttttgaagtctgggtttttagagaccaagaatgtatgtgattatagacaagacttgtcagtgggaagttaagcttctcgctgcctttctttctcctgtgtttcctacagaatgcctggtgccatcagggatgtcggaagccctgtgtttgtttagcagggcttcccgccgttgctctgcatttggtaggtgaacacgggcaggtgaacacgggcatacacatccaggagaagtctctgtaggagtttaagggtagattgtaaataacttctgacgcttgctcgccaaagttgccaagttcatggcctgtagtgtaatgcgaaatgcagccattttatttcaatgttattcaaagtgtttgccttttttttttttttttcttttttggaagtaaatgcacagatgctgggttttgtgcctgttttaaggcttttctttggcagagtgaatgtaaaatacagtagaaaagataatatcgtcatctcttttatgaattatatcaacttacatctttttaagaaggctcagtccaggatgtgaggtgtgcaataagggtagcagatgcacagttgtgtttcatggcatgacagagtccatccaatctcccttcccatcagagttttgctaataggcttaactcttatttgtggactaatagtaggatcttgccctcagcaaacgctttctgcttttaaattaagagagtcccaattgtcttttttttttctgcctcccccccactttatcttgacgggatggattttatatatataagaaatatttatttaactattctatagaattatcgagtgcctgctaagacctttaagcatccctccttccttattgcgtggtatagagcagctgggagagtgagaggcgtcactcgggaagctgcagccacacgggcctgttggaatgagtgacctccttaaaggtatcaggtcctcatcccttgactggtgaggaaaaagtgccttcctgccggccacggactgacatggaggtcttcggatgagcccggatgcccatgttcttactgtattttacaagtgcctggggaaatattttcaaaaataatattaataatttaaaaaaaaggaaaaactatgcactaacttaacgtggcgactaccttaacggcaggcgttggtggcagccagttaagcaccagtgtctctgcagtctgtggccttagctgtccctcttgtttctcaaccatttcacgtacactactgaggtaagtttataacttgaaatgtgaacttttttttttttttaggattaagaacaaactaatataaatgtttttaaaagttttagtgtttgggttttagtcatgctactagtttagtttttagcttcgtatttgaaaagctttttagatctcgctgcatttacatacagtacattcttaagatgtatgtggtaaataaagctttctttaaagcagtttcaagactttcttttcctttaaaaaataaaatcaggaagtttttgcaacagtggggggatggcacaaattcagtctttgcagttgggaaaatggccatgtggaaatgcagaggaaggcagtt

SEQ ID NO: 30126 - DNA, 1194 bp, Mus musculus
tctccttctcttccctttcctcagaagtaaacaaagcaagtcatttgttcctaatatcatgctcatttcaccttcaagacttgtttgtagataaatgaacatttcagtttttcataaccaggctccccacccccacccccttcccgatcatgagccctatatagccgcactggaggaaattatttaaacaagctctaagagcaagtagcaatcagattgtcacatagcttgactcccatttcttactgtgggtaatcattaaccaaggcgattacagttgggagtcggagagagaggatgagaggaaagtgcattaacaaggaaaggaaagcagggacgaatgaggaaggaagacagtgggcctcggaaggaactggctcttccagcctgtgttccctcagcttagccctgagtgttgtctcctgtatggaccgaaggccatgtgactgatgggtggccagggacttggggtttgtgtgctcgaacacagagacctatgtgagcgtctgagtcacgtgattggtatcagacctgatagtgtgagagctcctttaggcaggatcccccaccatgtggcagagacctccccaggagcagcctttgttccccaggggaggttggaatgtggaccccctgcctggacactcccattgtctttcactagaccattcttttcctttctttccttttcttttctttttttcttttttttacagagactatagttgtagtgctctataatagtgatagcattcaaaagtagatattttagacttactttattttttctttttaagatttatttatttattatgttgtaagtacactgtagctgacttcagacactccagaagagggcgtcagatctcagagccaccatgtgagtgaactcaggaccttcagaagatcagtgctcttaaccactgagccatctctccagcccctagatttactttatgtatatgagtgttttgccttcgtgtgtgtgtgtgtgtgtgtgtgtgtgtgtgtgtgtgtgtgtgtgtgatgcccatgtctgactggtgcccatagagatcatgagggtgttgggtctcctgaactggagtcatagatgggtgttgggtaccaaacctagaaactctacatagtggtgggtgctcttattccttgagccatctctctagccccttcaaaaaatgcttttaattttta

SEQ ID NO: 30127 - DNA, 1139 bp, Mus musculus
tgattaagcagcattgtgccctccacggtgttagatgtgagttggtgcactgttttgcttgaattaaaaaagcctttggagagaaacttgagaatctttctctcctgggccctcaaggtttgcctagacaaagagatcttgagccactgggtgacctgcattggacggtttgtagaagtctgtgtgacagcgagcccatagtgaaggggatgtgggatatgctagatggacacacatccccttccccaacagcagtgtcactcacaatgagaccagataccaggagacaccaatgcccgtggtggcttctctggccacttaagccacgattcacctttctgctaagatgcaggtcctaccaggctgggctctgtgaggtgtctgaggtgtgaagtgtttgctgtcagctgtctggcttcccagtgctgaacaatgtctctcacagaatgaagaggaggtcttggtggagtgtcgagtgcggttcctgtccttcatgggtgtcgggaaggatgtccacacattcgccttcatcatggacactgggaaccagcgctttgagtgccatgtgttctggtgtgagcctaacgcagccaatgtgtcagaagctgtccaggctgcctgcatggtgagtggtcccatcctgtatgtccaaacccaccctaccctgcctgttccacatgctgtaaattagagcagaaaccctcatttaggaggataaagtataactcctaaagccttttatagcactttatgcactatatagactttatagcactctaatttctgtgggcagaactcctaatgaccagcagaatgcatctcaggaggcagggtcctgtaaaaaaccagtaagatttaagggtcaccaattctagacttcgaattaattttagtatgtgaccaagaaatgctggtcatgtgtgagttatcaaagcctaccttcaactcaggatttaaaaaataataatttaacaagttgattttcatttcctgtggttgttttcagcacgtcgatattattttctattcaatttattatttaccccttactttttacagcaacactatccagtagttggttttgctttatttgtgacgtaagagattagacataacatcagtaggaggcagatggggtc

SEQ ID NO: 30128 - DNA, 1117 bp, Mus musculus
aacaaaggagcccattgaacagcatgtagtgtgtctgtaaagggaccgtcgacctcgacctggctaaatgtcaaatgtgatgctgaaggcactctggtagatgctggcttctgttgactgttcatccctgggctttcaaaggcaacaccctgaagtgggggagtctttggagcaggtttcaggttggagtgtcatggtctcgtagacaggacccactgaaacactcacacacccgtgccccgtgccctgccccccacatatatgcacatacatacatacatacatactcatgcactggatccctggagatgctcctaactctctactagaaaagctggctttcttcttctgagcaaacgagaatagagtgataaggtggcccggtaccagggacaccaacctactgagcgacgggacatgtagagacttgacctgtattagagagtggattttcaatcatccttttatctgtaggcatggacaccctgaacagtgccatagaaaatctcatgacgtcatccagcaaggaggactggccttcggtgaacatgaacgtggccgacgccactgtgactgtcatcagtgaaaaggtggggagctggggcagggacaggctcacctgggctgcagggaggttttggatacaatgccttttcataagactcgaaaactgagccaaagcttgacctcttggggtttgtactgccacatgattaaagtggcctatgttaaagaagactcgaggctttgtctgtatctaattgtgccttcctcgggcccaggatccttccatcctgatgccccaatcctgccttcctcatttgccccagaggctgaaactgttcaaggtaatgatgtagcgccagccatggcttactgtggatttgcattttgttattagggctccggtgtagattggaccgtatgctgtctggggctggggtgcaaatgttgctcctggtagggaacccagtgatttttaagttatggagaagaggccattggtcatcctgacaggccaacattagcctcaacccagattagcccatcgtggtgactggacaaattcacctgcctaacatcagatcagaggcccaggaccaggctttaaagccag

SEQ ID NO: 30129 - DNA, 1196 bp, Mus musculus
gggcaggaactcaaaccggacaggaaggaacctagaggtaggagctgatgcagaggccatggagaggtgctgcttattggcttgctttccacggcttgctcagcctgcttttttatagaatccaggatcacaggccagggatagcaaatgagctaggccccccctcatcaatcactaattaagaaaatgccctataggcttgcctatatatagctccatcttttggaggcattttctcaactgaggctgcctcctctccaacgactctagctagctggtgtcaagttgacataaaaccagccagcacagctagtatgcagtgtttaacctggggattttaactgcttaaaatagctgcaagcaggccaagacaaagaccatttaaaggagagagatcacagtcaagtacatataatggtaatagcagttaacagaagcagacggtgctcttgcacagctgtgcttttgtctgttcaacatgtgaatttacatccatttcctggtgcgattgcacaaatgcttctgatagcagagattcggagggaccattctgaaggtgatcagagagtaggacctgacccatacataatgtcggctcagaagacaaatgccgggcgactgaatggccaccttctgaactcacacagccataggaaggggggcttgtcctgtgtgcccctccttcccccacatccttcagggccttgggttccacagcctcacttgtgttcaggggtcagcctgatttatcatctctctcctgatcatttcccagatgtccttctgtgcacaccagaaggtcatccacatgtcccgttgtgtgtttttttggggttttctttatagcgctcaaggctgtatcacaaaagcccccttttctgctcttttgtttctttctgctgctctcccaaaattgctgcacacttaatgacataaaacaacaagcgatattctcttacagttttggagactagaagtttgcaagggccacggggttcaacatgttgcatatcactctttgttattgccaaacaattagcctttaatagacatgaggcattcgttactcgtttactggtcacaggcatttgagtcacttctactttttgtcacaatgaataatctaactgtgacatttctatatggtgtttcgtggaacacatgttttcatttctcttgggctttatctgagaatg

SEQ ID NO: 30130 - DNA, 1341 bp, Mus musculus
attgaaagctccctcaaataggctgcttcatgcgctcaaggaacacccaccaacaaaacccatctccacaaccaccagattagctcaccggcgagtgagactgcaaggtttgggggcttggcttgtaccattctgtgcggtgcatgggggagttcgagccctcttggccttcctcctctgcttgtttctgctcccgtctcccctgctcaggctttcccagtgagcgaggccggcgctttataacagcagcctgggcggctccaccggctgttttttcggctcctcgggtttgtgtctgcaggtgccatccgcgaagatgcagctgaagccgatggagattaaccccgaggtaagcatagctgctgggtcgcttcgggagaaataaggctgacccttagctacagctcggtagctgaatcatttagttttattatcattttcctctttgcttttggctttcagatgctgaacaaagtgagtggcgcggcgcgcagtctctgtccctatcctccaagagcatcgttggagacgcccagccggccgcgccctgtgcaatggaggtggctgggctggggcgcccagctgggtgtcgtctctgccctgagttatctaggggtttgggagtgactgagagatcgatcacggggaggtggcggaggatggacccggacagcaacgagcgcggggagcagctctcgagggcgtggcgacggcccgcggactctagtccgagggcttcgcgcgagccacgtgtgggctgagctttgtgctgtgtcactgcgcggcacgcagggtgggacggcgcggaggctcctcccagactcgggtggggacccgtgtgtgtgtgtttggtggggggttggggagtgggagggccgcacgagggatgctcgtgctggccccgccccctagcaggtgcccattatttgtctggctttttcggtctggctgccctgtctttttcttgcaggtgttggccaagctgggggtcgccggccagtggcgcttcgccgacgtgctagggctggaggaggagactctgggctcagtgccatcccctgcctgcgccctgctgctcctgtttcccctcacggcccaggtagggagaggtctgtgatgggcgggtctcagtggatacgcagtgttgtggaatgagttcctacctcacgctgtccccttttcctgtagggtccctgataaggatcccacttcttagggtgggaggtgcttgcattttcatcggggctctattgtgatgtccattattgcctcaatttggaagagaaggagcccattgcgtctaagtctttttttcagttatccaaagaaagatctccaact

SEQ ID NO: 30131 - DNA, 1197 bp, Mus musculus
catggttcttggccagtgtacattgagaccttctttataaaggacacagccttggaacatcaaagatctggtcacctcatagcactggtgaaccaaggtataccaacccaggcacttggcaaagaaacatggagtctttgtagagagggagtccaggttaaaatggagcctgaggtgtaggtctcagaggcaggtttttcccttgcctccgtcctctattaaagccagtgagggtaaagcggaaatatttccctttggagtttctctctctgtacaggttctattcgggtattaataccacctctccttttcaggatgctgccaaggtctgcagagaattcactgagcgcgagcagggggaggtccgcttctctgccgtggctctctgcaaagcagcttaagtctggggagagagaaccagccgatccccccttccctgggcaggtgcgcgcggcccgcccttggtttgcagctttagcacttagaaccacagctgtcttcttgcgttctacagccccatcccctccaccccacccaggccaccagggggctctgtcacagccacaccaggctgagcactttccctcctgtgtgtctcgtaccttgctctctacggtctctttggtttctgtctgtaagttacggccctggatgtggtttgtctagtccttaagaggaagaataaaactttgctggtgagagtatcagctggtttttattttctctttccccaccccaacccctcccacagacaaatgtcttccatctaatgcaggtaagaagattcccatacaatagtattggtttagtgtttaatccagactttatttctgtacactgacatgtctctacatacctgtagaaactaattgtttgaaagttcggtgtaggctgggtgttgtgactcaagcttgtaattctagcactagggggctgaagcaggaggattgacacaagtttcaggttggcctgggctacttgtgtccagagagagagaggggggggggggagggagggagagagggagaggggggatatgaataggcaatttatgaacagtttccataaagtgcacacccagtgttctatatcattgatgttttatgttggtttcatattacaatcagtcctggcaacaccgttagctggagatttccttgttcactgaatgacctctttcaggtcagaatcacatgg

SEQ ID NO: 30132 - DNA, 2278 bp, Mus musculus
gcgtagtttaacatctagttaagctgtgtttagaagattaacattattagctggtaattctgataggggtcccaaattacaggtctaacactgacctcagtccaatttacatgatttacataaatgcatctcagtgcaaaaataataattttcctggcatgttaaatcaagcctttaacactttctgagaaaattttactgtacattactgtttgtggttatgtaagtttgtatttagtgataaatgttactaaattgttttagatgctgctgtgcctacatcatgaaatacatttatttcttttaaaaagaattctgaaatttgttttaccctaactattaacccacgttatgtctgttgtgagttatggtactagatgagttgagtatgtttggagacagtggttttccattctgtaagttgggttgagattttagcagaagcacacctcctgcagtttcagttcacacgctactatgctgctttctagggcaggtgtgtttagcctgcaccataacagagaagtctgtctgcgtcttatgacctgtgaagctgttgttcccatagtgcatctgtggctatgaatgatgtttgaaaaatggattgcctgtacacctattttgaattagatctttggggccatgtaatcatttactgtagaagacagtagtgacacagagacctactgactaacttttataaatgtcaaccagtagattatcagtgttcctatagtttgtaggattacatagttccagaatcttgactttagttttcttggtttcttaggcttgaaatttcctagccatgtgcagcagcagttcagatgcctttgaaaggatatgattgaagacagcatgtgatacacttgtatgttctgaaataatgaagaatattctgtagatgcatgtttacccagcaaatgtggttcagagggtttaatggaaagggctatgggtaaggcaactcatggggaatgggcctggggagtagttgagggcagcgatgggtgtttcagcctggtaacgcatagatgagttggggggattggatgtataatgcatctgtgattgaggctgtgtaatatgttcaattcttttcactcaattctattcctttataaaaggcattctgatccttactactcactgttgcatgattggaagtacttaaaacactgcacaagtttaatatagagtaatggaatgtggcttttttttttaatacccagttctatctgcatgtaatttggatttttcaaatacattcattagtaacttaaaacatcagttttctttttgtttaagttactaatctatagaaaggtgatagtcttggggtagatttccagaaaatactacttgatagcttagctttaaccagctacttttatatttttgtaatatttatccaccaagttggagaagcaacctcataatatccagttgatttttttatgtgtgtgcctagcctccttatcactatgttttaagaatacaactttgtagagcaataaagtgactatcttgttatgtaaacatactgatttctaatgatgttttaaaacattgtcttgaatgacatcaagttctggcagctaaaggcatatttattttgaaatgtgttttctcctacattttcccccctaatcttggaacattttagatttataagaacttcaaaaatagtgctgagagtgcctatgcacctcttacttgtctatttttatattagcgtcttcttttaattggtaggacatttatgcaaagtaaaatactaactttggatcagctaaagtacaagatgtgtttgtatttcaccaactctttcatttgtgtcgtgtgtgcgctgtgttggtacctggattgccttttatgtttcaaggcctataagtgagtttgttctttatggtattggtacagaaactttccttagaagagctaattcatgctgactttaacatgaatttttttcttaaaattgtaatttcaaatgcttagtgatataattaagactctttaatggcattgcagaatttcattatttctgataacttgtgcatgagtgaaaatgtatatttgttccttaagggaaggtgtaatataattctcaagcccatgagaaggcaaattttataatttgaacattaatagatgttagtttgcatgaagttgcagttagaaatattatactctgtgtgaatatgtacaatcaactgatctcaaatctgaaattagtgtttccatgtacacatgtcaaaagtgaggacatgactag

SEQ ID NO: 30133 - DNA, 1142 bp, Mus musculus
gctcagcggtggcttctcagttgacgaaggctactgctgtaattatggctaaccattatagttttgagataggcgatgcattttgttctaatggttaatttgagtcatgatggtgactggtaatacagagcctttcttattgctaactttggtgctaatgtggtggcttacttatttatctttgaaatgccatctttatagtttgtagacacggagttccttccttgctgatcggatgcttttctttcagcaacacttctcgttgccataaatgaacttcgcaggagcgcgcaggccaagggcacgacattttataagtatggtatgtagtttatgtatgtttataagtatggtatgtagtttagagccaggtgcttattctttttatctgtttaaaatatttcctgctgctgctttgttactaagagatagcataaaacgtgcctcactgtccgcgctgtgtggctctcagaagacagatcagtctgttaaaaagagaactttgagcataggaatgttttctctctggacttgacttaagtcagctgtcatatttctgcatatgcctgcataatttggaaaaactgcttaagttatcagcacttaaggtaaaaaatagggttttaatactatggtctctcatacattctcatgttaattagcaaatggatacttattgaaatgacttctaatgagtcaaattaagatttcagaaatatttttttcttgtctattgccccaatggttaagtcatggaaagtcgtgatccgagtacaaatgttattctattggaggacactgcagctgtcttaggagtgataatagcggctacctgcatgggccttacctccataacaggtaaatatatcttaacctacgcatgattttcttctactacctaattctctaatatacgggaagttggtcatatcattgaatacttttaagccaatacattattacatattaattccatactgattttttatttatttgtatggaaccagctatcatcatgtttagtgaaataagcctggttcaggcaaatactgcctattttctttcatccacagactctaggaatgtgtgtgtgtgtgtatatgttgttgttgttgttgttgttgttgttgaaagcagaaaaa

SEQ ID NO: 30134 - DNA, 1330 bp, Mus musculus
agtttggtccaccaaaggtctcatcttgagcattctggttaaatcgcactgcgtggttttggaacaggcagtgttttgagggctgtctttcctgcccacttgggaaaatatttctgtctactttgtggttttgacccgaacactaagaggtgcgtctcctaacgtcattctctagaagcagacgtgcattccagaagcaacacacttactgaatggagtggagacatttccacatcttttagatcatagtagttgccactttgtaaaacttcttttctctcttttacctttttttccatatttggtttaatttttgtaatgttaaagacataatcctagatgtatgactttttttaaactggcttcagtgccatagtgtttatttactggaaatatttgtaaatgttttaccattctgtaatatggactagaaatatttataactttacaggcaggataacattttgttttaatttatttaagagaaggcactgcttgtataagtgtgaaccgtgggttcctttggcgttgagagaagtaaatctccaaccccgaagcgtgggctgtgctgtgtgtgcgaccgatgccctgcggctcaagtgggcattagcatagcacgctggctggaacacaggacgaaagcacagagctcgctggtgaccaacgtgccggtgccgagggcaagaacattcactttagtagctgaagactctgaaaagctgtagctgtctgcccaacagctcatgagctgtgctgcagttggtggctgccctgctggagagagtgctcggcgcacagccctcacacctctgggaacccagggtccccagattttctgagacggaagttcgtgtattatagaaaactgtaatgtggaaacaaaaataaatctccaattaaaggatttgttacggtagttttcaatccagaaatgacacttggtggaaaatcatgagaatttgtaacgtgctttgtgctccctagggagcatgcttgttaccctttgttcgagcctaaggagggtctgtctgtggaggtcaagctggcctggaactcactacatagagcctaggctctctgaagataggaaattggagccagtgggatagataggtcattgggtagagtattggccaccaagccttccaacctgaatttgatctccaggaaccacatgtgggtacagaaaactgactgctccacttgtgtggtatggtatgctcccttccccaaatatatgtaataaaattggacttcttcttaagaaatagccagtaacagtttccagtgtgcatgggtaacacctagaactgatttctcttttcttaca

SEQ ID NO: 30135 - DNA, 1230 bp, Mus musculus
tgttgaaaggggtgtttcttgtgtgtgatccaaggtctgggaagtctggcctaggaaatctccagtgtcgggaacctagctgttgtgcatatgtggaaactaaggactacaatgctgacctccgccgtagcagttctcacatgtaattacatgagggcctagaattagcctagtcaagtgtcccttttttctgcctgcttatgtgattgctgttttcttcagcttagtttaccacctgataccagcagtcaaacacttaggattgtttcagccttctgctggctctttccctgtgtgggcatccatttaaggctggggtgctactcaagtcatagtggtttcctgtgtggtcccctgactattaagtcagcctgcaaaaggtgccgcttctggcagaactccctgttaaagctgactaccctgatttccccacatgccttgagtttgttgtctagaggtctgaagatgttgtcaaattgacttggtttgcttttccacgtcattctggcagtcagacacattgttttcgtgatgcaaaacctagtcctctgtcaacttttagaattaccctgagccgttcagcgttggttggaagtagacttgagttaaaaatatctcaggatgcagctgtgccctgtcattggtgaggaaaatgtggttgccgggctggtgtaactgaatgtggcgttttcgtcagtgattgggtaggtccggagtcccagtgtccaaggctcgatagttcacagtggtgctttcctggtgtatccttcattttcgaaattaaaatgcctgcttctcacaagtgtttaacctcaggcacagatcttgccaagagaatgatggccctggaatgagctgtcaggggactgagaccagggacctgtggaggggagcagagttttacatttgataaggccccatttctcatcagcccatttgtgggtgttgagcctctcgtggtatcaagaaaagtgtagctgtttctacaagtccttagccctgttcctcgtcggtcacagcatttaggggactgtcaccatgtgtttcctaaggcttccctatggtagagagtggaggagtaaaagcatgctgatctcttggtcaggtggtgagggaagcgcgtgcctctgccagtcgctagtgggctgttcctgtagactgccccttacccttcagtgatctgcaccgaggccatgccttcgtcaggatgacaaggagacaggttactgc

SEQ ID NO: 30136 - DNA, 1057 bp, Mus musculus
agcaaagacacaagctaggtgacactgtaagcctccatccgttttaaacgctgacgggaagaatccagaacagaggccatgtctatagagagcgcgtaggtgtggacgtcggctactttttctgttaccttacagacagaactcactgtgtccatcagaagggcaacctcctcgctgtggttgacaagcaggagattctctttatatctttaggaaacatccaaagattgaaaaccattttccaatgcctcgtttcataagttcctaacgcacagcttccgtagccttaagtcatacttcgttgacacagtgccggggtggtgggttcagcgagaactcccacaagctggctgttgagtaagatcaaacgcagggcatgaacgacggcatctgctgttgatcaggggtctggtattgtagacgtggagcgtcaaggccgttctgacaactatgcaatggctggtgggtgatttctctgaaatttgaggcctttgctgggctgagtgaaggtttagcatatataaaacttctgtttcccattgtcatggatgaaaacgccccatccagctgtgcacatcctcctcggtctaagctctgagttacccttctgcttccctgcttaatttgtggaatccgtatgtgaggttagtgatgccctgggaaccacttcctagtaaaggctacagaggtgctataattgttactgatggagattacgctttggacctgcggagaacactggctttattaaacaaatcaagattactatgttctttgtggaaccaaaagctaaatgggcagcgtttgtgaaaattatgagtgtcatctacaaacacagcaaagagctttgaaaatggggtagaaattcagactgtgagtatccgtttagaaaggacttttggggaggccagttttgtcagaataatcacgcatcctttagattcaatatttagcaaatattgaacaaatcagctgaacagtttagaagtaaaagaaattaaatgggtaaatgagctgtcatttacagtggacccaagaccagtgtctttggctgtcc

SEQ ID NO: 30137 - DNA, 1212 bp, Mus musculus
gcagggagctatgcgtcatttctcgggtggcttcactgcgccttttgtgttatgaggttaagttgaaaatggaggcccttgctccttccacgcctggctgttggtcactgatatctctcttcttccattccagagagccggatgatcctggatgcctttgcccaacagtgcagtcgtgttcttagtctcttaaactgtggaggaaaacttctggactccaaccactctcaatccatgatttcttgcgtcaagcaggaaggctctagttataatgaaagacaggaccagtgtcacattgtgaaaggggtccagagtcagacctctgacaacatagacatagaaatgcaatatatgcaaagaaagcaacaaacttctgcctttttgagagtgttcactgactctctccaaaattatctgctctcggggagcttcccgactccaaacacctcatcagccagtgagtatggccacctggctgatgtggaccctctctcagcctccccggtgcacaccttaggtggctggacctctccggcaacatctgagtctcacggtcacccatcctcctctacgctgccggaggaggaagaggaagaggaagaagaaggctactgccctcgatgccaggagctggagcaggaggttatctcgttgcaacaagaaaatgaagagctcagaagaaaattagagagcatcccaggtatgtgttcacactgtatgaagacagcggcaactccaatccgtacctctgtgcgtacgtgggtttggctttagtgatggcggtggagccaggatgttgaaaacttgaaaaagcgtaaaacgtgtaagatgtccttggcttgcccggtccaggcaggaattccagggcaagagctaacttgtctgtgttagcttcctgttcttgggttaagccctgaaggccacagtcctcatgcaggatgtctctattggtgtgtaagtaattcctatgtgtgatgccttacattgatgtgcatttactgttacgaggctgagagccctttacaagtggcctgtatttaaatatggcatctgtgtccccaggtacaaatgcgaacaaatccatctttgcattagcaggattcagcgctgagcaaaagaacatgatctattctgtccacgcctctccttggcctcctttgctaagtttcagcatggaattgattcagcatgtaagcccctccgtgtagagtt

SEQ ID NO: 30138 - DNA, 1514 bp, Mus musculus
ctgggggtgaccattgaggtcattccccccaaaatgactggttatccaagaaaggcttgcttcccttggccccgccatcagaggtatctgtctccagattcctcgcctcagaacattgtcaatgagaatgggatcttctgacctctgcctggaaatctaaagtcatctttttatcctgaatcataaattattttgatggaactcttccacatgagcacactcagttatacaacataccctgaaaacgagactctatatgccttttgaccatggatcctgtgtttgaatgacaggcattaatttggtctctctgttcttaagttgggaagaacacagagagtggccatttgggtaaaacttgaaatagggacttgctatagcagtgagtttacagagacttaatactctcaagtttctaacctttgtcagctggggaaaaggcacatggttttaccatggatttgaatgggtgcagtcaaagtgactttaagcctatgttttctgaaataaacaacacagaactccaatttaaaagtcccctgtaggggactctggtaaatgctgacatgagtgctttgtaacgtttacaatccagaaaagcggggcggtgaatcgttggtgttgggttgggatatcgcacagtagtggagagcatagactttctgtgtgttagatatacacctaacaattcactgctgtatcacgcctataagatgcactattggtgaaggtattagcaggaaagcagtgttcttgggaacgtaggccttttaacatggtaaatgtgcctcttggctggttctccactcagtgctccctgggagccgggagaacttgctggattgcttctttgtcaccctggcaagtgaagggatactgccaaataagggagccacggactgtgttgtcattaaagagagtcagtgagttggtttcctttccatcaggaaaaatggattctgtaaagagtcagggcgttgtctcagcatttgatgatatattttaatttttcagttcagtatcccagatagctggtgtgatgctcacaataggttagtctgttctatactcagtgtcacactcataacctgtgattgaaagctgccctttcagaaaacgaatgctagtcagaaggcaatgggttggcgtcctttttaatcagtgtgtaactattataaagctacctgttcatcatacacttggttttttttttttttctgatgtttcctggtcttaaaacttgtatcataaaatgaatctctagtctaataattaagctacaaaatttattaaggaaatgccccactcattcacaccatggtgagcaagtatgtggagtcccttctgtctgttgcttacaataacactgtgtggctccgtgcctcataaatgctttgtaattgtgagtatttctggattgtttcttaaacatatcatagtctgatttttctcacattaaaataaaacaacttgtgaaacttagttatactttgctgtgttttaattaaccttca

SEQ ID NO: 30139 - DNA, 1146 bp, Mus musculus
accatctgcatgcttgacttttcaaacatgagcgtgacttaaaattttgagcatttccaggcgtttgctactaaaatctgtgatgttgcacctttggccttacaactgcttttctgtcgtttgtcttcttttatttgttccagttggagggacgtgtgtccgtgtgaccgttgttatgatgctgactttttttttccttttttaattgtactgtctctcatttctgatgaacgttagactcctttagatgttcctttaaaaaaaaaaatctggcttttgccgtgtattgagtggctacgtcttcagtctttcccctcctaaggaaattacccttacatatttatgtgggatttccaaagacctttgggataatccgtgagatagtgcatgggctttttgtcatgtacataggctcagcttttgtcctgtgctgtttgttcttcactgtgcgctcccactggcgatgatctgtgcagtacagttggtctcatggcgactacccgtatgcttaagcctgaaaattatttcacagttcactcagccgacaactcccaaactgagttgcatactgcttatcgacacgagagagataaggggcacacttccctcgttttaaggaaatacctattttactctagcctaacacctcccagtcaatgaatacttaccatcataagtagggttcactgatacgtttttcaaacatgtgttcgcgctgatcagtttggcatctccatgaattcgcctgaaaaaaaaaaaaagcctattttgctacctacagtaaatggtgaaggggctgtttaaaaaccacacccagttttctacagtttttatggtatttttttcatcttaaaagataaaaaaaaaggggggagttctagttttcagatacacttcagagatcgaaacaaactcttctgccttctattcaaaagcctgtttgcctttttgtggattaccagcaaaatagaccttcaaacgtgtgcaaggactagctttgagaaggggtgttttctccatattaccccattaaatcatttcatttccccttccccccttttcttggtctgaatttaaaattaggctgtgtcttccttctctaaagctgtagctagtttccatcgtgtctccatactccctgcaaag

SEQ ID NO: 30140 - DNA, 1236 bp, Mus musculus
acttatttaaagacaagtggtcatgtaaactagatgccattctctaataaagcagaggtcagttcttcagaggttgacctgctagctaggaacttcaccctggcattgtgagtggagtcccaatttgaccagtgttatccaggtgtctcttcttgtagccattccttacaaaaggtaagcaatgacaattggtagttcttccatagttccagaacactggcccctagtcatccgcagtcagtagccttggtggccattagatggcttcttggaggccagggcagtgggacactggacacatatctcacaggacattatcttactggggcaacaaaagtgttgcctgctgccaattcatttatgctccgttgaagtccatgtatgcagttctccttggtgattgtgtatggtcaccttctgtcagtgaagggatagtgtctcttctcaaataaaaaaaaattatttgttgatttttttttttaatcactagctagactaagaactgacatctcctcttctagaaatgtgggaattcacagctctctgctttctggtctttgacatgagagtaataaggaggaaaatcccttcattgtgctggattctgtagcagtcggctctgtttcacaagagtcgagtagaaaaccgaacagccaaagtctttcaggaatgccatgcttttatgtgttcatcagctactcatggatttaaacatttgacagagaagacagatgggatagattcagatacaatgaagtgaatttaggtgcattgcattacaagggttgtctgtatagttgacagacattgatatgtcaggtcgtcgtcgtcttcttcttcttcttcttcttcttcttcttcttcttcttcttcttcttcttcttcttcttcttccttctcctcctcctcctcctcctcctcctcctcctcctcctcctcctcctcctcctcctcctccttcttcttcttcttcttcttcttcttcttcttcttcttcctcttcctccctagacttcttgctcgggtagtatacaaaatgaagaagtaactctcctttgctccactgtgaacttaaccttcaccttttcctcgtgacaaccattgtcttgaggttgtgccgttgtgcatagattattgtagctcccattttaaaatatttaatagacaaaggtagcaaatcaccaactgtggtcacttatgttgatagcctggttagtcattcttaaggtcaaggtc

SEQ ID NO: 30141 - DNA, 1152 bp, Mus musculus
actacataaagtggtggcaccttcatttaatcccagcagccaggaggcaaagcaggcaggtctgaattcaaggtcagcctagcctacttagaaggttctgggtcagcccacattgtataatgagagcctgtttccagaatgataaaaggggacagtgggatggttcagtaggtaaggtgcttgccaccaaaccggaggacctgagttcaatacccagaactacaaggtgaaatgagagagccaactctcataaggtgacctctgacctccactcaagggacgtacatacacataagagttaatgtaatgattttttaaaaacgaaggagagggaagatacaatgtcattgaccagcactgcatttaaacctttttaggtatgtaaatttctttcagtcctccatattttccaattacctcctcagtcataaagcaacaggaaacatttgtgtggagagaatgtacctgcggtctctggttgtcagaggcagagattcctggtgattagagcgagggagcaggcttagggtctggagacaggagtagggttggaagaccactctggaaggcagttgggacagtagctgtgtttactggaaccagaagagtggccgcgcgctatttttacatgtgaagtagcaaacatctgctacagtggcgtcaattcaagaggaccagattagatggcagagccggaggggtagccccaagctgacatcagagaacagagggtgttacttcatctcgtgttacataacacttttaatctttttagcaacttacaaaactgagaaatctattttaagcaaatgtctaaatagctcattgcatccttatgtggctattcttattcagttatcacttgccttgccatcctagaatgggcacctgggggcctcccatgattcaggagattgtgtatcacaccataccacccagttccagtccatgaagaaacccccgtatgggagtagtcagcagctgctgtcacagtctctgagccctggcaacacctaatctccatcctgtctccatggatttgtctattttaaatgctttatataagtgtggttgtacaatccgtggtggcctgtctgtctgcagtctttcacttggcatgtcttcagggttcacccacgtcacccttgtctt

SEQ ID NO: 30142 - DNA, 1744 bp, Mus musculus
gctctcaggaactggctcccgttcttcctggtcacctccctggctgccatcattctagatccccctgcccttttaagccgcaataaccatcaccttcttcctagtctgcctagttgctcatgttttaattttgccttcatgattgaccctcatgtccggtaaccgtacttgtagtcgaagcctggtggccttcggagaggtgggtgtggcagagcctggactgggtgtgagtgaccgagcacagatctctgcagccaggagccataagccctgtccccatttgccagttgctcttcatatcgctcttcagaggtcatctagcacatagcagcttccgtctagtctatgctgacatggcttctccctgtttgtgtttcaaggtggtcctgcagttaaaataactggaaatggtgaccatcaacacctcagatttcagtgctgcaccgtggcagagggagtgctgtccatattcagcgggtggatgctccatcaggctgagcaggcagcagctctgagatcacagagatggaaatccgtcagaaaccctaagggacaggaaattgcatgactgataggaagtgcataggatgaaagaagaaagagctgaagtcacagcccgtgttttcacagtgatcgctttgtctcatttattaaacatctgagaaactttgtagataacgttttatcaagaggtaaaaataagttctgaagtaatgtaaacacacagagcacagacacgctggactgttcttaaatgcaaacagcaagacatgtattcttaatatgtaatttgtgatatttgaaaataatgttttaaggtgtatccaagctacatatgtaatgtaggaggtttcatatctttctcatgtttcaaagaaaagatttttaagttgtaaatttttaaagaaaatctgttatcagacatgaacaagaaaacatttaaaatttgtatgcatagtttgggaataatttgaataacaaaattcctaagaaatttatgaactaaaacaaaaacttcaaaaaaatgcaaataacattgttattttcacatcctcacttcttgggagaccatggtctgaggaaataagaaaactgtcaaagatggtatagttacatattgttactcacatcaagggtgtttttataaggtctgaatatgaaatttgagcttttggatggtgacaaagtaattgtaatacaaaccacttatcaccctagctaactgaaaataagcattctgaacaaatacaagctggtcgtctcttcctgtgttgcttgatttcagtgacttcccaaatagctcacttgttggtacagaattaactggtcgctgccgtgtgcagttctgtggctccataaggctccagtctgacagccgggagcggtgatgactactgttctcctcctacggctgcaggcagcctcagacaaggctgctctatgggctgcgacatagcagtgattaggaaaggagcttgggccagcgggttctcagtgtgctgcttttctcatcaagaaattcgggtgtggaaagtggacctatgcggtatgttcacgcagttactgatttccttgttaggcaagtttattaagtcagcacggagcattggcagcttgtggaacaatgtatcaggcctggtccagcagtctctattgcttccttcctttcagggcagcccttcataggagaataccttgttctcttccacccccaacagcctgttgcacagcttttctgattggc

SEQ ID NO: 30143 - DNA, 1996 bp, Mus musculus
gactggatcctcagcaagctaaacatgcaggacaccctgcttagagttgctggcaatccttcaagtttggaaggatgtagaagagcacctctcagaagttaggattacttgtggctttgtacaagggatgtcagcattttgcttggcatggaaaaaccaagaacctctctatcattgtatacctgtgagcacatttgtaaacaaaggatagtgtttgaccagagcagagtttaggaactggaatatttaattcaggagaatgtgttgtttttttgaaactttgatttttgtaaaggaattttaattgtcttctcgatgcaaacattatcaaagaagcttatttgaaatatatttattttacagattagcctcaccatgcatttgaaaaatgctttaggtatttaagtattctccatgggtcccctgatgcaatgggagtgaacataattctatgatgttctttgtaacctaggtttctttaccgagttcttcagggatccgtgaattctccttatgaaaatccaacctgaattctccttatgaaaaaaaaaagtactttaaaaaattgttcattaggaaaacattaatttttgaggacaaattcccaagagccttttatttcccatgagagaaggttttggttcccgactgaaggtgtttgacgtcactctctgtcatttcagctttctgctgaagtagcctttgtagggaagggcaaagaagaaggctagtgttttcaacaatcccaggctgccttctgctctgtttactttgtttactgtttaccctgttactgagtagacgcagagactccctatgtgccgatgttgtcaaccaggaaacggacaaatggccatgaaacacaatcacctgagcctacaggccgtgtgtgagcagctcctgggttctaaaattgatgacactcatgttaaaaatgagacaatcattttgaaagtcttccagagtccgcttgagagttcatagttgtaacagtgctcaagagtttgtctgtgttgtgccctccacagaatgagatatgggttgaaattgatacaggttattctcagtgggaatctccgaggctcttagaaaaatcaacatattgaagggtagagatgtctgtagcaaggtttctgctgtgacaaatcacggatggatgctgtctccatttagtgcctagaaattaacttacactagtcaagtcaatttgctactgtgaaatcatgcactcttgttgaagtctttcaaagcttccatatccacctgacagctgccacctccctgtcatctagaattctcttcatgaacctctatgctaaagatcagtgtctacatcaaagtcttataaactgttactctcagggcctgttacccgctgggtaccatcccagtcactttctgtaccttcctggtatcgttgttaaatggtcttttcacatagactgatttctggaactgtcacaaaaccatgtgtctaaacgaagctgccttctgcttccttgagatttttttttttaaataaattatttaataaatgatgttcactggaaactgtcattactcctgtaactattctctgaatctagctgtaattgatgctagccctgaggaggaaaacaccaacgcgtgcctttgtcagaatgcggttcaggcctttttgtctatgggggaaaaaaaatcacttgataccagatcattcatcatcgccatagcaacgggaattcagtccttgagatcatcacttcccagataaaccttaaagcgaatctcatatgcaacaaaaggttttaatataaagattaaaggaatatgacaaaagggaggaagaaacaggtcgtttccaaaatgtgaattatctgtacataagaatataggaaagcattaatgtgtatgtcatggggctgtaatcttatacctacagctccaaaaatcctcataactttgctcataaattaattccaaacttaatgtgttggataaatctgaagctatttat

SEQ ID NO: 30144 - DNA, 1148 bp, Mus musculus
ttgtctggctgtaggtaggacagaatgcttagtgtcatctgagtcagtacagtccccagcagtgagacgctgtctagagtcagcacgactgcagctgtagagcaggcagcattgccctgtgtgtatgaagtccgtctttctcatcagatatgtccatgttcaaagacaaaactgagccatatgtgcagcagcaggggtatttctctggtcacttggtacttttctcgatcatgtaactttctacttttttaaagaaatgattctataaaggaatcttaaattctaacaggaagctttgtaattagatttcaggttagtttatcagagaggaatttttattggtcattgaagcaaattttacactgcatattcttgagaaaatataaacaagggccagactaggttcctcctaggaggttggtttgtttctttttttggtgcaagaagctttaactgatgttggcatgttttgtaaaacttgtgtgtatcttttttatgataataataaaggaaaactaatatttatgagcaatatgtgccgagcacagggctcgggggctttatgtacttgattccattttttttactgtaattcttgatatgttatagctgaaaataatccgttttgtgaaatcaaactgatagagaaataataagccaaattacatagatttgtaagtcatttaaagtagttttgcaatttaattttatgattgttttcattaaaaattttcataccaaatttgtgataaaggatatttattattattatttaagacacccaggagttcctgattttaggtaagacattagtattaatgggcaaaactctagtgaggatgcagaacacagaaccactacatgtgatggatgcacaatttaagcatcactccagaggaaaagataaatctgcataggagagcaagcaaagagtagactcacagaaaacaagtgtggcttcatgtggtaagtggtattgaaaaaagtaagaaatggggctggcaagacagtcacaggtcaaagcactgtctgcccttccagagagctcagctgtgtcctggcacgcacctgaacgttctccagctcccccagcatcagaatacatacaactggtatacagacaaaacacgtgcacacataaaacaaaa

SEQ ID NO: 30145 - DNA, 1232 bp, Mus musculus
gttgtacctcagggatgggcagactggtcttctccatagttgtacctcagagatgggcagacttctccatagttgtacctcagggatgggcagactggtcttctccatagttgtacctcagggatgggcagactggtcttctccatagttgtccaagctgcagtgtgggaggccgagggtgactgagtgcagcacagtttgttctatctaccaaaattctcttgaattattctgatttgttcttttgacaaatgtcattttatattaaattaatccactgagagatggtctttgagtgtagcctatgactacaataaatgggtatgttaatgaaaatttctattttcttcaatccaactattttgtgtaggtaggacatgtttactttagtcaattactgtgccctgtggtgcattatcatatcatcattgtataggaacttagggcttaccaaaggataaaagatgacatttgacagtgactcacactccaggttattctcttttacagtcagtttttattcttcctaaagcaatcacttacattaaagcgtgaagcattttccccttaaagaatctttactgtatcttataaagggacttgtgcagaagagggtggtcatattgatacagaaaagacgctagttgaggcagctttttttctttactcatttggatttctgtgctataagccactgattcttatttcctgcattataataaggctaaaattgtatggggggcatctttgcatttgcaagaaggtgctcttggcatataaaatagtgttgaattcaaagctgttgtctattacatgttcagtatcaaagacaggctgacagtaggaaaggatgacttcctgtactcagatctgtttgctcacctaactacactctagcattcgttagatctagtcagtaatggatgaggggctttttgttgtctaaatcaaattcataatttattatactgttagcatcaaaacctttctcaaattgtcttatttctacttaaatagagagctgcagatccgtgttttctttgacgtaatactaatgaaacttttgcttcaggctgaactggaggcttttgaaaacagactgaagggccgtcggaagaagagcaggaaacgcgatgaagtggccgtggagctctcgccttggcagaagtataagtcctacctccttcccgtgtgtgcagttgtggtggcagtgcttatgtggtacatcttcc

SEQ ID NO: 30146 - DNA, 1207 bp, Mus musculus
ccagaacacacaagtgactgaagcatggaacaaggtggctcgctcatttaactgcacaccaatagaaggtaggctgttgcaccaaccgaagcagcatgtgattgatggagagaagacgattgaccaggagaagaaggaccatgaaaaggcagaattagaggtgcgtgaggtttatgctgtgatgtcctcgtcagctcaggagaaggcaaggccaaagatgcaggacagagaaccaccatctacaagtgagacccctctaagcaatatggcctgaaaatgaaagcttcacgtgaggtggaacggcgttttgatgccatgccgtttactttaagagcatttgaagacgagaagaaggctcgaatgggtgtggtagagtgtgccaaacatgagttactgcagccatcgaacgttctctatgagaaggagggtgagtttgttgcccagtttaaatttacagttctactcatgcccaatggccccatgctgataaccagtgatccctttgagcctgacctgtacaagtctgagatggagattcaagatgcagagctgaaggctcttctccagagttctgcaagtagaacaacccagaaaaagaagaaaaagaaggcctctaagactgcagagaatgccaccagtggagaaacctcagaagagaatggagctggggactgaggtgggtcccctccccagcttgtcattcctgcctcaccccctcccaccgcaccccaggctctgtcaagtgcagtttgtcttctccacccaagactagcagcagagcaggggtcttcagtcctcatcccggtccccagcccacccacccactcctttcaacaaaaaaccagctccaactgactctggtgttgggaggccaggcttcccagccactgaagactacttttagtaggaaaagaaattgaacaataaaatcaggagtcaaaattcaaaaaaaaaaaaaatgccttctgtgcgtccactaagatgatcgtatgacttttgtccttgttagtaacaaagataaaacaaggtaattctagccttctagaaagtgggaaaattccttcctctttggttttttaataacttaaagaaacctgacaccatttcttcattaaataattgatcttattcatttgctctagacttttctctgatgggagtctttttaatattgattacacatcagtacttgatagtaatatgttta

SEQ ID NO: 30147 - DNA, 2266 bp, Mus musculus
ttctgactaattaaattgttttattagtccttcaggatacagtaaattataaagattgggagagaggaaagaagggcctgagctaaagacttcaaacatgcttctacctatgtttagggaagttttatacagtacttttgcaggctcattgggaaaactatcttatgttttaaacatagctcacacgtagccatgtccaactggtgtcacagggcacgcccacaccttgcatcaacatcacagacttgtgtgtacttgtttttgattgccagaagggctcactgtcagttacagtctttctaactgtctagttcctggctcaggaaagacggcctttgctgttgaagccaccttactcacatgctgtttctgtcacacaactaaaagatctcgtttccattcccaggtttctatgatatgatgtgtctttgttcttgacaaaataacacctcagcacttacaacctggaataaaaccatgtcacaggaggaggggaaatctatgcactgaactataaaatctctggtgatgacagttgtattgttgctcgtgatcggcagaatgctctattatgtgggagtcgatccactttaaactgaattactgtatgaagtatctttttaaaatactgtcccctttaacttagattctgccttacatcagcgttttcatggtttgtaacaagtcatccgactctactttgctgagtacttgctttctaatggcatatgtgtgtatataccccttgaaatcagctggtttatttctatcggattattagcaaactataactctagctgacttctcattttttataatgaggtctgttttttaaatacttaatctagacagttttaaatattggcagttgggtcacataaaggtggggatttgaactcatttcctgtaagtagaggtgttctgtaaggtgcaagtagaaatgcagagagaaagggaaggaaagtttcccgctcaggaaagcatgagttaataacagagacccagtctgccactgctgacgctggaccagcagcagggagacatagagctcgctagcacaaacagcgccagtgccagtgccggaactagagtgtagagtgaaagaccttgtgtccttgcattggaagggatgagagggaaaggaggggctcacggttatccataatgatgaactaaaaaactgttgtttttccaagaaagatggaacgtatactttggtgcggtgtgtctcataaatgacaaaggagtagccgctgtctctgtagagtcacatgtgcacacagcaagcaggtctctgttcagtgtaacagttgaaaagaaataataaatgctgcaatctaataatttaaaagaactttaatgaaccatctattacattttttaagttagataatcagtttcaaaaggaatattcaggttatttaacattgtttttaaatggctgtatcagaaaaaatatctatttttttttaattaaactatttcatcacttgtttaaaaatgtattttggatctgagtttggtgatattatttcagctgctgctgtactaccacagattattggcttttagtttcctaaagagaaaaattgccttcttactagaaagcctttgtgtattgccggtttttctgtttgggaaaatctaaggatttactgtggttagtagtacagaagaaatgtggatttgatgaactagtgcctatgattttaacttatgtttgatatatagtagtagggttataaatgttgattattttgtgccaacagcccagaattgtcacttgtatgtcagcagaagctatgacctctgcttccaaagttatttaattttctcagtgtttggatgttattttttgtaagtgtgttaataaaagtgtaaagaattggaaaaatataaatattcttaactcaagcatttgctgaatcatttttctacaaaacttgtttgtataaaactctctgaagagttgacttttctcagttttcataccctggaaatcacattttgtaaaactggggaccattcataaatgtcagatacttttttaaattatctcagaacatcacttttatatatagatataaaaaatttttttgaaagcaaagaagattaaatacatatgtggcccagatgtttgtatacctctaggatgatctagactatgtatgttcagattgacgtaactcactgtacaggtgtccggttttgacagtatgatgcatggtccttttagatcacatgaagtttgatttgcaaacatttc

SEQ ID NO: 30148 - DNA, 1434 bp, Mus musculus
gaagatgatcaagactgctagccaagcaccttttaggaacccttgtgcttcattgataactttgggggcagcacttttaactgtagtctactaacttcaaaaacaaacaaacaaaactgaagaaaaatatctaactgcttaactgctgccgagacctccacagcaactgtatgaagaaggaatttttttttatttttattaacctatgtgaataagaataagggctaaaagtgacacgtacaaactacattactctggagaaaagaagaaattccaaggatgtttgcaataatggccccaagatgttgcagggcagggtgaagtgaggctgggatgggaccaactccttttagctgaagacctgcgcctgcagagccacttggatttccagccaccatcaacacagagttgacacttaatgatcaacttgaccacccagtcagacagataacacagactttttgcaaaaaacaattgggtctggggtttttgttttttgcgactgacgggataagggtttggggtgtttgggtttttgattgttttgtttttgctttttggtttattttggtctgtataaggaattatgtgtgtgtgagttggagtgtgtgtgtatgtgtgtgacagtcctattttcaaggtgtggatgtctggtgacagcttctcagagcatgcctaaaagagcactgcaagattatttttgaagaaattttattttattagatctaactcttcatagtgtgtaaatgttagaacactttaataatattttaaaactgggtttttcccagtgtctcaagaaaaaaaaaagaaataatatatctgttaacgttagtggactctgctgctcagctctctgatcagtgcttgtgtcgatgttgataactaaccaaagcagatgcctgcagagactttaaaattgtaaaataaagatggacgctgcccgccggcgcctctcattacacaagttaacttatttcactcggtaactactatagacaccgcctagactaaaacctgtattttcttgtacgttcgcgccacacgctgttacatcagagaacatgtccaaagctaaaggaaaagttgtggtcactgatggagtgtatgttctgcgggccctgaagggctgcggacttcaagagaagagatgcaaatgaacttgtgtgtttacgcaggactcaaacttgtttcaggctaaaggaaccttggggatatgggggacacagacaggaagcctgaagaccgactcccagaccacacaatgtccttctccactgtctaagtctgtaacataacaaacgggatcctgtcttcttcttttctaatagaattttgtaaaggaaatgaatgtagcctcccaacgcctctgatttgaaaggaacaccttgtatttttttatatgcatctcttctccactgtgacttttgtttg

SEQ ID NO: 30149 - DNA, 1167 bp, Mus musculus
gtcaggtagagacagcgaagatttccaataaaactcaccaagccaaggagctcacgatatggggccccacgggtcccgagaccactggttgtgtctttgttaataaactcacggcagcgtctgcatcttgttgtattgatccttgttcatttgtttacatggctggccctaggtgtgattgcgtctacagccagtcctagcctttctgcctttatacagacaggcttgttacagcgctgttttccttcttagtgtaatgactatggaaatttacccttgctcatttctgcagtggctagacaactgcaagaggacattcggtgccaacgaagacatatacaggatgaacaccaacgcgcatgtaagtctctgtgtctttcccactgagcacctgcatcagatatcataaaacaatgtatgcgtgcagctgtccttactcgatatccctagaaagaatatgtgggcaagcctttttcattttggttatcaaaacgatctccctgaaagttaggttcagtaaaatattggcttagtaatgaaaacttcactttaataaaagcgaacaaccagcttgcgaccggagcttaataacattgagtagataagcctgatgagtatccaggcagtccaggtctatggatatattctctggtgataaaagccagccccagggcagtgtactctgtagtccttactctaaatgtgaaaaatgtgggtttgttgtgtcttcgtctagtcactttaagcagtagcaacacattttcttaagagaaaggcatagccataatgctgcttgtgggaatagtatgttaagacccgtgcgttattccatagaagaacttgcccatctcacacctgataatggatttcagcttcagtaacatttataataatagatatctcacaaaaggtattctataataaaaatctgaagtctggataagaatgaaatcttgaaagagtcataaattaactgttaggcctttcagacccagtgccagtacatttttcacggccatattctctccttacgactcaattgaatggtcccttagttattcccattttaaacaggagaactgaggttcagtggggccaatttgtccaataataaataagtagtagaaaccaagataggtaattctaagccctatgctctttgagagg

SEQ ID NO: 30150 - DNA, 1186 bp, Mus musculus
aatgctaagtttaaaagtacacgccaccacgcccagccctgatccataactccagctatagcatattgtagacttggggttaagaacaatcacttgaaattcgagagttttcaaataggaagaacatgaatttacttatactatcctagggtgtttagtctgcattctctaaattagtggctctcaaccttcctagtgctgtgaccctttaatacagttcctcatgttgtagtgaccccaaccataaaattattttgttgatacttcataactgtaattttgttactattatgaatcataatgtaaatatctgatatgcaacctccagaggggttgcgagccacaggttgtgagaactcctgctcaaattcagtgtatatctgtgaacaagaatagtttccattcagtggcctaaagtcctaggagtctgttcctttgagatagcctgaggattgctatggattttgtgttcacagtcaagaggaagatgaacaagacggctttccagaagtgcaaacctcgcctctcccgaccccctttctgtctgccataatagcagctttccagccaatggcttacgaggacgaggaagaagcgtggcgttgccatgtcaatcagacgctgtcggacacagacgggtcctgtgcggtgtttactttccacgtgttttcaagactgtttcaggtcagtggacattaaggcctctgaactcacatcgcactaatctggtaaaactaggcttctctacttggtgtctcaggctttagtatccctgcagattccctttaagaagcatgcttgcttctaggaatgtaacattcccttcatttgcaattgactggcaatattcctggtatatcaatcacttactagtacagatgtgaaaccctacagtgaaacggctacaaaactgccactcggggcctgatggatttcctgtgggatgctgggtaccatcctgggtaccagagaaataaagggactccattgtgcctgccctcccccagccactacagggagggacacagtgttgatgaggaggtactaaatgtccctttcgtcactgtgagaactcagtaacaaaggtcactttcctccatgagggaacagtagcaataagcactgtcatttttttaagtgcccaccctgtgccatgcactttccagtgaatattctcagacagcac

SEQ ID NO: 30151 - DNA, 1202 bp, Mus musculus
atgtaaaggatataaattaatcatttttttttaccagcttagtataatttgtcaccccagggcttcagacagttaagacttatattcttcagaattatggctcagcacaaacatagcataaatcctgtccagagtggagctgaactgtatcatctctcttgtggcctcttttgaagctggcaacagtagtgttttgatagctatgatcttgattttaaatcctattgataaacgaccactgcttttcactgcagctgtcctgcagacaaagtaaccgtaaccccatatcgtcgtcagttgaatgtgggtactttgagtcagttattgcattgtaccgagtattggccgtgtaaaagttgaagatttttgtgaattccgtgttgccgaagtgtaccacggaagcgtcgttctacgtgtctgtctccagctcttccctggttcgaatcacatgttggcttcccgcaaaaaaagctaaatccggagctcgcatccgtctctgggtttgagaattcacagagttcttctcccaaaaagcgtagcatatatttgaatgtgtgtcttcgttctttctaactctgtgtgttttcctttttgctaaccaggaactgcaggtaagttgtagccgtttgtgtctctgttgccggtatccgtcctctgtgtggtctcatctgtgcttgtgtattagagtagaaatgatttagagtgtagatctaattggtccatcagcagtgcaagatgaattatcaaggcttattaaaaataaccaaatgatttttttaatctctataaatatgaacatttgatgacgggttaaacgttaaaagaaacagacaggctgattgaatctctgcttttgagaatgcattcagtaattttttttttcaccttggtatatgttcccgggtgtcttaatcgctgcagcattgataagcatgtggctgacttcttagaaaccgtgtcttgcttttctagggggagagcatggacaatttcaactggggagtccgccggcgctcgctggacagcattgacaaaggagacacaccatccctccaggagtacccgtgttccagcagcacccccagcctgaccctgacgaaccaggaggataccgacgagtcctcagaggaagaagccgccctcaccgcaagccagatcctgtcacgcacccagatggtattaatctcacctctccacaaagt

SEQ ID NO: 30152 - DNA, 1174 bp, Mus musculus
gaatacacacccacgtctgtgcgtatgcggaaatgtgtctccttaacaaacgcaacgagtcataaagtatttctgaagcatccgaagagttttaaagtgcatgtgctgacgccatggctagttcttattgccattaaaaaataagttggtcttggtaaatttttagtctttccctaagacatttcccttaaatgtgatgtcacccgactgtgacctgatgcttactggttatgcaaagtcatgcaaagaaatactctttaaatcaaggggcttggggagggaaatcttggatttctttgctttattcagtgaatattttcatttgctttttgaagttaaatagtatgataacacgtagagaaacattttgtcagcaaacacattacaaaaaaaaaaaatgatggtataaatttctttatttctcctctccgtcttcttctatcctttctatctcctcggtttggaatagaatccagggacatatccagcgtaaggcatgcaaacttcttttagttttatggagtgtgggtgggaaggggaggggagtcaggagtccgaggttggaacgggaccaacggtgacagtcacggcttggatggttaattctcccattttggattatgtggatgaaagagttatttatttctgcccaacacctggttcttataactcatttgttctacacaacataaagcagataataataaagttttataagcctaatacatgatttaaaatgcacacagttaaaagaatcgtggtttaggtcactatctatgtattatggtaacaaatagaataataagtggcttatttttggtttggtttggtttttttgagacagaatttcctctgtgtagccctggctgtcctggaactcactttgtagaccaggctggcctcgaactcagaaatcacctgcctccgcctcccaagtgctgggattaaaggggtgcaacaccactgctcagcaataagtggcttaataatgccttaaagagtgcttaatgaatgaaatgtaaaaaagatggatcttaatttctttaagaatctgaatgttaaggaacaaatatttaatgatgcgcacctctggcgacagctcacattatagaatgcgccatttcgttgggacaaaagttaatgggttttgttctatttctgaagagttccgtgg

SEQ ID NO: 30153 - DNA, 1188 bp, Mus musculus
gaggcttgaacccaggccttcttgaatgctaagcaagcacaggaccactgagcccaacactcaacttcccctatccccactggaaaacaacaaaattgtttctgagcaagattataccagtaaacaaaaagtggttttcagataaatctatcttagctgcaatattccttgttggtgtataaaattgtgacttaagtctataatacctgttggacagctatcttcagcaatggcattcacttattacaactgttagaactagacttgatctaccatcggcgtctgttaagtacctgcgtgtttaagtataggaaatagagtagaaatagctgacaatctaattcagaactttattggaggggattaaaatgactctccatgggagaaagacagggaggaggtttgccagagcagtaatagtgactctggaatcatgggtagagaaacattgaatgggagaaacctagatgatgtgggaaatgtcactgtgttcagtaaagtatttcacataggatatttttagatgcggattgggtatgaatgctactgttttaactacaaatctctgaactattttgggggcatcggagcttgagctgtgagttcaggtgttgttagcttcagaatgggcaggttccatccaaccagactaagctcatcaccctgtctgcaagccggccctctgtcctcttcatcagaagtgatttctctcctcttgggcccgtacagagcaagccttgttcttgtttgttggttcggtatgagtgcctgtgtatttctgtcactagattgtggagcttggctgaagttggaaccctaacctgtttactgctgcctcaagtacctgggcagttttattggttccccagtattctataaaccaagaagtattaagaagctccaatacttgcttgtatttggaggaaagcatttatgtaagtttaaaggaaacacttttccttatcactaaagttcacatgctcattgataaggaaggcctgttcagaccttaagtctgtcccagaacattgctcactcctgtagcccttgctagtgggttactgtctactttttgacttttgttcctttattacaacctcagaactgacttaaatgagttttcttgaaaatcttagcaagttgtgattattgtgaatggagggaaataataatatttatgtaagtctt

SEQ ID NO: 30154 - DNA, 1101 bp, Mus musculus
ggcatttgcaaaatttagtcactttagatttatccatttcttatgaccacttattaactgtttgttgttttaggacctgagcccaaccttgaagaaagtcccaaaagaaaaggtgttacatatgaggaattaaggagtaagaacagagagtcctatggagtaactttaccccacaagactgacccctcagtcaggcccatgcaggaaagagtgcccaaaaaagaaggtatgatgacagttgagtctactcatgactctagattggaaactgaagttttagcttaagatgttattatgttaatatgtctaactcttcaagatatttaccaaagtaaattatttttagaagaatagtcacttaagagtgggtgagatgactcagcaggtagagccacttgccaccaagcctgatgacctgcgtttagtccctggggatctgatggatgctagagagaaataaccaacttcagaaaattgaactctgacatgatgcaacacacaacatttgacataaataataacaaacttttttttttttttaaagacaaggtttttttcctgtagccctgactatcctaaaacttactctctagaccaggctgacctcaaactcacagagatctgcctgtctctgcctcttgagtgctgggattaaatgcacgtgccaccactgccaactaataattttttaagttacttatttcacagtttccactttaaggtatttcaaagaatgttgtgtgcaagaaaacaaaccttagttagagagacacagaacaaggaaagcagctcttagtacagtgttcttccttacagagaatcaccttgggaacgtataccttctccctaatgattgagtgtgtctgctgcctaaccagggttagcgacagaggctgatgactgtccagtaatggtattcgagcaaaattatggagtcacaattgagcagtaagatgctttattgtacgtttgtgtaattgaaaggcttatacatcttacaggcaggcttttatggcttttccagaggaggaattttactttttctctataattaataaactttaagttataatttaattttgttggacagcaatatgttca

SEQ ID NO: 30155 - DNA, 1116 bp, Mus musculus
ttacagctgcttctgcagccttgaggcatctcagtgttgctgtaaaactctgtacctttggagtagatatgagacctggaatgccgctgtggccccactgtaggttgtgctggctgacagaggctgcgtgtaatcctgacgcacacacgagggcaggaagctttctgcctctttttatgcttctttactccgtgtctcacagatacatctgcactcatgagtcagacaagaactactgtgttttttttttttttttttttaaagatttatttatttattatatgtaagtacactgtagctgtcttcagacacaccagaagagggagtcagatctcgttacggatggttgtgagccaccatgtggttgctgggatttgaactctggaccttcggaagagcagtcaggtgctcttacccactgagccatctcaccagcccactgtgttttattttattttactcaggttttagtgtaagaggctagggaaagctttgtgtacttgtggcatttgctccatttggcatgtggagcttgagctgggcgttcttaggttgctgttccgtgacacagtaataaggctcaggaaaacagctcttttccttctaggagaaaaattgaggattttcttgtgctttaaaaatattacaatttaaagaaaagacctgttatgaaattgtgatttttattcttctaaaatgttcttaaatctagatagaaatttggacattggtacagtgtagactcagaatcattgaaagtattaatactttgagcttttatctgggcaatggtggctcacgctgtgagtctcagcactggggaggcagaggcagtggcagatagagctctggagtttgagaccagcctggttgatagagtgagttccaggacagccagggctgttacacagacaagaagctctgttgtctcaaaaaacaatgcaaaacaaaaactgagctttatttggattatttatattagtatttatttcactagaaatgaagatagaaagcgtattaacagagcaatacaccacacatcataggtatggttctagaaaaataccgtatgcttataaagaacaaagcaaactgatagaacactggggcaatgga

SEQ ID NO: 30156 - DNA, 1241 bp, Mus musculus
tatgaaaagcaaaattctagtttattagttgttcttttttttttttttaagtaacttcttggtaactgtgttttggtatgtaccccatattcatttaggtaaatttctaaaggcaaacattcggacattggacttaaaacagatctttaaatctcagttcttgttaaggcttacaccttgggcaagttactaatcagctttctcacctgtaaaatgggggttgcacggttctgtagtctgataataggtcctttgtagtcagccccactacagatggctctcagagggtcttactcatccagtgcaaacacagcgtctcatcatcatagcagagttcacgtggtgtctgtgattgtttggaatcatcagttctttgtgcttttttcctagtcaaagtaaacaaatatggagatacttgggatgagtgaaagactcccatcattggacctactgaaggccttccttccatatccagcttcatccaggtgtcgtttgtacctacatgcttggactcagcagcagatttcataaatacagttaaaacgaaatcctggtttgtgtaatttaacatacgatgctttacagactcagattttatgtttgctattgtgtaaatgtaccagcctgggcactgagaacggtgggtttatgccatagttgtgtgcacttggtgaaattgttttcagttacagggagagactcatgaaactcaactgtgactctcgatcagcccagcccatgtgacgataactgatagtgcatgttgagggggggaggggggagcaagcacacgcctagggctcagcttcgcatcagttattaaaaggcctttctccagcatttctcgagcatcttaatgtttgtgatgaataaaatgtaaaaacacggagcaactgtcattcacatttttatggctttgtttgaaatttgctaatgcgttttaatgtaaaggtcttatgtaagtggtattttaagcaaaagaaatttgtgatgcaaatagactccaatacacagtaatagctgtcttttttttaaagattttatttatttatttatttatttatttttaaaatatatgatgagtacactagctgtcttcaggcacattagaagaaggcatcagatcccattacagatggttgtgagccaccatgtcgttgctgggatttgaaccaagacctttggaacagcagtcagtgcttttaccctctgagccatctctccagccctaatgattactt

SEQ ID NO: 30157 - DNA, 2960 bp, Mus musculus
gttcgttttcacactacagattggtgaatttgccaacgtcctcactgtgattatgtgtatattgctgtttaaattttgtatatgtgtataaaatgaaaagcttcacctagagattatttctgcaaaaatgtattgtaaaaataattttgtggcatatttttggtccccccctttttttttcaaatgaaccagttatactttatttggtctcaaatttcagaaaacataactgtccccgtaagcaagtattgccagaattaacctcattgcttaagaggccaacttctggaagaagtaggagccatgacttactgtggcataagccaaatatgacttggtttccttgacaactttggtattttaaagtgacaaaagttatttatttgagtgcacaaacagctgacacgctacaaagcatttctaacacaaaacgtacaggtttatggtgttttttcccttcctcttcctcctctcctccttaaattgctccttattttaaatcgaagcttacgtttccataaaccttcctctgtttccctgctttgtgttcctctagcagtgcttggtctgctgaagctctctgtgccactgtgcaaaccgtcctttgccacccaccctcatgagcctcctggtttgctggcggcatgactgcaaagcactttgaactatgcttgagattttagttactctttcatggtgtctgtaataccctagggctttggagttgtttgtttgtttttgtttttaaaccacaagtgagagctgtttgtttcctgtctttgtttcacccgtgctgggcttctcctggccacgcgtccattgcaggcagtggactgaaaccaccagcatcgagctaaccctgttcacactgggacctttctcggaggggccgcttgccattccctgagtcacaggtacagaagggtggtagtagccattatgtggatgagaaaccagagccaacacagcagtagttgtgagtttgtaccttatgtcttacgtttaaggtttgcatctgcttgcttgcttgccttgcccctcgtgcagaagtacacagttaacaggtttccccaaccatgtggtgctatgactcactcggtccctgaagtctgtgaaaacacatctaagatttaacccaggaaagagctaatggctggtttgctgggtaaatggtatagagggatccgtgcctgcccaggcaggtgatggctacaagatggtggggttattggccaaaaaagaaaagagtcttctccattcagtgtgaacctttaaatggcattaaatgagcagagcacagagacagtgctaccctgaccgctgtttcacagttccttttcaaagtgttgctattttcatatatttctttccctgattgaaccaccaaagacagaaatgttatatgtatatatcgtgtgcgtgcatatgcaaaatcatgatgtggtggaatgcaaatacttgcctttttctaccaaataatgaggtttggtttgctgtgaaataaatcagaagtttaaaaagaccaacaacccgatattgctttagcataaccatcctttgtctgtagtctcacttatgaattagtatatgaacacaatgtaaacttcttggaaaaaaccacagcttttgagactgctctatgaaaggcattccagtgcatacaggtgtgtggcgctggggactgctaagacaggcacagctctgcagaggaggatcccttttcaggtggtcccacggttaaagaatcattctctcagggtgactgttgttgaggtaggtcagctgtcgattgtctcgatgcaaagaaggatcatagatgggattgttttaaatgctgtgtgagaatctagagagtgtttgaaacactaagcacagtgaacctgcgagtaaaggtggttaccaacatgagaaattccattttatcttccgtgaacattttgataatagagactcaagtaaaaaccaccgtgatgactaggatggaagtcggcattccagaggggatgaccaatatttacaactccagataatctctgaactgcctcaagaaacaaaccaccgtgactgtggcttgcctttggatttctcgattttacagagctattattaaggggaccccttttcttgaagaatcgccaagttacgcaagttgaacgatcatcaagagcacttatggctaccattggaagaagcccgggcgccttcggttctccagtacctgagccccagccacccttcctcccttcacttgtgtttcagggtgcggcaacatcctcttgttggggaatgcagcttgcagccgtttacactgcactgggtagaagttatctagcaagatgtgctggatagccatggtagcctttggcgtgccccttttgaagcatgaactcttgtgttcagtctttctaactgattagacaaacctctagattctggtttaacagatttctgctgcctctgtctccatcctaaccatacttttgaagtttatacagaaagctttaagagtttagtttgtgcccttggtttttatttttacaactgctaaaatacctctgtaagccttatcctttatcctttcatagttgtataaaattgtatagaattcattcaccaactgaaatgttggatatctgtaaatgagaccaaaatgtgggttgctttttttcataaaataatttctattgggcgttgctgtgacatgaacagcagccagcctattaactgtgaatgccttgtgtcgtcagtatttgcattacattcataaaagtgtgcaagtcctgtgactcccagcttaactaaatactgttatgccacttaacgagcacagcaaactggtttaagtttcaatgaaattgatgtaaaatgatagcccataaataaacagatatttgtgtttggtttcagaactgatttgtggggtctttgtactctgggtttctctgccaaaaccattttta

SEQ ID NO: 30158 - DNA, 1103 bp, Mus musculus
tgtgaaccatgtttgtacagcgtttgccataacttgtaattattttacctggggagcaccactgtgtctattatgtactctccatatttaagggatcttgagtgcctacattctaatacattttagtaagttgcactgatactcaacagttctctaaaacaatgatgagaaattaataaaataaaattaatctttgaagtgtttttaacattctactatatcttgtcctagaggacaaagggctgaagtggttgagacactccatcagtaagccttggtcattctaagggagagatccactagagatgtttggagagacagggacactgtgctctgtctttggtttttaaaagggaaggcacagatttttaatgcattaacccaaagctacattttcacaaacaagtcattaaggagctttccatatataagcttgtaagaaactatgtttccttagttttgcactaaagaaaatactgtcatggtatgtttacttgaaataatgatacatgtatttacggtgtgtggacgttaaacgcaatcacagttctcactctcgtgagcaacagaagccatcatcatcaggcctcttcttgctgagcactgtcctgggtgcgatacacttgatctctctgactcccactgcacctctctaagcaagggcttcgatcccagctttacccatcaggaaactgaaggtcagcgaggttcaggatgctgccccatactatacagggttgggagtcaagtacaattccaacccaggtaaacctgattccaaatgtgtttctgccttttttactatctacactgaattttcaactatttaaaactctcaaagaatgggaaaaacctaatcctaattcacctaacaggtaaaaaaacaagcatgtgtgctactctagttaaaatgccaatgctagaaaaacatgaccaatcactgtcagactttaaactctcttgagccagttctaagatgtcattcaatagacagaccagcttggtctgcttgtcatgtgggagtacctgaatgagttatagagaagctggcatacttttccctaaaccctggggaagctcagtggaaaggggggaagctaggc

SEQ ID NO: 30159 - DNA, 1515 bp, Mus musculus
tgcagacctctcctcccccacaatggcccgctgatgtcatcactatgatgggcactggtccggcagtgttaaacttccttcctttgtgttttttacatgcagcactactcctgactctgttttggtctgaggtagagttaactgcagtcggattatatagtcagatttacatgaataactgttgctaattttaagattggagttgaatggttaatgccgcttgtcacgtctggctaaactagagtgatatttcctgtaaatgtcacggtccatactgagtgtttggtaggcttcctgaatggtttctgggggcccccttcccatgcattcctttgacaggtccctggaagcattgctacccgttgttagcatgcctgcctcctctgatgggaggagttgggtagatagatattcatctgttagggctgcaaccatagctttaagtttgtgcaagtgaaaatgtttaaaagtgagtggcctagatgccaaaatcctcctccacattggagcaaggtgaggtaaggctgtcattggtagatggcgtttgcacccaactgtgcttacctagctggtagaatcccaggggctaagacattttggagctcagggcaggcaaagccaaaaggaagatgtttttgtggtcagtgagaagttacttacctttctaccaaaagccacgtttctggaaaatagctcgatgctgttcattttttaggaatgattttcttccatcaggtcctgtagttgtcttcttctcatgtttggtaccgctaagcttttcaaactgtcttttcaaccctgctgatggtttttagtcagtggcaccagggctgagacggtagctgaccgcctctggcagggttctcgatagccagtcaacatcagcatcgttcctagatgaggaagacgaggaatcaagaactctgttcacctggacaaccatcagcagattgaacagcttcttcttcttcttcttcttcttcttcttcttcttcttcttcttcttcttctaacattcagtctatttatggaggcactggtgagttttgctggagttagtgcagtgtgaggtgggtcacaggaagtgttaggaggtgggtggagaggtaagatggtggctcagattcctagaatgcttgacaagacagtttccaggaagaaccttatctcaccgtttcccccttttgttttgtgtgtatttattagagcatttgcatactggtaccttttattaaaagggttgatttggtgttttaccattgaatgggtcttggttttcctacaaatactatgggtcatagtccttggcttccttttgggatgtcagttgacttctacacacgttaatatactgtgaatgtgttacgttgcgacgtactacgtcagcgaatgaacatgcaaactcgtggtgtaatgtgaactcaaactgcagttgaaatcatcagtggccatcgtgcagcagtgaagaggatagcactttatctaggtgaaaactggactccttatttctgaaat

SEQ ID NO: 30160 - DNA, 1202 bp, Mus musculus
acacagccctccttcgcctgggaggtgggggcggggcgtgcccattggtgatttattggcagggagagttaggttcagtgttgcttaggagccctgaagcgctatggtggtgtttgcgtgctcataaccgggatggccattcataacactcagggagatgcccagtccgcagccagaaaacactcctggccgtctgcctgctccctccactcacagctcaggaattactaaaaatgtgaacgaagcattctctggcctgactcgttcgtagtcagcagctgattccggagacagacgtgtgagtccctggctctgccctcactggctcagtgagcttggcagctttgcctcaacatttccttgtgtaggatgcaaggactctctgccttgggtttgtgggggagatcaaaggagcatacagatgtgcggttcttggagcactgagtacacaccattccccatccttcctcattttcccaagtttattcagtgagcagatgtgtcaagttctttctatggaaagcactgctagggggaggcatacgaatcagacataatcacttcctgaggagagactggatcttctgtagagctggcgggcttctctgtagagagctagtcgtagagtttagattttgtgggtcatagtatctctgcagcaagtccgtgatccgattgttctctcagaacgtagttgccacgattacctgactggtcacagcggtattataacagttaaagtttatataagcatctggaagcacaggcagagtaggtctgtgagcggcacataggcatctagtagggtgacgtgtcaactaataagttactctgttacaaattgggataagtgccgaaaggaaacagataggaaaggtctgtgtcttaggagaagactggcttccaggcagctaggatgaaggtcttaaagcccatgcccacagtgactcacctactccaaccaggccacacccactccagccaggccacacccactccagccaggccacacccactccaaccaggccacacccactccaacaaggctgcacctactccaacaaggtcacacttccaaatagggccactccttgcgacaagcatattcaaaccatgacagtctgtaagaaggaaggtcaaggactatgggacattgcagccacaggatgagttggagacagctggagagggagagacagggt

SEQ ID NO: 30161 - DNA, 1558 bp, Mus musculus
gggctgaggaggtagctctgtggtagagctctgttgagaactaactgcctcacatctccagcaacatttctccttgatattactctccaggaacacagaaaaaggcagctcctctcagggttaaggaggggccctgggagtgaactagctgaacaagaagggatctaagtcggaacacacctagcaccggcatagcttcaggaaaggaaggtttccactgagcacagcctcaacgcttccaacaccgcagtgggtggagaacctgctgctggaagtcaacggccccaccctaccgggtccgaaacgtcccgacgattggcttcccataccagccacgcctacaatccttctgacgattggctgctctccttttcctgttctgccccctccaagcggccctctgattggttgcaggtctcggggggggggggcagctccgcccctctcccggatggctgtattaacgcagcgcgcagcggctcggtctttcggtcccggccttggtggtgagtgtcctcgtgggagggtgtcaggatgtccccgtgtcccctcgagctttgcccgccccgagctcagctgctcccggcggccagaacggaggggtagagcagttctcagcggcccgcggggcgggcggcagtgtccagcccggggctgcgcgagacacaaagtcctctgtgccgtccgacccgggcaccctgaccaccgccctttccctctgcaggccgatccacccgagccggtccccactgcccagccgtgctgctgcctcggacacaagcgcaggtacgtcccggcattgatcggaggcaggccctggccacgtggccgagaagacggaggttccaggcctgtctttgttgagctgcgccgggcctccccagtcgccctttcctgtgcccttttaaggttgtcgcagtactttaagaggctaacacagaagggtaaaggaactctccataaaacccagagaggaaaactacacctcctctttggatcctgtctggagtcacaaatgaaccaaaagcttcatttaaaacttgaatgtgcgcattttaggttctggcgattgctaggtagtgatataggattttaaagaaaagaaaacgtagcctacctggtttaatttggttggaggagaaagttcagaagacaagaatacatttgcttttctagaagtgagattttaggtcagctggaaaggatatagttgagtatgttccacttatgtgaaacatttttattctttcataggttgaaaactacaagaaacccgtgactgaatggctccaaggtgaagtactcttgcatgtagtgaccaggtttgcctgtattccactttaggattagtatcgaagctgaaataggtgaagtgagggccatgtgagtttccttgaatggccttgtaactgattaccctgaaggtagtttgctaaagattttaatcaatgtactaggatcctgccccaccccttcttcatgtcccactgccctagaatcagatctgcatggctatgacatgctcgccgttttaaagatgcaaagatttcatgctaga

SEQ ID NO: 30162 - DNA, 1558 bp, Mus musculus; identical to SEQ ID NO: 30161

SEQ ID NO: 30163 - DNA, 1213 bp, Mus musculus
agagaacgcatcctttatatattaaatttttcttttgttggttgttaaaatttcgacgaattgacaattgtggttcagtcaaacccgtgcgggatgctggccttcaggattttaaaatagactagtggagggagaaaggcaacagggacagaaaagaacaatggtgtagcaaagggaactggggagtgggaggaaggttgggggaagggaacttcaaagaagaccagaagccccagagaaagccactcttgagaagctaagctagaatccttggggtggggcggggagggggaggagccaatcgcgcggcgcttgcgcaatgagaggcccaggtgcccgccgccgcggaagcgtaaccacctagagacgccgcgccgcttgggtgcctgcggcgcatgcgcagacggatcggtcgctgactcttcagggtcgccgcctccaccgaggttggccccagatttgagtctcgcgctcttcgttcgcttaccggcggcttccctcccattctcgcgccctgggacggcgaggctggaaaaaggggttgagagagctgttggccgccgcctttaacttgtgcgtggggcggccatgtcggccggcgaggtggagcgcctggtggagctgagcggcgggaccggaggggatgaggaggaagagtggctgtatggcggtacggaacttcctgtctgtctccccggttctctctggccttcctcccagcgtttcaggcccaggcgtccgaggcctctcgtattggccctaaccggccttggttaggccgagtgcggcctgctcccggccttcgcccggacccgcaggcactcaccgcgcggtggacgcgggccaaggaggccgggcagccctgcgtcgccctcctccgcaccgcccgggcctcctcgcttctgcgctctctattcatgctctttatcgattctgagccgctttggtgtctctcttgctcagtggctatggggtgcccctcctcgtccctttctttcagaaaccgtcattctgtaatagcagctaaataaagtcagtgcaatgaaactaacgtcttgtttcttgatggtcagtttgtatgggatgcacctgcaagggtacctccttgtctgaaagtcgtgctttaaaagtattaattaaaagaaacagatgaaatacactgtggtccataaagaaaaccctgaattgtggcctgtattaaggtgaagtgttt

SEQ ID NO: 30164 - DNA, 2123 bp, Mus musculus
tgtggccctggctgtcctggaactcactttgtagaccaggctggcctcgaactcagaaatccacctgcctctgcctctgcctcccaagtgctgggattaaaggcatgtgccaccacgcctggcaattattgtttattttttttaatgtgataactttcagacaaaccttctagtatgttgtaggggcatctttctagctgttttaagtgggcatcatcggatagttttcagaactcctgctgagcaggcagttgtcctgagaaaagtgctttcctgcctgagcatttggctaactgaagcatgcaaggaaggctggtagcagtcttcaaagttgacaaagtacaaaggtgaatttcaaaagcatatatatatatattctactattcctaacaaattaaagccattgctaaacaaaacacggtctgttttccttaagtagctttctttttggttagttaagactttgatccatacttaagaaggtacgtagatgggttatgttgctggattatagttatggtggcatggtttgtgatctcttgtaggttatagtaaaatgtatacaaattttaataaaattaaacatcataaactgtaaacttttcttataactcttcaaatcagatgtaggaatgcgcccctgtcatacccacattggaaaggttaaggcatgaggatttgagttcaaagctagcccgggcttgggctacagagtgagttctggacttaaacattcaaacagaaatctagtatggactggagaattacaagtttatgctgtgttagtttgcttgctctgacccgtcatctgaagacaggctcactttagtctaaactggccttcactaaatcatgctcttcccgcctcagcctcctaagtgagggttgtggaggtgtactgccacacctggtgtaaaagtgccgtttttagtagaatcaattgtagcatgtggtttcaacccgtaaggctgtggccaaattaaactaaaacacagcttttatccttgcagaacttaacataggagatgaagtaaaactacggaaataccaggtccgtggagtcctccagtcagctgtgggtctcagatgctgtctgttgacattcttagccttttagttggtggaagccagtggtgtgttaatacacacgaaaggttgtacctgttaaaagggtgtgagagatggccactaagtggctaatgatatagggagcccaggagaaattgtaattaggctgacaccctcctgcgcccccccaccccccaccccaccaagtcagttatcctccataagaaagtcagtttttgtcttcagctgtgcatttgtgtctacataccacatagaggtaggattctgacaaaaatacccaactctatttgcttcaagattttgtagtatgcactgaagattttttttacctccattgctggaattgttttacataagatacaaaatgaaaatggtacatgaaacaatttaagagagaagcttaatttttgaattttttgtttgttttgctgaatcatctctattagagggacttggggggcttttttttttctgataccttattttctgaatttctgttctttttactgtttttatccaaacaaaaatgagagcattctcagaattgtattctgcttctttttttctcaaatagagactgcagcaaaatgccatcgctgcccacagtatagttagtattttagactccattgcagaaagcctaagagagcccaacctttgtacctacagccttagatattgttaaatagccattcagttttcttcacattgtgtgtgagatgaatatttcttaagacgttttgtttgctctcccaaagaaatcaaccaaggaaaaaaaaaaaaaaaacctcaaaaaacaaaacaaacaaaaaacaccctgtaactcatgtgaagcatgcagggtgttgtaatttcagtttgcaaagcgctgagatacaatgttgctgagccaaaagcacacgatagatttaatgtagccaattgtggacttttgaaaaaaagagtaactgttccctgtgagttaattttggattttttcaaaatctctcttttaggctttgtgctggattcttccagacaaatgcgtcttccat

SEQ ID NO: 30165 - DNA, 1213 bp, Mus musculus
ttattttgttctgagctctgggaggtgctacgaataactgggggagggctggagagatggctcagtgtttaagagcactgactgctcttccaaaggtcctgaattcaattcccagaaaccacatggtggctcacaaccatctgtaatgggatttgatgccctctcctggtgtgtctgaagacagcgacagtaacagtgtacttacatacataaaatagataaatcttaaaaaaaattaaaaagaataactgagaggcacagaaaagaagttacagccaggggcacggagactttcagtggcttgaaagagtgcagccacagtcatacagcccaggcatgtggtgttcaggttaaaagagactgagctttaccatcgttgttattttgtatttctgttatatcctaagttgtgtaagactcaaagtccaggctccgtagacggtccggcttttgcctccattacactggtttggacatgattttttcatcatttttaacggccctgattcagctacaggttttactttgagatcccgactgtactgtattttctttgtcatctcatcacagcaacgtcagaactgaatctggagatggacgcacgccagactgtgtataaggcaggagaaacgatcgtggtgacctgtgccgtctttaacaacgaggtcgttgacctgcagtggacttaccctggagaagtggtgggtaccccgggataaggagctcacggaacccccacaacaggacttgtaactctacacaccagaggtgtttctcttggatgggcacatccctgagcttctctgggcctcagcttcccatctgggcaatgggcacatttgactccaggacttttaatttttctcaatcaggcagagtttggcatgaccacaagggacatgctccccttgagaaggcagagacaagcaggaaggttctgtggctagaacacaagcattaaagcattagaaaggcaagaaatgcctggattgtaaatattagccgattgcacagtcatgtatcctcactgtcttgggtcacacgccttggggttgtgaggtgtctgatagtgttgctaagtgtgtgtgttattgtggcctgtagtcacccagctgcacaacagcacaccagacttattccttccatctgactggaactttatataaagccttattcactctgatagctgtagagagtatataggagctgtgta

SEQ ID NO: 30166 - DNA, 1162 bp, Mus musculus
ttgagtaccttccatgtccagccccaaatctttaaggagaaccctttatctttaccccttgtgttctaagtatttgattctgggtcccgggtttttcaaaataatgtttatattatatcctaattatctttaagttttatctatttttactttgtgtgtatgtgtaagggcatgtgtatgccatgacacacgtgcatggaggtcacacgctaactttaaggagtcggttctttccttctctcttgtggatcccagaattgaattcagatcaggctttccagaaaatgccttatctgctgggcagacttgctagctctggaattttaagcagacaccctagagccatcacctaagtttcctgtagtggtagaagaagcttagagacaggtctcagctagcccagctgggccaggagttgatggatgtcagggatgaccttgaactcctgagactcctggaggggctgggattgcaggcccaggggccccaccgcagtataggaagtgctccggagttgaaggcagggcctttggtggctgagatggactctaaccactgggctacaccatcagcaggtcctggactggcatagctcttgagacttttggactttaattcttgggtgaagagacttctgtcagtagaattcagaccgtctgtgtatctgtctccacctggggcagcccttcctttgctagttgcttgaaaacaaacgcaggtcgttatgggttttatttaaaatgtacaactattaaatcatagtcgaaccaagcatttcacattttcaccctgtccctcaatcagcgcgtagctctgcttgaaagctggtgtgtaaagccctcagagtccttttcagtcccttagcagcggcagaacatgacatctctttgatcttgggtatgcttttcaaaaggcacaggcagcctggggcgtcttctttgccaccagatagatagtgtttaagattttggggtggggttagagcacaccccactaagatgagagctcagagaattggagaatcgagttgttcttaacagcagagtgagattggcgaggggttggaggtggggtggggtacaaaagccaggagctgggtgcagctgggcccgcagctggtggccctccagagacagagatgggagatcacctcagctcaggc

SEQ ID NO: 30167 - DNA, 1144 bp, Mus musculus
gactccagttccaggagatctgacgccccttcttccgctctttggtccgcgtgcatctggattagctagcagagtcatatatgtaaagtaaaatatcagactttgaaatccattgtgttattcaagcttgtaatcttttaaatcttttaaacttgttttcagagagcaggttgtggtggtgcacacccatgcctttaatcccagctgaggcgggtggatctctgagttagaagctaacattcaagttccagaccagccagggctacatctcgagaccctgtctaaacaaacaagctcacaaaatgttttcagtgtctccacatccagctttttgttcttctccacagatcctgccaaacttttcctggttggccttcccttgtttggcaaagaagacagcgacgcgctggtccgctgccctctgacagacccacaggtgtccaattattccctcatcgagtgtgatgggaaatctctccccacggacctgacgtttgtcccaaaccccaaggctggcatcaccatcaaaaacgtgaagcgcgcctaccaccggctctgtgtccgctgtgctgctcagcgtgacggtacatggctgcattctgacaaattcaccctcaaagtgcgggcaggtacggcctctttcttccatcctgtgggcgatggagaccctattcatggggctgatttctctccttccacttagcctagggcatcaggacacagctactagtaagatgaccaccttccagataatggtagacatttgtaaattcttccagagagacaggtccaccgctgttgctagctaagatggtcattaaacctcctggtttagggcatcccaaggtgacatccttgccgcaagtgttcctactcaatgcaaagatttaatttgaggacataagtctacaagtgatttatgcttgaatttgggtggacctgtttgtttgtttgttttttcctgtagctgattggttcccaagctactcaggctctgggaaagaaagtgctcacaacccatgaagctggtttccatggcatcacctcgaccattcagtggccaggagataaactaggctttatacttgaggttatctaattcagcatcactttgggattcaactgatgagaacttttaatctgc

SEQ ID NO: 30168 - DNA, 1187 bp, Mus musculus
gccaggagtgttcatgatctcttcctgggctctcctgtccttttcactcagcatgaatgagtttacttgtggatgaatgacttcataggtctatatttaggtatgcaaacaatacagattggttagtattgtgctttgtattttatttaatgatgtatggcacaagctgtgtgtagtcgagaaaaagcaacgttgggtctggagaagtagctcaggagctaggagtgcttgctgcttgctcttctaacagatcagctcagattccagctcccacctcgggtgacccgtgtcagccaacaactccagccccaggatagtctacaccctctgctttggctttctcagacaccctacatgcgtggcatacacatacaaagatacacactaatagataaagctaaaataaattttaaaaagaaaaaaaaaggtgtgttaaaaataagacaagttgaaattcccactgtgaaggaaggactgacgtcagggccgtattccttttctttgtagccatcaaggctatccctgttgtgtctgtgcctgaaacaagtcacctccttaagaaaggggacacatttacggtggtgtgcaccataaaagatgtgtctacatccgtgaactccatgtggctaaagatgaaccctcaggtgagtgctgtttaagtcctatcacgggctgtggtctctgtgtggctgattgtacaggttgtctccaaaactggcccaagggtggtgaccctgctggcagtcatagctgttagggactggcctagagtacgttcatgtgctgtctcaactacgtacactgcagcatgtgtgttcattatgagtgataaatagctgccacattgttactatcttttgagaaaagaaagggcacctgtctcaggttgttacttaacgctggctttgtttaaatggctttagtaaggaaatttaaaaaaagcaaacagaacaaagtaaatgaatagctgtatactatccagataatgtatacttaaggtctgcttaggccacgtgacagaaagagtcatcaacacctccccacccccttcttcttcttctgaggaaatgccagcatgtatgacccacaaagctcttctgatcccgcagaatggccacatcatctgggatatggggttctctttgtgcggcttggatttccccctttgaggctggttccctgagatt

SEQ ID NO: 30169 - DNA, 2349 bp, Mus musculus
acaggctttgctgctgtctccgaccccgtccttctggcttctgtgatggttacttggtttccctttgacttgcatcctattccagggtagcgagttccccaccccacctccaaccccactgtgattccgcctttacgagcacacactttagtggccgatggccttttcttttctgccatcagccaccgtcccgctgcgaaggtccgaactgtatgtatatattttcccaatagcaaagtagctcctactgtaaacagaaggactcctcctgctttagaggagaagggaagggcggggtgaaactggatgcccagagttcttcccccagtgctcccctgagtgtatttgaaaagtatggccagtagttcacttgaagaatagatgtagtcccatttggccctgagagccatccttaatgatgggagatatatgtagcaagactagaaaaggaaagccaagccctttgtgtagaaagcagaccattcttagaacagagggcaacggggcatcggaagtctggtcacgctaagaagaccgaggctgagaaggaacaagccaggggaagcgtgaacaatgatgctctgctctgggctgccgctcgggcttctgtacaactgacctggtttctcagtactttgctgtctgggagtagcattggaatcaaggcctcctccctagtcagcctttgtatatactcatctatacgttgtatgcgttcatactttggaggagggatttcccacaagctttcgtttctgtgtacagccctggcattagacctactgtgtgtaagaatagattaagagccatacatatttgaaggaaacagttaaatgttttttggttgtggttgttgttgttgttgttttaaagaaaaaaatgtatatgctaagcacaatctttataagacctcttagccaacatacttgctctgtctacacttcggaacaagccttccatgtcagagtggctttgcaggcaggagaactgaggctgtttgaaaaggttaccacaggatggagaaaacagtgcagtcctggtttggattctcacatagcagggagcacaagttaaactcagccttttataggcacgtcccggacatcgggccagtatctattcaagtgtgtatgtgtgtgcatgcgtgtgtctatgcgtgtgggtgagttgtgttgggaaacttgccctgcatccctgagggtcctccttcaggacccaagacgtaacagcttctgtcaccgctcctgtctctccagtttccctgcatgtcgctcactgtctagaatttactcaaagccgccacagaggcttagcggagtgaagtgccgaaggacctctttatttggagtcctcctgtatttaacaacactcttatcgtagacccattcattagaccttatgtaatgctgccaatccagggaaacagatttaaagtgtaccccgtagacagggcccagaggttcccttgtccttgccctcccccacaccacccatgatcactgtccaacataaagggttcagtgtgtacgtggtcatgtgttgtccttacaggattcaggtatgttgccttcacggttttccccaccccctcctgccctttatcctttaggccgtgtggccatgaacctggaagaagtgatcgtttgcacttgagtgctacactcttgcacctttccaaagtaagctggtttggaggtcctgttgtcatgtacgagactgtcaccagttaccgcgctctgtttgaaacatgtctttgtattcctaatgacttcagttagagtaaggagaatagctgttaatatggatgtcaggtacttaaggggccacaccattgagaattttgtcttggatattcttgaaagtttatatttttataattttttttacatcagatgtcagatgtttctttcagttgcttgatgtttggaattattatgtggctttttttgtaaatattgaaatgtagcaataatgtcttttgaatattcctgagcccatgagtccctgaaaatattttttatatatacagtaactttatgtgtaaataatacgctgtgcaagtttaaacatgtcacgttacatgtgggttttttctgatatgttgtccaactgttgacagttctgaagaattctaataaaaatgtaaatatataaatcaaataaatttttctgtttgttttttaaaggtacatttattcactcaatcagaaagtgttgtgtacaacatttgtgtaaatacatgcaggattctcattgtcacattagggtttagatccttgaaaattcaatagagatttattagtaattttagtgtgtgctattttgggttcttttaaaatttatcctcac

SEQ ID NO: 30170 - DNA, 1158 bp, Mus musculus
tctctcccttgatgtggtcccaccagataggactgatccaacattactatgagtctgtccctgaccgactacattcaggagtcggttcaggaactaaagacccacggactctgagccctgagcacctcgagccttcatggtgatgcccatgtaccccagaaggcttttaaatgagggcatcagagatgagtgctgtccccctccccagcaccctgccactaatttaccacgtgactcattcagcctgtgtcctcacactttgaaggaggaagctttagtttaaatggtctctgtagccctttgactctggtcttaggttgcacagtgagtaaactcaacccttgacccgatcctggaggagagactgagactgaccatgtccccttctctcctgcattgcagcggctgagctggctctgtctgccttcttggtcttggtgttcctctgggtccacagccttcggagactctttgagtgcttctacgtcagtgtcttctctaatgcagccattcacgttgtgcagtactgtttcgggcttgtctactatgtgcttgttggcctgactgtactgagccaagtgcccatggatgataagaatggtaagtggccctgccagtaggttctaaagtcatcataagtggccctggcagtaggttctaaagtcatcatgtcaacaggtagatacttaaccatcgtgaccactaaaacctaggaacagcacctaggatccgtagcagatccttcagtgacaataggacagtacaaatcattcctggggccgtttaaggaatgaagttaaactgtgggaggtggaaggagagctgagatctgaacagcaggtgggagcctccgaagaaagggccaccaaaggaagaggcctccccacagccccgttgtctagaagtcactctgtgggattaaatcccagaccaggagacagaggtgcttgaggtaagtagcttggatttgaagaaggaatgcaaactgttctcttgactttctttcttgggatggctgccttctcgacaaagcccttcttcatgtggggcagcctgagggaagaggaaaaccgagtgttgtgctaaatggagattgccttaaggtttccaagtgctctctagccaggaagagggaagcaaacgtttgtgtgtgagaag

SEQ ID NO: 30171 - DNA, 1214 bp, Mus musculus
cttgacatttaatagaagtggaggtggcggcggcttaggccttaaagacctaaggctcttgaggaagtactggtaggagcctggcagcctgacctctccagggccaataagggggtctctggtgggacccgagaggacgcagggagagtccatcaagcagctccagctacctggcccggcgcgccgggtccaataggaccagtgagcgagccgcacctcaacctgccggaaacgtcacgacgccgggctgacgtcgggccaatgggaggtcgtgttggccagggggcgggccggaggagttgggccgcggaggcagttggaggagtgtgtggcttctgctgcccagctgctccggagctcccgccgccggtccgtcccggtccggtccccgcgtcccgcgtgctgcagggctgccccctgagcggcagccaggcctgacggaggcgcctgccggcacgccgggctcgacgcttcccttcgcctgcacttcttcctgccgcagcgcggtgccggctgggcgggcgggatggcggccgcggcccgggggagcggccgggcgccgacgcgaaggctgctcgtgctcttgctgcttcagttgctctgggccccggccggggtccgcgccggcccggaggaagacctgagccatcggaaccaggagccgccggcgcccgcccagcagctgcagccgcagcccgcggcggtgcagggcctcgagccggcccgggccgaggtgagagcccgggctggtggggatggggcgggctgaggccgcggagcccgcagtcgggtaccaggctcccgcgctggcggcgccgccctctttccgaagaggctgggggaggggagccggcccctgctccgctcgctgggaggagggtgacaagacggctttcttaggcgcggcctggcctggcctggctgcttgggggaagggaaagtgagggccccaaccggggctccccagaggtcctctagatccctggtaccgacaggcttgctctggattctgccttctgctgatcacatgggccatactgaaaagactggaaatcatcatcccaagtagaaagtttttagtacagagccgctgggagacttgtctctctcgaagtagcatcacattgttggaagtatcagccattgttgaagcaacccaaccagagatgctcacccgaattcagctcggcacaccctgtggttcttgccagata

SEQ ID NO: 30172 - DNA, 1139 bp, Mus musculus
ttaaaaaggaggagtgtgaattatgttgtcccccttgatcttttgatatctgtgacaaagaaacatctacttatggagtagagtgtggcttccagtttataaaatgttggcattcttagaggacatcacagtctgtctagctcaagtgttgtgcctagcacagatgtaagggaagccagccattagttgagtttgagtggagaaccagtcagcatattaagaaatgtcctatagcagatgcatataccatggaaatgaggccatgcctgtcttggaatgccattctaaagttggtgtggaaagaaagagccagaagtatttcaggtcattacatatttgatgtgtctaatatgaaccagttttccttcaacactgtaaattatgatttcttactgtaactctctttggtctgtggtagaagcactgttaacactgttggcatttccttacagttttgtttggctatgccacaacagtcatccccagggtgtatacatactatgtttcaactgcactcttcgccatttttggcattagaatgcttcgggaaggtttgaagatgagcccagatgagggtcaggaggagctagaagaagtccaagcagagttaaagaagaaggatgaagaagtaagttgtaaagtgttgtgtgcatgcggatagcttagttactttccactcctactgtactgtggctgagtgtgggttactgtgactggcagggagggaggtgtccaccagatagtcagctttttaggttgatggcagatgttggaatcgtgggaactattctgcatgtttctgaagcatccaaatactatttgccgatgagtgggaaaattgacagtgtatgaggctggtggctaaagggcagtcggaggatacagtgtattttctttggagaatatgccatatgttttaaaagtgactttatgctatattcataggcttacttgggttaatggtatttttcatttgtttcagttccaacgaaccaaactcttaaatgggccagatgttgaaactggtacaagcacagcaatacctcagaaaaagtggttacattttatttcacccatttttgttcaagcgctcacattaacgttcttggcagaatggggcgatcgctctcaactcacta

SEQ ID NO: 30173 - DNA, 1099 bp, Mus musculus
gggtcctgtaggtagacattgaaccttggcctctggcacaggagttaagtggcagcctacagccctacacctccatcccgggctcctacctttcctgacttactactcttcaaggactcctctccagggcctccttgtctctctgtagaaactttgaaacgttctgttgttcttccttcccaaatatacgtggggtcttagctacccttaagggtcatcttcttctgtgaaggctccttgtttattttagcagtatttagtcctcaccctcagctaaaagctcgagggtcaagggttaggattcctgctctcaggaagcacagcagttctgtgccacacgagacttataactcaggtccatcctgtgctgtccacattccctgaagcagccatcttctgtgtaataaactcaacagtatgcctggatggttcagagcccatagctagttctatttaacactggccattctcaaacaccatctccaacttaacaagctaacacaagctacatctgcttccaggacccttatggtgtagcagtgggtggcacagtgggacactgcttatgtactggattggcagtaattggaggaaggatgatagcgcaaaagatctctgtccgaactggtaaggtctcatttttttttcccatgaaaatgcaagtatcatctgttctaatgcttgaaaatcatggagggtaatagaatgctagctcttatcatttttccagagaccacttgatctctgtgcctgatctaggccttgtcaatatttgacacattgttactgtgcactgacttcttttcctatgtgtacaaatgagaaaatcacaagcttatctaaaatatggtcacacttgtttgttttgtaagccagtgaaaaacttgtagaagtttggcctgaagtatttgataagcagaccctgtgtgaggcttgaacattttcaacatttaaaatgggctggggtccgagcttgtgggcactgatagcaggcttggccacagcactttttccatgctgtgccatctccgggccctcgagagaccggggtgggggggttaaggtgatgactgctacagtccaactgctgcttgccaac

SEQ ID NO: 30174 - DNA, 1668 bp, Mus musculus
ggatatagaatatcaagtattactgagaaaagggaggataagtgtggcacattagaattgaccttaaaaggaaagtatgtgatggtgaggtgctaaactggtttcagcagtgcagataacctaaggcagagttgctagatcagggcttggggaactcggagtcagctatctgtctctagctttgctctcatcatcagtaagtgtgtctttgttttcctgtttacctgactgcaattaagttagcaagttagtgataaaaagaaaacaaccaaagaaaattggtacctactcttctgcataagaagtgtgtctagataccagtcagtaactcacatatcacagagttcttctagctgacattcatacgaataccagaaatagttgtgagaatacacatttatgcaagtttgtgcacacgtgacgaaatcaatgtaagtcgagcacccacattgcttttctcccttccacattgccttcttctctttggccattccatgtcctcggagtcggagctgtgcctcgtttatctttttgcatcacatagcgataagaatttagctacaggagatacaacatgctagttatgtaatgcctgctgttcttcacagttcatctccctgcttaaaagtagcagttgataagaaactctagctgctaaggctgctgtccacacggagatgcatgctgggcaacagttgtcagcactagctgcctcttagctccttaattcttggttcctttggatggcaaactgtctttgtctgctccccacacgactccagtattctgaagaaagttcatcttttgcctgttcatttctgtagccaaagctgactgaaaccccaaatctaaatcatgaaaagataccaaaaagaaacacttctcagcttcttagaaaccttaacttctcttgctgtatttcatggatttgattttctttgaaatttttgattctgggcagcgccttttaattaagaaattgttaggatgaaggtcaaacaggttctcattgccctgcaggtaccttgctctggactgcttctgtatggggtgacttggggttgctgaacacacaggattagaacagtaaacacaaagctgcccttgaggctggcgttaaaccagagcctcaatattgaaaatatcaagtcctctttccttccttagagacgagactgtgagaggaaagcaactgtggtaggtgggcttgcttgcacatgagcaccaagaccattccccaagctctatcctcagggtagcatttagagtgctgtgttctgctgtcacatagacatggcttagggatgtagcactaataaaagaatgcccgtgcttttgaatagttgtgatagcaaactctaggctaactagcaagtgtttgaattctgtgtgctgtatagtagttggtcattgccttaaagcagtctcttggaagttgggagcactgaagcagtccaaccatatatgggcatcacgttgagggagatgagccttgttcaagccttagaaaggacccttagtctacacaggtagattcttttcacttggatattactgtgtttaaaatgtttccactatgttgaggcagttttttaaagtggaacacagataggatttttagtatttctttttttgtttctttggtgattaaaggtttgttggtagaca

SEQ ID NO: 30175 - DNA, 1151 bp, Mus musculus
tagggacacagccaattctgacagtttctttgcccaggtattttttgatagaaagagtatattgccaaatgctaacaagctcagctatcaaccagatctttactgaatccgaagagcactaacagtgttggtagctttagtgggtctgtgcctgcatcaaatattacagagggcacaccactgccaggggtttgcttagaatgccatgaagatagtccagtagttaatagtccccaccccaaactcctctccctgttcagacaatgatggaaccgtgatgactttgagaatgttgtgcaggtttgaattcactgtgtacagatgctgtagtgtctctgtgtctggatggaggagagaaagccactttgatacagaaagcattatctgtccctcacaggtatgagtgcatttcattaggtttgacaccatgtacaaactgataacaacctctcttttttcattttgtttacaacacagtagtgttctcgttacttttccagggcacaagtctttttgtccgtgctttggctgtgatgtcacagtttgttcagtgaggtaacaatgtgctgctgggaatggattttttttaaggttaaattattgctacatttccacttactcagaaatatcccttatttcattatttttcaattatgtttgagagaattgcactgctttattattttagatggttggttgagagtttaatcacatattttgatatatttcatagttggaatatttatgtaaatggttttcaacaagcctgaaagtaatttcaagaatgtttcagttgtaagagtaaagtttgcacacaaaacattttaggcacttttttaacattctcagaggtgggaattttaacttttaggatttgttggaatctttttattatctttaaaaatttcaatgcttcttttagtcagaaatgattcagggttatttgaggggaaaaaacccatagtgccttgattttaattcaggtgataactcaccatcttgaattcattgtctggtttcagtagcagttttgaaaccttagtacatttttagcagcagtgtcattctcaagtccccatgaggactgctgcgtctcttgggctgcctgacagcgtcacagctgggaatgggatcccaaaatcgtttcctgt

SEQ ID NO: 30176 - DNA, 1173 bp, Mus musculus
ttgtttgcatttaatggacacagtcttagaaacattacagaataaaagcccaggcatcttcatctttggtgattacatgcacattagcaaatctgtcttgtcctgattcactgttgtaaagcatgagcagaggctagaagtaccatcctggttgctgagagatgctgagaagcaggactctctgctttgactccttccccatcatggttaaagtacaaggcactgtgaatgaaggtagttgtcagggttagctgccaggggtatgggtgttattttatttttagggggaaagtagttttattttaattttatggcccccttccccctcccccctcttaaaggatctaattgcagtggttaaatgcagctaaccagtttttttagaatatgctctctagccaagtctaactttagacgctgtagatggacaagcttgattgtctgaaccaaaatgggaacattaaataaacatcacagccctcactaataacattgtgactttgctgtcaagtgtagattctccacccccacccccacccccaccccgaaaagacgaagaaaaagcttgtgaccattttgtatggcttgtctggaaacttctgtaaatcttatgttttagtaaaatattttttgttattctaaaaaaaaaaaaaaaaaaaaaaaaaaaggaagggggtaaaaactgaaaatgtgagaacaaccactaatgtaagtcagagggaggacacgtgtaccaggaggggctcacctggctagaaactgctagtcactgcagtgccatagacaggaagatacccactggcacttgtggtggaagagaggcgagcaccttcctttgcagttcgcccagtggcctctgcgctgttgccgtgggtctgcaggcagagactggttctgagagcagagatggagtgtggggaggagctctcgcctgactccgctgctcgtttctcacaccgcacagctaaagtgtgttgtactctctttccatgtgctgcttcagtttcagttttcagctcagttaggagccatgcagcatctaaaagaccagctagagcagcggacacggatgatagaggcaaatattcatcggcagcaagaagaactaaggaaaattcaagagcaacttcagatggtccatggtcaagggctacaggtaacttattctgtctg

SEQ ID NO: 30177 - DNA, 1200 bp, Mus musculus
aatgtttagttttaaaagagccttatatgtatattttcatatgtgaaaaaacaaaatatgtattaatagcttaactgatgtgatatgtgaatttttattattcccaactaaaattactccttacaatgtgtttatactgtgaattgctttaacatgctcacattatgctttaataatctgtgccttagtgaaccataatatatgcatggaaggattcttgcactatttaggtttcgtgcctgtgtttatagcccatagcatgatgaattcagaaaatgatccatttgatgctgttccgtaagtgtgacatcagtccacgtgtgctgtctatcacacaggggagtctatctaaatctagtctaatagaactctttttattttaaaagtaaagaaagagtttatgtgagcttctgtttccagagagttaggactccctcagggaagccgagcggctgacagcgagctcaccacacagagcctagagtggccaggaagtaggggaagctgtgtactccgaaagccctccccccagggacgcacttgctccagtaaatctgcacctcttagacctcctcaaacagcacccccacacacctggggccaagtgttcaagtctctgggtctgtctgtgggatacatttctcattcagactacattttctaaaaccaaaaattcaactgataccaattttcccccctgaggtgttttttgctatttctgaaagttcagacctactggaggtcaataaactcagctatctgtttgcaaattacttacattttcatcaactttgaaaaacattttcctggctatagaggaaataaatgtgcctagtgatctcatctggataaaatagttatcgccgtgtgtgatagtgcaagcaggaagggcggcagtgggagacacttttatctatgtgggccttatttgggctgtcctatgcgctctccacatgacacattttttttaagaattaagttaaaataattcagagttttgtaaaataatcaaatgaaaattttttttactaactaaattcttcagtgtactagtctaaaatttcagaatatgaaagtatataaagtaaatatagaaaagtgttttgttaaaagtccaatatgcatctgataatacctatttgtggctccaaatcctatctaatatccccagtctttccgaatagtatgtcaacaccatcc

SEQ ID NO: 30178 - DNA, 1187 bp, Mus musculus
gaacccagtcttttttcatgtcaatatgcaatgcaagttttgttcctaaacaagacagtttgtcttttggaataaagaggtaccttatattaaattctttagcaaaatttttatattagaaggctctctctagatttctttatttttaaaccataaataaagatagcaatacgttgaaactatctgcctcaccgttagaatgacatgtgaaggtccttcgaaaggaagtgaagtaatttaatatacatttagtaagtggttgtgggggttggcttcacaattgtgagcttgggtatcattgccaataagctttttaaaggaccacttcagatgaaatacaattagtggttactttgtggagatcaggagtatgcatctacagcatgaatggaaataaaaccatccttattttaagcaaatggacatttgtggcttgagatttttcccccgtgagagcatcgaatacagatcttgaacttcccgttctggacataatgcagcaaagctgtgttcacttcttcctctgccttagactcttctaaataatagagagcagggaccgaaacagaaactttgtcttaagtgagcccaggagatgtgtgccactctgaactagaatctatgggttaaaaactatcaaaggaactgtgcctgagcacaagtcatgcctagtttttacagcaccccaagaacccctaaaaacccccaggaatgagagcacaagaaacacaggggcccaggctgggtgggaggctgtggatgagcgtttggggtttccgtccaaagtgaagttgggcccgattttcagccccatttcacccaggtggctaaccagactcagtaccatgtgaattgtgaagcctgttctctggagaaacagaatcagggggcaaccaaactgagactcaaacataggaggctgaggataagcagccctaatgagaatcagcgtagatgaaagagtacccagcacagtgactaccaataccctagcaagtggggtaaaacggtgggaaaccgccatcaaaaacctgggaaacctgggggtgctgacatttgaaaatgccaacgttagagaaggctccaaagctctcccatgtctagtctccctttattcttttttgacttctcaaattccctcacatctggcaaggagcacagttgcctagatagagactctcttttcc

SEQ ID NO: 30179 - DNA, 1152 bp, Mus musculus
gacaaaggacagtaaaatatcaaggcttttcaaatacattggtgagaattaggtggattccagcaaatcaagggaagttttcttataggtttggggtgggatcagatgatgtttgtagctctgggcgtggtgggagctaaggtgcttatcctcacagatgcttcaggtgacagccacaaggacattgggtggacacaggtaggcagtaagcctgctttcaggagaatccaaggtagttgatctttgagtatgcaatatccccaatacctagtctcccgcactttcaccagtcagctgtgcagaaccttaaatagacagctcttatctgggcacttcctttcagttcattgttttgcaatgctggggactggactcgggtacactggcaaacgatctgtcactgacctagttacccagctgatggtcatttttgctagtagacaagttccctcctcacctcctgacaactcccctaacgtttgacttttctttctgtgtagatttctcagccaccaatgtttagacaaacctcaataaaatgactcttcaggagttggtgcttcggactgcctctgtctatatggatagaacagctgtatgttttgacgaaggcaataaccagcctccagtgtgctattcctacaaggctctgttgagcgcggcttcagaattatcccattttctgatagcacactgtgactttggaggaattcgggaaattggtctctattgtcaacctgggataaacttaccctcctggattttagggtaatatttctagtataaactgatattactctaaaccaatttaatagttttaatatgtagtatactttgtaagctattgttttatttgctgtacacatttcctatggtattaatttttgatcatgtacattagttaatttgagcttattaaggacagactaaaagtttttagtaatacaatatttaaatatgtcaaaagtataaaggccttatttgtctgtcaaagaaaacaggtaaagcattttataattgtcttcaggtaaaacaaaacaaaaaccaaaaaccaaacaaaccattgagctgtcattccagaacttgttaactctcttaaaatgttatctttctgtatattaagtgctaagagctctttctttttttcaatac

SEQ ID NO: 30180 - DNA, 1037 bp, Mus musculus
ttttttttttttttttttttgagacagggtttctctgtgtagccctggctgtcctggaactcactctgtagaccaggctggcctcgaactcagaaatccgcctgcctctgcctcccgagtgcttagtcttgtgggaggggggcacatatgcactaagttataggtgatttttgagctttctggtacagcaagtgccttctcattgagctgtcttgtctccttaagttgcccgggttaagttgtctcagttgtcaggggccaggctgggctccagctctgagaaaggagagaacaaaacagccccgaaatgaaaatattgtgtctttgagagcagatggtgaggaaagaggccatgtccctgaacagagctgagggtgagttactccccaaagtgaagcccagggagtatcccataatatgaaaatggcctctggtgggataggcttaggaagtctggcctgggatcctcttttgtcccctgttggacttctctgattgtctcactctctctgctgcctgtgttgggctcctgcttgtgataggattaacctactcactagaaacccggagcttggctgtcttggattgttttccatacaggaaaaaacattttccaaattgttttcagagtaagcagcgctgctcacttctgagtgagcagtgacagattgggggggggggggagtgggagagaggaggagaatctgtgaaaaggggggagtatgagtgtgactatgcagagggcttctgacagctggctgcaactgggacaatacttactgtttaatactgggacatagacttggacataatataactgtgaaggttacataagaattataaggttgggctggtgagatggctcagtgggttagagcacccgactgctcttccgaaggtccagagttcaaatcccagcaaccacatggtggctcacaaccatccgtaacaagatctgactccctcttctggagtgtctgaagacagctacaatgtacttacatataataaataaataaatctttaaaaaaaaaaaa

SEQ ID NO: 30181 - DNA, 1752 bp, Mus musculus
cgtcttcttgcctcagctgacaaagcagcaggtactgcaggctatgtcatcatgtcgggcttccttttttttaggaaggctaagagaagttttcatcctgacttagacgatgtagctgtgttgtggtgagacatgttttcccttcctcctgcaggagcaaacagcgttgtgtatctgtcagtggaaggactggtttcatctgtgcaacaagaaataaaatttaagaagcagaaagtgaaaaaacatgatattgcaattcaagaaaatggaaatggtttggaatattttgaaaagacgggacactgtacagcttgcctcactgggcagtaccctgtggagctggaatggtagctgcctggacagatgtgttgcttccagactgtagggtcatcaagaagtggtctacatactgttgttactcaggtggtaccaagtggataccacatgcttatgtatgtatactttaagctttgagattttctgaggttattattaaattgctatattgaacctgaagattacatggaatgcagcatctgaggattcattttgtacaaggactgacttttcactcgagagaaggcagggggttagtggcagttcccagaaccatgcttgaggggtttaaaagaggctagagtatagggctgttatgtacaggggctttataaagtttcatgaagaatttgagttcattgtgccccataggtatctagtctgtacagtcaagcctgtaattatggccttgaccttaagattcttccaccccatacacgtgtggctctgaggaccagtgtacaattcttaaaaaatgaaaacctacgtcggaagctgaggcagaatcctgagttcaaggcgaacctgggctttcctgtctcaagataaaaagcctctcctgtgccgggaccccccatccatctgtcgttcatacacttagtacatagtaggaatgtgcgtgcctgtcataggtcgtttagagctgccgtctcacccctgtgcatggccattagcatctcagaagctagtgataattaccttttgctaaattacttttcggtttcattgtgatggagggaaatggacagctttgcagtcctttcccatctctcttggggatgtaccagaatgactaaaaatatatctggagcctttttgttttcctacacttgaggagaaaatacttagtctagcaaataacttagtacattggaaagagaaagttttaatttcaaataagactttatcctaggttgattaaacctggctttttgaattgagtgcttgatcattcacagaaatgtatacttgtatacatattatacatatgatttaaacagagcaaatagatgcataatcgggctgattttcttaaaggccagtgttttgggaattagattgcctgtacccaagtgttagctcgcaatcatgtttgttctgctttatgttgttaggcaggcctggtgacattttatttttagtttttttatgatgcagatttagtggattgagatgatttactaactcctgtttgtgtaagattttttcacatggaaaaataactatttctatattgttgccaaaatttgctatatactttccaaacccacttagaaatataatatttattaataactgaaattattagtctacatttggtctatagtatcatgtgttacataatggcaggtcaagataaaatgttaatactttaaggtcatgtgctgcagtgcctgaggttatcgtatggcatag

SEQ ID NO: 30182 - DNA, 1134 bp, Mus musculus
ccagacttagcctagaagttgtccttttgcagagtcttatttgacattctacatactccgcatacatttatttaaaaaaaagcatctggggccaccctgtggtggcgcatgcctttaatcccagcaactggaaggcaggggcaggtggatttctgagttctgaggccaaccaggtctaaagagtgagttacaggacagcccgggctatatatacagagaaaccctgtcttgaacccccctccccccaaaaaaattgttttgagaatgtgtgtatgtatatggtgtaggggactatgttttttgttgttttgttttgttttttaaattagttacaacttgctgggtgcagtgactagctcaaagcactggagaggtctgcagaggcaaactgatctggagcttttgaggctacatagcaaatcctaggcctgccatagctacaatgaggccctgtctcgataaacaaacaaactacaacttattcttagtgacttgtcactatgttattatgtttcctatacttactttttttgttttgtttgtttttttgagacagtttctctgtgactggctgtcctggaactgagttggccttgaactcagaaatccgcctgcctctgcctccccagtgctgggattaaaggcgtgcgccaccactgaccaaccctatacttgcttttatatgagaaagctataagattagataaggtaaggacaataaagataagatgtgttagtgaatggattgtattttatagtagagttcataatatcagccctggcaaacatagcaagactagtctaccaaaagagattgactttattaggataacttaactaaaccaagcaagcctttggtaggagactagtgttgaaaatatgactgtgggttgttttgtttttttctttttctctttttgtttgtttgtttctttttttgttgttgttgtttttgtttattgagacagggtttctctgtgtagccctagctttcctggaactcactctgtagaccaggctggccttgtgctcagaaatccacccgcctctgcctcccaaactctaggattaaagccgtgtgccacccctgctgggattgtatttttcttttgaatagcagtgataagctagttt

SEQ ID NO: 30183 - DNA, 1215 bp, Mus musculus
cccgcttccgggcggcccctccccgcaggcagccaaaaagtggcgcgcatgctgcaaggcccccgctggccggagaggtttctgggttggagcggaccaagtcctgacggccgggggacggcgtgagaccagggggcacgaacggctcaggttttctgagggacccacgcgatcagctgcgccactctcatcacctactccttgggcgcgggaaaataacggagcctcccacgtgcagagaaagtagcgatcctgacctcggcctcctccccacctctttgactccgtagccccgcccctctctttgccctagctgattggcggagagcgggaggcagaactggtcacgccccttctatgaagcgcgccgccgcagtagcgagaacctagcccgcccgggaaggaggcagtcagtagcgcgagcctcttgaggcgttcgatagcggagcggacagctggttggtgcttggaccacgccgcggcagcaggtccctccacgtgctttccgaggcgccatggagctggaggagttggggatccgcgaggaatgtggtgtgtttgggtgcatcgcttctggagactggcccacgcagctagatgtgccgcatgtgatcactctgggactcgtggggctacagcaccggtgagcaacaggatggaggggtgggggtggaatggcaagtatttgcacagttccacgagccgcttcccagctctgtgctacggggaacgcaagacaatgagggtggatcatgactgggaaggggggatcagggctaggagggtgaatctcgagaatcaagtcaagtacctactcaggatattgaccaagtgggggtggggtacactttgcctgcatagactttaacttaggctgtcgcgttgctcccgagtgctctttacaggttagctcccaagaatgtgcatctctcgtcgcgggttagttactctggagtttgctttcactagccaggttgggaagggaccgttcagatctccttgaaactagaactgttctagagataagcttctgtagggtggtggtgctgaaggtcctgcaacacttgaaggtttttctatttgttgttgttttgcacggggcctcctgcttgcaagagctttgtttgcaagggcagagctactgagcagatttgtcagcctgaaagcagttagaggtttggagatcgtgagtttaaaagtagttatagctatgag

SEQ ID NO: 30184 - DNA, 1471 bp, Mus musculus
ctcaatgtctgactatatattttaactacagcctactattttaaatcagatcttatgtttttaaattattttatacttagatgcttaagtacgcatctctaagaaataagatttgggtttattatcatcttttttaatttttaagctgccaactcatttttctgtctttttcttttctgatccaataggtattggctgttcaactatactttctccagaaggatcagctcagtttgctgctcagatatttgggttaaacaatcatttggtgtgggccaaacttcgagcgagcatattaaacacgtggatatccttaaagcaggctgataagaaggtcagacaatgcaatttgtaaagaagcaatttaatttttaggagaaaagttacgtagtcctagtttggatttaaagaaaaaagtcaagcaaaatgatttcacataagagaaaacaatttagttactaatgaacaaatgttactcagtgtttatgagttggcacattgtcagtggatattactaatatttctagctctacaaagtgatatgtccctgtaaccttagcactccagaggctgaggcagcagcaggacctcttaagttcagggccaccctgagctgtgtattgagactcaacttgccgtggagggaatctttctagctagtaaaattggcatgacactactaaatttattctcacgctctgtatagtcactgttgggtaaatatgtaactatggaactggaacaatgtgtctgctgtctgaaccactatgaagaaccagtgtggctctcttgcagacgacctgaatttgcttcccagcatctctgtagactgtttcacaataaataccctttaaatcaggggatctgaccccatggcttcctcatgcacctgctttcaaatactattacattcccccacccaacacacacaattttaaaaagtaaactttttaaaaagagtaatagcattttttgttgttgttaatcagtagataatgcttgaactgagttgatacattgaaaattaaaatacttgtgtataacaatatattctcgctgtgtggtctatacattctaagtcattatctaagttgatggatgtatttgtgctttgttggggtttgtttttacagtgttgaggagaccttgcccatgctttaaccctggtttttttgttttcaaaaggttgagattagaggtagaagaaaggtgctcgccaggtctctttcctgaggtctttgggcagtagggcagtcgtacgtgggataaagccattccagggaaggatggagtaaacactgcttagctaggattggtaggtgcctctctggtaagacatttgccacacctgcagtcaccatcctgccaccattttaagaaattgagtctctagtttgtaatcatagttaaggagtgggtgagtgtgatgggctgattggtttgctagtgtatatccgaacaatgggccaga

SEQ ID NO: 30185 - DNA, 1882 bp, Mus musculus
caacagaagaagaagaaaggagggaaaagtggctggtgatgacagtgtacttgttgcaggctgttcttaatccagtgtcagtgacattaggaacataataaaggtaacacagcaggaagcacagagctccctcctccatccccatagtcctgaaatgatttcttacacttcagatgcgaagacatcctcctcagactgcctcatcgaattggcctgcttataccaaatagctttacagagagaggcctgaagatggcagcatacgacacattatctaaggtttcccgggatttaaatagacagggtttctcctgtttcaactagtgtgaagatacatgttcctatcaagtctcaccttaaattatgtcttacaaggctaaaagtagaatcttctgagcattccaagtatgtgtttagagctatcatgtgatgaaaagggatcttaataactgagtggccagaaactcaccgtctaaaataatcttagccataaattgtcctgtgatactggaattgggactctctctcgtgtgtgtgtatttgtgcacatctgactcctttgtacctttgttgtttccattttcagattatgttaacatactgatttagttccactgaagacctcaaaaaatgtatcagtgttccaagtagttgactcttgccccagtgttctgagggcaaatgggtttgggcttctcagtcagaacacttaatggccactatcaagaacataaactttgacctctttatcttaaagaggaaacaatatcaggcggtattgaaagccacaagagcatttggccccattaataatcagatggctcccctttctggttatgggacatgaccttcattacctttttcgaagtaacgtggtctgcattcattttgtggtgtaaatgttgctcttgtctttcattgctagcaggtcactttcacactcagcagttgtgagacacacatgggtgcctccccatgcttagtattcatttctgtcacccgagagatcatcatatttctcacctagatttcctgtgaccaggctactctgttcttgttaataaaagcgctgctgtgtttgagcatttctgttgaaacttctccagtgggttcacaaggctttcctgctctggggagttagaataggggctacttttctgttcagcatagtcagtgtctgcagtgtctaagaggggtcgacattgctctccagaggactaaatactctgtgacaggaataattgattccgttccatctcctttgcttaaggacttttttttatgttgaccaacagaatcttcatattctaaactttgagaattttggtctaagacatcatggtgaaatacacacgtagccctcttagttgacattgatacagtcattgctaagccacagaaacctcacttcaaataagttatttatctaaacttcatctgtattaacatctagtaactatttgggggaggtctttaactggctcagtgtgtgtgtgtgtgtacacacgtgcgcatgcacattaataaacaatgtggaaaacatccattcactgtgttacattttgaaataaattttaaaataaactagcagtgaatgtgactaacaatgtttcggtattggcattttatgaaggacttccttattaatacatctaagatctttcttttaaggtgactatctaaaattgcctcctgccgctcctaacagaactacaaatctaatgggattgggagaactcggtttaaaaaagtcaaaattcagaggctggagagatggctcagcagttaaaagcattcactgcacttccagaggccctgagttcagttctcagcgcttacacggcagttcacctgtctgtcactccagttccagggaatctga

SEQ ID NO: 30186 - DNA, 1204 bp, Mus musculus
ccccaattctcgtgcacgcccgggtaaggctggggctaacttctgctatttgtttataaaagaaagaagctcagggagtaggttccgcccctttaatgagcctaaggcgggagtcgggggccgggcggattaggtaagtttcccccgaggcgcgcccccaggcaggccaggagtccacttcgagcctcgggaccgaggggcggggcgcgctcggcggccacgcgcgcgggcggggaagggggcgtgtcggcgggcgcgcgcggacggcgagggggcgtgtccggcgggcgggcgggcggcgacggcgcgggccgggtgcgcggcgcagcgtcctgtgctggaatgtgcggctcccgcgagctcgcggcgcagcagcagaagaccgaggagcgccgccgaggccgcgggccccagacccgggcggccgggaccgcagcgacggcagaaccagggccggcggtctgatcccgctccgcgatcgcaccccgggatctcgagggcctcgacgcccaacttttccccgctctccctcccctcccctcccccgaaagtccagcaacaaagaaaaggagttggagcggcggcgacgcgggggtggcggaccgtgggcgcacagttcagagggtaggacgcggcggagcgaggagagcgacgggggagggcggcgggcaggcgcggagcggcgcgaggcgctgtccagggctgatttgcagatactgtggctcgggcggcgcggcggccgggcgggggcgggatcgagttacggagcgagtcacgggctgggccgggggctggtgcggagcggcgtgggcatcggcccccagcggagcacggggaggcccttccgcacggcgctgagatccggggccacggaggccggagcgccgctgctggtgaccgcggtcctgaaacttcccccctccgccctccctccgcctcgggcccaacgcccccggccccgccggcgtcccaggctcgccgccccctcccccccagtcgtagcagggccggaaggcggccgccccgcttgactcagcccggggcacgggcggcgccggcggcaggctggacagcgatttctgcggcccgcgctggctctgcgcagcgggggagcgaagttcgcaaacttccgggccacgggggcggcggtggcggcccgcgtggggcccctcgcagcgaccgggggccgacagcctcgggaggg

SEQ ID NO: 30187 - DNA, 1572 bp, Mus musculus
gacaacaatagttaactattcagtgatttggttattaaaattttagttaacattaaaaatattagccaccaaaaagaagacttgcatgccggtgtagacccaatgggtcaaagaattcgctttttttttttttttttttcttctggctatagaggaaacagttcctcatctgtttttgtgattgcaataaagagaattgaaaattcacagcacccttgcccaggcctatctagtgctaggattacatgcgagtactgccatacccaaccagaaaaaaaagtatttgaatgttgttgttagaagttaacgaagcttgttgaattttaaaggttgcattggaaagatgcttgctttgggtaatgagggctttatttatttatttatttatttatttattttggggggttttgctttatccagagtacagttatggccacccaggtgatggggcagtcttctggaggaggcagtctcttcaacaacagtgccaacatgggcatggccttaaccaacgacatgtacgacctgcacgagctctcgaaagctgaactggcagcccctcagctcatcatgttagccaacgtggccctgacgggggaggcaagcggcagctgctgcgattacctggtcggtgaagagaggcagatggccgaattgatgcccgtgggagacaaccacttctcagaaagtgaaggagaaggcctggaagagtcggctgacctcaaagggctggaaaacatggaactgggaagtttggagctaagtgctgtagaaccccagcccgtatttgaagcctcagctgccccagaaatatacagcgccaataaagatcccgctccagaaacacccgtggcggaagacaaatgcaggagttctaaggccaagcccttccggtgtaagccttgccagtacgaagccgaatctgaagagcagtttgtgcatcacatccggattcacagcgctaagaagttctttgtggaggaaagtgcagagaaacaggccaaagcctgggagtcggggtcgtctccggccgaagagggcgagttctccaaaggccccatccgctgtgaccgctgtggctacaataccaaccggtatgaccactacatggcacacctgaagcaccacctgcgagctggcgagaacgagcgcatctacaagtgcatcatctgcacgtacacgacggtcagcgagtaccactggaggaaacacctgagaaaccatttccccaggaaagtctacacctgcagcaagtgcaactacttctcagacagaaaaaataactacgttcagcacgtgcgaactcacacaggtaagggagcctaagttgtagtttccaaactgtgacttcgtttaaacttggattatataaactgaacccatctaagatatgctacggtttcccaagggaattgagggcgtagaaaagaaaacttactgattaaccttgtgttgttgtgtattgaaaatggcgttagccccatctttttttttttgaaacagactctagccttgctgtcctgaaattcatggttggcctcaaattcagatccacctgcccttcctccctga

SEQ ID NO: 30188 - DNA, 1195 bp, Mus musculus
atgctgcacaacagcttgtaactgagaatgtctcccgaccccctccccagtgtgtgggtctgggggtgggtgcacactaccactcagatctaatttatactctcaaaatgggagtagttgactgattctgccagtaattgagaggaatcgttttgctcttaagttgctgagccatgggtgtgttggctcatacctgccttgtagtcctagctcttgggaggcaaagggaggagggtcaggacagggtcgttcgtgctaggcagggcacaggtgtgtattgggagtctgagacagtataaccccaagttcatagcttgttgcacactgactcaaaataaaaaacggaaaccaactggagacacataaacctgtatccagacagagacaggaagatggagtgttttggctagcctggcctacctaggagaacctgttccaaaaaccgaaataaaaccctggcagaccaaaccccaaaggctgacatgcctaaaaagtatgtgtgagggaatagttaacacagattagaatgattttgagtttgtttttacatattaagcatctgaaacactgtccttatttatgactttgcaggagaacgcccgtataaatgtgaactttgtccttactcaagctctcagaagactcatctaacgcgacacatgcggactcattcaggttggtaagatggtgactgccagcatttcagtaaattgtcacttttatttcactgtggaaaactacctttaggaagaatttcttttagaattgaagttgagttgtttttaactcactggttttggaggtttttgttttttctgttgtctggaactcacagatccacctgcccctgcctggaagtgttgggagtagaagcctgtgccactgtgccaggcaggccctgccttaaaaaagcaaaaccgtaatgggagtggggagggtaaatatgggttctcttagatcagactctagaacaaaacagatgtcaacttacttgcatgctttttctggaagggctttctttgtttttctttttgaagttgtattaatagtgtaagtattttgcttgtaagtgcaccatgtgggtgcaggtcctgtgaagggcagaagaggatggcagatccccacgaaccggagtgcagatggttaggagacactgtggatgctggaactaaacttgggtcctctacaagatctt

SEQ ID NO: 30189 - DNA, 1145 bp, Mus musculus
tggggaaggagcgagaaccagctcccgtaaggttgacctctgacttctgtcttcatgttaacgtggtgcccttttgccccaacacaaacatacataaaaacctcaaatgatgctggtgtgcagggacacagctgtaatcctgcctcttgagggctgaaaactcaggccagcctaagccatgatactgaacgatcccaggcagtgtggtgaggttagccttaaaatctaaaggaccaaaaataaatgaaggttagcctagcctctctctctccttttttaaagatttgtttgtttcatgtaagtacactgtagctgtcttcagacacaccagaagagggcatcagattccattacagatggttgtgagccaccaggtggttgctgggaattgaactaaagacctctggaagagcagtcagtgttcttaaccattgagcccctcgtgccctcctccccgcttttctggctgtgactgacatgaatctctatccagattcagaacacagcctgtagggcacatgcgctatctggccctgaagaacatgattttaccttagtctctcaaaatgaggagttagaatttaattcccaatttgccccaacatcccatcttcccctttctgtgatgttctctgagctttggatggtgtaacatagatgtctccgttagggccgaacatgtcaccatcattctctggccaatggaagtctgaactagcctttctagctgcagtaagactcttggctaactctggatatagacacaaatatgtagaaggagattggaacatgactattaggtgaaacaggagtaatgtgtgcatgcctagggcctacgacctatgacctccccaggcactggcccttggtcagatttacattacttacgttttttcaagacagagtttctctgtgtatccctggctgtcctggaacaaacttagactggaacaaacttagaccagtctggcctcgaactcagaaatccacctgcctctgcctcccaagtgctgggattaaaggcatgcaccaccactgcccggcagtaccaaattttaaaatcaactttaatttattgtgtatgtgtggctgtgtatgaagataacttgtgtatagaggctgtatagggacagctctgcctccac

SEQ ID NO: 30190 - DNA, 3051 bp, Mus musculus
ttgtttttgtttctttaacctatgcagttaatctcccttcccctgaaacagcgttgtgttaaatagtaacactatacagatatatgcatggtttttttttttgtttgtttgtttgtttgtttttcctttttggagggatgcttttaggcttgtttgcaaagggccattttccttttctttgctgcagttgtcttttttgcagaacaatagtgtgtgaaagtttataagcaatggaacatgcaggttcaatccattgttttgggttttgttttgttttatttttttattttaaatttcaccacttatctatgccagaattagtttcatataagttattttgaatggtgaggatatgtgtaattccacagctttccagtctgatttttttttttccccccagtaagtcactagatgcatattgaacaaatatttgtctcaaaaatcagccaccagtgttcttttgctgtttctagctcattacagagcgatcatcctttgaggagttgtcttcaggagatggttgatggttactccactgagtagagacctccaagtggtattggaagcagcaaacctggagtgagacataattatccttcagactggagactgtcagttgtgagaaagccactgtggtcacatggctaggctagttgaaagtgccgagttccagcaggcggctgctgctgtttccagtgagtactgaaaaggctgatgttagaactgagtatagtccggagtttaagcatcatattttctcagggatctccacaaactagcgggtgtcctcgctgtccctgtgagacagcctctgtacaggagaggccttaagtgaattgtcactgtcctggaggtcctctggagacactgagaagctgcatgtatgtactccagagcctggtttctgtgctctccagaacatgaaagcgcccagcatggacgttgcttactgggagtagtaaattaagtatgagcccagtagggagttgtgacgttttgatggaataacctcgtgtatttcatttattttcctggcgatctctgagcaggcttcagattttgacagttatgaaagatccaagcattaatgtgtgggtgaaaagcttggtgaaattctgagtgaagtcttagttaaagttggttgaacttggaattgactgggaggccaaagatttaaaaagcagattttctcaagacacagttgtgtgataatggtgtgtgcttcgtgtgtgtgcgtgagactttgtaaatgttgaattctaggctccgacaatcattgtagtgcagatcagactgcagaatatttatgttttaaatttaaattataaagctagttaagtcttctaacaactagttttaatgttcatgagcaaattttgcctacattaccttttcaagatgttgaaaaagatgcttccgcaagcccaggttggaagctgggaggtgggtggttctaggagagatctttgtggattcattcttactcaatgccttctgggattgagtaagttttaatctattctgtaagattaaaaggaaaaaaacaaaaacacaatggaaattaaaacctcattaaattagtctttaaaaacattgttacctgagattgagtgggacttttgagggctttgttccagaaaacaaggaccgggtcctcgggcctacattaggcctgaccccggagccatgtgtttgtgcctaaaatcatctcagtgggaagtatcttagtgactctagagactcccgggacagtgggggggtcttccatttgaaaactgtgatacttgcatgggattgtttgaatcttgtttcctagtctccctttccccatcactaccctcatagtctgaaggtagatttttctcttgataaaggaacacaaaaatgaacatcttacttgtaaattgatatctagtaactagtggtaaacttgaaatggtagcattctttacagcttaatcctaggtagccttagagaaatgtgtctttattatttctgaacctgcatccatcttgtctgcccaagctgtcttaagttatgtttccttttttcagagctgctttttattttggggctacttttttttttttttaattgaggcgtaaatcataaaagactacattgctttgatgagagactttttacaccgtcaggttgtctttgtctagtcttccaagaagggtcattgtgcttttttagataaatcctgacatgggctacttcagatgcaaagtaaaacccaagctctcacctcacgtgtttcactctgaatgtggccagcggaagacacgacttgcctgttagcacactgttacttgtaaacggaaatgctgaagacactcagctttctttacagaaaatcaaggtttcctgatgactgggcacatgaggtgagctgacagtcttggttcagggtgatcggattgtgtagactgacagtctgtgtactgctggctaagtgtgatagcatctgcagttctctccctcccggtagttactgaactctttaaaactggtattgtgacgttacaacaatgttttgcgccaattttataaacctttacagtgcaatatgtgttacttttctgaggcaaaccaaaggtatatttctcaaggttctgctgccatcagcagcatttgatggaggattttttttatacatttgtaataggtagagatgaaacagattgcagtttgttttttgttatttttttttttttaaattgtaaaccatgtaccaggtttctggtcaagattgtgtaggataagttaaacataattgcattctattaaccaatatgagtgtatttcttatgcatatagttacattgaaataaagttctaaaaactatcggacctttgtttattattggtgtgtcaaagaagccgatatcacctcttttgtgtaactgggagtatattccgctataccttggtctttgttttttagtgctgaggagccagcccagatcttgctcattgtaggcaagagctccatcactgagctgtgtctccagcagtgtatttaaagtttctcatagctgtcaaga

SEQ ID NO: 30191 - DNA, 1198 bp, Mus musculus
gttttgagatatatcaagaaaagctaaaaatcaggtgttgtcattttcttttctaggtatatggttcataggttgcttctagcagccctaggcagaagagaactagacgacagagatcactatggcaacaagagattggatcttgctgggcctctgcttgcattcttattcagagggtaaggattacagagtgacacagaagagaatccatgacttcctctgcgggtgggtcttcctagtgacccgagtggccgctgtggccgcttatgcacacacaggctcttgtccttatggtttcacggcaggtattttatgctgtgcgatctcctcagctccctacattagttcatcttagccttctttaagtactttatcgcagttgttctccctgctacattcgtttataggatatagatgctaaagagagtggtaatataacatcactgtgtggccttgttagtggatggtatcatctctgctgaagatgcatatttctatagacttttcatgtttatattatagtaacaccatcttatttgacagcatgtttaagaatttgctgaaagaagtacgaatctatgcgcagaagtttattgatcgcgggaaggattttaacttagagctggcaatcaagacaaggatcatatctgatgggctaaaatactctttagccactgggaactggggtgaccagaagaaagctcatcaagccagagctggagtatcccaggtgaggtgcccactgttcctgggctgcattcatgtgaaagttacagggctagcagagtttttcatttcattgaatatgagtggtttggtttggttttgcttgaccagatgtaaaaatcattaggagtttttgaataatgaaacaaagtttctcttaaattacccattagtaataagagagtcaagtttttggtttataatttagaaactcaagatagcaaacaatcttctactactactactactactgctgctgctgctgttgctgctactactactatgtgatgtgagaatgtctgaatccagagacagttcatagggaagggtaaataacaagatcttgatatatagcctaagctggccttgaactagtgttcctcttccctcaacctccagaatcttgtggttatagcttgtgcctgtaatttttttgtttcaaaagctccattttagaaactaacccagaaaa

SEQ ID NO: 30192 - DNA, 1113 bp, Mus musculus
cacagagatacatacatacacagagatacatatacacacacacagatacatatacacacacacacagatacatacacacacacacatagacacatacacacacacacagatatacacacacacagatacatacatacacacacagagatacatacacacacacagatacacacacacatacacacacacacacgcacacgtacacgcacacctggtattagagtgcagagtttctggggtttggaataaggacagtaatgaacaatattgtggtgctagagacttgctatgagttaatcactggtttgtacagagttatacatgcatttctcatgcttgttggaggagctgtgtggcgtgttaaatacttcccgttagtgtcacttaggaaagtcccctgtctttctgctccaggaatgaggcatgccatctatgaaaagttggacgatgacggtttgatagctccgggggtccgagtctccggagatgacgttattatcggcaagacagtcaccttacccgagaacgaggatgagctggagagcaccaacaggcgctacaccaagagggactgcagcactttcctcagaactagtgagacgggcatcgtggaccaggtcatggtcactctcaaccaggaaggatataaattttgtaaaataagggtgagtatagttttattcatgtagaccattttagaaattaattgcgtttcagtttctaactcatttttatgtgaaaccaggtgcgctctgttagaattccgcagattggagacaaatttgctagccgacatggtcagaagggaacttgtggtattcagtatagacaagaggtaggtgtctccagtctttctcttgcctaacccagagttgtattgaaagattaattaaaatttcctgtagcttttttttttttaattttagtgtttgttagcctattatgttgaaaagaattaggacattcaagttttcccttgggaagtgtcaggtctgtctagctttgtctctaagagattcccatgtctttatgttgtttacaattttctctgtaggacatgccgttcacttgcgaaggcataactcctgacatcatcataaacccccacgccat

SEQ ID NO: 30193 - DNA, 1303 bp, Mus musculus
gtctgtgctcacaatctagagtgtccaagagtttctaagaaaagcactatcttcaagaacaaaacaggaaaccctgataaactcaaccaataaactaactgcggtagtcacgttaaagctaccttttataaagctcataagtttccagtgtcatgattgatcagtaccttatgatcaactataaaaatatatattcaaataacatacagactttgtaggttgtacttacatatttagcagcacataaacacacacacacacacacacatgtatttaaacacaaataataaaaaatattacaccttaaattttaaaaaagaggactatatgaaaaaatcaaagaaaggaaggggataaatgatgcacttacactataatatcaaaaaaaaagaattataaaatttaatagggtttagttcagtgaagaaggggactgactgttcacatctcttattttcagttctgtggcaaaggaggatgaatgaagacttctgaggactcttcaggaagctggataacagaacaagagcaatgtgctagaatagaagaccagaaaatgaaatggtggagtttgaggctcgatagacagtttgaaaaatacaaatgatggtttgaataaagaaaggtattgcgcatgggccaccccaagtgagcgcactgcaaacacaatgattggtcattttgaatttctgctccttcattctgaatttcaaaggctcctgtgacaagtggacatgcagtgactgtaccttttgtatctttctgtttctgacgtgcctggatggaggctcaaatagaagatggtgtcagataaacattgtgttgtcaaaattttaccattaaagtgtattataacatgaaaaaataaaaatgttttttaaaaaatataatgatctataaggttaatgacattactgtagttatcatgctatggaaatgtaatctttatttaggaaatatattcatttttattttgttaatagttagaaccagaacttttattttggaaaactgaaagcaatcttgacgaaaatgaagaagtcaagaatgatctgcataccatatttccagcaattttcctaatgatacctttaaaaaacagtggggtaataaaacttaaacagactgtagatgaaaggaacaaagataaagaagaatttgaatgcacataactagcatctcctgatatttgacagaaatcccaaaatacacagtggagaaaagatgccatcttcaaacaatgacactaaaacaactgggtgttcacatgtagaataaggtcaggcccatatctattactctg

SEQ ID NO: 30194 - DNA, 1201 bp, Mus musculus
tccgagccaataacccacaggtgactcttctgcaatatgtagatgatctgctcctagctgcagaaacacgcgaggactgtgaaattgggacccaaaacctcctgggcgagttaggtaagctggggtatcgggcctctgctaaaaaggctcagttatgccagatagaagtgacctacctaggatatgtcttgagagatggacaacggtggctcacagaagccagaaaacaagctgttatgcagatcccggccccaaccactgctcgccaggtaagagagttcctggggaccgccgggttttgcagactctggattcccggatttgccacactggcagctcccttatatccactaaccaaagagaaaggggaattcacctggaccagagaacatcagctagcctttgaaactctcaaaaaggcactgctgcaggctccggcattggccctgccagatttaaacaaacctttcaccctatacattgatgaaagaaatggagtggcaaggggagtccttacccaggttttgggaccatggaagcgcccggtagcctacttatcaaagaaactggacgctgtggccagtggatggccctcctgcctgagcgatagcagccacggctgtgctagtaaaagatgctgacaaactgactatgggccagaatgttactatagtggccccacactctcttgagagcatcatcaggcaaccaccggaccgctggatgaccaacgcccgaatgacgcactaccagagcctattgctgacagagcgagtaagttttgcacccccagccattctcaaccccgcctccttactacctgaggctgacgaggcccctgcacataagtgtgaagaaatactggcagaagagactggaatccggccagacctcacagaccaaccttggccaggggcgatgacttggttcacggacggaagcagctttgtggtagaaggtaagcggaaggctggggcggcagtagtggatggaaaggctgtcatatgggccagcagtctgccggagggtacatcagctcaaaaagcggaactaatcgcattaattcaagccttaaggctggcagaaggaagggctcttaatgtctataccgacagccggtacgcttttgccacggctcatgtacacggagcaatataccgacaccgtggactgctgacgtctgccggcaaagatatcaaaa

SEQ ID NO: 30195 - DNA, 1175 bp, Mus musculus
cccttaagaaaaaggttcctgctgggcaaaaatctctcaagaaaaaggttcccgctgtgccagaaaccctcaagaaaaagcgaaggaatttcacagagttgaaggtgaagcgcctgaggaagaagtttgccctgaagacacttcgaaaggcaaggaggaagctcatctatgagaaggcacagcactatcacaaggagtacaggcagatgtactgcactgagattcggatggccaggatggcaagggaagctgggcacttctatgtgcccgcagaaccaaagctggcctttgtcatcagaatccgaggcatcaatggagtgagcccaaaggttcgtaaggttctgcagctcctttgtcttcgacagatcttcaatggcacctttgttaagctcaacaaggcttcaattaacatgctgcggattgtggaaccatacattgcatgggggtaccccaacctgaagtcagtaaacgagctcatctacaagcgcggctacggcaaaatcaacaagaagcagattgccttgacagataattccttgattgctcggtctcttggtaagtttggcatcatctgcatggaggatctaattcatgagatctatacagtcgggaaacgcttcaaggaagcaaataacttcctgtggcccttcaagttatcttccccacgaggtgggatgaagaaaaagacaactcactttgtagaaggtggaggtgctggcaacagggaagaccagataaacaggcttattagacggatgaactaaggtgtcacccattgtatttttgtaatctggtcagttaataaacagtcacagcttggcaaattgaaaaaaaaaaaagaaattacatagaatctacatccgtgcaatctcaaaactattgctgcctaaacaagacttgactatgacaatagcagtagacatactattgtgcaatatagaaatatcacatagtccttcttttagacaaaagtctttgagaactaatgcctgctgagagaggaagaaatttgtctttctcaagatggagaaccctaattagttatccaatacaaaccagtgaatccttatatcatatacctataggcaaatctaaagtctctcagtaggatacatttatatatttatgcaggatgtatttatatatttgtgcatatgtaatttttatattagatg

SEQ ID NO: 30196 - DNA, 1195 bp, Mus musculus
ggctatggaggaacagtaataacacaggcgtgcagctgttctttgatgctaaacactgccaaggcatctgtacatcacttctcagggcaagtctaagacctgggagagtgtattgcaatgtacaacagattccacgttgttctcaaggttgtttaatagcttaactttggccagctttctgaattccaccatcagcaagagggcctttctcggggtctttgttttccatttctccagtttcgtctgttcttgttttctgttctaaagtcggatatttgtcatccaccatcttggcctgcttcaagagcttcttctcattccctttctgacatggtgtcttctactccttctccagaccctgatccttgacacagggactatttttagtatcagttttccgggggtgggacctcacaactagtttatggtacagctgggtagcttgactccagagtgtacactgttactcatgatgctattctgttgctaataacacaatgatatgaataaacaagtgaacagatgcccagtggctttttgtattttccatatcatgatttatacttttaaatatcacatatcagattctccatgtccctcttccccccctccttcttcccttggaagtctctttttcttggactttttattattaatttgggctgcaaaaccacacacacacacacacacacacacacacacaacttcatttcaaatatttttgctggcttgcaaacccaaggacaaggccgatgggatgcttgctagttttctgtcttgcttgcatgttagaaggtgtggtggaatgaaggctttcttttggtcttgtttcgtaaggaaactaatccctttcatgcagtcttctccctgttaatcactacttacacccccacctcctggcaccatcactttgggtgatttcagcacatgaattttgaaggaacacagccatcacaacctcagcagacacctaagtgtattcttagtttggctgccggatgatttaacagtagggtccagtaaaagttttcaacaccaagaatgcctattataaaaatctaatatgaaaggctatttaggagaaagagaatatgctatattatttggctacaaagcataaagaaaactgaatgattctcaagtctctccacatctttctagcactttaaatttcttacaattatacaaaaacaga

SEQ ID NO: 30197 - DNA, 2166 bp, Mus musculus
atttaaaactgtagttacagttagtgtcctgctacctgtgctaacagtgtgatatattactcccttccctaagtcaggattgtccctgatctgatcagtgttgtaaacagtgaggtaacatgacatgttaacttggactaaatgttaacagtattacatgcactctgatagagaatccataaatgtgagcagataaatatggttaatcatttgattgttaatatacctttattttatttatctggaagtctaaactagtcatagtatttaagaccaaaaattttttataaagggaatattcttagaaatagatgaaagttacaaattaatttggttgtctttttttccctttccagcaatgtaatggagaaaaaaaaaaaatatatatatatagtatttttttttaaaggaggcatgttatttcactcttcattcccaaattggggattgactgaaatagaaaaaattatatttttttagatttttctttactgaaagaaatactccattgcctgatgtgaacagttgctacttatgatataattgggtccattaaaatatataaacaatacttgactgtaaaatcactgaaaacagccagtaagtcttttttacaagggttatcacgcattctaaacaagtgcttacagcctctggaagttacttgcctggagttcctattcttaagaccattactaaatactttgatgaattaaaatttagattgcatcagtattaactccaatggtatctctttatactctatactttctttccatttacaaacaatttatgatctctgtggtaaccagctttttgtttcctccttttacgaagtgtccagttgggaaatggggtgagtttgtacaataaaatgatctgttcattcagaggtggagaaaagtggacagggtttgttttaaagaactggctacctttaaaataaactatagtttttatcatatcctacctttcccattgttcataaattgaatccatgaatatcaaaggctctgtggcttagaacttaatgacaaaaagaagtcctattttccagttttcactttgttttctcttctttggtagtaacgtattctgtaggtaatcattcaggaatcctcaaacatgaagcaatagcttggctctgtttacttaagtctacacgtatctttgaaagtaaatgagagccatgctttgtagagtgctttagtaaataaaatcaaccaggtttggtttgtttctaattaaatccacaaccattttgtcattgggttttgtttttgtttttctgtaggtagtgattattactgtcctactaaattatactgaactggaaagccataatgaagttaatgactttttttttttgttcattttgtactttaagattcttggtactaaaatatagctattgaatactgagtgcaaaaaaaaaaaaaaaagaaggaaagttgtgttattccatttggtttgttttctgtttgtatgtttgttttaatactaaaagtaagagaaattttaggtgtcattctcaaccatgccccgtggttcatcgcagagaatttaattatacctctttttctgtgtttaatgctgctactgtctcctcacttttatgctttgcaagcagactagtaagggccttgtaaaccaaagagggagtgtgtttttagcaagtgtaaagccctcactgtaatatacaggtgcaaaaataaataagaaaaaagggcagaaatagtcactccaacagaaacttagtttgaggtttctaaagtcagttctttataggatttggagcaattgtgttatgtgtcttattccttatatactgttcaagaagtagaaattggaatcactatattttgcttttacagtttgtcttccatggcacattgttggggagagcatcaacatacaaaaaaaaaaaaaaaaaaaaaaaactatagctggagttgtaactctgtagtacacaagatacatgcacaaggctctgggtttgagttccaactcattaaaaaaaactcaaagtttagattttaggagtcagatgaaatatcaacaggcaatttatgtttgcttttctcttactgtatcttgaaatggtatgtgtgtgtatgatttgttttgcctgcatttaaatgtgccacatgtatgcagtgtgtgtat

SEQ ID NO: 30198 - DNA, 1132 bp, Mus musculus
tactactaaattttatctaagagaataaaataattacattttttgtggtatttacccaagctacttacttgtgttaaaacttcatgttgtaccaaccaagtttgtatatttttgtaactttttttatgttttaactaaagtatatgaaaagaaaagaaagaaagaaaaacatctttgaagttctttttaaaatacattgatggggttggggacttagctcagtggtagagtgcttgcccctgggttcagtcctcagctctggtagaaaaaaaaaaagacaaaataaaatacattgaatgttccttagaatttaaaaatataatagtaaattactaaaatgaaaattatgaaaaaataaaaaaataaactttactaaaaatatacaggtcagttaaataagaaatgtatgttgttgcaatcatacatttacatactatttacagagaaatgcttgaaccttggaaaacagcaagaccaattacgttcccaagtagtttagactcttcagataatcagatcacctctcttatctaggttgctttggagatgatcaaggtagctggtggctatcccttcgacgcttacaaaaactgtttccttaatttagccattccaataatagtgtttacagagacatctgaagtaagaaaaactgaaatcaggtatgtatgaaagtttgttttgctgaaataacaagaaagaaagaaagtattctgcctttaaaaaggaaacatactgggtttcatctctatttcttcttgtctttgctaatccttcctactatttcaggacccagccaaacctcatgttgataaattatctccaagtagactagccaaagaattctcagagcagttgatttgccacaccacttagcattatacttggttcctaacttagataattttaaaaccattcttgtctggttatagtcctgtctaactgtgaaacttacaatgtaatcctatacatttattacaacagaaaacaattccttgaggttttgtttttgacatttcaggttgaacacagccagaaatgccagtagaagaatcttatcaggaagagctaatccatattatgctcatacattacttacaagaacagaaaatactgttatccattcaaagta

SEQ ID NO: 30199 - DNA, 1123 bp, Mus musculus
attagaggagggagagcatatatgctatttcccataaatctgttctgtagaagtatgtttaggatcatttcagacattgtaggaaaccatttcctaatcctaagtcaagcttcacttaacatttgttggtgtgaaactcaaatcaattcaaacagcaactttcttttaattgaatattttatttacatttcccctccacaacccccctattccatcccctcccctccttcctgcttctatgagggtgctcctccacccacccagccattcccacctcactgccctgggttccttccccttcactggggcattgagccttctcaggaccaaggacctctcctcccattgatggcagacaaggccatcctctgctacatatacagctggagccatgggtccctccatgtgtactctttggttgttgtactggctagttttgtgtcagcttgacacaggcttgagttatcacagagaaaggagcttcagttggggaagcgcctccataaggcattttctcaattagtgatcaagggggaaaggccctttgtgggtgggaccatctctgggctggcagtcttgggttctataagaaagcaagctgagcaagccaggggaatcaagccagtaagtaacatccctccatggcctctgcatcagctcctgcttcctgacctgcttgagttccagtcctgacttctttcagtgatgcacagcaatctggaaatgtaagctcaataaaccctttcctccccaacttgcttcttggtcatgatgtttgtgcaggaatagaaaccctgactaagacacttggtggtttagtctgggggagttctggtcagacagcaacttttaaaatcaaatattataatacaatctaacgatatttttgatgttcacatgcagaggaatgaatgcatgaaaaatcgccattttccacaagaaaataagtatctttatataagaacataaaacatttgagtgtacactgagaaacctcagttcatttgtgttgcaggatgatgggctcagtgtagagtatatatgttgtatgtttagaactaaggtctcacggggtggaacatagtgctgtgagaaacatttcagattcattttgattttgagt

SEQ ID NO: 30200 - DNA, 1153 bp, Mus musculus
aaataaacttgatatcattttggagagtgatggtaaacacttggcttgttatccaagtgtaaaagttttcagttagtgtgttgtttgttgagattaaagaaggggtatgtttaaattacagtcatggacacacctgtaaaactctagagtttggttctggttagcattataactctagtattttataacagtggttttacagaagtatgttttttttctagggaaggcaattgtgttccatttagacaaatactttccctagtaacagagccagtcagacatttttgtatattagtttgctggaccctctctaaaggaaactagggggtggagtagatacttgttttgttacttgattcttagaatatacatatactcatttttgcagctttttgcaaatttttgtcctttggagtcttcatggtttaaaacttagctgtagctgtaagctctcaaggtgaaacattgtttaaaggccattctgctgcagtgtcctcaagcaagttcacatgtaacactcaagttagttctctgtccttaagacaggatgcatgtgaaaatctctgtagtagttgaatgataacatcctttaagtatattcctgggaagagttgaaacaagggtaaggaaggtttaattataatgccctagtaaaaatataaagtttgatttattaaaatgcttgatgtttgaacagggtatgtaaaggatccccgataccaggaagtggacaggtaagttgggctcactcttgcttagctttgaattacattcttggaactagtttatgaattacctgaatttagttttacaaatcttattcccaacagacgattttcaggagttcgccgagatgtgtttttaaatggggtaagcattaaattttacataattaaagatagggtctgattgttttttgtttttgtctttttttaatttccccaattttaacattgttgacaatgtcatcttctattttagtcctacaatgattatgtgagggaatttcataacatgggaccaccgcctccttggcaaggaatggtttgtattgctctgttttttttatctgttttgtattattctaacttcattttgcagtgtctagtatttaaatacttactcagaatgtgatacctgtccactaagagac

SEQ ID NO: 30201 - DNA, 1213 bp, Mus musculus
aatttcttacagctcacaagtacattttcttatagttcaccagatttctgaatttttttttaaatttcttaaattactattaacaataatttgtaagaaacttttgagcctaagatttcctagtttcacagtttgcagttttgttttgtaaaatagcaggacatgaaagggtgtgttgcacaaaggatggtatttagtgtatttgctagtatataggttgtagggatggagtgagtgaacaaggatagttatgactgagttgtttattatatcttactaaggaatcaaatggaaagtctctacaagtggaataggaaattacaggaatacatggtgctctagttagtgctggtagtgtatatcaccattaagttccatccatgacttcatggttgcgttttctgatttcttctttaccagacaactgataaaagggtttttaactttcatataaagttttgctttgctgatctgttttctcctttttcctagcatgactatgatatgagggtcgatgatttccttcgccgcacgcaagctgtggtcagtggtcggagaagtagacctcgagaaagagatcgggagcgagagcgagaccgccccagagataacagaagagatagagagcgagacagaggtcgtgatcgagaaagagagagagaaagaatatgtgatcgggacagagaccgaggggagagaggtcgttatcgaagataatgtgcttttggaagcactgactgaagataaagaaaatattgtattttttttgtgtgtgtttacaagtagtaaatttattttcagctgtcgacttaaagctcattgtgtagaaggatttattatcacctttgttccaagcatgcagtagaataagaactggaaaactcagatccgccaaaaaaatgcacagttgacagttgggttgactcttttattggggcagaatggaacagtccaagaatgtagatattgattcattctccataaatgttctttttacagtgtattcatcctagagttattttgtttgtttgttctccttttggaccttggtcaataactgccatagaatttcgctttgtgtttctataggtagctgctcacggttcagtaaaaatactgctgctatcaagtatgcaaatatggaagtatgatggtttgactatatggcagtgttgtagcagcctctcggtttttcctctttcctccttttttt

SEQ ID NO: 30202 - DNA, 1554 bp, Mus musculus
aaccatcgaaaagtttgagaaggaggctgctgagatgggaaagggctccttcaagtacgcctgggtgttagacaaactgaaagctgagcatgagtgtggtatcactattgacatctccctgtggaaattcgagaccagcaaatactatgtgaccatcattgatgccccaggacacagagtcttcttcaaaaacatgattacaggcacatcccaggctgaccttgctgtcctgattgttgctgctggtgttggtgaatttgaagctggtatctccaagaacgggcagacccgcgagcatgctcttctggcttacaccctgggtgtgaaacagctgattgttggtgtcaacaaaatggattccaccgagccaccatacagtcagaaaagctacaaggaaatcgttaaggaagtcagcacctacattaagaaaattggctacaaccctgacacagtaccatttgtgccaatttctggttggaattgtgacaacatgctggagctaagcgctaatatgccttgattcaaaggatggaaagtcacccgcaaagatggcagtgccagtggcaccatgctgctggaaactttggattgtatcctaccaccaactcgtccaactgacaagcctctgcgactgcccctccaggatgtctataaaatgggaggcattggcactgtccccgtgggccaagtggagactggtgttctcaaacctgggatggtggttacctttgctccagtcaatgtaacaactgaagtcaagtctgttgaaatgcaccatgaagctttgagtgaagcttttcctggggacaatgtgggcttcaatgtaaagaacgtgtaggtcaaagatgttagacgaggcaatgttgctggtgacagcaaaaacgacccaccaatggaagcagctggcttcactgctcaggtgattatcctgaaccatccaggccaaatcagtgctggctatgctcttgttctggattgtcacacagcccacatagtatgcaagtgtgctgagcttaaagaaaagatcgatcgtcgttctagtaagaagctggaagatggccccaaattcctgaagtctggtgatgctgccattgttgatatggttcctggcaagcccatgtgtgttgagagcttatctgacgatccttctaagcttatggcctaggcatttatttgtaagtaattcagtatccaagtaattatttgtgaactgtggcatggatggaaaattctatggtgaactatgttcaggatatgtatatcctttcctccccaaatagctttgtttctgtttgatcaaagctcaagaaatacaatttgttgttttttataaaatctcaagtggtcatttttaccattaaagacttagaagccaaaagcctgagcctgtcttcctcctctcttcctctctcttttttccccctacgttcactccctgtaactagttgcttgctctgcctcttgacctatggtttgactatatttaatcttgtttaaaataaatgaaaagctcttggattaaatttgtttgttaggattgcgtggcaccacaac

SEQ ID NO: 30203 - DNA, 2013 bp, Mus musculus
tgactaacttccactctggcaaacggagaacacgaaaccgtgagctgggcaactatctagcgtggcccagtgggcgccctgccgacgcgtgggaacgtagatgccccgcgccctctgtcggccgcgggctgtctcgcggcgtccctggcgggattccggcttcacgccggaagtcaccagagagagagagagctcggaagtagccacaaaaggatccgcggaacggaaatatccttggcctagcgttcctacccggaagttttcattcgccggaaccgactggtttttaaaaagacacggcggcgggattacgctgggggggggggggggagcggaagtttaggcgcgcgcgctgcgcggagagcaccctgggagcggaaggaaacaggcctttcccagactctctgctccggtggtcaccgacttgggttcgcggagcgtgctggtgctgaaagcctccgcttgccggcatcattctgggcggaggtcagaagtggcggaaatcgcggcgtcgcttgggaacccgggaccgctggtgagccatggtgaagaaatcacggcggcgtggagcggctcagtgggccgccgtgcgggcccaggcaggtctcaccgccacggacgaaaatgaggacgacttggggttgccgccctctccaggggactccagctactaccaagaccaggtagatgagttccatgaagcgcgatctcgggcagtcctggccaagggctggaacgaagtcgagagtggggaggaggatggcgatgaggaggaagaggtgctacctctagatattgatgatggagatgacgaagatggagagagttcggaggaggaggaggttggagaggatgatgacggcggaagctccgtgcagagtgaggctgaggcctctgtggaccctagcttgtcctggggtcagagaaaaaagctttattacgatacggactatggttccaaatcccgaggccgtcagagtcagcaagaagtagaagaggaggaaagagaagaagaggaggaggcacagataattcagcggcgcttggcccaagccctgcaagaggatgattttggagtcgcttgggtggaggcctttgcaaagccggtgccccaggtagacgaagctgagacaagggttgtgaaggatttggctaaagtctcggtaaaagagaagctgaaaatgttgaagaaagaatcaccagagctcttagagctcatagaagacctccaagccaagttgacagaggtgaaggatgagttagaacccttgttacagttggtggagaaaggggtcattccaactggaagaggaagcgaatacctgaagactaagtataatctctacttgaactattgcgccaacattagcttttatttgatcttaaaagcccggagagtccctgcacatggacatcctgttatagaaaggcttgttacctacagaaatctgatcaacaagctgtcggttgtggatcagaaactgtcctctgaaatccgtcacctcctcacagccaaggatggtgctgtaaagaaagaaatgactccaaaagcaaaattaaccaaaaccaagcccaagtctgtaaagcaggctgctgctgttgccctgactgatgagcctgattttgatggggctgctctcaagtactataaggaaatggaagacaggcaagagttgaagagaaagaaggaagaaaacagtgctgaagaacaggctctcgaagaacaaaatgcaaagagagccattacctaccagattgctaaaaataggggacttacacccaggagaaagaagattgatagaaatcccagagtgaaacatagggaaaagttcagaaaagccaaaatccgacgacgaggccaggttcgtgaagttcgcagagaagaacagcggtacagtggtgaactctctggcattcgtgctggagttaagaagagcattaagcttaagtaaagttgctctttggcctagcttttggcaattattttaggtcaataaaaagtgttttgaagta

SEQ ID NO: 30204 - DNA, 1530 bp, Mus musculus
ctgtgtttacacacagaaagattcggtttgggattatgaaataagctacaaatttaaaattctgttcaaacagtccaggttgagattgagaaagtctggtctgtgtgacttagttttccgtcctgaggctctgctacagactaagatgatgtttccacccagtgccgctcctcagatccttgctcccgcctgttgttgcctgtgattgagagctctgatacaaactcatggaacacattcacggtgtatttttaccaaacactcaccaaagcaacagaaggtttcagaactttaataagccagtctgatttggtcaaatagcttttcattttatctgtatttgattacttagggatagaagttttaaaaaatagcaaaccacaggttagtgaatgtaagtggccactcagcagttaacgtctttagaaacttggcctccctaagccttgacctgaaggcatttgacattggtgcctgtctgtcagtgtcatggaagtctaggcaaccttcacttttttttcttggacagacaaatcttaaggctattaggtttgaaatcgtaatgtgacatatcaaagcagtccagactggtaaggacattaatagcttcacttgaattgaaccagctctagatagggaaaacaatctaagtcccctcgtttgcttttccagtggggtagccatcccatacttagaacaggtaggggtgccttgcttaaatcaaactagcatttcatgtataattgtgtgaaagatctgtggataaagctgtatttctgtcacattgtggcagcacctctgctttaatactaaatagcttgttatttaaatattggacaaaatggctggcttcaaaaatagtcattaataaacttaactttatgtatacctgtgtagaagaatcaaagttctgtatattttctttaccttgttcctattctcagggtgacagctaccaccaagagatgataaatctcacgcttcagactgaattttctgagctttcacaggtggtaacctggaagagacgtgcattgcttagtacatagccacatgtgattaccagctaaggggcaaaattactgttctgtagacaataaatgaaagtttgttttaagttggagattacctaacagtatttgttactagaatgtaggagtcatcttattttttatttatcaagtcctgatatattaatatgagaagagatggtttcgaggtgtgttaaaaaaaaatcagtaaaaaagtgtcttagagggctggtgagatggctcagcggttaagagcaccgactgctcttccaaaggtcctgagttcaaatcccagcaaccacatggtggctcacaaccatccataacgaaatctgatgccctattctggagtctctgaagacagctacagtgcacttacattaaataaataaataaattaattaattaaaaaaaaaaagtgtcttagagttggatgtggtagcaggtaagcttttaatccccacacaacagaggcagaattgggcaaatcccagtaact

SEQ ID NO: 30205 - DNA, 1214 bp, Mus musculus
agaataaaagtattgcttaagtctatcttaaagttttgagaattaaatagcttatgcctggatcacagtatatattcaatgagtgttacttgttaaattcttgacagaaattcacaaatattaaaactctcgtggtggcacatacctttaatcccagcactcgggaggcagaggcaggcggatttctgagttcgaggccagcctggtctacagagtgagttccaggacagccaggactacacagagaaaccctgacttgtaaaacaaacaaaaaaaaaagattaaaactatgatgtttggccgggtagtagtggcgcacacctttaatcccagcactcgggaggcagaggcaggtgaatctctgagttcgaggccaccctggtctacaaagtgagttccaggacagccagggctatacagagaaaccctgtctcgaaaaaccaaaaaaaaaaaaaaccaaaaaccaaaaaacaaaaaaaaacctatgatgtttgaattcaagtagcagtgtatttatctttgtgtgtgtgtgtgtgtgtgtgtgtgtgtgtgtgctttcctttgtagtgtatgaaataaacaacgaagatgtggatgccttaatgaagagcctgcaggtcaagccttcgcctgtgctcagtgatggtgtggtccgcctgagaggacttccttacagctgcaatgaaaaggacattgtggacttctttgcaggtaggtgacagtgacgtcgtgtttggacgtttcttcctatcatcattcttccttttgtgcctttgaagtgtttcagtctttgaggcagatccttcggaatgtcagctttcagatatttgttaaactgtgaagaaactgtttctccaagacagtaatcagtcgtgtttggacttttcttcctatcatcattcttccttttgtgcctttgaagtgtttcagtctttgaggcagatccttcggaatgtcagctttcagatatttgttaaactgtgaagaaactgtttctccaagacagtaatcatttacatgacttaaaaccgtctgggctggggatgtagctcagttggtggaatgcttgtttatcattcacaaagccctgtattagatcccagtaccacataaactgtgtggcagttcacacctataatcccagcaccgggggtggggtaggggatatgaggttaaagatttttcaacacatacggcttttatgcggatactgg

SEQ ID NO: 30206 - DNA, 1202 bp, Mus musculus
attttatataatatatgataaatattatatacatatctcacatatactataaaatcagtgcttccgttcaaaacaaagttggccttctgcacgaattttgaggttggggtatcaacgccccctcagcgtcgtcccaaaacgttttagagctaggtaacccattccttccggaaacttcgccgggcctcggtgacccgcagacctcagctctaacctgagcaggagagcctgggacaacttccactctggaggcgctcaggtcaccccacccacacccttaccggcgggaaagccccgccccgagggcggagcctgggcggggccgctcgctcacctccgcctccgagcctcgtctcagccccgggtgcgcgcggcgcatgtgcccggtgccccctcccccgccctggattccacttcccctccgctcgcgccacagcggccacctccaggccccgcgccgcctccggagccgatggccgggacgcgctgggtgctaggcgcgttgctccggggctgcggctgcaactgcagcagctgccggcggaccggcgccgcctgcctgcctttctactccgccgccggcaccttcccgtcgggcgtctctggccgccgccgcctgctgctactcctcggggccgccgcggccgccgcttcgcagacgcggggcctgcagctcgggcctgcggccgccgggaggctggcgggtcccatccctgcccgtccctccgccgccgcggccgccgccgcgtcctactcggccctgcgcgccccgctgtttccgcgatcgctggcagccgccgcgggcccggcgcggggttacagtcaggtacgtggcgccgcgcgcgggaccctcggcggccgcgcgcccgcgtcggtctgtccgcgagcgccccgcgtgcgcgcccggggatccgcggcacgcaccgcacccccgcctccctcccgctccgtcctcctattgggcacgggaacaagggacgctctcacggccccggctcttcttgttttgttccctccgagtctgggcggttgggcagtgtaagtgtggctggggtgaatgtagaggccttgtttcccgccgggcccatggtaggttttgggggcgccgccgacgccccccaccccgactcccccctagccttatgcccgctggaggtgaagctgagcggccagagcccgcggagggtcggggccggccgtgc

SEQ ID NO: 30207 - DNA, 1099 bp, Mus musculus
atgcaaataatgttttgctatttttaggagttcaaccttattgacagacgagagttggcaccactgcaagagctgattgaaaaactcacctcaaaggacagataaaaggatgcaagctgtgcaaactcttcttcagatggagctgtgtacagtgtccttggctttgttatagttcatctttatctacattgtttctgttttaggttttggggcttgcttgggttcccttttctcttctgaatatataaaatcatattctcttgctagaggaagccgagaccgttctctacatttgaaaagggcaaattttgtcatagtggtatacagtatttttttttttctattttatttttatcaatctggttttggttacttgaggaatttttatgatattgatgctggaaacaaatgcgacaaatgcgaactgactgaagtgctgatggactgggtactttgctgtgtaaactgtggtccactttgaagtccttaaaaaagacttatatatatgtttttaagtgccttgataggctcacttctgaggtgcaaagcacagatataggactgaacaaagcttgaaacaatattagaatttctatctagggcacttacttgtgcatgttatgaagttatctgttataaaagccatagtttactcaaattgttgatctccagcttttactatgttgaaaaaaacccataatttgtaaagttgtgcatgtagaacacaaatataaaacaacaaattatttcttaattatttttgacataatttgtaaaggtgtgcatgtagaacataaatgtaaaactacaaaattcttaattatttttgatattgactaatataatctgttcaacagccgtttaaagttctacaagcaggtctttttccatctcttaatatctgtgatattgaaatttaaggatgttgaaatgtaatagatactgcatttcagcttctttctacatgtaagtgcactgtaagtgtaaaacttcaggttatatatagaattgccatcttcagaaaggatgttgaactgtgaggtttcctagcaattgccaaatgagccgtaagtgcagaatccctttgtacttcaaagag

SEQ ID NO: 30208 - DNA, 1319 bp, Mus musculus
tttaataaaaatttggtttgagagtaaaatcccccttggccccccccccccttttttttttttgagacaaggtctttttgtagctctggctgttctggaactcacactgtagatgaggctggccttgaactcacagagatcggcttgcctctgcctcccaagtgctgggattacaggcatgcaaaatgctgttttataaagtaaggatcaaaacttgattttataggagagcttgcttataaatgtctcttaggttcttttcagaactgttaatttataaataagaaaattatccccttttatttctttccttattttttgagactgggtcttactatgtagccctggcttatagagcaggtctcaaactgtaagagatctgcttgcccctctaccccaaatgctgggattaatggtatgccccaccatacctggctaccccattttttatacagttataaaagtacaagctggttttccttatttcataagctcatcccatacaatcgaatgtagtaagttatcattatagttgttattcacattgctttggttaaatgtggacatgatgaagcaagatttaggaattacttcgttgtcagagtggtggtggtgaagagaaactgagtggagtgtttgccattagcagtaggtcgtacagctggccttgttcatttgctgaccttttcttccatgtgccatagaagccatgctattagactgccccagacagaaagcatgtgtgtggtggtggctgtgaagctctgtctaccttaaaatgaaagatttttaaattgtcgcctctttttaactctgttttgcttgtcattgtaaactctaaatggtcaacataaagttcgcagagtatattttaacatgtatttcagaggtactacctggattatcaggatagatgaagcactacaatctcttatcggaaaatggaaatatggatatttatattttgcatatttcatcactagtttccattttatgtaatgggtattttccttgcttatggggaaagaagcaaaacaacagatttcttttatagctttgtctacatcctctctgagagagaatttgataaccactaaaatggtagattatgtaagatgcaaatactaagttgtctgtcacattgccttttaagatgagcatgatatatcttaacacccaaatgagagttgaccttcaaagcagttctctttggaacattgtttatttcagctccgttacaaagtatgtttctggaactttgtcctatgtcataggtgctttgagggttgacttacgaccgtgtaagaagaatcagtttc

SEQ ID NO: 30209 - DNA, 1227 bp, Mus musculus
cagacaaccaggaagcgaaatcactggcctttaagatttgtgttttcccactcatgtctgtgtcatgtgcacatacatacctgctcacaggcactcaaggctgagtttacagttcaccattgttagagattcatacaggtttttgtttgtttgtttgacagtttctttgtcaccagagctgcagttattagtgacataatgtgacaatttcttaatttctccttcataattattcctttatggaatttcttctacttttgcacaaatttgagttttagttttgattttgaaataattgtataagttgtaaaataggttagtgtattttcgtttaagaacactctcctccttaaattgtcctgcagaaatgactatattttagggaaaatagttttttacagctattaaactgtatttgttatttttgtatatgcataaccagggtggtgagatcactaatattttaggaaatacctttgttatatttgatttttttctatacatttaagttattacttaaaattattggtagaaataatgttgtgaagacagcatataaggaatacttaacgtcagaatagaaatcatttctgaagatagaaatcagaaatgctgcaggtgccaggtaatgggagcagcagggcagcattctcactgtgcaactgcttaagacatgcacggagacaagagtccgcagtcacgggggacaggttctctagtaagatagttagatgggcaaaaatatctaaaatatgaaatgcaacgtaggcgccatattgtaagttgtgccaagattatgcaaattagttattgatcaaagttgtttcactgttgttattttaaaggaaacactgaatgtcagaaaatctgtaatatgttttatttgatagatgtaaataatgtatacagtcttatgtggcagaatgggaggtatttacattttaggttttttttctttagaagaaaatgtttataaggaaaaaaaccctaataaatacttttgtttggccatgaatcctgccttcgcattagtttatttttactgtaggtagttttacaatgaaaacatttcaaagaaaagtaaaggtatttagaacaaattgatcatttcaaaatttgttaggcagcactttcagtaattcttacaacactggtagttaccatctatgtaccacacatactaaaattcagaaattgtagaagtcattggctctcagacttgaaggt

SEQ ID NO: 30210 - DNA, 1198 bp, Mus musculus
ttctcacttgtcatcctgagtgggttaacatgttttcattgtgtctttgcttcagaggttgaccaatttcgtcccgggacacttgaccattccgtgtagaggatgtgtgtcttctgtgagttggtatacttaggacaggctgagaagtggggagtccctgggagagggatgctgaagtgtttgcttggtttccttcctggtccctttggtagtgttggagattgaagccagggtctctcgagctggggaacctctacagaactgtccccagcccttttgttctaatcaagtgcctctcctgctctacttagtgttgataagaccatgttagcgtcaccacagtaatgtttactactgtgtccgtgctgtgtttgtagaggaggaggctaaactcttcccagtttggtaatggtataattacttcataaatcttttcatctttaatctgtctgggataagaactctgtatttatgtgaaattttggaccagaagaaatctttaagaggtagctaagaagtttattacatgagtataaagcttcattaagatagctactgcttttctcggactactgcagttaaaatgcttgtttatgtttctttttttaagacagggtctctctacatacccctagctgtcctggaactcaccatgtaggccattctggcctggccttgaactcacagagatccacccacctctgcctccctccccactcccactgctcagataaggtgtgcagcatcacgcctgactcggaggtttttgaaatcacttgaagtgcaagtacagatttttccatttttcttttagtttcctaactaaatttcttttagttttcatgtaaaatgaggatagaacatgccaaggttttccatttttccccatgggccctgagttgataatgagtggtctctctttagctttgtatgaggtgagacactgagaagcctaggcgggctgttcagccccgcccagccccgcctccatcacctggcagacactctcccttttctgtctgaagttagaaggcagtctgctgacttgggatttaagtcacatttctgctgagagtgctgtggtcacactgtgcttcatagtttgcttgctttgtagaatgtttcttaacgtttttgtagttaaatacaaattcctgataaaacattttttcattgcatatattgtatcatgggaatg

SEQ ID NO: 30211 - DNA, 1144 bp, Mus musculus
attgttgagtgtttaccagttgcaaacttgtgtcttagtaagtattcctccatttccttaagatatttgtctcaggatagtacatatcatcaagtatgaagaaagggttttatcttgacattttaggttttgcaaacattggtttagtggcattgtcatgaacctaaagaaaatggtttaatggtggtggggtgtctttcaagactgtctatagagttaatacattatatacattttcttcatatctaatgatattttaggtttaagtcacaaacaacttcaaaaacaccacgtaggggctgagagatgaataacgatcataaaaaaaaaagctaagactttatggacacttaccatgtatcaggccgttttctgagcactttacattacatatcaactctctatcctttcataatcaccatagaagagaagcatgaaaagtcagtgaaataaaacctagaaacaggaaagtacattgcccagaaagtattcagcagggcaagtcaagcacttggctgtagaaatataccaggcagatgcggaagcgagatgataaaccgtcctgttagaactgtgggttaggatgagcaagaagtaaatcccataactcctaaaatgaggaaaggaggaaaaagaaagcttttattaaagagatgcttcagttttgaaggtgtttggagaaagacagcagtcatgacctgtgcacagtatgtggctccttcctgaagctgctgggaaggtagggtaaggtatctagggtgttgagagcctttgcgtggttcttcacttcattggcacagagggtggtcaggaggaaagcatcctggacagttgctgaaatactatggtggcaatgggggaagagatacgggatgctgtgatttccagcgtattcagtgattcagagagatagaatgaggacaggcttgtatttcagtagaagggaagttatggaagcctgagactaaccattgtatactcccactgaatgctgaaagcccgaaagcagaacaggaactcaagttggtcactgatacaaaacaacgcgctgatcttggactatccttagggaaactattgaaacttacattaaaatgtctgtatatgtatcacatgttgtgtgttaatgtgtgtgcaccttatg

SEQ ID NO: 30212 - DNA, 1120 bp, Mus musculus
ttgtattatcctgctagatgttacttccatggcatttgttcatcttgaaactttagattttagagtatttaggcatgaacgaccccaagggttttttgttgttgttattgaagtcatagcagcaaattacatgtcatttgttaccatctcaaatgatacatttttacattgcatttgttctgagggttatcctgaaaatggttgttgtgcattttctggttttctattaaaccgtgtaaggaatcttacctttttagggataaacacatcagtaaaatgttaaaagcatgcattgtaaatgcagtccaatcttgatgttgaatcaaagacacttggtttacttttataaaatctctggatatatataatatatataaataatttttaattatgaatcaagtctatatagggactcatgaccctcctcttacttttcagagagctcctggagttagtcacgtcagtccttgagtagatcctgaagttatctcaccccatgtatggtccctagtctgtgactggggtggatgttagtattcatggactgaacatagagccatacctgacatttgcttgaggagtaggtaacaacgagtgttctcattaccacctgagttcccacactaacaagcagaactccaaatctccatggatgccccgcagtatctgaatctggctgaatttgctcattggccgataactaagcagatttcatggtggtttgtttctatgcaaactggacacaaatacagcaatgaattctttataatgcctttctacccttcctccctggatgtgaatttggagataagtgtttcttgaagcaaagactcagagttgttggccaggagtactgtggtagtgcaaactggctgggagagagatgtgcaggctgagcctgcttgtcgaagcatcaaggcctccagtttgccgagatgctgagatgctggtcctgtcctactgtgtgcagaaactactaatggttttgtatatcagaggcggtattgtttcagcctctcctgataaagccgtggggtggggctgggaagtactcttttgagaagacacaaaccagaccttccttcttgtcccccacctaagagaaagggctgtctgttgt

SEQ ID NO: 30213 - DNA, 1174 bp, Mus musculus
ggactgtaagcagaccttgggggccagtgttcagcatgtgaatgcacagcagcactaggccaactccaacataatctttggaggctctgcattatttgaccagagttgaagtgacagaatttgaagacattaaatcaggttacagaatagatttttattttgatgaaaatccttactttgaaaataaagttctctccaaagaatttcatctgaatgagagtggtgacccgtcttcaaagtccaccgaaatcaaatggaaatctggaaaggatttgacaaaacgctcaagtcaaacgcaaaataaggcaggaagaggcagcacgaagagccagagagcttctttacctggtttaccgaccattctgacacaggtggtgacgagttaggagaggtcatcaaagatgacatctggccaaatcccgtgcagtactatctggttcccgtcatggatgatgaagaaggagaggcagaaaatgatgatgacgacgatgaagaggaggaggggctggaagatattgatgaagaaggagatgaggatgaaggtgaagaagatgacgatgaggatgaaggggaggaaggagaggaggacgaaggcgaggatgattagcacagaagactgacggattccaaccttcttttttattttctttttattttttaattttctccagtccctgggagcaagttgcagtcctttcctccctgtccctctgtgctcagtcgccctgttttgaggtctcaacatcatggttctcaattaatttggggggaaatatcttgagcaaaatacaacaggaaaagaatctccgtttctgttcttaattcattttttatcctttcttgtctaaatttgtggattccacaccaccatgctctgtgggaaaaaaagaaaagctctccagttcccttggctctgctggagggcgctaggcccctgtgtagtagtttatagaattttagcttttcttcttttctctgtatattgggctcagagattacactgtgtctctatgtgaatacagacagttagcatttaccaacatgtatctgtctactttctcttgtttaataaaaagaaaaagaaaaaaaaagaaaaaaagggggggtatagacggtgagcaagggtgggtttgaggtgtctggggtaggtgggcatctgataacatggcttctc

SEQ ID NO: 30214 - DNA, 1411 bp, Mus musculus
tttcagttccccttctacttttaggtcttttttttttttttttttcttttttccatacctggcttttgtctggttaattttgttcactgtcctcctataggatccatactcccggaacaaggtttcattacttatgacttaataatactctgttgggaactatgtgggggttggggaggggggcagaagggagctgcgcgagttggaatcgaagcctcttaaaatggcagatgatttggacttcgagacaggagatgcagggccctcagccaccttcccaatgcagtgctcagcattacgcaagaatggttttgtggtgctcaaaggcgggccatgtaagatcgtcgagatgtctacttcgaagactggcaagcatggccatgccaaggtccatctggttggcactgacatttttactgggaagaaatatgaagatatctgcccgtcgactcataatatggatgtccccaacatcaaaaggaataacttccagctggttggcatccagaatgggtacctatccctgctccagaacagcgaggaggtacgagaggaccttcgtctgcctgaaggagaccttggcaaggagattgagcagaagtatgactgtggagaagagatcctgatcacagtgctgtctgccatgacagaggaggccatggcaaaataacccgcttccagggtggcggtggtggcagcagtgatctatgagcctacagaggcctctcccccagccaggttctgctctggctgggcccttggctagactcctattcaaatttatttgacgtttttattttggctttcctcaccccctcggggagaccctgcccttcacctagctcccttggccaggaatgagggagccatggccttggtgaaactccctgcctcttctctcgcagccctgatgggggagagggagttgggtactgcttgtggtttaggttcccctctccttttttttctttttaattcagtttggaatcagaaagctggattctggcaaatggtcttgtgctctttctcctactcatccctgatctagtcccctgttctccatagtccttcacaggcaagcaccactgtagagtggggaccagcctccttccctgcctgtgtctcttcccaaacccttgtaggggtggtgagaagaagagtggggaggggacacgatccctcctcaggcatctgggaaggccttgcccccacaggctttaccctttcctgtggggtctctccctgacacatttgttaaaaatcaaacctgaataaaactacaagtttaataaaaatgaaaataataataacactctgttatgtacaataccatacttcttttacccattcaccagctgatggacatagactaatgtcactactgtgagttactgcagtgaatgtgaacgtg

SEQ ID NO: 30215 - DNA, 1909 bp, Mus musculus
atccagtgttcagaaattgtagtttttttaagtgatatttttttccagtttgtgagtgtgtacctgtgtttatgtctgtatcacatgcatgttttgtgcctttggagcccagaagagtatcttggaactagaattatagcccgttaaaaggtaccatgtaaccctagggaccaagcctatgtctgctacaagagcatcctgtgctcttagcaattgagccatctctgcaggccccgccttttattcttctgtttgagttctttgacaagaggtctcaagtaacccaagctgtccctactgtacagataaggatgaccttgaactccagagtatttccttttctttattaggactaaatgtgttgccaaatccagctatatgttgacgattgaatgagattatgttgtcttagtccataaatgtttcattgtttgtcctagtattctaagtatctgcctgacttgtatttggtgacacgaatgctctgtttgtaggtatggactggaccctgggcacctcacatgaacagtgtgcacatgaaccagcttggctgatgaggagaagcctggtagcctgcagattcctttcattcagaggaaatcacaagtggccgagaaacatttttatgctcccaaatcattctactgatgtgcttgactgaagtgtgtaggctttttgcagaagaacttactaactgacctattttctgtgaacatttgtgacagccaattctccatcatcatccgtttttaccttagttagaattttttcttatcatttttcttctttctttccctcttctcctttggacataactttctgttgacgctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcagtgtgtcagtctagaggctctactttatgtagacttaaattcatgtgagatatgtaccttcatattcagaaatctggatgtctccttcatacattaaactattaataagcaccacttttctacttgtatattttaagcatagagtaaaatgatgggcattatcaactgatgttccctgcgttagctctgaaacacccatcttattccctgttgggtttgattgtagcaaggcagatagaagaaatttctgatttttccgtgtctttattaaatttgtcacacttttcaaactcatgcacacacatctcttcagtttggactctctctttgccactattgctacttagtaagattctcttgctcaatagtgagaaccttcttgtaaagttttttcccatagtggctgtgacacagatgtggagcatcttcagtggcaccagtggttttttctaaccagaaagcttgagacttttgagcaacttaaaagccaccacagctctcagtcagcatatattgtttatttttaaagatttcagcatattttatattggatgatattgattcttaacattggcccttcctggtcagcaagagtcaacatgcagttttcccttttcaagcatctatgtcttagtttgaaaggctcctctctctgtagttgttggtagaaatgaaaaggatgaacagctaacttgggccaactcaaaaaggagtgtttgggttcctttttaaaatgaatacacggattataaattaaagtctccatttaacttgtttatatgtgattcagggccacactaaactactcagtgggaattatatattccaaccacttgaaacaataaacaataatgtatacaagaagaatatgtgtcctgccctgtctcctatggaaaagtaactcacatgattgaaatataaaac

SEQ ID NO: 30216 - DNA, 1099 bp, Mus musculus
tttataacaaatcttaaaaaacttgaattaaaaataaattagctgggtggcacacacctttaatcccagcacttgggaggcagaggcaggcagatttctgagttcaaagccagcctggtctacagagtgagatctaggacagccagggctacacagagaaaccctggaaaaaccaatcaatcaagaatagaatagaatagaatagaatagaatagaatagaatagaatagaatagaatagaatagaatagaatagaatagaggtgattaagagaccagcaccactaaagtgaaatcttctgggaagtgttttctgagagcacaaagaagttgtgatccagagattgtcaaggtattttcccctgttgcagctgtcttttggtaatgtgtaagagtcacccaggcgctactggttttgaaggcatgaagagatcatgatgagcagctgaggcctggcactgagagagtccatggaaggccactggtgaaggttcagccctaaatgcagtttggcccaggactgaaggggtcatgcaaaagagttgagctttgacactaaaaggagagcctgtgagaggcttttggtgaaacctagttgtagtggaagaccccagccagcttattggagatgccagtaccacaggatgatcatcaagaacagcagcaacagtgggagtggatcagctggaggttatagtgctacagagcacagagatagtgacgccagccctttggaggagcccagaagatcatgtgtggatcccagacactgaaacaagaagctgtgatacttggagaccccaaaatgtttgagatgtcagagccataagatatctcctgagacatgctgctaacaggatgtggaaccagtccaggaaaagagaaagggcctggagatgtgaagaccactttgacatcagacatagagatgcagagtctggagtttgcccagctgttttcctgtcttgatttgggtattacagttaagcgattgggtggatctcagaagagactttttaaattttttattatgctgtggctaggtatggccccccccccatagattcatgtgtttgaataagtctatggggaccagggaa

SEQ ID NO: 30217 - DNA, 1195 bp, Mus musculus
tgtttggtctgcagagtgagtggcccagtggcacaacttgattagattgtctcagaatgccaggaaagtagtgctggatctgtctctggtctgctcagttgtttttacttaagtatttgatgaccacaggttataaatgtagttgtctcattttgtttactcacttattccccgactttatattaacttacattctaaaaaccttttttgttgtcgttgtttttttttgtttttgtttttgtttttttcgagacagggattctctgtatagccctggaactcactgtgtagaccaggctgaccttgaactcagaaatccacctacctctgcctcccaagtgctgggattaaaggcctgcgccaccaccaccttgcttataaaaacctcttaatggacattttcttccattcttgatttgtaaaacctttgggttcatgtctttctcccctttttttgaatttatataaccacatataattgaccacttgagtattttcccataagtgatttattcccaactgtttccaaatattttctcttgctgtcatatcagtctcatcagtgaatgactaactcactattgctgcttttacagaagaacctgaagtcttgacagagcctccaagtgccactaccaccactaccataggaatatctgctacatggactactttggcaggttcccatggtaaaagaaataataccataactacaaccagctcaaagaggaaaaacaggaaaaataaaattactccagaaaatgttcaaattatatttgatgatccactaccaatctcgtacagtcagccagagaaggtgaatggagagtccaagagcagcagcaccagcgagagtggggacagtgacaacatgaggatttccagctgcagtgacgagagcagcaacagcaacagcagcagaaagagtaacaatcatgcgtcggctgtggtcacgaccactatggccagcaagaagcagccgtctgttcttgttacatttccaaaagaggagagaaaatccgtttcgggcaaggcttctataaagttagttccaagttctgcttttactggtgctgtgttaaacaccttgtgagacaagtaaattaccaaatacttttgtatggtaaagaatactaagatgttgtttagattttatgctgagaaaataaataattttcactatgtaatttttcgt

SEQ ID NO: 30218 - DNA, 1194 bp, Mus musculus
tagtaaagaggcagaggataaaggaaggaatgataaaagttcaaaaccaacctagtacagtgatgttccatctcaaaaatttaaacaatgttatttaaaaatagtgaatataatgttttagtagcctttgtactatgtaagtcactgaagctagcatatggaagaggcttctaatttcagcactccagtggtgatgatcgcaatgaaaaagagttcaaggtcatcctgaactaaggcaaatctgagctatgaagtttcagaatcaccaccctaaaagaaaaacaaaccatagtttggctagtcattgatagaagagttgttagtaaaccacatagcatcctagtacttgaggaggcctgaggcaggatattgtacattccaacctagcatggaccacagattttgatgtcctcacataatagagtggtacatatgtatctttgtgcttctcattaacactggaaagtattcagataaactaaactgatctcttttttttttttttaacagactgagagtaatcatgatactgcactaacacttgcctgtgctggtggccatgaggaactggtacaaacactactagagagaggagctagtattgaacatcgagacaagaaaggtagcccttatttttgtcagtttttctttatggaatgtttatagaaactatgtatttatcaacagcttatagccaagtattggtgcttaggtgtattggaaaagagttgttactggttctttgcttaacatatagtaagatgatctttttctttccccaggttttactccactcatcttggctgctacagctggtcatgttggtgttgtagagatattgctggacaatggtgcagacattgaagcccagtcagaaagaaccaaggacacaccactgtccttggcttgttctgggggcaggcaggaggtaacttttctctttagcaaatatgaactcatatatttgttttccatataggaaaatatttgcctgatttattgaaattactgtataggaatacggttaatacaatgttccgagaaaagtcatatattgtataggggaaacaggttaaatacaccagttatactatctttttggagtcacaactttccagttttagatttagaaattgccctgtcatccatgtagtttcctgttcagtgtaaaaggcttgttgagcccgcctgagg

SEQ ID NO: 30219 - DNA, 1153 bp, Mus musculus
agcatatttattctacaaacattgcgcacacacctctgaaatatatgccaataattgatgtcctttacctcagggagagttagttcaagtctacacaagggaaattagtggcccccctaagtagatccaaacaattgtgccccatcatggataggactggctggaatgctttggagagaaagtcagagcaaaaaagagaactggagcctcttctccatggactgcaaatggtcaaagaatggtaggcaactatgctttcttttcccatggccctgatgggcccctatcttccctacacagctgtgtcttcatttataaaatgggggtgacgctttcatagtggctttaccccttcctacctcacagatgtgttgtgaggattaatgaaattgtgtatacagtgttttcagtttctggagaaaaactatttatggacatttcgagtattatatagatatataagtgatctcagtttcttactcactgttatactggtgtgctgtttttacttactctgtaaaactacagttaatgtcacggccacctcagatggctatcagagctctgaaacttccctcccgcacacctgactgatgttgagttagctgttttggggaccacagaggatgtctccctccagctgaaaaggtggtccaggacacaggtctcacaaacctgcatcaggatccaggttagcatgccacacctggatgcctcagcacttccagaagaaggcctctgactttcacaccccgaggtctcggaggagtagattatgatctgatgtcatctgcccttcgtcttgcttgcaagggtgcatggttcgatcctatgcatcttgaaaatgaattttgtgattggtccagatgctaatttgcacgtcgattcaccttcattgcctttaaccttcttttgagggcaaatggatgtaccatttcaactttgatctcagaagcgttagtttgtattgactcattgtcacgttgctctcttggagtaaagttagctgacatcgtttaaagatgggaaggtgtgcaacttctttgatatttgatgacatcatatctacatttgttgtaagacatattgcataccaattataactatgccaattaaagtggttaaaagcttgtgtctagctgtggtgattcac

SEQ ID NO: 30220 - DNA, 1254 bp, Mus musculus
gtgtgttattttgttttttaaatattaagtgtttgcctaatgataagtataagatctgaatatatccatgttaatttgcttgcttgtattatgtatacttttaggagctattttaagttgagtgttctgagctcagattcacattttcattttatgaattcaaagccatcctaataacctttaaaatactcactggagaaaagacattttcacttcaaaaatgcttagacatacgtgtattttcacatctttcatatgactttcaagtgattgttaatcaggcagtgtcacttgtagttacaaggcttaaaacttttcctcttcatttttcagattctctgcaatgactgtaatggacgatccacagtccagttccatatcttaggcatgaaatgtaagctttgtgactcctacaatactgcccaagctggaggccgtagagtgccagtggatcagcagtgagaagcctgtccttggctagagaacagctctgtgatggagatgaagctctgtaaaagatcccagtgttcgttcatctgcatcagagatgtttcataccactgtcacaacagggggtcacagcgtgaacacctgaggattcaagatctctggatggaaatgtaatagagcttactgggtgattgtaatagcgattactgggtgaagcctctgagcgtgtgtagattggaaattcctttagtgtcaagttttgaagccaatgatgttagtcccagatatagtcacattcatcgaaatattttatattttcatggaactttaagtgatactatgcacgcagagttaatttcttgttcttgatagaactacattcaattttaactagtctttgattttaagggctgtactgtgatttttaagttcttattaaaatctaattacgtgtgcttcttaattttcttttcttttctctctctctctctctctctctctctctctctctctctctctctcttttggttcttccagacagggtctctctgtgtagccctggctgacctggagctcactctgtagaccaggctggcctcgaactcagaaatctgcctgcctctgcctctcaagtgctaggattaaaggcatgtgccaccacgcccggctgctttttaattttctaagacagtcctttgaatactataatacaattttatgtaataaattactaatgaaattgtactgaaatactgttttacagactttttttccctctaggttgttaatttttggctcttgtga

SEQ ID NO: 30221 - DNA, 1192 bp, Mus musculus
tctggtacacactaactcctgctggcgtactgtttgccattcaactttcagctcgagcgtctccttccccagggacaccacacaggactgtccttccagtgtggaagttgtgacctcatctaatgccgtggcgttctccccctccccatttgtgagttccacgggggcgtggcgtggctacttgtttttcactttgcgttcttaagtcctgggtgggtgacagcacaatattttctaaagggggcgcagggaaaaaaggagaccgggacagccgccggcactcggacctgcgcgcgcagccgccgagccccgccccctttcggagcagccgcgggaggggccgctcctcaccggcgccggcggctcgcagcagcgcccgccagacgacgcagcggtccccttcgcccgcaatcagggctggcagcgatgccggggcggggaaaaagagccaacctaagacttactaccattagcagtgacgacagcgactaacgtggacgacggactaagcgtctcacttggcttccaccccttacaccagggaccggaaatccggatgctgcagatcacgtgattggacccccccttcctgactctggtggccgctgctccgaggaggagcgggtgtccgaccgactctgcttccttaaggcgtggcttccaagctgggggaaaggttcagtggctggtgagggggaggtggtggaggaggaggaggaggagatggcggcgacggcgcgggaagatggcgtccgcaacctggcgcaggggccgcggggctgcgagcactatgacagagcttgtctcctcaaggtgacgactttagagggtacctcctcgatgagctgcggtcgggtctggcaagggcaggttgggcagaagcttcagaccgagctgcttgtcaggatacctgccatctggagttgggctctccttgcaggaaacgttttggcaaggcgagcaggagctctgtactcgatcgccgctgcaagccaagttcttgtttgtaaagacttggcccttgcttaaattcacctcccttgtgggtttatccgtcatttgcggttgacagtagaatgaggaagtgaaagggccttggcatttctgtcaagtgcgtatgatgcagtgatgaaagcataagcaagggaagaatcagaatataatttctgtacgtgtaggaagtttatagtat

SEQ ID NO: 30222 - DNA, 2851 bp, Mus musculus
aaattaatatctgtctatttttgtgtaacccactcatgtcatttttctgttttaaagccaattatgtttcgaggagaagtacgtttaaatgtggaagagaaaaaaacaagagctgccagagagcgagaaaccagaggtggtggcgatgaccgcagggatatcaggcgcaatgatcggggtcctggtggtccacgtggaattgtgggtggtggaatgatgcgtgatcgtgacggaagagggccacctccacgaggtggcatgacacagaaacttggttctggaagaggaaccgggcaaatggaaggtcgcttcacaggacagcgtcgttgaagtcccactgttggcagttttggcagtggtacctaactcatcgtgtttgcattcttgttaagtttttttggctttggaatgtgacacagcctttttgatcatttctttgatgtgaaaagcatcttttggttatcagttaaattgaggtggacattatttccccaatttcacaacaggattcatattgttaatttataaagctagacttggagaattaaggactgagaaatgaccatatcttaaactgtctacaacaaaatgaactttaaaaaaaaaaaaaaggacatgcccactgagttcaggtcatttgagttaaaacaaaaaaaaaaatcctctgctgcacattttgtttaagtgttaactgtttctgctattaatgttggaaacacaaatagtgcaatttgtgcaattggagaatcttgccttttttcttgtctccctcccaccccccaacacaaacaaacagaagcttgtacgtattcattagaatgcactatcgggtactctgaagtcattaacattgaaatctgcaccaggaggcaacaggggaaaaaaaagtttgatcttcttttccagtagagaatagtttgtgaaatgataagggcattctatctgcttgctgtgaccagcgtgtgcacacaaaccttaacaagactgcaaatactccagaaggaagtcatttagttatgaacgaaataagaaaagtgagaacttcaaaagctgtggtcttaaatactagaccaggtttagtagctctgttttgtcagttttctatttgccctcttgagtacagggatggatggatggctgctcaacacactcctcccctctctcctttaagctgtgtccagtgaaagctgtccttcctgtattctgttctctggtaatgtaataagcatgatggtgccttctattacatcattccagtcttgctggtgatcctgtacggtgtggtctatgaattgctgcactgcaaagccacacagctgcaaaacgttgaagaaaatcattgatgtataaaaattgcagtatctttcaaatcagtaaaatggatgcttattatttatcttgttcttcagttaacatctgtgttctgtgggggagggagggagtcatgtgtgtttgaagggagaagtccattgagtctctaattgacttttctttcagctccagtgtgaactataaaaccataatcactcagttcttggaaaagtcaaacaacgtggtggacattttgtcacattttagaagcagtcagattcccccaaacggcacgtgaacctgagtgcggatactgcaattttcagagggaagaatggcagctcttatgggtgggggacgggaactgtcactcattttgcacaactcttgaactgatgtcagcacccaaatggctcctgaatttaagtctgggaggacatctttttatttttacatgaatctttaaacaattctgtgagcagagtttctagctgctggattgttgtctgtctttatagcaggtcccagtgaaccacaagaatggcgagggttatctggttacagttggatcaatcagtatatatcagatttctggtgtttcaagcaagaagcgggcggagtaaacgcgtgtgaccacttaaagctgcttgttaacatggaagacttctccactctcccttagtgagaacaaatacacacttgacatgggagcaaactggttctgaactttgtgactgtttgctagtgacgcaactattggttttttgtcaactgggcaatatgggtaaaatttccttttttccctaagaatgaggtcttccatgtttgaggaaatgtcttgcactattgcatatattttgtggacacagatttttgtagtttccattttggaaggctaaagtgttttgtttgtttgaaacagttttacactttctaatgtacagtacttgaagttcgtactagagaattcctttgtagttttgaagcttttatccaaactactttgaaataggtggctttcttgtcagtggtttgccccccaggtgtaatttttcttttgttattattcctcctcctattgtgtataggtgtgtatatgtgtgtaaatatttcacacaacaacatctgtacaagcatatatatttcaaatccaagatcttgccctgtaacccatatctactgttctggcgacaaaagacagatgttaagtgtaacagataattggagctacgagccattcagcttcagcctttccagaccacacacgagacattaaccatcccatggagaagtttacatggtgactgttcacctgcagtactgtggactttgaacattttgtcccctttccagtgaaaaactaaaaagtagtcatctgccattactgttatttgctgattttattttattttgatggtaatattctatccttatgacactattgcaaccaaattggctttaccatcttggctttagtaggtatagaagaaagtggattaccatctttattttgtaatgtgttaaataagcattatatgct

SEQ ID NO: 30223 - DNA, 1183 bp, Mus musculus
tatttgagacaaggtctcgttgtgtagctccaggctgatctggaactcggagctcttcccgactgttgggatttatagggtatgtaccactctgcctgcctggcactaatactgatttagggtatgtaccactctgcctggcactgatactgatttagggtatgtaccactctgcctggcagtaatactgatttagggtatgtaccactctgcctggctggcactaatactgatttttctttctagttcatttctttttttttcctcttgagtctagttcatttctttgtactgtttttatatgttgttataggctttagtgtttcctttcttcctgtctttcaggcagaggagatatggaacagaatgactctgacaaccggagaataattcgctatccggacagtcatcagcttttcgttggtaacttgcctcatgatattgatgaaaatgaactgaaagaattctttatgagtaagtggtttagtttgcatttatgttctacttttaagttgaagtttaatggttaccctacattagatcaacatagctgctcattagggctcagtcttcctcttgtggtcctgacctgcctgccctccatgagcaagagaatctggactggttgggggtgtcctgtccaagtggacaacaggactccacggttttcagtacaacaactctaccatctgacaacatgaaggcttccctttaaagaaaatattcttgaatttagtaaaaagccctaaaggaagaaacatcctttttgtcataataaaagccaggattttgaattactttattgtatcttaacctgcttccagtctcactttaattggttagaagggaagaaatgataaagctatcacaattgtcagggactgttgagtgttgtttggtcaggttcaggagatgaggaagaaggttggaatcaacagtcttagatttaaaactccgaggactctactggtaaaatggggtggggaaaatgtttgtcttccaacacttgacaatttttttttctcctgtggagacaagcgtctgctaaggttgttaggggtacagaggtggtggccctctgagcagcagatgtcctatagcaaccatcctgcatagcagctttgctgtgtttattttcagacggatcagaaacatgacagttgctcattctgaacaattaaag

SEQ ID NO: 30224 - DNA, 1377 bp, Mus musculus
cagttaagagcaccagctgatccagtacccacgtgactggttggaaccctagacatgggaatctgaccccctcctatggcctccaagggcagtgtacatgcatggtgcaccgacatacacgtaagcgaagcaccattatgtgcaagatactaaaacccattttttaaaatgtgatggtgcactctaatcctggcactcgaaggaggcaaaaggagaagctcactgactctgaggtctgtgtggtctacagagttgagttccaggccagccaaggatacatagtaaaatcctgtctcaacaacaaaaaccagaaagatgggtatagactggaggtgagtctctggtagagcaatttcactggtatgtgcctggcagtcaggactagggtttcacccatacccaacaccacatgtgtatgaccagagaatacttgctcacaaacgcagaacagtttacccacaggaatgtaactagtttcaactgttagtttggagaaaccgttttatttcatctgaatacctagtgacctaggtgtttcgttgtagtaatggcatagaggagcctttagaagaatcctctcatgaacctgagcctgagccagaatctgaaacaaagactgaagagctgaaaccacaagtggaggagaaacacttggaagagctggaggagaagtcggccactcctcctcctgctgagcctgcttctctgcctcaggaaccgccaaaggtgagatcaaaggaacttttcagatctgggacctcacattttcatgcttggtgccattaataaagcatggttttggttctgttatttgaaatagtaagctatacttatatgtatatgaaagaaacttgagttcttgttctgaggagattttatggtttctctctacccccaaaatattcctaagagtgaaatttataacctagattcctcttgtctgtatgcagtgttgaatgacttacatgaaagtccatgtgtgaggttttcagttgctcatctcttctgatgctctaggagtcatgcagtgtccctactgaagttgatctgtgagagacacctgtttgcgatataaatgggatcagtttccttactctactaattctcttgaacagatgtgtggcacccatagtatagcatgtgaactctctctctgtcaagtagacggttagtagatctgggcaggagaagcgagtagtgcaggagtccttgctcactttggtaacgtctgctgagtctccaaccgcactctggtcttcctgtgcttctccctaacaccatcactcacatcctgtctccccatggggagagcagtcagtctctgcttcagattttatagcatgtttagttgacagtggtttgccacttgcttatgta

SEQ ID NO: 30225 - DNA, 1180 bp, Mus musculus
aaactgcattttaatgctccgataacgcagcaaccaggaccattactaaatttgctccctcttatcacgaataaaggctccaggaataaccgtttgtaaaagccactggttagcggcgagccatcttttttgttcgcgccacctgagaggacagggaggcttcagcatcactgcaagagaaaggcagcttccttgtgacgtcaaatcagcgggctctcgccccgactttaggccggttccggttccctggctttccggacgcccgagcgagcgagcgagcgagcgcggcgccgttctgcgcgtgctccgcagtgggacgcgagaaggttgggtctagctctccaaactgatgcctgattggctggcgctgtgctggggggttccctagccctttccgcaggggtaaaacaataagagggggcggcggcaaagggggcgggacgtccgtgttcttggagctcgttgcagctctaggctctcgggaagaggtggctgtgaggggccccgagctcgcggctctccggattccgaagcctcgggttgcttcgagggaggagaatctgctgcggccgatcccgcgacactactgacctccgcgcgacgtgcccgccgccgctgttggttggaggtgtgtacgggggccgagaggggcggtcggtgtggtggtcggcaggggacatttccctccgctccgcggctcgcggcaaccgtccggtgtgtgcgcttggtgtcggggttggtgcggcggaaacattgttctcgccggctgcctacgccagcaagagtgcgtgcgtgcgtgcagagccgagcctttcctgcaaggtgagcggaaggctgcgtggggaggaggatgacctgcgcgcgtggtgcagaggagggcacaggtggggctggggattgctaggatgaagcagcccgggggtaccctgtccgccgccagctcccagagcgcgccaacgggcgccaagccgcgaagcggggcagtgggctcctgcagaggcggtttcagggtaggaagcccacccgcctggttcctccgctcgccggcggccctagttcccggtcgtcgccccgcccgtgggggaggggaaggaggccgtgtcggcggaggcagaagcaacgcagatgcgaaagtagcggcctccgggcaccatttctgtgcccggaaactgaatccggg

SEQ ID NO: 30226 - DNA, 1184 bp, Mus musculus
agaatgcagagccattctgaagacgatacaatttaactttgcagcactgtaagaacctaggtcgtgctttcccctcggccgttctcctgtataggaggcagccatggcgcccagccggaatggcatgatactgaagccccacttccacaaggattggcagcagcgagtggacacttggttcaaccagccggcgcgcaagatccgcaggcgcaaggcccggcaggcgaaagcgcgtcgcatcgcccctcgccccgcgtccggccccatcaggcccatcgtgaggtgccctacagtgagataccacaccaaggtccgggctggcaggggcttcagcctggaggagctcagggtggctggcatccacaagaaagtggctcgcaccatcggcatctctgtggacccgaggaggcgaaacaagtccacggagtcactgcaggccaacgtgcagcgcctgaaggagtaccgctccaagctcatcctgttccccaggaagccttctgctccgaagaagggagacagttctgctgaagaacttaagctggccacccagctgacaggacctgtgatgcccatccggaatgtgtacaaaaaggaaaaggccagagttatcacagaagaagaaaagaactttaaggcttttgccagtctccgaatggcccgtgccaatgcccgactctttggcatccgagcaaaaagggcgaaggaagctgcagagcaagatgttgaaaagaaaaaataattctgtgttggagagttgcaataaattttccataaagcaaaaaaaaaaaaaaaaaaaaaaaaaagaacctaggtcgtggatgattatatagtagatgctcaaagccttggctagtcaagcacgtaggccaaatcaaatatggacaattaaagcacctaatagtacaccatgcactccactgaggctctataaatccatgtcaactagtggcccgtgagccctgctggacttcccgacagactcagaactaactttgatcatacagtaactcagtgacctcggtcctcaaaagacagactactgattcagttctcagagccagtgaagtaaaagggcatccctctcgtctctctttacatgttcaccacggtgacactgggcatcagtataaagtcatgatgtaaaactatgatactgatccatgcacactgaaccaagcatccca

SEQ ID NO: 30227 - DNA, 1537 bp, Mus musculus
acctggagcatagagaacagctgttgtcactgctcctaggtattaagcgtcactgtccagggtgagttgggtggtcatgtttttaccaccatgtattcagactcctgggtagaaaggtgtgagcatttaccgtgaccgttaactgattagcataacccacagaaatgcagagagccacagggagccccgagcgctatgaagtcaaggaaatctgatttcaccataggacagactgataatatttattagcaggcgttttacatgtatatgtttcccagtgtgttattctgtgtgtgtgaacaaatctgtattctccccttaggttgaagaagaagatgaatctggagaccaagaagacgatgatgatgaaattgatgatggtgacaaggaccaggacatctagctttaaaccctaggaatgatagagattacgtcattatgtggaagaagtcttaacagtgctttggtttgcctccacacaaaaaataaagacagaaccaggtggaaacattgactagtaaaactattgatatatgttttttaatattgccacccatgtggaaaactgacttcatgtggaacttttatttatgttcatctgaactctcccaaaataaaatttgcacagggcaccaagctccaaaagtaccccctttgaaggcatgtggtggcaatgcagtttgccatgttggttcactgatggctttcagacactctgtgacttcagtactcacacatttgattaatgtgtattcaatgggagtcatcatttctaagtcagcgtttgagttctcggctgattaatccttgtaaagaaaggactgtacttagggtagcctggggctcctgtatgtcatcccctcaaacccccactgtgcctcccgagatcaggatgggacagttccgagtgagtgcttgccgtccagcggggccacattctgcctactgagaggaaagattgtcccagagtgtggagggcgttctgaggaactggaacagtgtactaatgtggctggttttctctctgtttaagctaaagatggaaaacagattatagtcagcagttcatatagctgggatttagaattgtttgattatcataaaacatgttcttagttttaaaaaatcccacactatgatttatgtaatttattggcatttttgctgaataggtgtaagtcagataatagatttttaaaaagcaaatgaagcaatgtgtcaaagtctaatgttttcataataaaaatagatattatgttcacttaatctctgtcattgttccctttgtttagattttaacaaagtattctgttcactgtaagaagtaaggcaaatggaaatgctaaggaggcttcttgtagtcggtgttctactgcccagaagagcactcatgaccaaggcagctcttcagaaacaaaacgttaaatggagaaattggttactttttcaggggtggagtccatgatcacggtgggagcaagggtagcacgtgtggcactggaggagtggaggagagcgacatcctgattggcaggca

SEQ ID NO: 30228 - DNA, 2631 bp, Mus musculus
atttggtattcttaattgggaggtggggctggtgggaatgtgaaatgtaaatagtagcaatgttaagaagtgctgagtacctactgattgctgctgcctatgtagctgaatgagccagagcccttgactgagggcagatgtacatacggtgtttatagtaagctgtacatagttccctggtggcagctagtccgtcttcctggggtcactgggctcctggactaactgtgcggggatgggagttattcatgctctgcaatcaggacagtgttacaagagtaagaggttcttacttgtaaataggcttgcctgctcaaacaggctcctgctgtacagattcaggtagacagttgagctccactcttttatttttttagtataaagagtttttgctaagctctcattttttttaattgccttaagtctaaatagtgattttgaaatgcctagcagggtgtggtggcacacacccataatcccagcacttgggaagtcaaggcaggaggctcgtgagtttagaaccaacttgacatcctgagttagttcagggcagcctgagctacgtaattgagaagcaaagctatctttgagctatcgttgggtggctggttctctgctgcctgttgctgttggggtttgttttcctttctttcctgtgcgggaggcgagccctgggccctcttgctcaccctgagcaggttctccctgggcttcaccccacccctgagtgcctactcttcacatggtttgatcagttcccgtgccttgttctcaaccaaagctacaggtggttagtagtcagatgggtgtgtaccgcggtgtgtgctgctgttgccacacgtgaatgcattgcaggacccagtctgcatgcaggctgctggctttagaagcagtttgatgccttttgcctcagacttcctaggtgctattgtcatgagaacaggtttgatgttcacgttagaggaagggcagtctctgcccctgggctggagagcaactgctgctggttgccttcctctccatcgatggctctgttcagcttctgaggtcgacttgggtttatttgtcccttgctttccccaacggtgcccaggtcactgtaggggactgcccgtcagcctcacccagcactgctgtggaggaagtttctggtgcctatctgtgtgtgtgagacctgaagccgtcccttggccttcttcctgtgttcctcacgggtgtgtgctcaggaaccagctctgagcagccggagctctgaaagcagctggagctcccagcccctgggacttcaggcacacagtaccaaggccagttctaggctgctgggtcatacccagggattggcatagaaatccagaatgccagcatgccacatgcatggcattagcaaagttcacaggacgctctcgcctgttccctgcagcatctctggtgctagctaagggtctcctatgatgtagagggcacagcagctgtttgaacatgaggattaaccccagcctgccacggtttccatctgtaaatgttagaccacctacctctcttttagtaaattgtgttttgggagggtttttgttgttgttgttttccttatagttgctatgtttattttaaccatccaacccaatgtttaggcagctagtgtaaagcccatattgaatatccattgtgtataaagcactgctagatgtttgtgtcatgttgaaacttattcccaatgcgtgtggtaggcaggaccgcactgtagaaaacagttcctaagtccggtggctactggaatagtttttaaatgttacagttaatgcaaattttgttttttgaaaatgtataatgtatatagagtattacattgaaatttcagtttaaaatgtataatgtttgtagagtattacgttgaaatttcagtttaaaacgtttaattgttctgagtgtcctgtttaagctcttctaggtgacatatttttaaactctctctagatgatgttttctcccaaatagtaccctctcgttccttacatggtttggagtgtatttctcgagatttagggaggctttaccaggtatggggacacacacctgtaaccccagcacttgggagaatgaggcaggcagtggggtgctctgggttgagaccacatagcaagagagcaaaaccctgtctgggggcttgggggtggggtgaggatatgaaatgggggaagagtagagagagcttgaccaaaagaagaaagcttgcagcagctggaactctgggtcaggtcagagctccgggattaagcctttcctgtcgtctctgcttctcacccatgtgaagatacaaaggaaagcggagagcacagcagcttcagccacagtcaacagcacaactcctcttcctataaggctgtctgtgtcattttctcctgcagattctgcttgtgtgttttgaccatctcatctcagtgtataagtagctaaagtttgaaaaggatttgtagcataattcagtgtacatgtaggtaattataaaaaaatccagaaaatgtgccaaatattagggggtgggagttggtgctgggatcatgtgtaaggtgtattttctttctactttctgagtctttcacggtgtatatgtttttacttaatgtcattgtg

SEQ ID NO: 30229 - DNA, 1144 bp, Mus musculus
ttgttgggtttacctggcttcagggtgtgtcttgtaggggtgcacagagctggctcgctgtgcacgtttcagttcctaagtcctgtattgggagtagcttgcaatttaacagaacagtacactgttttatttttcttaattcattctagcatttgaaacaacaacaggaaggccttagccacttgattagcatcataaaagatgacctagaagacataaaactggtagaacatggattgaatgagaccatccatagcagaggcggtgtctttagctgaccgtttacagacttgttgcagagattgataaaatgcgtctccttgctacatcgagccttcttcacgatgaccacatggccggggaaaaggatgcttctcctcactgggatgtctgcgatcctcagaggttactgtacgttaaatctgaaatggtcaccacaaagcccttcaaagagaatctttgaaaagtttatatctaaaagctgtatttacttttaaagaagtgttacccaaagcatacactgttgttcattttataacagcgttaagcgtagtcacggagcctgatggttattctccgttctcctctccatagcacagagcgccacagagctacttcctacatgacacaacaaactgggattccatgcctgttggaggctgtgcttcagggtataaatgcatttcagcttttatatctgtgaaatcagctgtggagagtaaagaaaatcccaaagtatttaatgatttgtgtggttttccttttgttctagaaagacttgaaaatatatttttatattattttacttatttagaacttacagaaaatacctaaccggttaggatatgacaaaatcaccacttttgcaagctgttttgttttgttttgtttttttatttctaaaaatgaaatccttaaaataaattgttaatttgtaattttatgtaattctgtctggtgttttatttaaagacttgtcagtgctgacatattttgactaggggttaagaaatggaagttgtcgtctagagtgaagacttcccccatttcttagcatctgaaaacactggccaagtcctacagcatcatgagattctcccacagtgccagttttacatacaacttctgactgcaaaatgtacct

SEQ ID NO: 30230 - DNA, 1206 bp, Mus musculus
tgtaatagctagtctaaaagtggatatatatcattttagacttaggacagtctaattttttttcaatcacgttacccatttagttaacgggatttgtattgtgttgtattatttctgtctaaagcacttggtcatttatttcttgcaatgcattgaccttctgattagtaagtaattaggatttttttaacctatgttgaaaaaagaaaagaaaaatttagatcaatatgtcctttatatttagcaactacttacaaaacaatttgaaatgaaaacgcaatccccgctgtgtgcacaaaaggacccttacgttttatccgtttttaattaggtgggtttggaggatttggaacaacaactacaactgcaggctctgccttcagcttttcagccccaacaaacacaggcagtacaggtaagaggttatcctaagtcctaagacataaatgtggcacaggttgatgtttttagcttactcaattctgatttctcattgaaaggccttctcggtggcactcagaacaaaggttttggctttggtactggttttggcacaacgacgggaactggcactggtttaggcactggcttgggaaccggacttggatttggaggatttaatacccagcagcagcagcagcagcagcagacttgtaagtgggattttaccttcagctataaaattgtggcagtaacagcaatgttgcttcggatacagattgccttagttttaaggactgtaactgtatcccaaagagttccgaaagcataatatttattccagaaagttattccaagatgcataatatttatgcattcttggaattaggaaaaagactgactggtatgattgggactgtaagggccctacgtttgaagtcagtccatgaaagctgtagtgatttctgtgtcggggtatagtttactagattatacatacgggctcacccttgtcatgttgaggcagaacctgagcacactccatatcttcccttatagcactgatccatgggacgagctgtgtcccggctttcacagcctcttcccttcctttgtagttctgctgtttacaagtgtgaacatcatgagtgtgaacgtcacgagtgtgaactgaacagatcattttgccattcttagatctctgcaggctccttttatatcattaattcacagatgaagtcagatctttgtctttcaggttttcta

SEQ ID NO: 30231 - DNA, 1165 bp, Mus musculus
cggtgcaggtcaggtttgttcacgctgtgaaacctcttgctgattcttgtaattcttacctttctttcttctccttttctctttccctcctctcaccttttcaaatttttgtttctcttgcctccacgactatcaggatttggtgggcttgagactgccaactccaccgccggtgggtttaattttgggggtttcggattaaccgctaaccctgcagtgaactttaatattgggaatttcggtgtttctactacctcggcgactccgttcaattttggtaacagtctggcgagtgcaggtagatactggggtcatgtgtgtaacgagtatgggggctggagtccaagaatgttccgatgtccctagagtttgggggaagaaatggcacttgtctaataaagaaaggggtttatttcctaagatcaaatcaaatatatttaaagttttggctgctttaaaagatgtgggttttggaaagccttaaagaattagaatgcaccttggttggattttcatttaatgatacagagcacagcttccaaatgataagttgggaaccgaatattttttaaaacattagctttagcagaaggtaagcgtttccctgggattcttggactcctgcagtcatttttcattttttaatacatatttcattgggatttcatcttattgtccttgtgtttccaagagaaacaagtcttatacgaacagcagcgacctgtcttgtttttcaaactgtaacgatgtttttctagcattaactcaatatattaggatgtatttctatatataattgtagaaagaatcccggattctttgctgggtttttgggaaattttccatgagtagttttaatttaccaattaacactgagttctaaaaagtaggctcggcatcttttactttcaaaaagaggatgatgaaggtttttggttttttggtttttttaatctgtggcttgtttgaagatcactgaaatttttcagaacacaaattaatggatgtgtacgacccaatttaagttaggcttatgtgagctcgacatccgtatgactcttagaaaactctccatcctcagctgctcgtatatgaatgtactgtccatagtttatgttccgtcaagccactgctgcccgtgccaattatatgcatttggtaagcc

SEQ ID NO: 30232 - DNA, 3697 bp, Mus musculus
ctgtcctggaactcactctgtagaccaggctggcctcaaactcagaaatccacctgcctctgcctcccaagtgctgggattaaaggcatgcgccaccacgcccggcccgggttagagtcttaaagagcaatgacagccaagaggaagagaaaagtgggggaactgcctccccatcagcttctcttttcacctctgccacctcgcctcaacccttcacatcaggacagaagttcctgacatgaacgtttaacctctctgtgtcttctctgtctgtctcagggaactgcagatgaaagagcacccctcatacgaacctaatgggacttacctgttgcctgagcttggtgagagaatgtgagagctgccctgacctggaccaggacagggggaaccctgcatcctcatgggctcctggcctgtcaagaaggaaacatagcactggcaagcgagaagcccctcctggtcagagggaaatgagcagggtgacatggctggcaattctgctttataaaatcgtgtctctaaaactgtgttcatgtgtctaggaagtatttaataaacttgtgtagaaactttttgtggttgggccctgggagctgaggggacttcgtgaccccctgttgtagatacaatgtctgaatcgcttgttaatgttccgtggcctgacccgattcagtgtgcttcattctccaaactttgtgttcagagtacgtatgtgtttctgttgttgttccctgttcacctccttacacagaaagatgtggtacccagggtagaatcacagctccatacagtgtaccaagcaaatggggctgctttccttctgtaaaacattacattttgtgtctcgctctaatcttcaggaaaataactcaagtcttttgattggtttatagtgtgttaggaatcaagtaggggaagggatggggtggggtggggtggtgtctgtaagtagacagcattgagctcctgaggatttttagttgtgcttttgtgaagcaagaggttgcactgggaatgttggtgagggtaaggcagatatttcatttagaatagagttcaatgttagttatggcatctagaggctaactgtcaattttagtcagagatgtctgggtgtagaatatgctgctgagaggacagaatcaatgacttctaaccccctcccttcaggcttctctgccacataggacagtgacacggaatgacagtgtctgcaaatattgaggggttatttgtaaaatgacgaatgatggaagtccatctgcccgtagcttacattacagatagatccaggaagtgtgcacaggttagagaggcatttcttctggacccagccggtgcttcgtggctccctgtcactaagtgctctctgcttcctgtgacaatcacttttctgacagagcgagaaatgttagactgctagtcagaggcacttcagataaggagtcgagcagccaggctgcttctctttggaaggcaatggcttccgtgtaggactaaggacattagtgtcacagccgtcagacctcagctatcctggagggcagagtccatgattctcagagtccactattttggggttgtttgtttgttttagtttttatttttttattttttatcttttggtggcttagtttttaagacagggtttctctgtgtagccctggctgtcatggaactcgctctatagaccagactggcctcgaattcacagagatctgacagcctctgcctcctaagtgctgggattaaaggcttacaccattgattttttttttttcaatgaaccctatacattatctggctagctgtttatagaattccctgaaaactgaatttcagtatatttaaatttttttaaaaactgagatgtcacatacatattagaagtaaaacattgctttaatatacaggcccaaattttcctctattgacacaaagcaatacacaatgtttcccttttttaaaaaaattttggtagtttttgagaccgggttggtgtagtcttggctgttctggaagtcactatgtaaactaggctggccttgaactcagagatcgcctgccttgtgtcatgagtgctgggatccataagccaccatgcttggctgatgtttcccttctagagagacagctctttaaattttcacctttcctactaatcaaagtaaaaaaattagacaccccaaatcaccaatatgtgaaactaaactgaaaatatctgacctttagtaatgacaaatatttttagactttgtcaatatttaactcggtagttggcacatcttagtcttcatgcttcatgacagggtctcactctgtagctcaggctatcttgaaactcactatgtagcataggttgaccttgaatttatagtgagccggtctcagcctcccaagtgctgctattacaggcacgcactacacctgtctgtgtttatgcaactacttatccacactaataaattgataagctagtgcatactaattggttcattcctattttcaggatataatcatctctaaggagatttttaaacacagaaactatagcatttagtgatgtacatagtagatagacatgatcgcacatagaaaaggagaccaaaaacagattgatcctttattagtgccatggttgtgaatagcagtggttcatttggtgttttctttctaaaaggtccatggcaaacccacaaggcacagtcagaattgtaggttgattaacaacaaatctacccattcagtgcggggctgaaaatagcaagctgttccctgtgttcgttcttctgagggcattctcctggacgggccccaaaggctgtggccatcatccttctcatgacacagagtggcagggcactgggagtgcacagggtgggggatgggcaggggataggcatttccacataggctctaggctctgcccagtagatttcacttccttgtgctttacaaagatcactaacggtcaaatgggacaagcactacacaactaacccctattggggtttttgcttaagggggataacttttaacttgttgtttgcggtgtgaattcttcaaaaggccctctgagcattgttactggtgtaaattgcttgtgcctgcctggctttaaaaagactgaccagaatgctcttcatgtggcttacagagttggttcgttgttgtgcttcttgacctggttttatttctacccataatacaatgaaatgtttcactaattaaagaaagtttctataaagtttcactgtgaactgtctctcattggatggcatttcagttgagacattttcctcctcagtgttttctttggaggcttggaagcctttgatggtggaaggagcattagtaacaaacaccgaagcaagcctaaactaaggggacagctgttgtctgattagctgctcagcctcggggttaggaggctccttggtctagaactgctctctagctggacttaggaggccctctccatctcctccctttcttcccctcctctctctctctctctgcctctttccccagctgggaactgctttccacaagccctttcctcatctccttatctttccagtcagcccctcagtgttttttttcccaagtcctatcatatcccttcactgccatccttaccttgggctgcctctaaccacatcaaccgaaatgctcacagcccaccaagaagaag

SEQ ID NO: 30233 - DNA, 1197 bp, Mus musculus
caagactttttcttgcaacttgaccttattcccctagttattcccattcaacgttacaaattagtgcttgctgtgtctccaaaacaccaagctggggctatgctgctatgactcagtagtagaatgcttcatcgcccgtggtaaatgtcctatgtttaatccttcggatcaggaaggaggagagagatcatgactgtttagagctacaactacaacagtaaacaagacagagtgtctgccaaaagccaagaagacttagactcttcatctaaggtttttgattaaaacaaaacaaaacaacacccccctcccccaaacgttagaaatcaccttatttgttattctactttcaggaaacagactcaggatgctaagtggcttatggaaaggccaggggagcagtaggcttgcgagcttggtcacctgatactgaacctgttttcccaccttatggctgatgccatctcagttcccaggattgccttgccctgcccgattgtatgtgtgtgtgcttgctagtataagggtgagcagcctctccatccagaagactgttggtgtggataatgaatactgtggccacctctcacctgaccccgtgccacatggtctccccataattctattgtctttaatgtcttagcatgggagggggcccagtctttaaggagcacagacccccttcatgcaagaggacttcttttcttttcttttcttttcttttcttttcttttcttttctttcttttctccttccttccttccttccttccttccttccttccttccttccttccttccttccttcctttaaagctggaaggggaagctcttgagttagaaatggccctctcaggcctcttgagagtataatacaaactggatagtcagcaggaacccagcttccttcgcttacacatctaaccctggctgtttactgccctggggcttccccaccactgtgtggctccagctgttgtcctcaggaaatgctggcttcttagtttctcctttgcaagttgataaaccgtggtgtggttggctctccacccaggtaggactcgagagttataaacaggcctgtgagtaagttccttaaaggattcttgactcctcagcagccttttcttcagtctattcaaaacatgatcttgtcacatgacactcctatatgcttccttcaaccttgtcagtctga

SEQ ID NO: 30234 - DNA, 2128 bp, Mus musculus
gtgctcttaaccactgggtcatgtctccagccctgacttctgacagtcttaagtagtaaacacttactaaggaggatagccagcacatgggatgctgatttaggaagctcgcacattcaaggcctgcctgagctacatcttaaggccccatctcaaaaaaggggcttctaggtttaatcagatccttgaagtgttgataaaatacatcattaactgaagggattcgaacctgctgacggataactaggctctcctggagaagcaactcctgctgcctgcttggtgtaactgagcaacaaagatcaggcatgttacaatgaggatttgatttggaggaacacaaaatatcatactatgaagtggttttgttaggaagacttggaagcaggatttaaaaagcatattcttgtgcacagtttgtttaattttcgtatattgtgacttcatgttgttaaaatcttaagatacatggtctcctttggtgtttcagtacagattttagtatataatgttcaaacaccaagagaaaaaaagcaaagaaaataatgcagaaaggttaaggatagagctcagttgggggagtgcctgcttagcattcttagttctgagtggacccccagaacatagctaacatggtgtgctagagcacacctaacacggtagcacatgcttgacatgccagtgactgggcagtaggagcagggtcatgagaggttcacggttgtccttggctacatgaggagtttaagaccgcctgaggtacctgagactgccttaaaaacaagatgtttttgataagcctgaacaaaacttttctacctagaatgtggaaattcagagaaaagctgttacaaagaataatttttttcaggttaacaagtatttcatattggtgaaaacagacattctatatctaggaaaattttagatgtagcctttttaaaagctgacaaaagtgttttactataatgctgtcttctattcttttctttccgtttaggagcctccagaattcccctttacgaatctggaccagtagaagctgtcactattgactctgtagatttggctttacttttaactttcgctttttgacaacaacaacaacaaaagcatagcactatctttctaagttcatcctgtgttgacagtagttggtgctggattgcctagtccatagtgaagatggagcagcactgtctggagctgtccactgtgctagcagagcgtataacggcttcagagttctgtgcagcttcaagctgaagcacagaatcagagcgaaagaaagcacactcataaaaacaaaaaataaagcatagctgtaatatgatttgatgtgattggccgatactcctaaaatcagtgaaatttgaatagaaatcttgtactaatttgtactgatccaacccaaaaagtctgttcatggatggtgaaaagggaaaaccaggcaagaaaggaggaggaagcttgtctgtctgtctgtctctcccgtgtccgtgcttctgcacattctgaaggcttttcttggcagttttgtcttacagctgtttgtatcagctcggctgcgactccactggttttccctttcactgtccatccgtgtgtgcgagcgatggattaatgcacacaccgtgcatacaggcgtgtgtgctctaaaaagtgaaaggtaaaagcagagcttagcagccgagtcagtactgacagctacagagccaggtccctgcctgccagccggggggtggggaggggggtgctttgccggaggacgggaggggaggacaggcgacgggcaggtgggtgccagaaagtgtgccctccccttcccctccccctctccctcctatctctctagttttggcctcctgttattgtcaagtttgatattgtgaaagagccaccccaattttgatttttctttttgcagtaaagacagagctattttgaaagaacatatacaaataaccctttgctcaaggagcgaaggtttgcacccagctaggagagtggtgattcagactaaagacttttgttcaacttagggcccaacgtagaggacgtatagaatccagtctaatctttttttgatacttttcttataagtcatgaaaaacttaaataataagaa

SEQ ID NO: 30235 - DNA, 1169 bp, Mus musculus
cgcctgttccctgctgttccttgccctacatgctattaaatgcttaacaggttactcttaccttcctcgtttttaaggttggactagtaattacagtgttatactgatgattcaagaccgtcactatggcacacacggtgacaactgtggtgaactacaggtttaaccacaagcaattgttgttgcttttgtagtggaccaaagtcagaggtcacatgctgcgatctccttctgtgatggggcaacccccaccatcaccacacccactggaggcttaacccagaacctcacacatgctaagcaagctctcaacgtaagggagctatggccaacagagccagactagcaggccatggctgttgacttgagaggatttgagcccccttcaaccccaccccacccctgggaatattgttgtttgaggaatggcattcccactagaaggctgctggggagagacagatatcagccataaccactggtcattctgcaccctggagttggagatgaggacttggtcagcaagcgggaagctgtaaaattggacacattcaagattaatcagaacctggatgctcttgagctctgacagaccagggttaagaagggggtactactcagacgtggcccttgaggaggccataagatagggaaaggaaaacaagaccatttttggtttgttttgacagggcttcttggtgtaggcctggctgtcctggaacttgctttgttgaccaggctggccttgaactcatagagagatctgcctgcctctgaatgctgagtttaaaggcttgtgccaccacacccagctcaacttcgcctttctaaaaggaaaggtaggagtaggttgtgtgtgtgtgtgtgtgtgtgtgtgtgtgtgtgtgtgtgtgcgcgcgcgcgcgcgcatatgtgtttgctgggaatccaactccacctttctcactctggctgaacaagtattgtatcactaggctatccccccaccccagaaggctggtttttgttttttgtttttgttttttccaaagtaagactatctctataatgcaaaacctaccagaagttctctttttctgataagatttttatcagacttatctggttgccccaaccagagctctgattgtaacctacttgcatcccactccttgcatttcacagtaaga

SEQ ID NO: 30236 - DNA, 1146 bp, Mus musculus
ttttggttgacttatgtaatttttgaattgcatcattgatggcatatgtgctaaggttgtaaaggaggggctgggctcatggttgagagcactgactgatcttgcagagaacccaggtttgattcccagcacccacactgtgtcttacaaccatctctaaccccagtcctagggggatccaactgacaccctctctggcttccgaaggctttgcacacatggtacacagacatacatccaggcatcaccccttctcctaaccagcacactcaggatggtaaaggagtctgtgatgggtctgacccagcacccacactaaaccgaggcatgtgctgacatcagaggcagaaagagtagcagaaagggtgacactcagacgcttttgctgcggtcaccacacaagcacacaccacactggctccgcagagggaagcgagggctaccgaagcttagattcagggttggaaaagaaaacagacatctagatttgaagtgaaatttttcccttttgaaaattttggcaacattaaacccacgtgcttggaaagaattgtgtgggacacgtaaacacatttgtaatctgactccggtaatttgaaatctgatttccattggaagaaattaatttgttttccttatatttcagtaaagagaccatcataaattggcacacctatgcatctgtttatatagacaaggtctcgggtagcccaggctcattttgagctcactgtagtgaagggtggagaactgctgatgcttcccgtgctcccacacgtgctagggcttcctgtgccaccatacctgctcttatgctggagacgtagcccagggctccttccatgctaggcaggcatcagaccaactgagttacatgtcagctctgagatgccttaaaatacgggcattgttgacatacatcattaaacccagaactcgggaggcagaggcaagtggatctctgtaagtttgaggccagcctggtctacagagtgagttccaggacagccagggcaacatgaagaaaccctttctccaaaccaaaccaaaccaaaccaaactaacaatgacaacaacaacaacaaccagaatcaaacaagaacaaaaagaatacaatagaatttgaagaactaaagcatactttgt

SEQ ID NO: 30237 - DNA, 1199 bp, Mus musculus
agccctcagcacctgtctcatagcaaagcattagatagctgggaagaacttgtttctctctcatatctgggaaagttgtttttccaaggaaatgctattgcagcagaaatctgctcattgggaagaatggtggtatttaagcactgccttgctgggctggcacagcctggagtggtagccctggggctgaccttggagccagatgttattacccagatgttgggccatcagctgcatcccaaacccggactctgcctctgcaggagaagactcaccatttggcaggcagaatgattgaaagctaaaggaaagattgtgaagcccctccctccgcagcatcaattccgccaccctcgcctgggcttccttgagcatggagggagaagctagcaagacatcctctatgctttctggaccttagatcttaagaggggtggcgacaccccctctggagcgtcaccctgcctctcagtgaagtcactactgatggccttcctctcctttgctcatttttcttgtagttgagaacgaaaaccactgtgattttgtgaagctgcgggagatgctgatccgagtgaacatggaggacctgcgagagcagacgcacactcgccactacgagttgtatcggcgctgcaagcttgaggagatgggcttcaaggacacggaccccgacagcaagcccttcaggtatgagctacacagcagacaggtgtgtctgcaccatggaaagggttgctggagagcaactatgtatctatgaggctttgttacctcagtagcttggcgtgaggtgaggtggggttaatcagcgggtgttaggaaaaccactttgttgccgggcaataaccactttgcattatcatcttagctaggtgatgctgtggatattggcattgctgcccgtgtttacaagtattagcattcaaagcgccgaaagtgtaagcaacctcctaaagtcctagtagttagggaaaggaggctgttctgaatccttgcttttttggttcctgagccctagctcctgactttgtggggtttagtgcctgtcccacaccctcacaggatgcagctgctgggtgacatttgcccccattcatttgtcttaaacagtttggactttctaaggctcttagcttttcaggtatcttttcattataaagcatgcaaggatgtctgtatgcctgtgtttgtgtgtc

SEQ ID NO: 30238 - DNA, 3597 bp, Mus musculus
tcaaggtcactcatgaatataaattccacgcagaaggaaactgagccacgtgctctctactcagggctccagggtcgctttgcttttcctgaaggctacttgggtttttcttttaatttctctcggtcccataatcattgcatgagcattcgccaccaccgaatgctggcgctggtactcctggttttctttttcatttaatttgttatcatttctaactttttttgttttgtttttttaacttgcagtgcaagcttcgcataaggcctggcaagccaaggacgcccccccgcattcacctgctttggcagtagtagcgtacctctgtcatctgtgtcctgtttgattcgttgtttcagcctttcccccaaatatcagtaacttagctcattttactgaatgttgtcaggtggtggaaaaccatagcacaagtggatggcatcagcaagcgcgcgcgtggctggactttgtttctcgaaagtcgatttgccttgtatgcctgttccaagtggcggcaggaagcatgtctgtcccttgtatgtcgctttggaccgaggaaagtggggtaaaataactacctgtacgtctggcggggaaactcaccgcctcagcagctcagctaaaaccctgagtagccatgacaacttgcattttcttagttgtgcatcccgtgcttgcacacctccagaattacctgtctcttcttcacacttgccacaagccagcggtgggctggaaagtaggcagaaacttgagtgagcatccgagatagcttttcccctcctatggctttttcatttaatcgtttgtttatttggcttgagcctatgatctggttagactgtcttagggatggagtctgcatctgaatgcctaccttcagagccaggccacagctacagactggcacgagaaacatgattacgttcacccccaccagggcgtcccggacactctcacgggtccagatctcaaagaacacctcatttggtactgcttggctaaagaatctttggttaaggaggctggattcccacttccctccagcctctctgcacacacacctgcatttgctttaagcaggctgaggggggacttggaggctgactctaggatgtggctacttctagtaagttttcatgactcaccatgagaaaacttgctctatacattgtactaccggtagcacaagtctgaaaggacgtcctcagttgaaggtggcaggggagtgaatggacagtgcagccgctactcaaagcagagatagaggcctgatagccagcctctggtccacttccttgctgacagtgtaactcagttgcctctaaggagttgtcctccctgtcccctcactgtgaccagttccatctgctatgactcttgggtccttcagttacctcacctcaccccatgaggattaactcagaagccaggacatgttgcctgctgtgtaagaactgagaggggtgcatcatttgtcctgtcatcttttccctgacgctcctgtcacctgcttggccacccccttctaaccagatcttggctcttccctctcatttctcatgaacccaggcctccgcctctgcattttcctctcacgtcaccagttacacgtgaatgggacaatgcaggctgcattcccctctgtcacacacacttaaaaaaacattgtccagccagcccctatctgaccccagccaagttttgtgttatcttttacctccccatcgtaagaagaaagcagtggcctttcataaactaaattaggcttcgttagacaaataaggacattggcttcactggggtgtagaccaggctggagagcagccacagccatcttcactggtgaaggggatagctccaacacagacatcggctttgcttccatttttctagctagctgtggagcagcagggactaatggcatgctgactaaccgacgctgcgtttgcttcttcaccgggcaccacgtaagagcttgagcactggtgtcctctgcttgttccggccactgcttgtgtgagctttattttgtgtgtgtgtatgtgccttggaatagaaaacacccctttgcattcaatttctctcatccctaaaagcttttaaagacatgctcagaaacaaacaaacaaacaaacaaaaaacccaaacaattgacttttttgatgccaaaattattgaattttttttgcattaagtttttgttctcagtaaaataaatcctctggagagtcagggaataagaagtcaagagaatcctaaagaagcttaaaaaagagaaaagcattgcttctgcaactttttcctcccactgctcccgagcctctggtagctggttattgctgctctttctttccgtatctatacctttcttcacagtagtccctggctctgcacggaataaacgatactctcaaatctaactggacgtgctttcgcctttgcatgtaagtacaggagtaagaactcggatctttctgtttcagattagggaaaacaaatggggcagatgaggtcttcttttagaaggtgtcctggatagtctgagtaatctttttttttttctttttctttttttttttctttttaaagctaaatactggccacatttctattttacccgacagtttatgcttcctcttgatgtcagaggaagttggggattgggtactgaatgttgtgtaccactgttgtgtatggcctcctggaggtcatgtagagggcctttgattgtgacagtggcaaaaagctggggaaagattcccactgtccacgggacaaaaatcctgaaaatgatgtctctgccatgctgcctttctgcttgctccctgacattccggatctcaggctagtggcttctcctttatgctcagtgcacaatggccacttctttttagtttttggttggacagctttggcctctctgcacggtgagcatcttctgctccttcaggactgtggtcccctgtaattgtcatctgtgctgtgggaggacgactgagtacttggtcagcaagtactcgggtagcagttgagaactgttttctcagcttgggctctgtatgaatcgatccagaagggtctctctcagccaggggagctcctccacctgaggttaggtgtgggtttcttgctttcgtcctcctttactttgcaactcaccagcaacagctcttgcttcctctccatcccgtgcaccttgaatgggtggacttgactctctcactttcctcacacacccctaagtgttccacagagttggttgttcaggcgtcccctacccacatcgtactgtctctgtgtggtcctcccagaactgtccatctgaatcccccagctttgccattcataagtgtctggagttgtcaggttccaaaagtcttagttctattgacaggacatttattatggagtcattaagtgaatcatgacctacagagtctagtttgtatgtaggtatgaagggaattttaaaaaataaattgaaaattaagctgtgaacagcattagaactttgtctatttcttgattttaaaatatgctgataatgccttaaactgtagttgtagaattgtcattttttgctgtttgaagata

SEQ ID NO: 30239 - DNA, 2212 bp, Mus musculus
tctgccttcatgtgagtgctcacacacaaaaccagatgtatgttggaagcgcaagcatgtgcacgtatttcagaagaaggctctgtaggtagagtaatcagtggggtggagggtgtggcggaggaaagcaagctgaagggagagaaggtccagggtgaggccagtggcagtaaagggaacagtgggccatgttactgaccagtgtggttttgtttctttccttgatccagatggacagctcccagttgatccactgtcgggagctggtggcatatcacctttctgctctgcagtctgccctgcctctaaattccgtttatgtctaccgtcccctcaagcacaccctggtaacctgtgacaaaggagcattcaaattacatccctcctctgtctcaggcccagatttctccaaggacaacagcaagccagaagtgccagtccgaggtccagcagccttccacctgcatctccccgctgccagtgggtgcaagcaaacctctgctaaacggaaagtggaggagatggaggtggatgacttctacgatgggatcaagcggctctataatgaggacaatggtcctgagaatgtgggttctgtatgtggcactgatttatcaaggcaagagggccatgcttccccctgtccacctttgcagcctgtttctgtcatgtagtttcaggtgtcagcttccagtgcacacgaaggctgactactcggggtgagactagaaacccagggaaggctgtggagaaggcatgtgctttatcagactgactgaagtgagccaggaaaaaaagaaaaccactcttaatctttcgtgcggttacttacaatccaacgtaatttaatataaaggctatatttgtagactcaagatccaaaatatatttaaaagtaaagcaaaagttctttgtactatgtcagttccaccattgttaaataagtttgccccatgtcaaaaaaaaatgtttagcggaaagttgcaaactctcagctaggaaccttgttccagtgtccttattttcctcttgccttttcttgcctcggttgaatacttaactaagctgtgtgcttgttgatctatgtattctgacttcacttgagtaccacccaccttttcttttaaagtaattcagtaagtaaattatttttgtgtggcagccatgtttaatccacagttcaagtatgttagtttgaaaagggcactttgaagctatccccatgaatcagtggcagtaggaaaagttctctttttttgtgtctcatttcagtttttagtttaaaattattattgtcctttttttgtttatcttgaagctcaataaaatggcacgtaattaggacattttaagcatttttgacatttatataaaagaatttctgataaggttaatatatccaggtgctcaccaaagaaacatgtatgtaatatacacgtagatttttgtaactgatctgttcttgctcatttataatccgtagaagcaactgtctagatactggggcagccctgatttgagtctgtaacttataatttaattcattaccctagtttcatattatgccattaggattttcttgataaggaattattcccttgtttctctctgagcaatgtctggaccctgagctccctttgcagtctgaaggcactgcagtcagaaccatgtactgctgataaagcctctggtagcaataaaatgttgtccttaacgttggtttgtgtaggagtttttgttggtctgttttgctgatgagaaggtatggtttctgacttcttggacactttgttttcaactaaggaaaccagcaaggagcctaagcacaagcttagacagggtgttgggtgtcctctcccattcctgattttaatggggcttattaatggttttattcatttaggatattggccatgagtttgtcatacataacctttattatgttggaatatgtttcctacagtcctacttgttctagggcttttattcagaatgcatgttgaagccggacagtggtggctcacgcctttaatcccagcactcaggaggcaaaggcaggcggatttctgagtacagagtgagttccaggacagccaggacttcgaaaaacaaacagaaaagaatgcatgttgaatcttaaaaaaaaaaaaaaaaaaaatttaaaaagatggagggggttgactgcaagtttcacatttgtagtattttcttc

SEQ ID NO: 30240 - DNA, 1199 bp, Mus musculus
agatgcagccggggctgtgaggccgggcggcggcggggaggtcggatgcgggtctcggggtgccgctgaggaggctggtccctgagctcggagacgggtccggacgcccccgccgcgccggtccgtgacgccggggccgacacggtgagtgggcctcccgggtggctctgggtttggtggctccgggtctggatcgcggtttgctttgatggtggagtcccccagccgcagctgagggactgacaggggctccagggtgttctgaggctatacggtgggttgacagccccggggcttcgcaccgttactgagcccaagtattaggctactgctcgctgcgggcgtactggactccccactgtctccccagcatcccccaagctactgggccgccctgtctcgagttgcggggctcgtcaaagctgcagaagctgcgggggtagcttggaggtgggctccgcgacgggctcccggggcggggctccgaagccgcctccttccagttctttgttcagtctcgagactccccctcccttctctcctattgtgcaacgccccgccccagaacccgcttcggtggcttcagtcttccggtcccccgctttcctctagggcctagagtctagttagaagtccctgctgtgctgtccaggtgatgcggacagtaggggacattacgcttcttggacacttttcctgtacgtcaaacgctgtcggccacagagctgatcagaactagccctggccagcggaggtgaccgagatactgcccccccatgccacgcctccatgtctttaggggaggattcccctgaggctggcggacgtgaccgatccccccctcacccggttctggcttgcgtgatctggggcgcccctagctggagggatcgcggccagctccttctgctctcacaccctacgtatccggattatattcttaaccggccgcggtgtatttgctgcagatgaaggatttgggggccaagcacttggcaggtggcgaaggggttcagcttttcggattgttgaacttctacctggaacaagaacagagataccaacctcgggaaaaagggctgatcttgatggaggctaccccggaggtaaatttgagaattgataggacttgggggaaggtgggaaggtaactttttggttttcctcgtaccaaatcagtaccaaaggctaaaaagtta

SEQ ID NO: 30241 - DNA, 1209 bp, Mus musculus
ggactctggtgaagacatgagttgtggagaggagagtctcagcagctccccacccagcgatcaggagtgcaccttcttctttgacttccaagtggctcagacactgtgctttccaccatagaggtcacatgtctgtgtcagggtttaaagtgtgtgtacctatttcaaagcaatacttgggggtgtgggtagttttctagtccagcccccgtctagacaggaatttcacagactggaatacctaccttctatttattattcagatcagatctggcctattttcatatttaatcctaagccatcaaatgggttagtgcctcttaacagtacttaaaacgttggcactttattttttgttgacatttatcttggggaggagggaaggtgctgattccttcattcctttcaggcctttgaaagatgaacagtgtagcctgtctgaaactgtagagccttcaggtgtctttatttaataggttgggagtgtgcaagggcttccttagcagggacagaaggcaatcctttcatggtttatcttggatttccttctcccttgttctcagaacagagactgcagtactcttgagtgtcaaacaccaattctgtttttctaatggtggtgtattgtccgatacagatcctacatgttaagaattgacatgtctgtgaattttagttcataaatgtcttgagctttctgctgaagcagaagttgccatcaagctaggactgttagttgcattcttaatacctaagtattgtcagactgtagtattattttagtgttacctaaaaaagttcataatctgctagctttgcatgcacctgtgtgaaagcagaacagggaatggagttgataagtgctgatttagctcatctcactttcttgtattaaaatatctgcatgattactttctaattgttttataattcacatttcataatgtattgtatatgggtgccaagatgtgaatatgaagtgaaagacctccagtgtttgtagtgttagtttaaagcaattctgtgtggtgatggagccataaggatgaagatgtgtacactctgtacactgaagcttttgtacagagaatttttaactttataaacctatgtgaaaatgtaaatctttaaaaatgtacataaaatactgtatttttttacctttgtgtgtgataattggtcagtgcatgtaaatataatttattgtgt

SEQ ID NO: 30242 - DNA, 1161 bp, Mus musculus
gacgagtttgactgccacatccttgatgaaggctttactgctaaggacattctggaacaaaaaaatcaatgaagtctcttcctctgacgataaggatgcgttctatgttgcggacctcggagacattctaaagaagcatctgaggtggctaaaagctcttccccgcgttactcccgtttacgcagtcaagtgtaacgatagcagagccatagtgagcaccctagctgcctttgggataggatttgactgtgcaagcaagactgaaatacagttggtacaggggcctggggtgcctccagagacgattatctatgcaaatccttgtaaacaagtctctcaaatcaagtatgctgccagtagcggagtccagatgatgacttttgacagtgaaattgaactgatgaaagtcgccagagcacatccaaaggcaaagttggttctgcggattgccactgatgattccaaagctgtctgtcgcctcagtgttaagtttggtgccacactcaaaaccagcaggcttctcttggaacgggcaaaagagctaaatattgacgtcattggtgtgagcttccatgtgggcagtggatgtactgatcctgagaccttcgtgcaggcagtgtcggatgcccgctgtgtgtttgacatggcaacagaagttggtttcagcatgcatctgcttgatattggtggtggctttcctggatctgaagatacaaagcttaaatttgaagagatcaccagtgtaatcaaaccagctctggacaagtacttcccatcagactctggagtgagaatcatagccgagccaggcagctttcacgcttgcagtcaacatcattgccaaaaaaaaaaaaaaaaaaaaaaaaacgtgtgaaaggagcagccgagttctgacgatgatgatgagtcaaatgagcaaaccttcatgtattatgtgaatgatggagtgtacggatcatttaactgcattctttatgaccatgcccatgtgaaggccctgctgcagaagagacccaagccagatgagaagtattactcatccagcatctggggaccaacatgtgatggccttgatcggatcctggagcgctgtaacctgcctgaaatgcatgtgggtgattggatgctgtttgagaacatgggtgcatacaccgttgctgc

SEQ ID NO: 30243 - DNA, 1084 bp, Mus musculus
tcaggcatcagtatcctcatagctttacacactctgatggggaatattgcagcattctcaggactgacatctggaaaaggctcaaatcacttactgctccttgcttgttgactttgttttacaatattgtgcctggtgtcaacttttaagcaacagcactgcctaaaagcaagcagagaacagaatcccagcaccattctataggcaactttttagaattcagatacagtaaatctgttcaagatttatgatgttttatgtaaaaaaaattttgtactacatagctgaatatttttgtttgatttatttgatgtaaggcgtgtgaacattcatttgaatatcacatgttaaagtcaggtatggcacaatgggctctgagaccagcttccccccgcaccccccccccatttgccttgttctaatctctttcttttcaaattgcatttctggtattcataagcagatatttaattttactaataagcatcctgtgtgaatgtactttaaaagccactatgttttagtgttatggtttgtagaattatgaaacttaccttctccccctcctttttttgtcttaaagtcataaatctctgagaagggagaaagttaaaatccaagactcatatcacttgaatctgtggcagattatgttaaaattgagggtgtggcaattaaacctagaacatggacaatattgtgctgtttaaaaattctgtctcctgagtatgtcttgtcaataggtgaaattttaagtctgtattgtacttccaagaattagtaaaactcgcaaataccacctgtatactcaatagcgaatagcaaagggaaggggagcacacaggagtggtaggtcaggtatgcgcctggaaggggttagagagcgccatctctaacacaggctacattccccagtggtaaaatttgatgttggcttaataccgatttaaaatttcatcttttatattcttgtgttttttgaaatattttaatagttttgcaaagtatactaactggttcgtagcttcagtcacagaaaacaaattgtatttcagtaatggtcctgtagcaagcaagaattctt

SEQ ID NO: 30244 - DNA, 1221 bp, Mus musculus
tgtaaatttattttatatattacatatatatggtataaaaatgactagtggttaatttaggtattggttaggaaataagaacttcaaaagtgtactgcaaatattttatttggataaatagataagcatatacttattttctcagaaagaaaccttgtactgtcagatagaaaggatcagagtgagaatcaagcaaagaataattcatgtatgtgtccccccccccccccttcacttccctttgttttggagacaagtcttgctgtgcagcacaggctgaccttgagcttctgatcctcctatatccaccttctaagtactggggttaaagtgatattttactgtttttggtgttttgccttctttaaccactgagaatagatgccattataggacagctttgtttgagaaatgtatgcagtactataagccattgaaatttctctaaaatgtaagctgacatatcatacacacatagtttttgctagcttttctatctgatgtcatcatttaatatctctgtagaaacagtatgagtttaatgatttgtattttagatttgtattgttagaagtcttcattgtgaattactcttttggtgatttgtaacattctctattactctccaacaaaatcatgctgaactacagagacaaattaatttcaacttgtgagagggtagccatggtttaatatcataagacttagatgtttacatatacttgaggctggtctcccccggattttcctccccctctcctccctctccctcttcccttttctctcccccctctccccccctctgttgtgtatatctgtactatatagtgttgtttaattagctaacagtgatagagattcaaacttgtttactttagcatagcttacataagaactaagaagtagtaatacactttcttaatcagtaatacatgactaatttcagaacttttacagggggtgtccaaaggctgcacaggtggtatagtagaggacaaaataggtgaaattcaaagcaacttgtgtagttaggatttagagaaccacattttttcctagttttttttttttcagtgtttttcctagtgtcatatacggtttaaatacttaagatcagtgttgttaaggggcttttagtttattttgttacatactcagggcctccaggttgccctaatgttattatcctttggaaattgatgtaagatattgtaaaaattg

SEQ ID NO: 30245 - DNA, 1407 bp, Mus musculus
ggtgctggggatgaagcctgtgtccttgtgtttctgcaacaggcactttaccatggagccattcccagtccacttttacattttaattatgcgtagaattggatgcaaggccatgtgcatgctaggcaagggcccaaagctattgctttatttgccaatttttctcctgactaatggagtgttaactttagaatggaaatattcgggacactaataaacaggaaaaggaatcactcacaatcctgatactcagacataatcagaaaaaaattgtttagtggatattccttttacattttcatttgaaagagacagggcaaataaaaagagcatacatgcatgcatgctggtgggttttgttttgtttttaagatttattttatgtgtattagtattcggtctacatatatgtaagtataccatggacccgtggtggtcagaggcgggctcctgatgccctagagctggagttacagatggttaagggccaccatttgggtgctaggaactgaacccaggtcttttaccaagtgctcttcacggctaagccatctctagccctgcatgtgtgctgtttgaacgtactcatttcttttattcaatcctcatggaaaatgagtaacacttcatcgctttattgtggcagtccctcaattgctagccatttaaattgtttcaggatcgccctcccattgacttaagtaagggtttaaagttttacagtaagtactgatgaatcccaaacgttagtttccatacagattacttagaaggtttgcgtagaacaaatagctggtcttcacctagtaataggagattgaccttggaattctgcagtttttatcaggtagtgggacaatggggactctagtggataccagtgctgtcaaccctgattctaataaaaagaaatctgattttcagaccagcatcagtttattctaaaattccacaagtgatctaaagtaccagagtgaaagtcactgttgtacttcactacccaatttataaaaggttgcaaaatttgtaatattttaaatattacaaattacaatattgtaattttgttaatttgtaattacaaatattaaattttttaactattaaaaatttaaatattttaaaattatctttattctattatatgtgtatgagtattttgtatgggcctatcagaagagggtattgaagcccctggaattgggattacaaatagttatgagccatcatgtgggtgccgggaattgaacctgggtcctctgcaagaacaaaagtgctcccaattccagacccatctctccagcttcaagatttttaaagatttagataacagaagcctacgttccctgaacctagatctgggacaagtttctaactttctggtttatccctgtctttaaataatta

SEQ ID NO: 30246 - DNA, 2554 bp, Mus musculus
tgtaagaccaacttcattcatgaggaaaagttcctgtccgtgagcaagggaggcatatcctgcgtgaagactctcggaggggacattatcactaagtgatcacatttaagtgcctcttcagagccagggttgctacatcctgtgttgctccgatctaagcagcacagctgagtcctcacaggtctcctcccctccccctccccccacccccccaccccctcgtgcagtctgtgagaaacgggcgcctgacttactgcccgtagccaggttctcctctccttaggaacatttagggttttgttttgtttttgctgtgatcgtttttttggttttttgtttgtttgtttttatgtttgctagcaaaaaccttaattctgcctttaagaaaggtggtgagaagagaaacaaacgtgcactactgttcttaaaaaagaatcttagatgggagactaggccatgcctgagcagcactctgtctgatagcccagtcctcagccaactaattttgctccagttatttaattccatattataattggattcttgacactgaattttgatcccagttttcccaaagaactttcatctctaattctgtagtcctaagttctatgggttcaaaactgtatgggtgctactttgaaggccatgcgatctgggtggccctttcttgaccatgcaacggaccttagagcatgcagccttagagcatgcagacggctcatgggatcacggtgaggccattcacgtcggctccagtcctgcttacgctgtaccagcgagtcacggacaacgtaagaagtgtggacaccatgggcagtggagagctgaagcattagtcttgtttaaactcagtagtagatctccctgccctgtcagagagtgtgaaccttcttcttcccacatgtgtcagtaaaatcattcacagtattcctgaaaccttctgttgtccactaaaaccagagtaccacctcagtctcctatcaggttgacaagctgttttaaatactggtatatttttttttaaatggaattaactcatgtatcatcaattttttttcttgtcattgatgtttattcccaaatgtactttgtatatgcagtatcaggaaagtagatatgcctctacagagggcttctttctagtctagtggttttggaacttacatttcccatgctggaatgttagcaggaattttccccgtgagctctgtataggacaccacctcattgccattgttatgatggaacactgtttgcaagtggctgttgtatcttagggttacaaattcagctcatatgctcaattttagatgacctggatataacaaaaataggatatttttttcagaaaatatccttgattggtcagggttgttcttgaatacacattttgtcattttggccagaagaaatatactaaatagttattaagtaaaaaaagagtaaaattcagtaattttagatgtagaaccatttttattatgaattcttctaaaaaatattgagccttttaagtttttttttttttttttttttttttccagacagggtcccactctgtagctctggaacttgctatatagaccaggctggccttgtagtcatagagagccacctgcctctcccttccaaacgctgggattaaaggtgtgtgccaccatgcccagccatataagttttactttaagtcctaaaatgcctggcttctttttgtacatgaattctgtaataactggtgaatgtataacacacataaaaagaacatactttgttcccaaacaactgttctttaaattcaagacctaagtctaactggagggacagttattccatgttctctgaaatgttcagtattgtaaaaaacaaaaaaaactattgttctcatttatccttataatgtatttattataaaggaatgactgtggattgctgtcaactctaaacacttctgtatgtcagcatttattgaccatctactgtgtgcatagcactactgataaaaaatttattcacattaaagaatatttgacagttgctttaaaatctgagctttgtagtaatgtatatttcattttgtttttattagtttattaaaataagttgaaaattgtatttccagctacagtattaaaaaaaaaaagctagtctcagtagcttatacatactaggaaagctaagactttaaaaatactgtttttaagtatctgtgactgttttaaatgataacaatttgtagagacacagttaactcacttaataaacaatcatcttcctccatggagccccttttcccgcagcaagccgttgttcatctttgtggcactaagtgcagctaagtagctgcatggcccagtgtgcatatgtaaataaacatggtttactaaatgtgtgctgcctgccttctttgtgatacattacagcctgaaatcgcatgttagcgtcaaatgatgtgtcagggactgtcgcagctgtaatcccactgggcagagtgtccattgtgacattgtgcttgaggaacgcagagctgtacaactcttcacttggcaggtat

SEQ ID NO: 30247 - DNA, 1374 bp, Mus musculus
gcgtggttcgtatccccaaggaacagggagtcctgtccttctggcgtgggaacctggccaatgtcatcagatacttccccacccaggctctcaacttttccttcaaagataaatacaagcagatctttctgggtggtgtggacaagaggacccagttctggcgctactttgcaaggaacctggcatcaggtggtgccgctggagctacatctttgtgctttgtgcaccctcttgattttgcccgtacccgtctagcagctgatgtgggcaaagctggagctgaaagggaattcaaaggccttggtgactgcctggttaagatctacaaatctgatggaattaagggcctgtaccaaggctttaatgtgtcagtacagggcattatcatctacagagctgcctactttggtatctatgacactgcaaagggaatgctcccagatcccaagaatactcacatcttcatcagctggatgattgcacagtctgtcactgctgtcgttggccagacttcctatccttttgacacggttcgccgtcgtatgatgatgcagtctggacgcaaaggaactgatatcatgtacacaggcacgcttgactgctggcggaagatcgcgcgcgatgaagggagcaaggcttttttcaagggcgcacggtccaacgttctcagaggcatgggtggcgcctttgtgcttgtcttgtacgatgagatcaagaagttcacataattaagtcctaggtgttctccccgagaacgggcatgttgtatgatataccatatcttgaacattctggacagactctctgggcttgtctgttttatcagtggcaactatttaccagttgaaaagtgagaagcaataatattcatctgacccgttttctcttaaagccatttccataatgacaatgatgatgggactcaattatattttttatttcagtcactcctgataataaaaaattgaagaaataaaaatacctaaaaccaaaaccaaaaaaaaaaaagcatccaggagaaactgttctcccctgccaggacatccaaacaatctctcgaagaaagatgggtgccgaccacccaaggaagcaggaattctgattttaggcataagcttttaaaagcatttttggtaactaacttatgtgcccaaatgctgtcattgttagctgatatgtcatctgtcaggaaataaagaccagagatggtatcaatagaaacttttaagttatcttactgttttctttggatcatgtcatccccatttagtcactggaaatggcaggtatagagttaagaggaagaggaagcaagtaatgcctacattttcctttgtccttactagtggtgtgtgtgtgtgtgtgtgtgtgtgt

SEQ ID NO: 30248 - DNA, 1425 bp, Mus musculus
tgttctgtaatccatcatcagccctgctaagtacttcttacaaatcggccccagtgtgtggagaacgcctggctaagggtaaaggcttgcctgaggcacacatataactttcttttttctccgtagaaggatttgccattttgtgtggcaacctagtcctcggtctttccaatttccttttttttttctttacaattttctcccttatctctgaaatggttttattctttccccacaagcatatgattatctctttatttttaaatattacagctttctaacatctgtctccagggcagcataatcttactgataaaatattccgtgttttccttgagcccttgtcaatatgtctttgtggtaacagcccagcagatggagaaacaggaggagcctcagcttacctgagtgatttctccaggccagcaccaagcacaccgagtctctagtaagctgatcttaatcatcgaagcaattgggaaatcagaaaggcttccgggtgtttgcagtgcccctgaacaaagccaccagtgctttgcattgtcaccaggagacatcagaaattgagcaacgcagcagcctaccgagtttgggttacaactgtttagataataaaagtaaacaatgttctaacattgtttagggcttaagttaagcaagttcccagacgattccagggatgcgctgctgatggcagagaagcagccgccttcctattcctgggggcctcggacgctgcgttcataacaacactgttcttttcacacagccaattatgattctttctctgaacagactgcttgcttttttccttgagcctggtcctagagagacccaagcaaggatgtagaataatagttcatggtatgagtgtagtgctggctgtagagtgactcacgccccttctgaattgtggctttacagaaactcgagtgaaccctgttttgtcaacaaattgttcaaagctcttagtcaccaggacataaagtcttgtgtagttgggttatcaactcgtgaatgaagcctgtggcttacatagctaaaaatctgttcttcccttggagataagagcaataagaaagagatgatatgaaatcaaataatggaatatgggagtgagggagacacacagagtagtgctggaaattaagccaaaactggtaagctttaaaaggatcaagaaataaagtactttttctcattagttctatgtaatgctgatactgactagtaatggtcatgaacatcaacttctaacccgtctaagacacttgttagattactttaaattagaccctaagtaatttaggatctcattcactcacagaaatgctatttgtgacactgtgtcaagagattggtgaccaagtcatttcaatagaaagtttcagacatatcaaaatacatacaataaaaatgtttatt

SEQ ID NO: 30249 - DNA, 1202 bp, Mus musculus
aatccctgggacccacacgttggaagataagatttctacaagttctctgacctgcacatgtaccactgcacacacatgcaggtatgcaatgagtcccataccttttaaaccgagaaggactcagctcctctcgctccgccctttcccaaatgtgaacatactgaggcctgagaacaggaagcctcacgggctgggacagcagacttccggaagcgcccttagccccgccccttccgcccgtaggccttcccgccaccggtctctgctcggcctggcccgctgaggtccattgccaaggcaacgacgccaggatgaacatccgcaatgcccggcccgacgacctgatgaacatgcagcactgcaacctgctctgcctgccggagaactaccagatgaagtactacttctaccatggcctgtcgtggccccagctctcctacatcgccgaggatgaggacggcaagatcgtgggctatgtcctggccaagatggaggaggaccccgatgatgttccccacgggcacatcacctcgctggccgtcaagcgctcacaccggcgcctcggcctggcccagaagctcatggaccaggcctcacgggcgatgatcgagaacttcggcgccaagtacgtgtccctgcacgtcaggaagagcaacagggcggccctgcacctgtattctaacaccctcaacttccaggtcagtgaggtggaacccaagtactatgctgatggtgaagatgcttacgccatgaagcgggatctctctcagatgactgatgagctgagaaggcagctggtgctgaagaagaacagatatgtggttctgggctccgaggagacccagggcggcacacttcctgatgctggggaggcctgcctgcccaagaaccccacaagcaaagacagtggcagcagtgacagcactgatgtccaggacagctcagaggacttggattccatctcctagagcatttcctgaggtattctcttccttggccccgcctcctctgtacccctttgagtcatagcttggcctgcccagtcccatcttgtcccacccttttgtacttgtgctaggtttcttcctgaatgcagtgaaggtgtccacagtgttacccttgccgcattcttgctaaaaggaagatttcttgttgaaatccaacaagtgtttctttttatagaaaataggatgtgttgaacg

SEQ ID NO: 30250 - DNA, 1383 bp, Mus musculus
tcataggtgctttataccctgactagagatagtttacacctgagatgtgagaaaatgggttttgagaaaagcagtactctccgactatctggagataatttggtaataaaaaaataaaataaaataaacagtattaattggtctttggaaccctgcacctgtagttaggaatctagtgtggctagagaagccctgctaggcactgattataaatgctgttcttatagggaccagcagcttctcaaagttctatggtaagggaacagatggctgtttttcctacaaaaattggattcatcaggtgacaaggtgctcctctcttgaaattacagctagaaaaattaagaattttgtttggtttaaatgagcaaatgtatacggccatttcatttttgtttctaaatagtttcaaaagtataaatgttttatatgtcttggttatagattagtggctcataagttattggttatgattaaaaatttgtaacattagtaacaaaaagttgacttaaaactggtaactctgggttagagtaattcagaacatgtggcatgagccaacccatgggaacaggtctctaaagatacgcctaaattgggtaatattctgtgtaattcttatcctagaaacccgattataatagatatattggcggctacaccttcttgtgtttgtgtgcaggaacggacagccaaaactttgtagcaagtaatgtttttagagttcatttttaaagaaaatagattgtttacactgttaaaattgggttttgcttctcaaaattgtggttgtgctctcatgttacaagagaaattgaaggcttctcctaaattagagccaccagctaaatcggctcctctaaaatctataaagcctcctgagtggcctagtccataaccttccccttatccacagcctcgaccccagccgccgagggaaccccaaacccctcggggcgttgagaggcggaccgctgtgagtacatggagccacagggacctgcagagcagagtccgggcggactctggtggacccacccaaactttaaacccttcagtactggtcattttcctctgctggtatttataacaaaaaaactaaccaccccctttctcaggatccccaacgcctcacagggttggcggagttccttatgttctctcatcagcctacttgagattactgtcaacagcggttacagatgcttttaacaaccgaagagcaagagaaaattctgtttagaggctaaaaaaatagcctgggagccaacgggcggtctacacagctataccttcttctcagcacctcatggtaccttctccaaaattgaccacataataggtcacaaatcaggcctcaacagattcaaaaatattgaaatt

SEQ ID NO: 30251 - DNA, 1173 bp, Mus musculus
aggctggaaaaggtatgaggcagcttttcactactggaacgaaacattgaagataattcactgaaaaggtggaggagtttcttttggcctctggtttcaaaagacgcttcttatagtctgatggttttactatactggttccatccatctagtgactccaataatatctccttagttgttgggaggatccattgatgcgtctcatcattggaaagtttcactgatgtcactcagagttgaatggccccactgatggttctcatggttgaggcaccactggcctgtggtaacatcatatatgatgattggagtcatgtggcagacaaaaataggtttacctcacaatggccaggatgtacagaagaaagaggaaaggaccacaggtccaataatttcttcaagggaatactgtgtgacctaacttgctcttgctaggagattcctccaccacctccttcagctgcttaagactccgtccctcagaactgtttgtctcaattggccatttaagtttaataaaagtaaaagactggttaatgataacaatgcatcataaaaccttcagaaggaaagaatgttgtggaccatttttttttgtgtgtggcagttttaagttattagttttcaaaatcagtactttttaatggaaacaacttgaccaaaaatctgtcacagaatttgagaccattaaaacaagtttaatgagaaaaaaaaaaaaaagactccgtccttagaaaaccatcatttcctctcttcattactgataactgattgggctcattccatttatttgctatgataaacgctgcttctcagtaaataagcactctttagatttgtgatttatgaaccatgataatgacagtagaggcgtcatgaaacatatccttccccctccacctccttgaatctgataatgtcccacagtgaaatacaggaaaaaatactggtcatgatttttttttctgctcacacatataacaaaggcaaccatattgaacttaccatgctatgaaaacttcacaccacatagaaaagctcaagtgaatgagttgtcatatgaagagagagacagaccggccactagtcagagaagttagtcacctataatgtgaatgaaggctccatctttgaagtgtatctctagccacagctgaagctacctcagatgac

SEQ ID NO: 30252 - DNA, 1665 bp, Mus musculus
tgtgtgtgtgtgtgtgtgtgtgagagagagagagagagagagagagagagagagagagagagagagagagagagagaagtttgtggaaaatcaggtaatgacagctcatccttttagaattgtacttcagaatagaaacatttggtgggctgttaggtagctttgattacttgtgggtagacctgctagtattgccagtcctcaagcaatgagctttctgtatcttgtttactagatatatactaccaggtgagtcatttcctggggttctgttttcttttaaaatctttccctaaacttaatatgtattaaaaagtctggcttttcagtccattctttgtgcactgggatggcaattgcttcattatatgacaattgctgttcccaagtcagaattcagtgtgctgatttgacatcagttcgtcccgaataagttcctgttaccaggatttacattcagcacattagaaacttgttggtgtgcttttattcttggagcattttccttagactaccttccactttgagtgctctgtttaggatgttgaggtgttaggattcttgacagccagaaagactgaacccactatctgggcacagtgttcgtgttgctctataaatgtatgctttttttgatttggggttgttttacctacattgtcaaactagatccatgcttaacagtgataatgaaggctttttgtttgttttgtttgtgggtcctccccccccccccaagacagggtttctctgtaggctgtcctagaacttgttcttttttaaccaaaatttggcaaggctgaaaatggaatcctataatcaatgctggccacattaaagttaatagttgagaagtcttgtctgaatttccttgggcaaaaagattctagccagttcaataccctgttgtgcaaattcaatttgctgttataatttgctctcagttatcagttggaaggaggttaattctaatgtacttggaagaggcctgtagaccatctataactgcatcagttgtacagcgttgttgcctgggattctctagttcacataaactcccaagtcttagccgtggtgatggctacagtgtggaagatggtgagcattctagtgagtatcgcgatgacggcagtaaagagcagcaggcagccgtggctgggctcactgaccgtggctgtaagttacggaggcagcacacacttctgtacacacctctcatcagttaccggagtcattgcattgcggactaactggctgactcaagttgtcttgctactgaagtcttgagttggtctcatgcatttaccctgttgacttgagcaccttaaagtcgaaaggatgtctggttgtggctttattgtaaacagccttaggtaaagaggggagtatatcggttaggaaggtgaaaaatgatacttccaagttcagtgggaaaccctgggtttatcccccagcttaagaaagaatgcctaacaatgtttcagaattagattctgtggaaggtgagggtgttagaacagtccaaatttgttattgtagacttgcagtgggaggaatttttaaatatacagatcagtcgacactcattaacttcactgataaaggtggaaacggatgtggcaacacttctaagttcatttgtatatgtttgtaatttgattggtt

SEQ ID NO: 30253 - DNA, 1333 bp, Mus musculus
aattcctgttgtgacaactgcctatgtatctattgattacttacaataagataactttttcttctagtcatagataactcttctataacttgtgatgaacaagagatatgctgatccagtaaaataagttaaataatagatgctcttgggtcaaaatgtccttttatcaaaaattgactggccttttatgagttctttaggtaatactttttgaaaatctttttgtaattttaaagaattttgatgagagcatatcacatcttaaaccagtggtgcacatgtggatttacagctcatggactctactgttcagctttaatttataaagcatacccacacatttaatgttatatacagtatttacatgtagtgaaacatagggataattcagttttatgtaagtttttgcttaagtatcatggcctgccccgagtgactttgtccctttttctttgtctccaggtggtgaagcagtattttccaatttgaagattcatttgaaggtggctcctgccacctgctaatagcagttcaaactaaattttttctatcaagttcctgaatggaagtatgacgttgggtccctctgaagtttaattctgagttctcattaaaagaatttgctttcattgttttatttcttaattgctatgcttcagtatcaatttgtgttttatgccccccctcccccccagtattgtagagcaagtcttgtgttaaaaaaagcccagtgtgacagtgtcatgatgtagtagtgtcttactggttttttaataaatccttttgtataaaaatgtattggctcttttatcatcagaataggaggaagtgaaatactacaaatgtttgtcttggattcaagtcactagaagcataaatttgaggggataaaaacaacggtaaactttgtctgaaagagggcatggttaaaaatgtagtgaattttaaatgtttttagcaaaatttgattttgcccaagaatccctgtctgaattggaaatgacttaatgtagtcaatgtgcttgttggttgtcttaatattacttctgtagccattaagttttatgagtaacttcccaaatacccacgtttttctttatatgtattgtgctttttaaaaacaaatctggaaaaatgggcaagaacatttgcagacaattgtttttaagcttccattaaataaaaaaaatgtggacttaaggaaatctattaatttaaatagaactgcagctagtttagagagtatttttttcttaaagctttggtgtaattagggaagattttaaaaaatgcatagtgtttatttgtatgtgtgctctttttttaagtcaat

SEQ ID NO: 30254 - DNA, 2433 bp, Mus musculus
attaccactgctgccagaaactgctttgggcattttgctgcatgttgagactttgttctaatggcctttcctggagtgttttccatttatcattttacaggcctaaacatgtattacttgttaactgaggctctcctgtaagtaaatcctctaagttagttagatgtggtttagtggtctttctgtcggagtgtttacatgatgactgtggtcgtcttgatggagtcctgcacgcgaaaaactctagttgacagtttagaggacttagcatttttccattttatatatgagttctgcaaatgggagaactattaaaagtagagaaaggagtcttgctgtagataggatgctggggctgtaatgaagatttgatagaatctagaaactaagattttatctgttaaagaaaactaatacttttatttggcatgcaaatataaatatgtatatgtatataaatatcaggaaatagcttcttgctcagtattgtatttgaacagaaggagcagtgctgagtggaactttaaacagtagggtttggtaggtgtctgtaataagaataacatttgaaaagaaggtgtgttactgatgtgtgtaaatgtaagacaaagtttaattttcttcttaacattttaatactgctttttgtctttacaggaaaatgtttataggaggccttagctgggacaccacaaagaaagatctgaaggactacttttccaaatttggtgaagttgtagactgcactctgaagttagatcctatcacagggcgatcaaggggttttggctttgtgctatttaaagagtcggagagtgtagataaggtagtgtgttatatatatatatatatacatatattctgattaatgaaacctggagagtttgatacagtaaacttgtgttatatgttctcttatattttttgttgtttgaaacaaggttctgtgtagcttaggctggcctcaagttgtgcacatggctgaggactaccctgagccgcatgcctctactttccaagtgttggggcagcagaggtgctgaacacaccctgtttgtgccagtatattttttggagagagaggtagatttatggaattatttactgatacttttcatgtgccagccttcctaaattgaaagtgacttttaaaaaggacagagatttgtctgggggcagtagcttgtggttagaatgtatattgtttatgttcagttccaagaggatagagggggtatgttataaacagtatgacaagttggcaaaaagggcccaatttaaaataatgttagataaagtttcccccctttactctgattctcagaatagagtagttctctcagtcaaatgtctacaggatgatcaacttttgattgtcattattttggttctgcactgaggggaagtagcaaccattgtttacattgttatcggttaaaggtgatggttacctagtaatcaattcagttggggtgatgtttcccctacatcaattctcagtgacttttattttatttttttatttttatttttggttggtttttcaaaacagggtttctctgtatagccctggctgtcctggaactcactttgtagaccaggctggtctcgaactcagaaatctgcctgcctctgcctcccgagtgccgctgggattaaagatgtgtgccaccaccgcccggcctcagtgatttttatacttgggcactagtttgtgttagttgatgtcataattactctgtgacttgacagttaagccagttgacatggtattggtacattgtgtgattatttgtaagtattttatttctgaacagtagttaatttttacatattaaagtgaaaaatttaatttccttaggtcatggatcagaaagaacataaattgaatgggaaagtcattgatcctaaaagggccaaagccatgaaaacaaaagagcctgtcaaaaaaatttttgttggtggcctttctccagacacacctgaagaaaaaataagagagtactttggtggttttggtgaggtatgttgtgttttgatgaaatttatgtcaacatttttgtgtgatggcacattaagtagatttggccttctgggtttttcagagttgtgaagtagttttgttttggtaataaggatattgatgtgaacagatctgaagattgggtaatttttttttcttaatttttgagtatctgtatatataaagtaacagatacaaagatgaaataaacaatccccaactgcaaagaacggtcttgttaggtaatgtaggctgtctgactttgtacttctctttttctccttgaactctggacttaagacatcttcctgcttctataccacatagactacaggaatgacccactgtgtccgagttggacagcattcttaactcggaatttagtggaaggaagagaacaggaaggcagt

SEQ ID NO: 30255 - DNA, 2299 bp, Mus musculus
agtgcataaatgcctttttacagcttaatcattttggtcttctgtttagtgttgtatttcaattgtggagcctcattttaagtgttcattctttaagatttaatgcttgctttttctttttatagctaatagtgaaatctacaaaccaaaacaagaacttttaaatctgggatataagttaaagatcatatgcacaaagtaattggctaccgtgttaccattataaacctacctggaatttgtgttggtagcatccagttggcttactagggatgcttctgttctggttggccctcacttgctagatgcagatcagggaagattgcattcccgtgttctaaattcagtccatcctgtgtcatttggaactcgagtgagtttcagtgcccaaactgtactttgctgatgaacatgcgtgtgatctttaattgaagtgaggacttaagcagtccatgaaagtggacctttgcacacttgtggggctgcacacatctaatgggtgtttcgtttttgttttaggaggtgtaaagaaaccatcttacaggacgacattgaagattgcttgatcttctgttgacctaagatgattattttgtaaaagactttgtagtgtacatgacacaattgtgtccaactgtatatagctgccaattagttcctctgttttactttgtcctttgctacctgtgttatgatgactcaatgtggatttgtgttcatacaaatttttatttgtgtggtttcatgttaaacctcaaataaatgcttccttatgtgattgttttcctgcgtcaggtactgcatagttctgtggaaatgtaattttataaagaagcaataatcaagacagacgcagcttattttgtagggggtattggtccacaggaagaaactggttgtagtatcccctggtttctgtgggtgttactgtgcttacagtctaatgcttaatttctctgttgataacttctacaccttttgaataatgtttcctccctgggtatctggagactgacactagtctgttgtgattggtgacacttcctatcacatggtgtgctttcagattatggttctaaggaaagcaccttggtgtgctagggctgtacctcactggcaagtgtcctttgcctgagcacaagtgatgctcttgtttctatctcatcaccttagaaacggacctgttggctaccacaaagctttttaattggctacctttgctctgtgcttatctaacaaaccatgtgtaattcacagatgactttaaagagagtccatggtttgtctgttagaggtaaatgcaggggggaaactggtggccagggtttcatccattctatctgcaattatccactaaggtcagtgcagtgggctgaggttttaggaaaattagcagtagtgaatccatcccaccatagtacacaagctaaatagatttaagcagtttgctatgcaggcagaggaagggagttgtggaaagtcacatggtgtatcttttggtgcattaaaaacttaaaagatttaagtaataaaggctttgagcttttccataaatgtttggcttagaggtctctccacggttccacaaaagcttctgggttggggtacatgtttagagtacttggtcttagaccagtgtaagctttttatactgatatcttttttaaatgcctacaactttgttccaatgatatttgtacttgctaggctgtcaagttaccatgccttggcctcattttcttctggccaggtaccattgttggctattaaaaagaactgtttcaacttgcaaccagagaataggaggtcatttcacatactgttagtaggtatagtatccaagaaagaaatacaattaggtgacaagttggcattgaagattgtcatttcccctgatcaaaatgaataaagtctttttaaaataaaatctcagttaagtcttgctatgtatgactttaagaaaatacaaagatttgagaattgaagggtgagaatgtacttggtcattgagagatcttgaacttaggaaatttctttagtgttgatgaacccacagaaatgtgaactcgccaaggctgagtagtgtgaacattgcttagttggatgaatagacattaaggtcagtgtccattcctaaatatttattttgacaatatcttggccactttttaaagatgaggctcatgtcattgttgggctactaacgtgagtaaccagaaccttttcctgttcaatgtgtgttgttcattagttctgacagggaacctttaataacatttcatgctatcataatcaggac

SEQ ID NO: 30256 - DNA, 1199 bp, Mus musculus
ttatttatatgtcaataatgtttacaaacttctgaatataaatggtactgttttcctttctctgaagctatatatattgtaaattcttggtgatttcattctccaagaatagaggctagaacagaactgggagagagacattaggtcagtaaggaaaccccaacaaaaagccagtcatggtctgaaacttcacctgctgtttctagtgccaagtagcagctacgtagtgatctatgaaactggattacatcctactgtcatgtaatgtgtatgagtgcacacatggtacattggttcgtgtagatgaaatgcatgttttggggagtctgtgagaggacagggagatgaccctgagtgtggtcctcacccatgctaggtctactgcgatgctttactctggaattgtgcatagcatttcatttgagaaagtattctgctgagaaacgtaacctgggtcctctcaggccttcacttccttagccaaggaaatggtttgcttttctcttcttacttttgctgctttaactttccttttttttttttttttctttcatcttttaaaagatgcctgaaaacttcatgcctcctgttcccattacgtcaccaatcatgaacccttcgggtgatccccagtcacaggggctgcagcagcagccttcaactccagggccgctgtcaagccacgcctccttcccacagcagcacctagcgggcggccagcccttccatggtgtacagcagcctcttgctcagacaggcatgccgccgtccttctcaaagcccaacactgaaggggctccaggagctcccattggaaacaccatccaggtatcagtagaactataggggtgcatgggagatggcttggtcagtgtgaactcagtccttcatgttagcttcaaaatggcaactccattttaagagactgtacatgtatattattttttaatggcattggctatacgtaagctttctagacaagagttacatatttggggagtgtatgtttactatggctcagtagctacagtgttttctaaatctagtcagtgcacaagttaagattggctgagtcaccactgtgtctgaggctgtttttataggcttttctttttaaaatgctaagtaaaaatgttacgagttatgtcatttagtgtgtactacctacccagaagttaaaaactcatagcacacacata

SEQ ID NO: 30257 - DNA, 1147 bp, Mus musculus
gggtggcaatagtgaatatgtcatttaaaagtaatttcttctgtgatgtgtttttggtcagagcagaatataaggttggcctctgctacttagtagctgtgtgaggagaaaggaccatttcctaagcctccgtggctctcagtagacattagttggaaccagtgtaattgtagcagtcaggagtattcgtccttgcaggccagggctaacttggcggctgagaagcacagaagctttcttgctggcatggatatttactgtagtgttggaagtcttgtatctgtagctcatgaggcaccactgacggtttcttctatgtgtgcgttcagagttcttcgttcctattttcccatttattctttcgaatgtacttgctggagagcagagcagttctgtagttagacataggagcatgtaggatgcttgtttctctctggtcctagactttactggctgtaaatctagtcatcttaccttgcctttctcttgattcacagatctcctgggaacccgtctggaaagagaaggagacagcctcctgcggactcaggcctgcctctgctacatctgtgcagggaatgtagagagattggttgcttgctggacaaaagctcaggacggcagcagccccttgtctctccaggctagtgtctttgcaaccaaagctgattttgtttcagcgtgccctcagctgaccgagcgctgagctagaaatgcttttgttctagaagcttgctgctttcacctgacttacagcttctggatgcatcagtgtgtgtgttcattgtcatcttcgaagaagccaggtgtgaggtggtgggctagtcagtcaggtgtggatgaagccgtcgggtcagatggtgtgtggcagtttactggagcagtaggtggcaggaaaactgaaagaagcccacggtttacctgctctccctttaagctcctacctctggcagagagcggcagtatgggctggagaatgggatgcacccaacactgaggagagtagtgatgatcagggagtgtgaggttcaagatgaactgaacccaggttagctctaccgcacaggctagagagaaagccaaactgtggagacggtcctaggcctcaagtagagcttaaaatttcccccaaggcacctagtgggca

SEQ ID NO: 30258 - DNA, 1180 bp, Mus musculus
ccttcttggaccatcccaggatcactgtgctgtacggagaacttagtcttggttttcttggctaagactctttcttatagaaaatgttcagctgcacgtattaccagccttacttattttgcttatgaccaggctatccctttttctaacgtattttatttatgttggactaggtattatatgaacttcccaccaacacacagtggtgctttgatatccagtggtgtcctcgaaatcctgctgtcctgtccgctgcttcctttgatggacggatcagtgtctattccatcatgggagggagcatagacggcttacggcagaaacaagttgacaaggtaacaggcagtattaaggcttttgatggttgcgaccgagaaagatagccatacgtgtgcaactatttttaaagtgattttaccaaccagcaatgccactttactggataattgttagatattttgttgttgaaaagttgcaacacagttcgcacaggttactgttttttggttttttttaaactagctttcatcatcttttgggaatcttgatcctttcggcacaggacagcctctccctccattacaaatcccacagcagagcgctcagcacagcatagtgctgcccctgaagaagcctcccaagtggatccggaggcctgtgggcgcttccttctcggtaggtggatttcacttatggtcagggcagcgtgctaccaggaattgtgggacagcacaaagtactgcctatccaaggtggcttgtgccaactgcacgggacagctgaaggatggatagcctgaggctctgggttgtggggggcctgtccgtggggcacagttttcacttcagcaggcttccggagccttgggagctcagattgacggctcacgagctcatttgtccttcacagtttggagggaagttggtgacttttgagagcgttgcagtgccgctgcagcagggagctgagcagcagcgacggcagcctgtgttcatcagtcaggtggtgacggagaaggactttctcaaccggtcggcgcagctgcagcatgctgtgcagtctcagggcttcatcggttactgccagaaaaagatcgaggcttcccagaccgagtttgagaaaaatgtgtggtccttcttgaaggtaaagttgggtttatttttaatttttgttcctgtgt

SEQ ID NO: 30259 - DNA, 1239 bp, Mus musculus
tattttattttattttattttattttattttattttattttattttattttttgaaacagggtttctctgtgtagaccaggctggcctggaactcacaagagatctgcctgcctctgcctcccaagatgggattaagggtgcatggcaccacagccagctatacagggcacttttatctcagtgttttctcataaaacgtagcctgtgacattatttctagtcgatgtggttgggcctttgctctcattcttaccatctacaatgctgtgcacagtgctgagctccctgtgtctgtggcatccattaccagattgctgttagcagtacgtgaatccctgagcctgcacaggccggactggaaacttgctttcctcaagatgggttttcttcgtctgtgtgtgtgtgtgtgtgtgtgtctctgtgtgtgtgtctctgtgtgtgtctctgtgtgtgtatgtgtgcctgtctttctcttccttcttttcttgcgaggttaacggtttggactagtaaacagagaagtgagttccgtcagtatactgttctcatttgttcctctctcccgcctatttttttttatagggggattttggcagttgcttggagcatggcagatcctgagttgttgttaagctgtggaaaagatgctaagattctctgctctaaccctaacacaggagaggtaggaggaggggtgcttctcagcctgtcagcccttggaatatcttacttctacctgaataagaattttccacatggatattaagcacataattataattaaaaccattggaggaaggtgacagatattaatccatcagaactctgtcaggaacattacccaggctcatttcctttaatctttaaaattaatctttctctattggaacatagattctagctacagtcttcttttaaaaatcactatttttatttttgtgcattggtgtttttatgtgaattggtgctttgcatgtatgtgtgtgtgaggacgtcagatcccatagaactggagtcacacacagtcgggagccaacatgtaggggctgggatttgaacctgggtcctctggaagaacatggagtgctctgagccatctctccagccccaagccgtagccttatatcttttcctcttctctattaaagtaagtagaccaattattgcaggtgcttttgtagttgctctgctggaaaactaagacaaatgtgaatggctggggctggaattgtggctca

SEQ ID NO: 30260 - DNA, 1154 bp, Mus musculus
tcacctcagtgatgctggtctcttcttaatcaccgctaatttcttagctccagttaaccagcatcaatagttccagtaatgcaaaggtttaactttagtagttcttgtatcttgttaatcacagctgattcttcagaaccacagaaccttcacaatccaaaatagcagtggccctgaaaaaagtctttaattttacctctgaagtttcacaagccaggcctccatttttctgcaatgttctcaacattatcttccaagctcctacacaacatctcacagagctcttaacagcgaatggatcttctggcccaaagttccaaagtccttccacagtcctccccaaaacatggtcaggttgtcataggaataccccacttccggtaccaatttctgtcttagggtttctattcctgcacaaacatgaccaagaagtaagttgggaagggaagggtttattcagcttacacttccgcattgctgttcatcaccaaggaagtcaggactggaactcaagcaggtcagaaagcaggagctgatgcagaaagctatagagggatgttccttactggctggcttcccctggcttgctcagcctgctctctgactaagactaccagccaagactaccagtccagagatggttccacccacaaggggtccttcccccttgatcactgattgagaaaatgccttacagctggatctcatgggggcatttcctcaactgaagctcctttctctgtgataactccagctgtgtcaagttgacacaaagctagccagtacacagtctctacagcaaatccctctgagtttcagagatgccaggcattttgctgtagtttgagcttttattttccacagttgtttctcacagtggccctgtgggcagaacagtcaactctactgtagggttagcgctgtgcctcttgagcatctgactattatcagattctttgctagttctctcagcaccgttaatgatgtgccctactgtaactcattcacaaggttcctgttttaaagattccatcctttgcctcatagctagtatcttggaggttgactatcagctggcttctttaaagtgtccatttcacatttatgatttggattcagtatttgaatccaggactgagtataagagcatgcat

SEQ ID NO: 30261 - DNA, 1220 bp, Mus musculus
tggcttaccgttgtacgggtcagtcctatatgctgggacagccaggcaggaaggcatggtgctggcaccgttgcttcacatcctgctttgccagcagagagcaagactcactgcatgggcttttggtttccaacaaggccacacctcctaatccttcccggacagctcacctggggacagatcatgcgaatacatgaggggccatgtcagaccaccacacgggctaagtggtttcagaaacataatctgctgagattctcacaaaagggggtgctgcagctgaggagaaagcctgggagcatctcagtgagatgcctgtttaattgggtgcctgctgctgagggtctcctaggagagatgcaggggtcctgagagtccctctgacaagccctgtggctatactgctctgaattctggtaatgtgatacattgtaatactgacagatgggggactgcaaaaggcatttacttaaatgtcatagacctttaactaaaacagcaacgttaagagacattagagaacttggtgggcatggagtgctctgagctctttgctgtttccgctagtggctgcatatccgatgattaaactcttcactgctgttcacatactgagccgttgtgattattgaggaactaatgaggatatgcaagctttcctaaaggagatgcggcagccacaggcctcagcccctggcacacgatttaaaatacaatcttttttcaggaattgtgttctcggtgatgcctggaagagatgcgtgacgttggaagatgattacgaaatacaggaaaggtagagtcatttgttttgtatatattaaatattctgagtgatacagtctgggaaagattatgaagtaaagactggaatcctaaaggctttggtgaaatcttaattacctattttcggggtggcagagaacttttatttagacaatcattgtgtccttgttggtgtggaggtcagaggacgacttggaagtttctccaacccaggcctcctgtcttaacgacaggcctttgtgtgtgtgggtgttttgtctgcaccgtgtgcatacatggtgcctgagaaggctgtaagggggcatcagatcccctgccactgcagttggagagtgaagctgccatgtgtgtgctatgaatcggaccccagtcctcttaactcttaagcagtctgtcttagtcagggtttctattcctggacaaacatcatgacc

SEQ ID NO: 30262 - DNA, 1177 bp, Mus musculus
agcaggcgggacaaaagagcgatctcaggcctcatctcgtctcttttgtaggtcacggatggcgagggggcacaggagctctcgatgtgacctggcgctgtggatgtgatgcacagcagcttgagtgggactgctccgctgtcctcatgagagaacgctttttctgaagatgggaggtggctaatgaaagaaggtgaggtctctcgggcccttgctgtctccagtgcgatgggaactgcacgggtacggaaacttagggcccacagaactttgtttgagtttgggaatagggcatcgagggtggatagctttcaggactaggcgattttattggagcccagtgattaaaacctttgacttctttgtatccttcaaatgatacaaaattcaattccaacaagttttttttacctcctattttactgagaattgaagtcatcaaggaattaatttattcatgtttttccattatatatgcttttatcttatttggatgaaatcaacattttgctgggtttttccttttatttttatttttttaaataaaacgcagcccatgaacttctggggaatcgggtgctatggtacaagtgtttgcttgactgtcaagaatacaaggctgtgtgtttatccttaggtgaggtttttcacaattggcagtgagttaagtgaagttcagtctggtctcatgtaatcagctctcagcacatcggggtttttatcttgcagtgctgggactcaagcccaggatttgtgcatgatttcagtcactgcatcaccaacctacgcttgcctttagaacagatacaattttatcttactgagctgggcttgtctcctagagtccgttttcaacctgggggtgatctttctgaatgggtctcccatgaagctgggagtaaaggttcaggccagttttagagtagaggtctaaccccaccctgtaaaaacattcattttgtttttttagacaggtctcatgtaacccgggctagattagacttgctgtgtagcttggcatgactgttctattgatcatcttgcctccacctccccagtggtgtgtgttcctgccaagcccagttaatgtgctgaaggttgaaccttagggctctgggaacactaggctttaccagctgcaccctatctcttctccaaagaaactccattcacatta

SEQ ID NO: 30263 - DNA, 2880 bp, Mus musculus
ttttgtttgttctttttacatcatatgtagtgtttactaaaatgcctttgtgtcagaaatgatagtcaaaccaggacagtgctcctgggacaggagaggtgtaagtgggaggtgtaagtggtaagaaagtcacatctttatttagctggataacattgattgggaagtaagtcatttatgttaaaggtttttcctggtaattgcttttagatttgctccctgagaccaaaccctccgagtcttaggctctctcagagctgattcccttaggctggtgcagcatacaggaccagtagagttcccaggtcaaccttgatcacctgtgtttctctctcgaaactcattgcagattgccgtttacatttgtaactaaagaagtagctgaagccacgtgtaattgccttcttgcccaggcagagcaggcagacaagaaggggaaatcaaaggcggcagcagagcggatgatacttgaggaatttggacgatgtttgatgagcgtcatcaactctgcaggaaaagccaaaagtgacccctgtgccatgcactgctaactcttgcacaaaagactgaatggaactgtacagaaaatttaaggtgccgggacacttgattttctagaagatagcttaacaattactgtattttaattcagcctttgttttaagagatctgaaactataatattgaaagagaagaaattagtacatttaaaatcttagttaattctgcctatgccccttctaaatttttttctttaaaaatttttcttttatgtattatatatttttttaatttgcttgggtttcttaagaattagatgttctgtcctgattctattgacaaagaacattcataaattatagtgatatcatttataatgtatggtgttgtatgactttgttcagtagaaaaggccaaagtagcatgggtattacccattctttggttacagatccagagtattcacaggtagaatgtccgcataaccagattctaaatgaaatatatttaggagacattttgtttagagaaacaccatccttaaaaaaaaaaaatcagatttttagagtggattctggaatgctgtctgctgtctcgttgggagtatcagaaggggaaacaatccccaccacacttttcagtataatacaaacattatgctttctttaaagaaagcaaaatattaaggggcagtaattttcagaggacaggctgtgtctctgatgaggaatggctaacatggtctggggcgtcttcattttctctgaaggaggtggtatgttttataataattgtcaaagtgattatggctaattactaaaatatgagaatgaattacattaaacattttgtgtcatgatgacagaactcatacgcagtaagtctgaagtctggctcgctggagacgcgaggactcagagctgggaggttatgtgtggtggcgctttatgcacacacttctctgcagaccttctggactgagttcagtcagtgtgtgactcctacctggtttactgagataaacgcgcctcctagcagcttctagaactgcagccagctttttataaaagaagttttaatacaacattgtttaaaacagtgatttggtaagctgaagtatgtgtgctcttagactcgcaaaaacaacctctatattcttcagtaattagaaaccgtgtgaactcgggagcctactataataggacttgagtttatgacaagcagaaaactaggttggaattgaaacattttgtaaggtaccttaatccttggtaattattagcatatgattattgcccttcctacaaggactctagcattgtaagtagtaagtatgtatatatgttcatatgaacatgaaagatatagacaatagaaattaaccccaagaggattccgttactcatttaagtatcctccatttaaaatggttttataagatgacagtgcagtaactttaaatgtagataatgcaggcatccttagcacctcggtctagagtttttaagtaaactttgtacaaatgtaaattagtctaagaggacaaaataatatctaatcaagttatttttcaaaagactgcaataagtttttggtctaaacctaaactttgttcattttgtatatattatgtgttaattctaatagcaccattgtgatgtgtatttatatacagtgtgcacaaaatgtttgtgaattttttattataattgtagattatgtatgatggcattgcttaagattgttttgcttgtaagaatttgaaggtgcaatcaaagctacgagtttggatttttaagaagcctttaacctatcagcccctttccttctgtgtggttccaactgaacaactttttgtattaggcatttgcatcaaattgctgaacaaagttaatagccacattaaatcaccaatttcaaaagattatttggggagggtttggtctataatttttaagccctatttacatcctaaggtagaaagattatatttactagagctattcaaaaagtacacttttctatattgtaaaagcagggcagaagaataaatcatacagaaaataaacatttatactattctgtaaaaaaaagttttgcattttttctttagtttaacaataccagttttaaccatttgccatgcagggagccttttaagtcacctgattttcaagttcatttgacttctgaaaaaattttaaagatgacattgccaattccttaatgtgaattgcattgaaatgagactatgtctgcttttccactgctaaggcagaaatgcctctactttcttttagctacatgaagcactctctcgcgactgactactcttagttcttgtggctctgaagaggtcaaagcagcctgtggtcttat

SEQ ID NO: 30264 - DNA, 1154 bp, Mus musculus
acactgtgtgcatgcttggtgtttgtagcagtcagaagagggcattgagtcaccaggaactggatggagttccaaaatgttctgagccaccatgagagtgctagaaactgaaccctggtcctctgcaagaacaacaattgctcttaattgctgagccatctctctagacttatataatcttgaatagtttcttctttgatactttaaatggcagaggatttgaaaatctttccaaagaaaaattcctctataagaagctacttgattagacttgggccacatagtccatttgatctccgtgaagtggattcatctagaaacccctttactgtttagtggatgtttataagtagggtaatgccatttgtagataggtcattgatacattttgttatttacatttttcttgagtgtatttttaaaatctgctttaaagcctggtaacgggtttttccgcttttcttgcagcacctgggcatctctctagaagcggtgcgatcatggaggtggtgccggccgaggtgaatagtttgcttccagacgacataatggacactgctataacgttagtggatgaggatagtattgaggctgtaattgtgtcatccccaattcccatggagacagagctggaagaaattgtcaacataaattctaccggtgactctacagccacgcccatttccacggaaccaatcacagtgtacagtaaccacactaaccaagttgcagtgaataccacagtttctaaagcagattctaataccacagtgaaaccagcatttccaagtggccttcaaaaacttggtgctcagactcctgtgactatatcagccaatcagattattttaaacaaagtatcacagacatctgatcttaaacttggcaatcagacccttaaaccagatggacagaagttaatattaacaactttgggcaagtctggttcaccaattgttttagcactaccccatagccaactaccccaggctcagaaagttacagctcaggcccagccaggagatgctaagttaccaccgcagcaaattaaagtagttaccattggagggaggccagaggtgaaacctgtcattggtgtctcagcactgaccccaggaagccaactgattaatactacaactcagccctctgtg

SEQ ID NO: 30265 - DNA, 1443 bp, Mus musculus
gactgattcttcagtaatagttgtttgcatttttctgcatcggaagatagttaggatatagtaagggcttcctatagcttaagctctgaaactaaaacctgagctgtttcccctgaatagacttgctgtgctgcctgcagtccagatgtgtcctaatgtatctccgtgctcttccttcagatttacactgtagacatccacagagccgaggactgctgggacaagttcacctccaaccgcacagtaggaatgctcctgttcttagggattgtccttggaaacctgtgcaaagaaaagacggaagaagcaaaagatgctgaagctgttagagtgggaagtgagcagacgagctgagcttggcccctcaggaagcagaggcaggaaaactgtgaggtcaaggcatcgagcggcatagtaggatcctgtctcaagcacaccggctagagtggtagctcatgggaagtgtgggcaccatgcagtgtgcccaaggctctaggttctctcctagcaaataaactcatttgtacaactttcagggcttaagactacattgttaggcttggatgagcaatctgttaaagaagtaagaagcactcgggcagcgtgtactggactttactgcagctgctttcaaccagctccctgtcacagcacctgtcccagggacctggggttgggtaggcccctgtgttagcattctgcaaccttctgtccttgttccttctcatccaaagtttcaggagcttcaggaaacaacttgcataactcatctaatggcttttatgacatggccgtgtgctttattttattcctcactaagaatctccttgtgatctgtactcactgccaaagctgtaattcaagaagccattctgattctagatgttttagaaggatgttggcaaataaagttgttatttatatccatagacgcgactcttcattacagccctgacagaaattttgatgtgtgtttatttcttctttaccttggccagtcctggtctgtgggatggtaacatgctatataacaggttacctttcattgtgtgtctgtggaagcagccagaaaacctaagtgaggtcaagtcaccccccagcccacaagccagggtctcccagtcactcaggacgtgccaagtcgactgttgccccgccagcctctaagctcttacctccagactcacactgcctgcctcactgtcccacactgagcaggaccccctcgcccagggcctgtgggcttactgttcgttggccagagtgaaaattctcacagcaggccttcaaatatcactctctcaaagacgctttgaattttcaacaaatactgcctgcgtttcttttcattcgttttagatttatttttattttatgtgatgagtgttttacgtgcatgtacaaatgtgcaccgtgtatatggccctggtgcccatggaggtc

SEQ ID NO: 30266 - DNA, 1177 bp, Mus musculus
tatttcgccaccttgcctgtgtatgggagctggatgtgggcttgctgagctgagcggctatgtatctagatctggaagacactgttagtttggaggtggggctgggaatggtgtcacagcacttagcccctttacagccactttaaactatttaaatacaccgtgttagttcttgatgggacttcactctgttcataattgttcctaagagcctgcccttagcctttaacatgcttttgtctgcatgtatgtttgcgtaccagaggagggcagcagatcctttttctattacaggtggttgagagccaccttgtggttgctgggagttgaactcaggacctctgaaaatgcagccagtgctcttaacggctgggccatctctccagccctcactttaattttgaaataacatttatttgtatgtgtgaaggaaacaccgttcacgagaggaagtcagagtaaacctggaggaagcatttctctcctgttgtgtgggttccaggtcatcagacttggaggcgagtgccagccctgactgtctcaggagcccgtggagcatctgctaatcactgtttatgtgaacgactgacttggcatataactgaagggctctcttttcctgtgttgaggttacaaggacagcaaaccgcccaatcgctgctggagacatttcgaccttccagtccttcgtcttccttgggggacagctgaccttggcactgggcgttctcctgtgtttaaactactacaggtacatcagatgaggtttcacagttgtgtgtaaaatatctcctctgacatgtaaaatgtggggatagagggggattctctttattacaaatctgcttattgacccctgtgaagggcctgagagtcagcagggcacaggacctcagcacgctgtcagatctgcttccgagacaccgcagccaagagcagcctcgctctgaagtattgtagagtttgctctaggtactcctgataggacacagagcacatccctgggttctcaggtgtgtgtgcaacaatatgtgtgcatatactacgtggcctgttattgctgagtacctggaagcagaagtggttgggctcagttagcaaaaagtggaactgaatctttcccagagactataactagtcaaaatagcagaagagaaagccaagagggcccacatgg

SEQ ID NO: 30267 - DNA, 1160 bp, Mus musculus
acggactgctggggacgcacagccagatcagccctccttccccacgccatgggctctgtcacagcagcagaaggcaagacgggactaagcagatggagcacttacctcacttaaactcttcctttcttttttctgtgtggttttggttttgtttaggaacctggctgctgtatttgccatgcacttggagcattggtctggccgctgacccaggttgttttccagactggtacatgttatcactttttggcactggagctattctgatgcgtggagcaggctgtactattaatgacatgtgggaccgtgacttcgataaaaaggtagtttcaccctgggaaggaacagagaggcctctctcatttttttcagaacacccgatgacatcacacgagtaccattgaaatcctctgtgaaaggcaggcagttgaatagccaccgtcaagaagtgctgctcacttcccttccagcagaagagtggccacaggacaggagcgtgctggagttttacaagtagtttaaaatgtgggagacaagggtgaagaagttaaaggtaggaactgcagttagagactgacctgaaccttttcgtgtctaagaggtctgtctgtcatatcctgccttcagtcagattgtagtttaaatggacctcagcagcaggcacagcagtattggctccaccacagccccgtcctccatttactctacagctccagtacccaggcagcagtggcccagcactagtaagtggaaaattccagagcttcagtgggtatgctttacattatgtaccatccgagtgttaccacagagctcttcttctgaggtagtcttacaggtcctgttttagcctcagttttatagttagtctcttactgtgccacaaaagtataagcaattgtattgaacagtttgttccctcccccctcgtgtgtgtgtgtgtgtgtgtgtgtgtgtgtgtgtgtgtgtgtctgtctgggtctgggtctggaagcaggatggagtggaagatgccagaagccatgtgattaagcacctccatgctatgcagacattggggctgtttgattggccagcaaatgcaaacctgatttgcatgttcccatttcctgggttatttttcattctgcatatgaatgagatttcagattcatgttcaa

SEQ ID NO: 30268 - DNA, 1190 bp, Mus musculus
tttacttttctggctcgtcatagaaaaaacctggcatcttcaacttagaaaactgttttaaatgtagtaataacattctctgacgtgtaaaagcacctcatttattttcacaggtctttgtggaaagaaacagagggaaataactaaagccattaagagagctcagaaaatgggtaagcactcctgcacagctgagttgaactaatttaagattttgctcattgtctttgtcaagaactttaattatcgtgtctctagctgcatatgaatcaaaaaatggcctagtcggccatcagtggaaagagaggcccattggtcatgcaaaatttatatgcctcagtacaggggaacgccagggccaagaagtgggagtgggtgggtgggggagcgtgtgggggacttttgggatagcattggaaatgtaaatgaaatacccccccctcccaaaaaaagaactttaattatctctttacagggtttatgccagttacatacaaggatcctgcatatctcaaagaccctagagtttgtaacatcagataccgagaataaattttgtatttgtgaagttcctgccaataaacctctaagtggttgtcagcagactccaactaatttgagtggaaatgtctttcagtggattaggaacaatcggtcttctccccaccagtgagtgttctctggacaccgtgcttctgatggtaatgtgatattgtacatttcggtaatagtggttccttgtggttgtcacaacttacttgtatagtatagattatgggagaagagggcttctattagaattccaacccagcccagattctgtccttacagcaggatggtttagggggatggttctagaaaggcagagtgtttgtttgaatcctgtgtgaatggctgtggcattgaatttgcttggaagcattttggtgggttttttttttttgtgtacgtgtgcacaggagtttatgaaggccagagattgatatcaggtgtcttccgtaatgtgtctctaccgattataaagttcacttaggctagaccagatgattaacaagtcccgggcagcctcctacctctgcattgacagtgctgggctccatgtgagcaccactaagcccaggtttaaacagaacaaaactctgtgtgctttatgcacatgtatgtatgtgtgagtgtgcacatgtgtgcat

SEQ ID NO: 30269 - DNA, 1167 bp, Mus musculus
tccgtgcagctcaaggtgcagtgagtggctctggccctttgctcccctctcttgagcactggacacgcccagctggagcttgtgaagagctgtctcacttctgtaaaggtggctgctcagcgcttaaagctgggtttttgggagggagtgtgtgctcactgtgcaaacggtgtgtgtgaacggtgtgtgtgaacagtgtgtgaacgggtcttctctgcttcatcaccaggggtccgaatcccagcaaagtgctccagcagctgttagtgcttcaaccagaacagcagttaaatatctacagaaccctgaagattcatctcaccgagaaagggatcctgcagcccaccttgaaggtgtagctgcccttgaggacgacgggctgctgaggaggagctcacagaccagctctgactggagccgtgcactgagccagcctggggctaaaactcagtagatgcaggctttgcagatacaaaggtttctttttctgaatttacaattactgtgaatatttaacaaacacgtggtctaaggtgagtgcagcagtcgcccacccgtgaaagatcctgtacttttctaaaatgtattttccaatgttaagttctctgccctcactggccaggttccatgatttaggtagacttgcgttttaaagagtcaaacactatcaactgaggccctcgtagggtgttgacctttgccctggtgctgccctggcgtagccatagctgaatgcactggaggcaccttgggaatcgaggtctcggggtttcctcctctaatgatctcaagcatttctgaagggctgagttagattaaaaagaaagaaaaagagcgattgtccacttttctctctcttctttttgtttgtttgttcatggtactgggctagaacccagggtccggtccacaccaggcaggtgccccactcttgggctccgccttggctgggccgcctactttcagagtagcagtcatctgccaagtgttaacgccctggtgttaaggagtttcaaaatcagaagctagaggctggtgcttagaccactgttgatttgttgaaaaagaagttatcagaatccatttctgatgcaaaagagactcagagtgggtcctgcatggcgagcccagcacgaggctcctccaccagaaatacctcaccaggga

SEQ ID NO: 30270 - DNA, 1153 bp, Mus musculus
ggagatgctgcagaggatagtttggtaatgaaaagagtaaatattttgtttaagttagaaatcacccatatttccttcccactgtggatgcgctagggttctgaggaggagcccacaggcatcagtagcagtcctgagaacaccattgttggcccccaggtgactggtgaccctgcgctggattcagcccacgccctctgcatacaagccaggggagcgctgtcaccttaggagatcccctctcagtggctgatgtcagtgtcccctgcttttgtgtgtccccccgccccgccccagatgttgaccataaatgagttgcaggcacaaaagaaatggagggaagccttgtggtaggagcatgtccaggaacaggctgtctgcagaggtaaaggatggttgaggacatggtggcttctccttacccaccatgctctcatggcttgcgaggcagaattatggaagcattacttaatacacgtattaaaaatcaatattctaaacacaaaggatgaaactaggactatctggggttacaataaaagctcttctcaattagatcttttagagctgggtgtacattatgccatataaaaacaagcgagttctttaacaacaacactctagtaatgaacattttagcctactttttatagcgtgtacattaaagtggactatagcaaacaaccaccgtgagagcgactgtgaccagcgttccatttgcactggaacaggcgtcatccagtggagtgaagtggtggatgagtggcaaccaggaaggccctccacagcagagatccatcgatggaaaatcgacctttgaactgctgtctgacctggtagcttttgggatggtgatgtctgagaaccagggcgctctccctagtcttccttgtggattcacacagacagttgctgtccgagattaaaggctgcccccacttttgtccctttgcactttgaacagaggtcatggcgacacctggtctgatgagaagaaaggtcgagacagtgtggatatactgtacggggtgagagtttattatatgtgtctatcagccctcagcgctgtggatatatatactgtagagcttatgatatgtgtcaatcagtcctctgaatctttttactgaaactgggatagaaaaataaagat

SEQ ID NO: 30271 - DNA, 1112 bp, Mus musculus
ttgctatgaatataattacagtattttaatatttagttatttaatttgttctactagttggatacagaacacacacattcaagaggaggaaagctgtcgggctaagagaagtttatagaaaaatggctttggtgggattttttaaaaatgtgtgttatgtacataaatataaatatatatatatatatgaaatcaaaacaattaatctagattttaacattttcagatacttagcactaatactatgaacaattctaaaagccctgtgatttgatgaacaacatggggtcactaatggcccaagaaagaaaggacaggccttgacaccctcatggagggagatttcacgcaaaggacagtggctttggcttccccagctctccatctttagccctggtgacaggcacacttatgcactaaaatgcacatatatgcacatgtgtccagaaacaggcatgtggtacaacagtgaccttgtaccctacgggctgaaagcagcttcggaacaaacttgttctccctgataagcaggtctccaggagaaaccgtgaaggctgctttagtgccttatgcttcctaaatttcaaccttcctttctaggtttcagcctccagtctgtgatacatatcaaaatcgaacccaacacttccatttttaaacgctcaaatacacacgtgaataaaaggattgtcagcattaacgcttctcacctgaagagctttgctttgctttccttcctttcagtgttgcccacccctgattgtttctttagaaggatgccggtgtccctccattgcagaaactgcttttgcacagtagggagcggccctgctgcctctggacgctttgcaacagtgttactttacacttttggaaagcagcgccctcctgtggcccacgaccctcatttccccatacccaatggcagaggtgttcaagacttgaatagaggaatgtgtgtgtagccacttgaagcttgctccactgtctgtctaacctgacatgctgtgggatgaacgctcttaaactttccagcccataactagtagatggaaagcaaaccctcgctcactatggcatttcctctggcagctggtgctgtgggcaactgt

SEQ ID NO: 30272 - DNA, 1069 bp, Mus musculus
aatgcagcatcttgggtcagcagcatgagtgccaaccggcctggccttgggggctggcggttccagcatggtgccctctgccagcaaacttgcccgctctccagtccagcttcacagcactcagggtgcctcgcggggatggcctggaactaatttatgttccctcttccttaggtgcagtcggtttcagtcagaaatcaagcgcctgaaaatctcgtccccagtgcgtgtctgtcagaactgttactatagcttgcagcatgagaggggggcagaagatggacctcggaactgctgagatggagggactggcgagagaccacagcctaggaggctcttcacatcctgccgggactccagaggcactgaagcagtctccgtttacacggctcttcactgagtgttggaagtgctgagtgtaaaggaatcattggatcacggcttccgaggccagtgaccggcacgggtactgtgcagtgaacagcacaagaggaagtggctcccaggagcatctcagacctgagtctcccctagtgtagctgtctccaagaacaaaccccgtgctccccaactgtctttcttgcatctcatttttatagagctattcatccttatttggaaaaattaacaaaaacttaaaaaaaggcttctagaaaatggttgtaaatctgacttctttacaaggagctgtgtatattgtaaataggtataaaggcctttttttttctaaataaggacctaattgcctgtaacatgagacttcaaactaagccactaactcaatgaaccatctaaggtctgtctaacgtctcgcaattataaatatgggttgggttttttttttttaatcctcaaagacattatctgtactatttttttttcttgttcagaccaagcctgtgtgcctgatatcatttctttcaagttgcccacagtgtctccacttaaaataggctagtaaccaaaacgatgtagccctgctttaggggccagcgtgggagaagaggtctgctcctaaggtaacgtgtaaatagccaatggtctgaggctgtgtaccgctacagtgttg

SEQ ID NO: 30273 - DNA, 1194 bp, Mus musculus
tgtttccttttcccgcttggctcctcacagcatgcacgaaccaattatccctcgaggtgccaggcaaggccccagccaactcaagagaacctgcagcatctttgcatatgaagacatcaaggaggtgcataaaaggagatatctcctccaggtaagcggacgctggtacactgaacgcctcgcccctctggtccattggtaaatggaccagtgttgtgagaactgcagcacgcattgctgcctccaatcccaggacatacagagccttagagtgcttttgtgttttcacactcacagtttgagctctgcggccccctctcatgcgcaccccttgctctccaattcaagtgcacatttgtgtcttataaaaatttacatcctcatcacttcaggaacatagtttttagttactatttatcattccatttttaaagatttctttaattttgagcagaataggaaaaaaaattgactgtgtgccttaatatagagataactcatgagtctgagtattctccattcaagaaattcaagattgtagatatctacagtgaaaaagttagcatgtgttctccaatctgtttcatcgtttgtctttctccagcctatcgctgttgaagttttctctggagatggacggaactacctcctggcttttcaaaagggaattcggaataaagtctaccaaaggtcttgttcacggggaaatccttacatgctgctttgggaagagatggcagggcggccggtgggggtggcgggggagggtgggaggaccattgcaggctgaactagcttgagctagctgcttatgtcccagagcagtgaggtgagacctttgcagaagtattcctcccatttccgggcctctaactgctttcagaacaatgtcagctccgtgattaaatagcatttctccctcctggtaacttaggaaagatagtaaagacccatttagagcaataaattatcttaagtgagcgagaactacccaaggctatttcatcacaaagtcttaagagaattaaaatgtcaccttatagaagtaaataaatgaaataaaattaaaaacagaatggtgctttgatgggcccaagaaatggctcagtgataaagggccttggtaccaaagtccagtaagagaaaagtgtatgagagcaagggttccctctaggctccacacacgtgggtctg

SEQ ID NO: 30274 - DNA, 2238 bp, Mus musculus
gctttcaggaatagtgagaggtacccagtctgtgggtgtagttctagataaaccaaaggcttcgcaattgggccaaacgctcggtcacttgcttctgctaggaaagaccacttaatatctttttagcccaggactgttgcccttgggacaagagaagactggaaccacagggtagtttcaaaggaatctcattgagtgatgcagtttagtccgatattatctaaactctcatcttttggagttttgaatcactcattcacctgtttttaaaaaatatcttccggtgcaagtagtagtgtttaatgaaacagcctaaagagtatataatacagatggtatgaaccaggaattgatcattcgtctccatcttactgggtgagggtggatacattgtttcgtctttataaacctgtcatccagcaggtcttttgtaactccctgaatttcaaggcttttgcatatcagtgattaaaagcaagaggagatgaagaaaatgaacaatggatatggttttgagcaggttctaaataagcttgcttgctttatttatttatttatttatttatttatttattcataggcatgcatttcattgcgtctcaactcccccggtgtatcctgcgaaaaatgtcactgacctgaaacttcaggtgacaagctcacctctgcagagctctgatgctgtcattatccaccctggagccatgttagccatgcttgacctgctggcctctgtgggctcagtgacacagccagaagtaagctgcgtcttggtatctctctgtttagtgaatgaagggaccgtgtgtttacctgagtaaggaccgggaagaacatgcaatgtagctggcccgttacatccacaataggagatctccctctgagccaggccttccagatacccggtctagttttgagtatggttaatgttacctgtagggtaacagaaggtggttgcttctgctctgagactttgtttcctgagagtcgtgctcagtgctggcaatgcctcagaggtgtgatacagaaggaaacaccacagtgagcctgtgttgatccgttctgttgtggagcaccaagaagtttggggtgctttcatttggagtgaccatctttgttaaaaatgttatatggtttctaagccccaaagtgtcacaaatgtgaatgaccaacttgcttaaggctagttacctaccaccatgaaaacgactttacactccagatatggtggcacacagctataataccagcacttggaaggcaaaggaaggccattctctaagttcgaggccagcctggtctgcatattaagttcctggctacgtagtgaagccccgtcttaaaaagaaaagagaacttgacacctgcagtttctatgatgggaatatgttttcagataacatgtttcatgttagaaggggtgcttcctgtcggaagaacccgtgtcactaaggatgccccggtgacacacttctctttgttaactttagcatgctttggaccttcaacttgccgtggccaatattttacaatcgctagtgcacacggagaggaaccagcaggtcatgtgtgaagcgggtcttcatgcacggctgctgcagaggtgtggtgctgccctggctgacgaggaccactccctgcacccgcccctgcagcgcatgtttgaacggttagcctcccaggccttggagcccatggtgctgaggtgagttaacgcttctccatacttactctgtaacttagtaaaggcagctccgggagtccttgcgctctgttctgaccctgtggcgaaggcctgcaacctcagggtctcgggaagctgggacagggggatcacagatgcaaggctcgactggcggtgatagtctggaggaccgattgccgtgctttctcacgaggaacagagaatggagtctgacggtgtagctcagcgcaagagtgcttgcctagctagcatgcaggaagtcttggaaccagatcccaggaccacaaaaaaataacaacttgtctttcatgggcttagtagatatttaatgtggacaaaccacaaccaaagtaaacaaactatttagaagtggcacaactccatacctagctctcatgacttctgggcaggaggattgtgagatgagctaaggccagactggtgcaccatgatgactgataccttgactcaatgaatgaatgaatgaataaataaataaggtgattggtaccttgattctaaaaatgaatgaa

SEQ ID NO: 30275 - DNA, 1173 bp, Mus musculus
agaattgggtgttctagttcagtgttcatatttattctgaatggcatcagtttgtgttggtttggaattctgttctgacaggctttagatttgttcacattctatgaataacatagcaatcaatgtatctttgctatggttgatgtgcgtgatctagaaagtgctatgctgattatctgaaactgtgatctgttggtactttgtgcattcagaaggttttggagtcaccacttgtaggtccagaacttttcattatctcaggaggactctccactgactgggcagcagcaatcctcctcctcatgcctggcccctgccagcctctgttctactcttgtcgcagacatttcatgtgtgaccttaagacatctgtccctttacatatgcctcttccattcataaggctcacaaggtttatccgtgttactgtacgcatcaagcctctttttttttttttttaatttattttaaggacagaatgatactttgtcatgtgtgtttgctatattctgttgtagatttttctcttgatagagagttagttatatctactgtttggtgacatgaaagctgctctgagggtctcaccatctgtgtctgagtctgtgttcagggctttcaaaaagagcttgctgctggatcatacagggaccagtgttttaagaagtattgagctcatgtgccacgtgagtatgtggttgacagcaacacatgagtgtgtgtgtgtgtgtgagagagaggtgggagggagaaggagagaggggccatgtattcatttcctgatgtggtacatgcttggcccagggagtggcactattaggaaatgtggccttgttggagtaggtgtgtcactatgggtgtgggtttaagaccctcaccctagctgcctggaagccagtatgttcctgtttatcttcctaacaagatatagaaccctcagctcctccagcaccatgccgcctggatgccaccatgcttcctgctttgatgataatggacctgtaacctctgaacctgtaagcccaattaaatcttgtccttataagagttgccttgatcatggtgtctgttcacagcagtaaaaccctaactaagacacttgactatttcaagattgtgttgaccttcttgttggtgagttataagacttctctttgtctactagatattaaa

SEQ ID NO: 30276 - DNA, 1158 bp, Mus musculus
gaacccccatgtttagtagcgcagggtttagtgagacagaggtgtggctaacactttagctacgtctggagttaaggtgactgcttctaatttatacaatttagtttcgaaattcaaatttttgtgtatgaacatctgtgcatttaaaaatgctcagcctttgacatcatacataccagatttatcctaagttagaggcaggcaaagcatgatataaatatatgtagacttataagggccagagtggaaattctgtctaaattttgtcctgtttaaaacttgacgccttaaaaatgtgttgtgtgtgccacagttggaatgcacctacatcatttcctaagcatttcttttggctgaacttgcactgaaatgagagcgtagaatgctccatcagctgtacggtattttatgtctgcacgtcactgtatctgtagatggcatgctgctcagaagcacggatcgaggaaaacactggcgccctagcttgctgtttgcagttgcctggcttcctgctccttccacttctacttatctgatagctacttgggcctggccgctgagaactggccgaaccagataatctgcacccaaagcctgtgtaagagaagaagaggaactcaggaaggaagggagcaaaagatagagaggcctttggccaaagggaaagcatgaattaaccaataaatagggtagaatgtgcaccatcgttgatgagcaagaagattgtggttgaatccattttatatcctaaaagtaagaaagtgaacgtgtgtggctaaatgtggactgctattgcacctacgcgtaattgctaagcacacagtggggaatccatttggtatcatcatgaaaattgaatgaagaagtcttggaactgtaatattgaatgagagtattaagtcttataagacaagacctgcttgatgtcactgacttccattcttgagttgggcctgttacctagatgttctattttgtttgtatgaggcagggagggtctcatgtagtcaaagctagcctccagttgctgagtagctgaggaaggccatgaactcttgctaagcctctgcctcccaagctgctgttcacagtggttgtggttcactgggtctcactgtgggatgaccctgtgctctgtaaacggaccccagtatagtt

SEQ ID NO: 30277 - DNA, 1116 bp, Mus musculus
ctggtaattgaaagtcaaattggtcctagtctttggaatggttgagacagagactagagtagagcctgcagaaaacaagtgaacaaacaaacaaaacaaaacaaaacaaaacaagctaacaacaaaaaaaccaaccaaccaaccaaccaaccaaccaaaccctccagaagtttgcttctaatgacttagctctgaacagggttagggtagtgaaggaggaacagatagcaacaatgtaacaatgtaacagagctaggagcggggaggaggagactctcacagcaggatgcctgtccaggttgccattcttttctgtaaagtgcgggttcagggtaagatcaaccctgagttaatcagtgaccaccctttggcatcacgagactgcccagagtgctgacatttcccattttcactggggagctggtgctcccagacagaactaagctctgcaatgcacttgcttccttgcggaatttctaggaggatgtgagaaagggctgggggcctacgaatgtggcagctctggaagtgaacctgcattgtggagagacaggaagcgaggggaaggcatggttgttaggccgctccatggtaagtgtgagtgagctttggtgctcgcacagtgcaagacttttggttccacttggcagagaaagggacccacatgggaattcggaggcaaacacatggcgcttaagcaggaacaagagctgctctggggtgttattagcaggagttacttagtcattattgagacaaagttactgctttcctgcctcagcctccaggtgttgattacaggcctgtgtttccacatggaagggtgagggggtgggggatgggcagcataactttttcggagtccctgacattaaggttgctttgctgaaaagagtgagttgtagcaaccctgtggagaatagggatacagagacgtgatagatacatggctagtagccttgtggttttttctttgtgcactgagggccattcccaaagaagcagaaatcaaagctgcacacccttcctagaaatggttagaatatctccttggtaaccccgtttttttcttgttgttccattactgcttacacttaaaaaagagacatagccctg

SEQ ID NO: 30278 - DNA, 1225 bp, Mus musculus
cccaacaaaaaaagaaaaacaaaacccttgcgtcgagacagcagattccaggctggcctctatcaagcaggtttagatcagttttcactgtcaggatgtaaagcaagtaaaaataacaaaacaatgaaaaatgtacttatttacaggaaaatgggatgtggtattagtgtagagtctaggagaaagactatagtctgttagtgtatagatctagtcaaagtaaatccctctttaaataaaactgtcatcatgggaccctgctgtgtaagaattagcttgatatgcatttaatgtttaaaaaaaatctgtatttcattaggtttgagaactaaaactttgagcagttctgcctcaagcaactagaaatacaggtttttaaatagtttctcttttccttagttgaaatctattcatgtaaaaatatgcttctcacaaaaatttctctacaaatgtgctatgagttaaggaacatgaggctttgaagtaacttggaaagacatgaaagaaagttaaaccgtagtgtaatattccaggatcagattctgtactctgaggatgctgaactccacaagtcttcactgtttacctctggtgtcctaaatatcaccaaggtgctgcattcagtggggtcttagaatttctagaaattatcctcagaatgtagcctacatcggggctcccccacccccatttgatctggaaccacaaaagatggtaaacaactgggtatcgtagtttaaaaagagtaaatatcctacctgggtatggtgactcatacctgttggccaggtactgggaggctgagaagagcgtgaacgtctaagtcttgtagatgcaggcaagtctgaggaaaaaaaattagtttgtgtactttccacctgtctctgtctaatgcttgtgatggagagtgtatcagagtaccacggaaagatggagaggatcccaggatagcatgcatgtaaagtattcatccgtgtattctcattcagacacggggaagatgctgatcccattgtacagatggggaattaggcaactttagggaaagtctaggacccagattgcctaagtttagagccagtgatgatcaatgttttaggataccaattagatgtgaagaccggaatggcatggcattttggagtcatgggctttcagtgcagagggctcagtgacgggcttgctggggtgacccaggtatgcacacagctctgcagccacaccc

SEQ ID NO: 30279 - DNA, 1175 bp, Mus musculus
gtacactttaccttctctcaatattttcccataattcttgttctaaaataagcaggaagtgaccgtctcaccatacttagagacgagatggaaggagaaaattcacttcaactaaaaataaccagtgtcactgagacgctgagaaacagagtgagaaacagagtaggaaaaggttgataatgccttccttagaagagcttttaagagagcggaagggttgtgtgcccgaaggttagcccagtaacctctccagtgcttataccctctctacatacatacatacatacgtacatacatacatactacatgtctcagatctctgaggcacctggattcttttgacatttagataacaaacacactagtttggagtagattacaaggggacacttgtagtacacaataccaaaatgtcaccatgggggcctcataaggcctttagaaaaagattcaggactcctaatgaaaaatgtagggaaggctctctaggctagttaattgataaatttaaaactttgagaataaatagacagtccctggtagacaggaagggaaagaaggtttggtgcagacctcctaagtcgggaaggatgtgggatgctggggaacagagaagagggtgatcatagggtgagtggaaacggaaaggtggaggccaaggcaaggggcttcatgcagtgtgaatcattagtcctggaagaaacagagaattgaggttgttaaaagctaaaatggtctatcgggagaccaggaatgaattggaagagcttagaaggtgtgaattagtttcctgccactgctattataaattatcaaaaatttactcgttaagtaaacctcagcttatcaccgtgcagctctagaggacagaagccttaaacttggtgctgtggaaactgcccgccttctggggctctgggggagggcagcttctacccttggccagcttttagcatccccacccaccccattcactcccatccccaacagtcctgaatacacggaccttattccatcttccaaatcatcagggtaactttgtgtctcctcctcctccctcttcttctagccctacacctctgctttgtgatgctttggtcaaactaaacaaactaaactaggcaggattcccaaccccaagcccttagtttaagtatgtcttctaagtccccttc

SEQ ID NO: 30280 - DNA, 1303 bp, Mus musculus
tatcctaaatcattccgtaggtaattgttgttctacaaacgttgctaccattagcgacttgacttcattttaaaaccacatcatttccctttgacgacagaaatactactccgtaaatgtaatatatgtaagcatcacttgtgtcttaggtattgtgatgcagtatagctcagcggctgagttattgcatggagtgtctctggcttgggttccacctcagtatgtgttcagcggccatgtttccacccttggcatccctgaggtcacctgtctcccatcctccactgcgtccgtcacttggggagctggcagcacttccgttctcagcagtgggttacatgctagctgattctctaaagattctgcgcctacatgatagattcttatcattccaggaagaagctccacttcagacgcactagacacacacgaggctccactctctcagcagacctttcttaacaaagggcttagtaagtctatgggatttctgtccatcagagacacacgagatgaggaagactatctcaaggatactccatctgataataattccaggcatgaagattctgagactttctcttccccttaccagttcaaaactagtactccacagatggatgcactctccaagaagaagacatgggcttcctccatggacttgctctgtgcagctaacagagacatttctggagagacgggcaggtaccaacgctgtgaccctgagacagtgacaggacggacgtccatcactcctagaaaaaaagaaggaaggtactctgatggaagcattgccttggatatctttggccctcagaaggtggagccggtgatccacacccgagaactgccgacctccaccgcggtatcaagcgctttggaccgaattcgagagagacaaaagaaacttcaggttctgagagaagccatgaatgtagaaggttagtgattctctgtttgtctgagagataaatgaattaaaatattaaaccatttcagcagtctaatttccatggccatctgggtcgcattgactcctgcccacttctgttcactctctgattaaaactcttatcagagtgctacagaaccctgcggcaggatgctcccaggcacctctctgcacttttaaatctgagctcttcaaggatctggcagctttgagtatgttctgcctctttggagactcctggtgctgagaagctgtgggtgagatctaacccatggattgagcaagctatgcaccagctggcctctagaccgctagctagaaggaccaggcgcacgggtgtgaggataggca

SEQ ID NO: 30281 - DNA, 1327 bp, Mus musculus
ttagccttcggtaatgtgtgtccatggcctgccctcagcaggggaagtgggttaacattgcgttccatattaagttgagggggtttttcctcactgacgttacataataacttattaattattcaaataatgtaaatataatcatatcaacttattattgctctgcttagatttgttgccgagtctgctgtctctgtttttttagactgcaaaaggcgatgagctatcaagtcggatccagaccatgctgggtgactatgaggagatgaaggagttcctgagcagcaagtcccacccccaccgcctggatggctctgaagacaggcccgggaagcccagatatcccttaggtcatgacagggggaacggggctgcatccagctccctccgcacacatgtctaccaccagcctatccacacttctgctcccggatcacgtcctgtcggtaacattagccacagtccaaagatggcacagccaaggatggagccaagtctccacaccaaaatctatgatggcccacgtctgactcaagaccacctcagtcagggacattgttccagaaagtgtgaccgaagagctgaaggagactctgctcccgagaggaagctctcgcccttgatctcctctttgccatccccggtgccccctctatcacctgtacattccaggctgcagggaaccagcaaggctcacagcagtggcgttagcagtaaaagctgctgtgtggccaagtcttccaaggacttggtggcgaaggcccaagataaagagactcctcatgacggtttggtggcagttaccagccttggatcagcccctcctcagccaccttgccagacatttccaccccctcctctcccctcaaaaagtgctgcaatgcagcagaagcccacggcatatgtccgtcccatggacggtcaggatcaggctcccagtgagtcccccgagctgaagctgccactggaggactatggtcagcaaagctttgagaaaccagaccttaaagtgcctgccaaagccaagctcaccagactaaggatgccctctcagtcggtggaggtaagtgggatttcgtgagggtttttttctcttttcctttttaatgtatattgtgtgtatgcctgcccatcctgtgtatgcatggccagaagagggcgtttatcctctaaaactagacttacacattgttgtaactgtgtagatgctaagaattaagcccaactcctctggaaaatcagccagctctcaaggctctttgttttttcaagacagggtttctctctgtagccttggctgtcctggacctctcactctgtataccag

SEQ ID NO: 30282 - DNA, 1121 bp, Mus musculus
agagtgtgttggatgaggcgcacagagtgtggtggggataccatctctgactatctgtgttatcgttttaatttgatcccgtgcacgtatttactcgagtttgacctggattctgttgcagaattcttcgctcagctcagcacaaaagtgcgtgtgttggccctcaacagcagcctggtggacctggtgcactacacaagacagggcctgcagcggctaaaacagtcacccaaaggcccctaacgtaggccggacctactcctgcctcggagtgtctctgcaccattggaagccatgatccagtgcagacaacgactgtcagatcggaatgtcagtactcaacaagagaagcacccgagagatggccgggatgcttgtccacttaaactcacaacagctgtgtggtcatcgctcagcgctggtcatctgagcagatgctgcaagatggccttgcctttgccaaccggaggacaagtacaacggagccccactggcgtatgaatggtctagaaacatttctggtttttttctgtttgtttgggcgataggataaaaattgcaaatgagaggaaaatttcagcaaactcttgtcatctcagaagccatcctagtttgcatccggaaggaattttttttttaaataataataatttctggtgaagggctttaaagattttgttttcttttcaagttttaaagaatacattgtttgatacattctgatggccatctgtggaacacaccttgtgaaggactccattgcactccccttactgcagggaaggggctctgatgacagagtactgatatttacagaattgaaggtgacaaccccactccccagtgcctagagtgctgcacattgtctagctctggtctctctggctgtcctgagaagaatccctagtcagtcctatgggggagtggcagcatttggatgcgggttctatctcacagtcttccccacaaccctagaggcctaacacttcctcctgacacacgccaccaaagggactggctaagcagcattgaccttgggcgaacacaggagcctcatgttgactttgggctgtaggcagatgcagttcatcatctgtctgctggagctggagtcccgggca

SEQ ID NO: 30283 - DNA, 1072 bp, Mus musculus
caaaactcagctttctatccaggatatccttggctatccaggggacattagctcctggagaggatgtggagtttgggggggggggcaggattaacttcaactttaaaaaacaccccactatcatacaccttcagtccagaccatcttctaaggtatcgtgacttgatgaggttgaagaagatctgtgaccttcccaggctacaccccacccacagtagaccaggttcacttagatgggaagtgaagaatacactcagaattcacacctgcccgtaaacacaggcctttccttgagacttcaaggttactactggaatactctcaagtgtttttaaaaagccagttctttttaatcccttctagaaagaaagtagaatttgcacatgttcaccatggaggtgtgttacggctccccctgcctctctttcctgccagccatgcttgtctgtgtgcatttggagattagtggagatgggagacccatctttccttagtgatgatgtctgtggtccttgtggtaacatcaggactttcttggtaccttggttaaatctacacagggtctctaggtgagtgcgataccaggtttttcagggcaaactgtctgtgatactccttggtcttctcagccttctctcctggtttgaatgaagccagaaaatggctaccttgtacatatctgagtatagaccaagacggtgatccagctaagcccttttctttattgatattctgaagccaagccatgtctgactgagtcgaagtgtatggtaggtggtccctagcacagtggggcttgtgggctcatcaggatcttttctcccacagccctgcatcccttgcagcctgttggttgtaaaatggctatgatccttgtgagaggttctggcctactgaagttttgccagagcatgtgtacatcctgccagcagatcactgtgccccttgcctggacagaatcagccagtgtaggaagaacaggctgcctcattctttaatgggtgggttttctcctcagttttatttgtaccttgaaaaccaatgcagttggacaggatccgtttgtgccagt

SEQ ID NO: 30284 - DNA, 2070 bp, Mus musculus
attttataccatctgcacagttcactgtgtgcttaaacttaccagaggcaaattttcccctgaggtgattattttgggaggactataacattagcccctttgaatatctgatgttcttaaaaccatggaagagcatccaccttatgggggggggcagcatttaatgaatgaatcttccatttgccactacaaagggtgtgtgtggcccatctgtctgggacacaaagtagaggaacacaataatgttttctcttttggaaaaaattaaaattagatacatgtaaaaaaccctgttactaaaacaggttgcccttggttaaggtgcctagagggcagaccacatggcagtagggaggagcaggagggcccagcaagtgcttgctaatggtcccttacaaagtgacatttattttgtagaggttctgacaaatgtctatccattccctggaccaccaccacccagcctcatctgtaggaagtttcaaacgggctcttccccatcttaattgaaaatgtgcctttactatgttgatgttagggacaggaccttaagtcctacgattcctgtttggtaacttataaaaggacttgtgctcttgagctgtggtctctgatgcagaagatgagagattcagctagacgtatttgtgcctttgctgaccaaacataaattctgaagttacgctgtttgttttgctgtggctttgagtgggttcatgggttttatatgtttcctttcctgctttgtgaaattcgagatgagttgggcttaaaaaatattatatatatctaagatctttccatacctcttacagattctttttcttcttaatgacttatttcccccaacactacgaaatgtctttgaaaatttaccacttcatctgttaccttcttcatcaatggttagtatttaaatcgcctcagaatgttttaggggctcctgtctaaaacacagaagtgtaggtttttctcattgaagaatgagctatggagatgcgaggatcaattttgatgcccccctccccctgcctctttcccctggttttggctcatttggaactactgggcaagaggacttttcctgtggaagggaagtgtaaggacagacgggcatgtgttgggattttgggatttctgccaggcgatcctccatatgcagtccagtttcccacttactgagagcagctgtctggtagccgtgcctcttactgatgcattgacaagcaccgcatcaccacatttctttgagcgactgtaaaatttcctggttccttgggggtgaatcacactctgttctgttccgctgtgcgtcagacatcagcagttactgtggtgggcagagaagtgcctctttccctacctaagagggagccagaggacaggaaggaagcgtagagctctctgcaagcctgtatattgctatatttgtccccataggacaccggattgaggctggcggcaggcaagccgggctgcactgttgagctggggcggggggaggggggcagaggctgacctaaggaagatgaactcactttgcttagatgttttagcaatgctcagtacaggcagtattacgtttgcctttcattcaggccatgacatgtattgctaagaacactgcacatctcatgatatcgcgggtacactgttcgtggtggggtgtgtccatgtgtgtcccgaattttaatttttttctgaatgtgatcatgctttggatgatacctgagcagggttgccttttttttttaatttattaccattatatattatattatatattatatattttctttcttaaaatgttagaagtcaaatcttggtattaaaattgctttaaaaaggagtatgttgtcaaggtgataatgagaatcactggtctgcctttaatgagtttttctttatcatggaataatgtgccagctctgatcagcacagtggttttgtgtgcaggctggggaagcagccaggctcccggtgaagatgcgcagtgcaaatacggggagcaccacagatgtaaaaatcagcatcagcagtggaacggcacccctggggcttctgtgaatg

SEQ ID NO: 30285 - DNA, 1239 bp, Mus musculus
cccagccacctcaccagcccttggtattctgctttgttgtgttgtgttgagacaggatctcctgtcaccctggcaggcatcacacttactatccaaaaaataatgtggagttacaggtatcagggttcctcagatgaagatcatattgcctcagctgaagttaactactggtgcctcataggaagaggtcagggatgctataaaacctcccactgctatagggcagccctctgcagcaagaattacctggattggactgctgccataccaggtgcaccctgccatgtgcccctcacccaagctccttgtgtgtttacacctcacagttacagtcatgccagaaatacagagagcatcactagagacaggactgccaacttccacaatgtctcaatacagttttctttacaggttggttggttttgtgtgtatgcatgcaagtgtccacggaggccagagagggcatcagatctcactgagccagacttacaggtgtttattaatgggttaccaggaattaaaccccaatcctctgcagtagcagcaagttcattcgaccactgagccatccctccagccccccacattcttgagtttctaattggttttacgaacctcctttattggctgttaatttgatactgtatgaagagaaattgaaacaggtatgacaatactcctgaccttagtggaaatgcatgtagtgtttctctcaactattatactaattatgactgaggcttattattaccttgttaagaaaatagctctctcaatttctgctttctttactgattttaagattagtgttactatactaatttttgttttgttttattttgttttgttttgttttgttttgttttgagacagagtttctctgtgtagccctggctgtcctggaactcactctgcagaccaagctggcctcgaactcagaaatctgcctgcctctgcctcccaagtgctgggattaaagacatgtgccaccactgcctggccactaattttcgtctataataaattgaactatattttgattattgaaacttatataaaggaaagattgttgattacatgattcagtaattcagcttcttgtaaatttttattaatgatttgaaatgtaacttgcaacatcctgagatgacagagcaaataaaatcatgtcatcaaaatcaggactcagaaagcagtaagcctggagatacagctctgtctgtatacagtgcttgccaa

SEQ ID NO: 30286 - DNA, 1230 bp, Mus musculus
aagatggaatgcgtctaacgtagaacctcaaaggacttaattcagtaaaataacctttgatttttgccgagtccacaaagaaagtttgtagacctacctttatagcttacttttgaagccagtgcttctgaggttaggccttttcgttgtttttgctctgaaaggtgtaatttcactgatgcagctaagtgactcaggcagtgttttgtgtaagctacagggtttctccagagatgaccagtgtggctccgtatgttgtactaatgattataatcaacaataacaccttttatctttgtgttttgttgttttttttttaatatttcagcagactgtatcgtgacattgaaggaattttgaaagatgcttcaagcttagtagccacatctattgttggtcttctcacccttaaaaagagaataaatgggatgtttcagaagagagctgtataaaaagaagagtattgcaaatggcttcagaatctaccaatgggaaacaagctaggagtcacgtgacaaaggggcggcgtcagtaccagcaccagcaccaacagcagcagcaacagcagcagcaagtgaggagcaggtcctctgtcagtgagtgtgatggcgacgactccttcatcttcgaagccaacgaggcctggaaggactttcacggctctctcctgggcttctatgaaaacggggagctctgcgacgtcaccctgaaggtgagaccgagctttcctttcccagctcctttggtgtactatgaaaaatgaggctttctgcacttacacaaacaaacgttaagtgtcatgtgtatttgttatgctaggatcactttaatgtcaatctcctgtgaatgtctccggtatagcccgagttagcctcagactcacgttctgcctcacgtctcctgagtgttagggttacaggcatgtgctgcaccataccatattttttattgaagatgtaggcacatcattacactaatttactgcggttctttctttttttttaattgaaaacattgtattctaatcacgattttcactccccccacaccccacccaaccagctccatacccttccccctctctctccctctctctcaaacaaacaaacaaacatgcaagcaaaaatacaaaagcccaacctgggggacaaaaaacaaaactatgagacacacacatatcacacacacatcacacacacacaaaaaccacacacacaaaccccacaaaat

SEQ ID NO: 30287 - DNA, 1134 bp, Mus musculus
atgtttttaatgttttctctgtatcttgtttcttcactgtctcctcttgaagctgtgaccattgtcatgaaagccagtttcatgtcctagacccaaacagccctaaggaagttgcgcctatggaaaaggctggggggggggggggacgacggtgggacggaggggtgggggagacggggggggggggggggggacaggacgggacacgacgacggggacgatgacgattgatttcgtgatgataatttccccagattctgtggctcatcaccaggttttcagagcttgtactgtcggttttcatttacagtgtctgtaactgcactttgagtttgtataattcacacttcctgttctaccccatataaaattagaaaccttaacctctcacggtggaatgaaggactgagtgtagtgtcatttcacagcggagtcatgtgctctgtaacgttccattccgtggatcagcgctatttcctgagataccagcccaagggagcttggaggaaaagcgtctgtgggattgcagtctgcgtactggaaaacacgcggacagatggacagacagaaataataaatggaccaaatctcacgctcagtgtctccatctgctgcagagaccatggcttgacctttaaataaaaggaaaatcaatgactcgataaagtatctgtctctgtccctctgtctttctctcgtgcgcatgcgcctccaatgtatgagatgtgaagttcaatgaggtgggacttcacattgaaaatgtagattttttttttttaagtataatttccgttttattttttccagggtatttttccttctgcccttatgaaaccacctctttacatgggctttggtggaggtcgtggtgcagcactagcaggtctaaaacgtggtgggggtgctccgttcttccgggcttcacaggatcgattcctgccgaccttgctatgaatggcacagctcacgcagtcatgcaccttggcaaagagcttgggaagcacgtaagcgtcgaagacgcttgcctcagatatgcccctgacagcagcggcttctacaatgttccagcaatgaacttctcaaaggtcttatccttgggcacgcacccggcgcagcgaactgactacacatggc

SEQ ID NO: 30288 - DNA, 1148 bp, Mus musculus
catctgtcctacctcacacttgctcccagcctcttagggccttgggcctgccttgtggatgcagggcgcatgcaaatgaagcagcagggttttgagagtctctcaatgagatgacagcaaacagcttgccttagaggtcagaggccttggataccctggagctggagttataggtggttgtgagctgtgtggcttaggtgttgggaatcacacttgggtcctctggaagagcagtacacacatgcaatcgtcattgccgtgttattttctgatttttacagggttttgaaattgacaaatgtttctggatctttgaactaggttctttaattcatatgcttttggaatgtctataagatgtttatcttttttttttttcctttccttagaaacacatttccaacctgtgggttccaccttaacgccaacatcatgtctggttctaatggtgccaaagagaattcccacaacaaggcccggacttctccttacccaggttcaaaagtcgagcgaagtcaggttccgaatgagaaggtgggctggctcgttgagtggcaggactacaacccagtggagtacaccgcggtctctgtcctggctggaccccagtgggcggaccctcagatcaggtgagcagacttacggaaagccagggtttttaagttatcatttgatatttgaaaaaaatcacgtcaatccatgctgggtgttgttgcaagtgagtttctgcttttgcttgaacttgtccaaactgaccagtccatgcttgcttattcttcgccaagttttgtgaggacttcccctaatgggcaaatctatttggaatcgccgctgtttgttttggagtaataacaactggtggtatctggttttttttgcatgttctttttgggttaacagttgtgcacctcttgtttctggcagagctaggcctggtattcgaggttgtggaaacatttgtcagactcttttccagatgaccataatccaaggatgagcttgtgagcatggaaagatgggcaagagagaggagggcagtgctttgattctgtccctgcgagagcttggctgcttcctattttatgattatattctctttccagctttgccgagctgtaatcacaaaaattattatgtatgtgcagctc

SEQ ID NO: 30289 - DNA, 1178 bp, Mus musculus
gatcttccggagtacaaaacagagccactgtggcccggccaacctaagctaccgaatacaaaggcaaaagggagggtctgaaagttctgccgagacagcagttttctagatttaagtaagtctgagagaatcaaattgtgtatccatgtggcctttatctgtaacttagataggagaatccatacctttcatccccattgatgtttttctactaattcagtaactataaacaaagtctctgtgagggtgatctactcttcctttccttatggatccctgatgctcttccgggattctaaatgcagtctataaatgaaaagggtagttaatgacatcgttcatcagtaatgctttgtgtgtgtttccttttcttccttttttttttttttaaccacaaaaccagaggaggaagtgtaggagcaggtgggccgggtagtggcaaaaacctcatgacacatcactccacctcctgattggtggagactgtctggaccagcatttaaattctgggaggtctgagccaccagcagctcacactgaagaagcatccttgcttgggtttgcagtcttctgcggcaggcattctcggaggaaaccagccaaggtaagcctgcagtggcccatgaggctgcagttctcctggctgaattctgagggtgagtccagagaacattctttcaacagtcgtatttgttagtcagactcgtgctgttctggtctttttgaataagctggtcaggtacattgcaggtttcccggtattttcaaagccagttggatgtagaagttaaaataaatctagttggtcctctaaaggagagagagagatctgctagtaatctctctctctctttctctctttctctccctctctctcttcctctctctccctctctccctcctctctctctccctcctctctcttcctctctctctccctcctctctctctctctccctctctccctctctccctctctctcctgtcacacacacattgtaaagttctatgtatctttggaacaaatgtctgcatcattttaaagtggctggatgactgtggagaccagtaaaggaggatcctctatattaatataaaccagatacagttatttttagaaaactgtctcacttcaaaagagaaccttccttaatttctcgcttctgcacttggctttt

SEQ ID NO: 30290 - DNA, 1461 bp, Mus musculus
ctcttgttcctgtctgtttatataattcttcaatttgttcttgattcagtatcctgatgccacagatgaggacctcacctctcacatgaagagcggtgagtctaaggagtccctcgatgtcatccctgttgcccagcttctgagcatgccctctgatcaggacaacaacggaaagggcagccatgagtcaagtcagctggatgaaccaagtctggaaacacacagacttgagcattccaaagagagccaggagagtgccgatcagtcggatgtgatcgatagtcaagcaagttccaaagccagcctggaacatcagagccacaagtttcacagccacaaggacaagctagtcctagaccctaagagtaaggaagatgataggtatctgaaattccgaatttctcatgaattagagagttcatcttctgaggtcaactaaagaagaggcaaaaacacagttccttactttgcatttagtaaaaacaagaaaaagtgttagtgagggttaagcaggaatactaactgctcatttctcagttcagtggatatatgtatgtagagaaagagaggtaatattttgggctcttagcttagtctgttgtttcatgcaaacaccgttgtaaccaaaagcttctgcactttgcttctgttcttcctgtacaagaaatgcaaacggccactgcattttaatgattgttattcttttatgaataaaatgtatgtagaaacaagcaaatttactgaaacaagcagaattaaaagagaaactgtaacagtctatatcactatacccttttagttttataattagcatatattttgttgtgattattttttttgttggtgtgaataaatcttgtaacgaatgtaaggagtctggtggtgtcaattattctttattagtttctcaaaattattttgtaatgtctaaaatataaccatttcaatggacatgcccagtttaattaaagccatttagggttttaatggtcagaggaacacagattacccgggagttgacagcagccagaacctacaaggctccctcaggaaatattctcacctaagtatgacatatactaattaatatatgagcgagcaaaagcttgaaacttgaatggaattagaagttgattgtttatgttttctatcatctttgctcagtaaatgtgtggctttcttgccctaatagaaccttgtgtctgtcttctagctattctagtaattcttaggtaagaatgtgtgcgtgcttctgtgtgtgtgtgtgtgtgtgtgtgtgtgtgtgtgtgtgtgtgtgtggtgtgtgtgtttcaattgaaaaccaacgttctcagtttcatccaaatatgaactttcagaaatattgtagtgccacatgtgactttagtctttagaactagatttcccttttagaaatcatggaaacaatctaaatatccttcaactgacaaatgaataatg

SEQ ID NO: 30291 - DNA, 1208 bp, Mus musculus
acctcttggaagggaatattgggatccaggtcattcctcccatctcctttgctcctcttccctcccgcccaccttgtgctcaccgtgggtagccttgttccaccacctgtggaagctccagtgacattcacactcacaagtctgaatgcacagagcaagtaaaccacagactgaacggacgttctgtgactgtgatccaaaataaccttttcacccttttgtcttacctcaggcattttgtcacagcactggaaaattaaccagcacaaacctcctttggctgtataagacatccatcgctatgactaatcgccctctaaagacccccacctccttttattatcatgtgacagacagacagggatttttattatcatgtgacagacagggattttggtgtatgaacttggaaaacgtcacacggtaaatgccatgtgctattagtgctacattcatgtttatgtttcaatcatattatgttaatcctattaatatgattaattgtattaatgaaagatatcaattattttttgatccaccataattattctttgttcatctccgccttagcttgacgatgtgtttgttgagaacaggggggctgtagcaaactcgaaattgtagagaaaatacttcttgagaatccagtgtgcatgagacacatatctaggagcaagacacgatctctgaaatgggcaaaatctagtccttgtgtgttaagcaacaactgaagcttaagaatcttttgtcatagagctggacctttcctggctctttggaatgggggtgagagttgtttgcttgccttttgggttattttttttccaactagaagacaactgggcactgaagaatatgttccttttttatttgtccttggcctctcttcctagtatgtgtgaagtctttgctttaaacagtgccgcatcagtggggggaaaaagtgactcagccaaggaagaaacagagcaatcgaattcactcaattactttatatttaccttgaatgtccaattctgtgtttttacttacacaataaaatgtgattcttgtttggatgggttggaaaaaaatcaattcaatttaggcagattcttcatggagttgtgttcttgttggagagattgtccccgtgaatataaataatagcatgagttatcatgtagcatctaactaatatggaagtttccagcaaagagggaatccct

SEQ ID NO: 30292 - DNA, 1156 bp, Mus musculus
ggagcacaggcccaaggatttatgtatacaggagtgcacacctgagcgtttgtttatgtgtaatggagtacacacccaagtgtttacgtgtagtggagcacacacctgagggtttatatatagtttatgttgttttaatttgtgatatccaatcttaaacaatagtcttccttaatttatagagatttataattcaccagtaaaatgagagtcttaattttcattcatgagttactcgttaaatattaccaaagcctatattcttatacagatattttacataatatatagtgtagattatagtgtttgtgcatttggtgatgtgttacacagtagagggagccatgaaatgagggatagggcttggactttctcaggtttcatggactcatggggatagcaggcatagttgaagatacctctgttagctgaccactgttatcagatacagacagcacacagaaagctaatctgatatactaactgcagtgctctgagaaggtgttgcaaacagatggaaatatccattgccactggggaagggaatgtcaggcatttgtaaacgacagcagctgtgatgatgagcaattagaacctgtcacctgttaggacctgactgagcacagcatcgattttcccattaagggaggtcctgtcacctttttcatttataaatgcaaatcgaggggttacagaggtggtttgctgggtaaagcgcttgctgctcaagtctgggagctcaagtgtgcattctcagatgccatgtaaatgtggctcagttaagggcagccagcctataatcccagggctcaggaaatagaggcaggcagaatcccttgaacaaactggccagctaaactagccaaatgagggatctctgggtttgagtgaaagaccctgtattgatacataaggtggaggtagaagtgagtggggaaggcattctgtggttgccaagatgagtgatacatacacatatctgcaggggtgagcaccacacatacatatctgcaggggtgaactccacacatacacatcttcagggatgagcactacacatacctaaagggatgagcaccacacatacccaaagggatgagcaccacacatacctgcaggggtgagcaccacacatacctgcaggggtgagcaccac

SEQ ID NO: 30293 - DNA, 1919 bp, Mus musculus
agggcctggaaggtggaggtggaaatggaagtgccaacgtccatgcctaataatccacacgtgtttgtgtgttcctgagacaccgagaggtggctgtccagtacgacaatgataagttcggtatttatataccccggctgcattatgatgctggtctttgtgaccaattgttataattttctgcactttaatttattttacgtaaacttaaacccgtggttcaaggaaggtttgtcttacttttctcatgtgagaaatctaggtgtaaatattgagttcagaaagaagaaaactttgaaagtacgctgatttgctgccctgcccgtgtcttcaggtgacagtgtttggaagttagagagccttcactagtctctgagttcgtgtggagccaccacagtctgctgcattagtccagtgcgagatgctaaggaaaaacatgacatttcattccactgaggtataactcggagcttactgcatatctttcttctaaggaaggagtagtatttcagcaacctttctggggtgcagagaaaggatatgtatgtagccactgtgctaaaatgtgtgtgaacagttgagatagatgctaagcgccataccagtttgtggcactaagcatatcatttaatttttgtgttatttagcttttgtttcagatttggcaaggaaagctcaaaagataaattataagataaagtgtaggattggagccgggcagtggtggtgaacgcctttaatcccaacacttgggaggcagaggcaggtggatttctgagttcgaggccagccagggctacacagagaaaccctgtttcgaaaacccaaaaaaataggtaggattggaaggggccttcaattcttactacatttgacttttcaattatttgttagcatagaaatttctctatttttctttcctatgtgtctcatttataaccaaatttaatattaaaaaaactaataagacaaacactgaatattttcactgtgtagtgaaagttttaactcatcaaatatgtacatgggaagcagtattttaagaaagttttgaggtgcataaaagctctgtaaaagtagaggtctggtttacgttgtatcttgaatattcttaatatctagaatattcttagtcatatatcaggatggagtcatataatgcaaatttagttcatttttatgtgaggggccttgggtattgtaggtttatatatttgcagaagagatccactaaaagttgactatcagcagtaagagagggtctcacaaaatttataggagaaatctatatctcaatatcattttggtttttgtgtctgtcaaagacaggttttcactatatactcctggccggcctggaactaactgtgtaaactaggctgccctcagactcccagagatccactggctctcagcctcttgagtgctgggattagggccagtgtgaccacagcagttgttgaataacttggccctttgagagctaggggtcagaagaaacaaagccaagctggtagagaagccagaggtagagaacaagtagaagagaatcctgggcttagtaccgtatttgaaattcacaagaattcattgacttcctagaatataccaaacctctccaacctctaacagactgctgagtagacaggccttttctcgtcagcttccacagaagcgaggcacgccatgtttccctgattctgatggctgcacatcaatcattttcttttgaatatgctacactaattttttttccttcctaggtattggattttgcattgcaggggtattattgtatgtatgtatttatgtatgcgtactgtactgttacaaagtgaacaaacttcaacttgaagtgcattaattatgtggtatccatgtgtatcgaccatgtgccgtatgcctattatggtcactag

SEQ ID NO: 30294 - DNA, 1132 bp, Mus musculus
cccaactggtactccctcctgcttctctctctctctctctctctctctctctctctctctctctctattcctccctccctctccctccccctttcttctcccttttcaataatccatggagtgcagtcagtgctgcccatgcactcattggtggaaaaaacatcccccgagtagtcaacacatcaaggaccactctcctgaagaaaaatgactttccctcccctggcagtcaccaactgtctatagttcctcagctagggttctctgtttctgtggaaggaaaacaggtctggggcaggggcagggagcacttctgtgtccctccctagtccatgctagaatgttaaaacttgttgggaagtgaaagttactctttaaccttgaacttgaacaggtgtatgatccatctgatgctattccacattgcaccatctgacccaggttaacattacatgtgtcgtcgccccaccttcttgccccctaattgcagctctttctccctggactgtactctcttcctacatcccccctccaaatgacccctaccacttctttccccatttacctcagtctcccccgagagtctattctatttctgctttgcagaaagatgactgtgtcacctctccatctcttctttttacataacctctctgggcctgtgggggatagcttcattaaaatttacctaagagctaatatccacttatgggggaatgtataacattaccatcattctaagtctgggttacctcaggtagggtgattttactctagctgcagtcatcagcctgttgtgctgcagtcatttcatgttgtcatatttttagcagctgagtgatactccattgtacagacataccacattttgtttctgcagttttcagctgtggaacatctatgttgtttttaccttgtgtctaatacaaatgaagctattatgaacataggtgtcctgggttgctggatggagtacttttttcatttatccaagactgatatagcttggtcctgaggtggatgcattcccagtctcctgcggaattgaaaggaaataaaacttgagacctgtgattcatgtaatgtatgtcaaatagcccaaagagttgtttgtgagctttgaaaccagggg

SEQ ID NO: 30295 - DNA, 1105 bp, Mus musculus
gttaaccagtcctatgttgttttctgtgcaattgcttaaatgatatctctgccttcagtgacaatgctgtgctcctttgggaaatcatcagagtgctgtagtatatatcatgaacctaatttatcactgattttaactgcttacattctacttcttaattctgtagccttacattattacctgtttgtattttatatctatggaattttgcttacatgtagacctgtgaactgcaagccagaggacgtttcagatcaactagaactagtattgcagaatgtcatgaatccccctttgagcgtgcctactataactgagccagtgccctgtggagaagcagtaattgctgttatgctctgagccaccactccagagtcatagaacatacgttagattcaagaagaattaccttgaaataatgtagaatattgatatttttagatacatgtgccaacattgcacatattcacactgtgctctgggccctccaaagctgttcattttgtaatgatgactgtgtaaatgagtgctattaattcttactaatttcttgatgacttagacattttactagggttgtttttgtaatgtagttggaaaaagtatctgtcatccataaatgacgaaactgtttatcccttgttcttcagggaacagtgcttgactgcacagtttctaatacacctttggtatcaattttgaaataagtcatttagacatagatttaatcttgctgtacttttattagattagtaataccaacaatatttctctcaatatttgtttgtcaaaaggtgtcattgtatttgttggttgatcacattagagggatttcaaattactttttttaggttctgcattctcattgtgaatattaattttttttcctgtttacttacattagtgtcaccatgtgtctcagacagtaaaaaaaatctcacccaggcagtggtggtatatgtctttaatcccagcacttgggaggcacaggcaggcggatttctgagttcgaggtcagcctggtctacaaagtgagttccaggacagccagggctatgtagagaaaccctgtcttgaaaaaacgaaaaaacaaagacataaacaa

SEQ ID NO: 30296 - DNA, 1230 bp, Mus musculus
agttcacatttaagggactatacccttaaaaagaatccatacaaccaatgccctattggttataaaacagcacagaatggggctggagagatggtcagtgggtaagagcactgactgttcttatgtaggtcctgagttcaaataccagcaaccacatggtggcttacaaccatctgtaatgacatctgatgccctctattggtgtgtctgaagacagatacagtgtacttacatataaataataattaaatcttttaaaaaaaaaacagcacagaatgagagcttaagcgatgtcctgctgactctttcttttatgacactgttatttgtcagatggatgtgagagcttcagccgacttgtctacatacattacaggttgaaattgaaaattcgggggagaaagcacagaacgtagcatcagctttcacgttcaaaatgtttttataaagttcttctggttggtgtttagggaagaaagagtgagtgtcaagctttttacaccagagttgccaggttattgagaagcaaataggtcatcgcagactggaagaatccagaaagttgttctatgtggatgcaaagaggactttctgcccatgagtcacagtggaccaaaaagtaaaaatgaggttaagaatcagactaaattgattttgtttgaatttaaataatggcaataaatgatcattgagcaaaagtgcaatactttagaaaagtgacccatttcaattcttctgagtaaataaccaggcttaggtagtcacacatttttttttttttttgtagaatatgtttgtaaatatttaagagattttttaaaaagatgttatttattcatttattttcattcatttatttttttatgtatacagtacattgcctttatgtatgtatgcaagccaggagagggaacctgatctcattatacatgactatgaactaccttatggttgctgggaattgaactcaggacttttggaagaacagccagttctcttcacctctgagccatctctccagcccaacatttaacatttttgcccaggagtgtctgttaagtgtaatatataattgtaatatcaatacccaatgatatgtatgcatttcttatttttgaatagttaatcaaatataattttcatattgataagcaagagtggttgtttagaaataaacgtgcaattatttttctaattccacagtccaaccttatgaaagataacacaaga

SEQ ID NO: 30297 - DNA, 1214 bp, Mus musculus
atcttgaaaagcataaaaaaaaccctacactggaaagactctctatgtatgtaaccattgtgataaagcctttgctcatcacagctatcttcaaatccatggaaagacacatagaggaaatagacactatgcatgtacccaatgtcgtaaagtgttttcacataacagtagtcttccatgccataaaagaacatgtactggatagaagccctatgaatgtaaccaatgtagtaaagccttttcacagaagagtttttttcagtgtcataaaagaacacatactggagagaagccctatgaatgtaaacaatgtgttaaagcctttgctctacacagccatcctcaaagccataaccggacacatactggagagaaacactatgcatgtaaccaatgtgttaaagtgttttcacatagcagtaatcttcagagtcacaaaagaacacatacttgacagaaattgtatggatgtaaacaacatggtaaagcctttgcacatgtggtcttcaagggcattaaaaacctagaatgcagtgaactcttttgaatgtagtcaacttgattaagactttgcatatcagagtctcctccttttgtatgaaacagatcattcagcagagagattttgtgtgtgtgtgtaggcttgtaactctttcatctacttgtcccatgctttttctctagtaaattaccttgcctatcttttatatgaggaattgtgcgtttgttattgtcataggtgatgtcttatttagttgatatccacaagagactgccctgctatttttcgaaggggataggcgaggagggaatcttgggatcatggtaggttgggaaagtcatggaaaactgaagcggaggggaaaacaacccaggattggaaccttcagcctataaagtttcctgcttgcaaggtgtactgggtcaatagtagcacagaacttgtggtggtaaccaaatattgactggtttaattggatgcacatgaaacaagaaggagcctgtaactgacactggttgatcaggaactagaagcaagataagcaaggatcatactttagaaccaaacatgactgtcccttgcccatcaccactatccccacaaaaaaacacagtgatgttctgctcttttcatagtttggtgattcgtccaactgtcattaatgtctgctctcattagggcatgggagtaatataaatgacccacaactaaa

SEQ ID NO: 30298 - DNA, 1237 bp, Mus musculus
cggtcctgtgacacatcagaactttttgttgactgaacgagtgaccttcgcttcattccacctgctgtcccactgcgtgagactgcacctactcatcactgcgctgacattctggcagaagaaatgatctgaaggatcaaatcagccttggcctgagtgtagtaaactcgcggttgaaggtaagcagaaggggggaacagcagtaaggtggtgaacagaaaaaaagtgatctagaccagcagcctccctgaagggacgtcggcccagaaagctgaacttgtgacaagctctatgaatggcaaaagaaaagtctacactgacagcaggtgtgcttttgccactgtatggagcaatatacagacaaagagggatgttgacatctacagaaaaagacctaagatgctgtggctaaagaaaatcagatggcagatctaatggccaaacaggtggcccaaggagcaatgatcctggcagtcaaggagcctaaagattattaaaacatcagagagaccagctttagatacacccctgagcattatcaagttatggacagtatttgacccacctgggggccaagaaattaaaaggggtggttaggtcctttgactgctatgttacaggactctctgacttggcagaagaaatagtcaaaagctgcaaggcctgtgctatgacgaggtaaaatttctaaaagaaatcttcccaaggtaattgggtccaataacggacctgattttgttgcccaggtaaatcagggactggctaagatattaaaaaatgattaaaagttacattgtgcctgcaggcctcaaagctcaggacaggtagagagaataaatagaaccattaagagatccttaccaaattgacagcggagactggcgctaatgattggatagctctcctaccctttagggttagaaacacccctggacagtctggactaaccccccccccataaattactctacagagggccccctccactggtaaaaatagcctttgtacatagtgctgacatgctgctttcccagcctttgttctctagatgtattcagcatgggtagttttgaaccatccatggctcacaaatcagtgaaatataacctgttcccaacacagaatccatgctgcctataaaggatgaccagttaagactttgtcctcaattaggaggaatggtcaccagtgtcaccctcagagttccctgaaagttcccagagcactttgttccttt

SEQ ID NO: 30299 - DNA, 1204 bp, Mus musculus
ctctccaagtccaaaaccttgctctcaacctcagggggctccgccgacatcgacgccagcaagcagtcattgccctacccacagccaggcttggagtcgcctggcatagaaagcccaacttctagcgtcctggacaagaaggagggcgaacaagccaaggccatctttgaaaaagtgaagaggttccgcctgcacgtggagcagagggatatcatctaccgggtgtacctgaagcagataatcgttaaagtcatcctgtttgtccttattataacctacgtcccctactttctcagctacataactcttgaaatcgactgttcgatcgacgtgcaggcatttacaggctataagcgctaccagtgtgtctactccttggcagaaatcttcaaggtcctagcttccttttacgtcattctggtgatgctttacggcctcacgtcctcctacagcctgtggtggatgctgaggagttccttgaagcagtactcctttgaggctctcagggagaaaagcaactacagcgacatccccgatgtcaagaacgactttgccttcatcctccacctggccgaccagtacgaccccctgtactctaagcgcttctccatcttcctgtcggaggtcagcgagaacaaactgaaacagatcaacctcaacaacgagtggaccgtggagagactgaagagcaagctcgtgaaaaactcgcaggacaaggtcgagctgcatctcttcatgctcaacggtctcccggataacgtctttgagctgacggagatggaagtgctgagcctggagctgatcccggaagtcaagctgccggctgccgtcgctcagctcgtcaacctcagggagctccacgtgtaccattcgtccctggtggtcgaccaccccgccctggcctttctagaggagaacttaagaatcctccgcctgaaatttaccgagatggggaagatcccacgctgggtgttccacctgaagaacctcaaggagctgtacctgtcgggctgcgttctcccggagcagctgagcagcttgcacctggagggcttccaggacttgaagaacctgaggaccctctacttgaagagcagcctgtcgcggatccctcaggtggtgacagacctgctgccctccctgcagaagctgtcccttgataatgagggaagcaaactggttgtgctgaacaacctgaagaaga

SEQ ID NO: 30300 - DNA, 3783 bp, Mus musculus
tgcttagataaatgttaacctgaggttcagactcgaggcaaaagcagttctaaagaggccccgggataggaggatgaactttcctaagttatcaagatgagagatggccggtgactctgacacgccataaccaaaaatattaccaaataacccagtgtccaaatcaagcagttaaatatccacaccggagttttgtgaataactgatgtttaaattattgagatgtaaaaagtatgcattgaaggtggattgaggggcgtgtcgttacagaaaccttacctttcacatcttatcttcagaaccctgtccccacccccaccccaaccctttacttatttgcatacatgttttcatagaaccttgtagtctgatatttaactccatgaagactcgtcggtataaatctccttgttgtatgctcaccactggctttgatttatattgtttcttttttttgagcagcatgcatcacgctgggcagaattccatcttggctgtcttctctgctcctttctcattttgctggaatcctcatccaggcttctctgatagtcctgggaaagtgcttacgtttggcgtttgcctagaacaggagccaggggttctaggacatgtgatcttctgagcaccctaaaaattaatgcattctcaaaatgtcttctggtctatcatcaaagccggttttaaatatgttgaagttttttatatgaaatataaaatattttctactgtatgatctcagatgctacatctacgagaacacctttttgtaagcagtgaacatgtgcatctctgtaagaatttaatgattcttagtttgggctgattatgattctcatgtttgtatgcattctgctccaaaaatttttgtactcttgcaactaattactgcaaccaatttggatgacaaaaagccttgtgttttgctccctaacatctttgagggtttcctcatgagaggacaggagggccgctgaatcacctacctctccttgctgttgtccaagagtacgggtacaacccctcaattacttaaaaactaccaccaaggggagagggcaagatctagattggaaaattgattggaaaatactctgttagatgtagcccccccccaatctgcatgatctctcaatatgactatgatagaagccatctattcagaatctaactgagcccatgaaactgacatctatctcataggctgccttgtgacccctggaatacgtcatgttcctcctgacaaagagctttgtgtttggcccttttttttaatcatgcgtattgttgaataaataaaatagattgacttacactggggaagtggacattgtagcatgtttttctctcataagtctaggcattatgaaaccacctctttttagacatagctgtcaaataatccattaactgcatctaaaaaaaaaactggaaaacacttctaaggagtcttctaaacacagaactgtggcatgttgttttctcctaattgttctagaaagatgaaaatgtctctcagtggccgtatatacctgatgtctagagaagagaatttcatggaggaaacctgagtaaagttagttacaaagaatatactgaaggccctaagctgcctaacacactatggatagactaaaagagacatcttagcaaagcttgcctttgttagaatgtccaagttctcagggacctaggcataactggctctcactggggcctcatggacaggccctggcttagccaggcttttctgatttttactgttttaataatgtgagctgatggctgacgttttccagtaaaatcatcacgtggaccaatttcaaagttgactggaattgtctgaagttttgaacataaatgtgagtgaggtttcaatactatcaatcgtgcttcatatgaactaaaaaaaatcccactctaaccagttcagactgtctaagcctccccctgatgaaggagaaatttcctgtgcctttgttttccagtatatgcatcattggctaactggtctacctcctcaaagcagttccctagatggatcaatcatgaggtgtgagccactttcaacacacaaggctgttgttactggtggaaaccatattgctcttgatacaacagtcttatagtgtctcttgtatttaacactgatgcatcaatgttgaggtagcttttcaatctaacacaaagacaatggacaacacatttcccacctgacagagatctgtgttagcactggctttactaacctaagtgttgatcgccaccttactgaagaaagtagtcttacaaattatcatgagattaaagtctcatggtaaaaatattctttccaaaaaccaaatgtagaggctcaaaaacaaaactttggcctatactaaaataatatgggctaatttgcatacacacatacaagtacagagaaagatgtatagcttcagttttgcaaatttcagttttcaatgtttttctgaaaattgcaggaggttataggttagtctgaggatagcaacttttttaattcattatttttaatcacgaagtattcagtttctataaaatcaactttagtttaagaagataccatgtgttcccacaagggcagagttttcccctcatctacatcagggtggatttctgcagcataattatactgaaattttattttaaccttctgtgtgttagcatatttctgttaataataaacaggttgaatcagggtacgtgaaattgttgggttctcagtgataatggcaagctctaatttgtgtgctgcagtgtgctaaagtggtttatgcacatgacattattctttgatgatgaaatggttctgctcgtgtttcataattctgataccatgtttaattaaaacagcacatgatattgatgggttcatgaaaatggccaacacttactctgtggagttgtcactgtttccttacatttttcaggaaatccttccatctctgcagtcacgtggcactggtccatccgcacactgttttgtcctcacccacctcactgaatctgatggacactgtacagtcgcagtctctttgtgcagaattggcagcgatgcctgtgcttgatcatccctgtttataagaatccagcttctggtctctgttctcattaaccgcatattgcattatagaatgaaaaataagagagactaattagagagaggaaggaagacttattttgcatcctgaatgaaaaaatatatatatatatatttagacagtgtaaacaaacaactgctgcagagtgtcctgtgtgtaatagtgtctggtgtgtacctgtgtgctgtgctaaatcaggggaccctttctgtctcttgtccatggtgtctatatccagtgacaagtgtctgctatgtaccttttgcaatggacttcataaactgcattctctaaaccttttttttaaacaatttcatgaacaatttcataaacactgaagtattaacagattatatgagtcagagtattgagctgagatagcttctaattgaacttaattttatatttaagttttgaatttatcacaaaatacaccatagctgagaaaaaaacaattatgaatgccttctgcatgttcgttatttctaacagacatggtgcaattttttaaatacagaaaggtgtagggttagaatggatgtgtctgcactcatctctgttgtctgtctgtctttatattcacactgtacagtaagacttaaagttctaagtttcatgctaagtaaaaggatgacccgatcttgggcggagatacttagtt

SEQ ID NO: 30301 - DNA, 1127 bp, Mus musculus
tttcaatattaatattttaaagttttatttgtcccggaagctgacgtatctgttattgattctgcccgcaggaatgggtagttccacctggctttgggttttgctttctcacttgagttcattcttgtaaaaggaaaggaatcgtaggtctcatgaattttggcatcttctaaatgggtgaagatactttgccaacaccatctttactttctttctacctgtccgagctcttggtgagtctcatcatatgtaccaagaagttgtgccagtggttttactgtcagccgccaccttggctggtcaggaggtgccactctataggaaactccagactctgagctcacacaagtacactgtcacagagtattaccctgaaaagccccctgcttctgacactgttaatcgtatcatttcctaaacaacagtttcagttagcctaggacaggcttttgaagtgggtgaagaaagcaaccccctgtggttgcgctccttgtgtgcatgtatcatttggcgtctcactgatctgtatttttttttaaccaacatcctaaaatatgtcgtcaaaaattaaacacaaccactacccccatccacctcactattgccatgtggtactgttgaacaaccttaggaaaattagattttatttcaatattctagcagataattaaattttaaatcatagaattagaagcctgttttgagtaatttaatcacttttgatgccttgatatgtggatgcatccgatggaaaacaatcttgctactaaggcactctgttagaaagctgatgtattctatgcaggccccgccccttcctttgttagaaggctgatgtattccacgcaggccctgccccttcctctgttaaaaagctgatgtattccacgcaggccccgccccttcctcagaccctgtgcagagatatcaattcactttctgcctggtgaataaaacaacccactgtgtacataagcgtagtcatcagcttcccgcaagcctgccctcagtgcgggcggatgtcagtgcagcaagcacgggaactctcagctctctgctaaagatcgcacctcacttagccaagtgctgtgactaacctctgagtgttctcacttcgcaatagttcc

SEQ ID NO: 30302 - DNA, 1092 bp, Mus musculus
tgatttgacttctgaaaccctgttttgaagaacgttttcttggcccccatgaccttgcccagacctgggttttgttgttgttttttgtttgtttgttttttggttgttttttttttttttttgtggcatgtaaacatagacaagacatacctgggaagcacatggtcctcatgtgagttaagatgggggttggggggtgcgggatagctcagtgacaaagcacttgcccagagctgagccccgtgcctgagtttagcgacctgacactacaaaacagacaagggaacaggactcatcactctgtgtgaagggccagccccgtgcaagtgcttctatttcagtcatgatttctttaaacctggaattaaaatgataataataataataatttgaagtactattatgactatacttataggaagaaatattcaattttagaatattgaatggtatgaatcatgtgtcatgttcagaaaagctctgccttaaagaacttaaaggcagattgtctgttattgagcaagagtaacttgttgttggaatgtaaattgaaccattgaatgcaccgttttgattgttaaaacttatggttatttctaatatcacccttcagaagggatctattcaagttaaacaccatagttataatgaagtctttctctggcattaactgaaaatcctgtataggttcataactgaagcaaatcgccaataattcaattttatcaagcttccaaataatttgttttatcttcataatgatttcacaggccgactcccaacctaagttgtaaataacattcaataaagcagtatagtttttagactttcttttaactaagagtaaaatactcatagatctttctattagattttataaaacttccaaagcctcaatctctgaagagtttgaactttctgattctcgtcctttttaatacagtaagtttttgttctcgttcttgagtaaaatgctttcagctactgtccagccttccaacgggaaactcgggtgcctgaaccactggcttttctaatgttctctgatctaacttagtgcagagaggctgtctgcctcctctctctctctct

SEQ ID NO: 30303 - DNA, 1159 bp, Mus musculus
tttgtttcacattactctgatgaccaaggaggcacagcatctatttatgcaaagaaaaaattactgtttttcttctttaagttctccttgagtctcagaattacaacttaagataacgaagtcctttgagaattcttgaaggagataaactgtgagccagtttataagaattggaagacgggaggggagaggcggccaccacccagccaccacaggtctgggaactgaccgttggcaggccatgagttgaggagaaggggttcggtaacctgtcatcttcaggagcctcctcctttgtagccctggagtgtggttgatccagctgctgacactccattggagaaaacttcctatgcctttgtcagcaggtattgattgcaaacagtttattggttaggggtagggtgtcatgtccacttgcccctcttagtgcaggtcttttgtgtgatgccacggcctctgtgtgacgtgccctattgggtttggaaagtactgtgtccttggtggcacccgccacctcctgttcttacggtctctatgcctcctcttccacgtagatcgctggtaacagtaactaggtgctggtagcagtaactaggtgctggtaacagtaactagaactaatggtttcattctgattgtgcactgggcattgtgctaagtggtttgtattgttgtttgcttggcactaattcgtaattcagtgaagctgttattacattagagccacattcctgaaacagaaactgagtctaacctctcagatccaacagtttgtctgtatcatacactccatggatacagcacttgaaccttttccagacaagtgtgtggaacctcttagtaccaagatcctcttgcctctgcctcctgagtgctgggactaaaggtgtgtgccttcacaccaggttaaaactgagtaatttctttaggaccctctaccttcaacgtaggcatcgaatgtgacgtggtttgtgaattgtactccaaaagcgacttcagggatgaaaagcttggtgatgcagcaccgaggtgggggcccgaggaagccagtctccagctgttccattcatgccgcaggtcacagttatgtaagctgtttaccgtgcggcccagcgaaggcaggttcattagccgctggcggggatggaccccaagc

SEQ ID NO: 30304 - DNA, 1100 bp, Mus musculus
ctcctaaaaacctttaaactcttagcacgagccagcaaatggccattgatataataccttcattgtagcaaagtctgttgataggatggaaatgagaccactccaaacatttagcaaatctgaaacagttcacaggaggaaagctagcagagtggccgacaaacacacagcccgaggaggggcatctgggatctagggtgaatatgcttgcttagcatacaagcagcttcaggttccatttccagtgccagatgtgtcagactggtggggcgagtctataatcacagtgttgccattggaggcgaaggccaggctggaaggtcttagttggctgcatgggggagtctgggggagtgcagaggggagggagggagggaaaatgaatatgagttgggggtaggattgtgcctcacagtgagaaggggaggggacctaagcattattcactaagcatcttggggtcttttagatttctcccaattctcacacactgtgaagagaacacttccctcctgtgtgtcaggagctgagactgaagatgaatcgggcaggccattagctgtggatcacacaggtagtaaatgccttcagagctgggtaccctcgacccagagtcgagcagaagacccagtctctagctccgggaagccaccagaacctcgtgccgagagggtaatgtttcagaatgatcccgggggctttattgttccttatgaaataaattaaattttaataagtatcctgaggtaaactgagtcaccatcatgcttacctgttctaaacacagaactcctaagagccttttttaggaagcctgcttcctgtggttgaaatgtttgtagaggctggaaagtctcccaggaggaggaacacttcaagtgacttagacctggagacttccatacccaaggtctttgcttaggtgtcttaagccaggcacacataggtatcaggagttctaactgcacatcttggcttaacttatagccaacaggtgagctactttgaatatacctgaggccccacttgtggctgcatagaattgatgagagctgttggaatggctagtccgcccacatacgagcacaccctaggctaac

SEQ ID NO: 30305 - DNA, 1199 bp, Mus musculus
caacagaagatgccccgcgtccagaggtgcacagagacccgttctctgcacactgttgactggtgaacgcctgtgaggcaggaatagcgctactgttctgactggtaatgtggcagactgctgctggcttagtgtgtccaggatccgggttgattcttggcaccagaaagtgttgggtgatgcacccttgtaatcaatcccaaggcttaggaaagagagacgggaggaccaggcattcaaggaaatcttcaactaaagaaaaagctcgagttatccgatcaagagatcccttaaacacacacacacaaaacaataaaaaataaaattacgactctctttctgccatcttccctcgccgccaccatggtgcgaatgaatgttctggcggatgctttcaagagcatcaacaacgctgagaagagaggcaaacgccaggtcctcatctggccatgttctaaagtcatcgttcggttcttaaccgtgatgatgaagcacggatacattggtgaattcgagatcaatgatgatcacagagctgggaagattgttgtgaacctcacaggaaggttgaacaagtgtggcgttataagccctagatttgatgttcaactcaaaggcctagagaaatggcagaacaacctgctcccttcacgtcagtttggcttcattgtgctgacaacctcggctggcattatggaccatgaagaggcaagacgaaaacatacaggagggaaaatcctgggattctttttttaaatgtaaagcataaataaaagcctttgtggactgtaaaaaaaaaataataataaaataaaattactacttctttgcttgatagtcagaaaacatgcctttaagtcttcaagttgtgtgctaaggttccatattttattttattttattttattttattttattttatatttttagaacagatggttcgtttagttggtaatggcatcaagtcaggtgttttatgtacactgacacagaactctttccagttgtaaatataaagtacgtgtggatataggttcaaggtaatgggattaaaaaatcgtattttagaagatgatatgattttaaatagatccttcaggaattctgaatagtttgtaattacagaaaagcaaaaccaaaagggaaaatactgtcccaatctcactgaaactcttgctacgatgtttcagattatcttt

SEQ ID NO: 30306 - DNA, 1851 bp, Mus musculus
ggcctgtgaagactctgaggagaacaagcagcggataacgggcgcccagaccctgccgaagcatgtgtccaccagcagcgatgaggggagccccagcgccagcacccccatgatcaacaaaactggcttcaagttctcggctgagaaaccggtgatcgaagttcccagcatgacaatcctggacaagaaagacggggagcaggccaaagccctgtttgagaaagtaaggaaattccgtgcccacgtggaagacagtgacttgatctataagctctatgtggtccaaacgctcatcaaaactgccaagttcatttttatcctctgctacactgcgaactttgtcaacgccatcagcttcgagcacgtctgcaagccaaaagtcgagcacctcacggggtacgaggtgttcgagtgcactcacaatatggcctacatgttgaaaaagctgctcatcagctacatctccatcatctgcgtctacggctttatctgcctctacactctcttctggctattcaggatccctctgaaggagtactcgtttgagaaagtccgggaggagagcagcttcagcgacatcccggatgtcaagaacgactttgcgttccttctgcacatggtcgaccagtacgaccagctctattccaagcgtttcggtgtgttcttatccgaagtcagtgagaacaaactgagggaaatcagcctgaaccatgagtggactttcgagaaactcaggcagcacgtgtcccgcaatgcccaggataagcaggagctgcacctcttcatgctgtccggggtgcccgacgctgtctttgacctcacagacctggatgtgctaaaacttgaactgatccccgaagcaaaaattcctgccaagatctctcagatgactaacctccaagagctccacctctgccactgccctgcaaaggtggaacagactgcctttagcttcctccgagatcacttgagatgccttcacgtgaagttcacggatgtggctgaaatccccgcctgggtgtatctgcttaaaaacctgcgggagctgtacttgatcggcaatttgaactcggaaaacaataagatgatcggcctcgagtcgctgcgagagctgcggcaccttaagatcctccacgtgaagagtaatctaaccaaagtcccctctaacatcaccgacgtggctccgcacctcacgaagctcgtcatccacaacgacgggaccaagctcttggtcctgaacagcctgaagaagatgatgaacgtggccgagctcgagctgcagaactgtgagctggagaggatcccacacgccatcttcagcctctctaatctgcaggagctggatttaaagtcaaacaacatccggacgatcgaggagatcatcagcttccaacatctgaagcgactgacttgcttaaagctgtggcacaataaaattgtggccatcccaccctccattacccatgtcaagaacctggagtccctctacttctccaacaacaagctcgagtctttaccgacggcagtgtttagtttacagaaactcagatgcttagacgtcagctataacaacatttccacgatccccatagagataggtttgctccagaacctgcagcatttgcacatcacagggaacaaggtggacattctgccaaaacagttgtttaagtgcgtgaagttgaggactttgaacctggggcagaactgtatcgcctccctgcctgagaaaatcagtcagctcacccagctcactcagctggagctgaagggcaactgcctagaccgcctgccagcccagctgggccagtgtcggatgctcaagaagagcgggcttgttgtagaagacca

SEQ ID NO: 30307 - DNA, 1299 bp, Mus musculus
tcccctttgcaaacgggatttgaactaagcgaatgcaggcacacccacgtgcgggggggacaccttcctagattgcagatgctcacttgcaagttattacaagataatgcattttaggagtagataagccctttaaacaggacacgatgcatagaggctggtagcagacgaaaccgaatgttccatgtttgtagcattttcagtcattcatttccagatcttttctttttgtgggttgtttttttttggggggggggtgtttcctcttccttctcttcttcttcctcttcctcctcctcctcctcctcctttttctggggaaagggaaggaaaaatcacaatcactgatctcagttctttttaaattgtaagtcggatgcggctgctggctgagtgtttacacattgcttgcctgctaaagtatatgattaaactgactttcttcttactacattgcagttttttggttttttggtttttttctttctttctttcttgaggtgtcctgatttatttttgcttagctggtgcaatattgcttaaccttggatcgttgaagacacaaggggccaaactcataatcttagatttgctaaaatattgacttctttactgttttaacttaaagcaagtgagtggagcttcctggagcatttgatggtactgtacctctgcgaatcccacagcagactttacagtcttggcggcctggaatgaagtagagcgtgtggtgtgtcaagactctttgattgtttcttaaaacaaatactaaaaataaaataacacatcctttaatagtcactttatgtgcataggctggagttttggttatacatggtacacttttgggccaatataataggatttccaatgaatagaaaatgtgttttaaaaataaatttataacaataaaatacgtttatctaaatcgtagtggttcacaacctttcttgggaccagcatttggaatataaacagatccaccttctcatggtggtgtccgtgaggggctgttggagatcgggtgtgagaggaaggacttgtaattcattgagctggaagatgcctgtctttcataaccattttagtggcaagttgtatttcctgtgtttgtctgtgaggaggagtgtgaggattgtctgctgtaggttataattctttaactcacaaaatgtctgaatcagcctgtcacctatttagattttagctgagtaatttacagaccttctacaagaatggcctttccctctcttccttcttccctccctcccatcctcctttcctttctttgacagggtc

SEQ ID NO: 30308 - DNA, 1197 bp, Mus musculus
cagagtactattctatctagatgtgttaagtgtttttttaaaatcataatggaacggtttttttttatatatatatacatatatatatatatatactaaaaagttggagcgagatttgtttaaacaagtatttctaaaagaaatattgtacatagtcctggaaattatttgtggtaaggaaatattctttaatccagttgcatttctcagacaatgaagtggtgcgtccatgctacctcctgctttgtcaacaaagatgctatttaccctttccatttgtatcataatagattttaaaaatctaatgttctttattgcaagacatacttttgttaacagatttgtttctttgtaacgttttccatacgtttgacatgcttacaggacagggttgtctttatttaacattgtagaaatgtaattaataaacaaggctcactacacaatttagaataggctttctcatttatattccaaatttgatcatttagcaaaactattgatacacaaaatatttctacatatgagaatgtttacaatttgaattttagaagttgtttttggatgtgattctatgtatgaaaattgtgtaacactatgctcatgctaagaaccgacttaacagaattactgaaataaatgtgctgtgaggaatggacagtacggtgcaggtgtcttggtcatgataaactgtgatgattcttttaaacactttccaaaaacaacttagttcctttcatcctgaatgagcgtcgtttacaaacagcagtttgtatgcaagcaccattccgcttcatttcatggtgttgctaatatagttgaaccaaggatatgcattgatacttttcataatttgtaaataaagttaaaaacagttaaaggagtgtttggtagaggtatatgtatatatacctcactgccagtgaaattactttcctatggtatatctccttgccagaaatcactaaataaaaagacttcaagaattacagtgcctctaatgtgaaacatttgttattttttttatttcatgggaaatagtccataaggttgttttatttagttaggttgtttatatttaccaagttacttttgttctctaaaaacactacattgatcaatatatttcatgtgaagaaatattttcccattatggttaataaacatcttaattaggtgctagttagtgtgtaaaat

SEQ ID NO: 30309 - DNA, 1318 bp, Mus musculus
agagaaaaatggatgtgagcaagatcactcgctacacagaggactgctacagtgactcaggccgtgcacctggaaaatcaaaaattcttcaggttgactttctagggcaaaacgaggagatgcaagcaatagactcacagaactacacattatcaaaagtgaaacccgagtcagctggtggagacttggagtctgtggacacttttcagcatctagtttataactcagataaatgtggagaggataattcacctgttcatactcgcactttaatttcaaataccttaaaaaagaaatgtgaagagagtgatcctgagtcacctgttgctttcagtactgaagagccatcattctacccctgtacaaagtgcaatgtgaattttagggagaaaaagcatctccacaggcatatgatgtatcatttagatgggaatagtcactttcgccaccttaatgtccccaggccatatgcttgtagagaatgtggacggacatttcgagatcgtaattcactactaaagcatatgatcattcaccaagaaagacggcagaagctgatggaagagattcgtgagctgaaagagctccaggatgaaggcagaagtgctcgactccagtgccctcagtgtgtgtttggtaccaattgccctaagacgtttgtgcaacatgcaaaaacccatgagaaagacaaacggtactactgctgtgaggagtgtaacttcatggcagtgacggagaatgagctggaatgccataggggcatcgcccacggagcagcagtgaagtgtcctgttgtgagttcagaagtaactcagagaaaaacacaaaagaagacttcagtgaaagactctgttataggatcatccaaaaaacctgctacttacctatgtaagatgtgtcccttcactacttcagccagaagtattctgaagaagcacacggagtatttgcattcctcggcgtgtgttgactcctttggtaatccactgggacttgacaaaagaaaaaatgacagcctcgaggagtctgtagatgtcgatagcaccaagtcattagctaagcagcagccaagtacatttccaaagaactctgctttaaaacaggatgctaaacggacatttggatcaagctcacagtcaagtaatttttcaaaatttcataagcggccacatagaatacaaaaagcccggaaaagcattgcccaatctggtgtaaattcgtgcagtcaaaacaagtctcctcacaagaacgttatggttaagagcagcactgaccaacaaccaaagtatttccatcaggccccaagagaaaaacctaa

SEQ ID NO: 30310 - DNA, 1132 bp, Mus musculus
tttgacgatttcttactgtaattgtggaggtagtaacaaattgtacttgttttacaatttaaatatcttacctcttaagtaaaaggattctggcatttgttgttatcctatgaataactggagcctaagtttataggctgttgcatatgagtataaatagttaaaagctataaaggaagctttaccaactaaacattgtgatgggactgctggccaggatgatgttggcctgttaccctagcacatgggattgggaattgaaggtcaacttctggctgcaaggttaatgaggccatcttgggccacgctagcctgtctcaaccctcctccccacccctcatctccacagaaagaaggaagaaatggagaaatgtattgtttatcatgatttttgcttacactgtttgacttttctcttcagttggaagcagtaattacatgactgttactcattaatgctaagcagtggaagtcttataataagcttatattaagtcctaaggttatattaagctggtgctttggagaaaatttctttttccctgaaatctagaagacttagaattgtaaaggtatatagtaaagaaaatatgcatctttatattttattatacttagttttgaagaatggatgttttgtatattctgtagaaattgccataaaatattttattattaatatttagattatgaatgtgtttgagctaatgaataaaaatttgtattccatgtgaaaatttttgtttttgtttttgttttttgtttttgtcttttgctttgaataaatgtatttaatatattgctgctcttgagaatttgcatagttgtcttgaagagatggctaactgtatctgctgtatgttcttagggtaggcgactagggctaatgtacagttgggtagaccagacattaaagtacatgctttgacttcaaaatgttaagatttttataaaggtgggggtctttttgtactggatttaggaattcacaaaataatttggatgccattgaagcttttgtgtagaaaacctgaagaatgtgttttatgtcactgtgttgtgtgataaccatttgtgagtttggttttgagaaagttgattttgttttcagaaacattgtttgtattatggc

SEQ ID NO: 30311 - DNA, 1204 bp, Mus musculus
aatagagctgctcaagtttgtccagtctgaggctcagcaggaagattgttcacgaaacaagtatcatggagtcgttggacacaagggcctgctgagtcgcccggcacctaaaactgtggatcagcagtgtaccccaaaaacttctgtcaaaagatcctacacacaagttcacattaagcaaggaaaagacggaaaggttctagcttttacattttcaacaagaatattagaactgtttccatcagccaacagagggagacctagtacgaggatagcactgtgattaagacgctttttacaaacctaccttacacatcttacttggctggttaattagagtgttactgaatcaatttcactcggtttcaaactaatttttttattttgtcagcttatggtttgcagttatagattacactatatgataaaacaaacattctatgttacaaaatttaagttagttgtatccacactctctttaaaaagagcattatgatgggggaaattctaaagtgtctgtctccattttggctgcccaggaaaatgaaacccctgtgctgtgcgggtggccttaggagtttttagtgttgtgagtgtggcctgtggtgacgccgtgtgggtgctgagttttgcctagactgtgtctcctttcacagtgtttggtgcctaagagtgtcttggctgtcatgtagtctttcaaaactgtggcagaggacagctggcagaaagtgttacaggtataaccctaattctccttgtttctgttggtgttgtaggagagatctgtaggcctttctgtccagcgctctgtttttggagagagaaatttcaatatacacagctccatttcacatgagagccctgcagagaaagtaagtaatgcagcttcatagctcagctgtcagtcagccacacagacgggctcagggacccagtccacgaggggagcgtggattagtttggctttggcagaaggtattgctgcttcaagcatttactcaaaaattcaatctttaatctttttctgaactctttttgatggaattttttattttgattatctattgctgttttttctctataggaacatttcagaacaaggctagacttcaccatgtgagctcccaggacctcacagttccaacacacagtcagtagtgtaaagattcctgtaaagtgccttcaggttggatggttttacgtt

SEQ ID NO: 30312 - DNA, 1276 bp, Mus musculus
atttttgtaatatatttaaatgtatatttttgagagagatactacattgccaaggactttataaataatcttaaattaacttacaaatttataagatgcaaaccaaaagacttttttttttttaaagagagagagaaaagagaaaaaagcttttatttccttggatctcattatcagaaatattattcagctcaagaaatctgaccccatattggaaaatgaatgtcctttagtattcctgaagctaaagcttgggtgtctcctcccagctcttgttacagtgtttctgactgcttcacccttcacagatttaatacaatgtataagccttactttcataacatattctacaagtttccttaagactgttgttatagtctggctgaacccatttccacctgcaaagtcttgtgttgtgtctgcaggccacaccagtggccacaggggccattttgtcttgttgatgctgaaaccatgctggactgccccaggctaaggcaggactgtctgtgcaaggcactacagctattcacgtggagttaccgctgcattttcaaaggtcggagatctttcttctgcctgagttggtcatgtagcaattttttcctaaacacaaaatggccttttgcttgtctggtaatgagattgtaaatccatttcctgcgtgtgttctccgcaggcttgcctgagtgtgtggggtgcgcaggcgcgtgcctgtctttttgtactgtaactacctcatggtttgaatgatgagcgtactgctggttgtattaacagagcacatttgtcgggtgagtcgtgtatacaaactttttttttttatcctgtttgttttatctgggggttcgttcattaaactgacagatatttttctaggaaggactattatcagtttccaaatgcaatactctattctggtttttcctgagtgagcctgattttgttcctgtttttcatctacgagggtaaaagcataccccgggaaatccctgtggccagtttgaacacccctgctgtaaccttccctctgttccatggtctttgtgaacctgcttagaggtatagttttgataaccacagttttaattcttttatctgtgcataataaagatatgtatcaattattaatttatgtcatatctggtcatcactaaaccctccccttggtctgacacagctttgatggcacctgctggaacagggcagatgaggatgaagagaaaggaggggaaagaacaaggacccaagagagcagagaggaagggagggggca

SEQ ID NO: 30313 - DNA, 1120 bp, Mus musculus
aagaggtggaaatgaaaattttgtaagatctccatttgcacagcatgtaaatactcacctgtttccatcctctctcttcagggccattttaagtgccaggtcgagttattttgctgcaatgctgagtggctgctgggctgaaagctcccaagagtgtattactcttcaagggtgagtaagcataatgtttcatgagtcagcgtgactatagaagattacagatgatacacacagcattcttcctgcgttcagaaaaaacatatcttagatggtagaacttcagaactgacgttttttctaaagctaaaggcagaggatcacttagtaatcaaggtcttatctgaatctgctcaggccctgaaacagagccgagagactgcagcaccacacaccggttctcacacttgtgaaggctgagagatcatcaaggcttccttagcttgtggacagctgctccctgtgtctcgtggggcgtttgccatttgtcttgtctgaaaggatttctgtggtatctctccaaacactactctgtcctatccaggctccagcctctgcttaatttaagcttatctctttccagtggcctcctctctgtgctgaaggctggagcttcagcgtctgatctggggaggacacagtcagttcctggtgcacacatgcatagtgcacacattccgattaagggatattttaactgtcaggcttaaagcttcattatcctgtgggtaagaggagttaaaaggcatacctgctggtgacctatgttaccactgttgaaatacagcgtgagggggctggagaaaagctcagtggttagagaccttcttgctctccacaggaccctatgagagttcccagatgtttggacagcttacagatgcctgcaactccagctatggggatctgctgtcctcttctggacttcatgggtaccagcacatatagacataaataaaaaatttaatctcaaaaaaaccccaaacaaacaaataaacaaacaacccaacttgaaagacctgtctgccagactgatgatgttttcctttgagaatggaagaggttgaacttgcagaagccacatatcttcaggagtggctgctttgtgttaattttagaaact

SEQ ID NO: 30314 - DNA, 1099 bp, Mus musculus
ttcttctcttctaccaggaaacagaccaaaggcagtggatacaagaccgcagccgcacacaaaaagcagcatcatgagaaagaaggctgctcagaacgtggactccaaggagggagagcagaccgtgtcagaggttaccgagcagctggataattgcagattagatagtcaggagaaagtggccacttgtaaacgtcctttaaagaaagaaagtactcagatttcttcacctggccctttgtgtgacagatttaacacttcagccatttctgaacataaacacggtgtatcacaagttacgcttgtaggcataagcaagaagagtgctgagcatttcaggagcaaatttgccaagtcaaatccaggttctgggtcagcctctggtttggtacacgtgcgtcctgaggttgcgaaggcaaatttactccgagttctgtcggacactctgactgaatggaagacagaagaaacactgaagtttttatatggccagaaccacgattctgtgtgtctgaaaccctcttcagcctctgagcctgatgaagaacttgatgaagatgacataagttgtgacccaggtagttgtggtcctgccctgagtcaagctcagaacaccctagatgcaacactgccctttagaggctcagacacagccattaagccactgccaagttatgagagcttgaaaaaggaaacggagatgctgaacctgagggtcagggagttctacagagggcgctgtgttttaaatgaagacactaccaagtctcaggactctaaagaggtatgtcttcatgatgggtgtcttcatgatgtcttcatgatgggtgtttcaggctgctcagactgagagaactctgcagagcagacctgggagcctctcgctctgcagtggggtaggtcggtcacttagatagtcagatgtttctctaggtgactgcagtggagtaggtcggttacttagacagatgtttctctaggttaattgcagtgtccatttgaaatgttacagatatggctgggggtggcttactggaagcttgaggacctgggttcagattcctagcactaataaaagctaagcacagcttacccactg

SEQ ID NO: 30315 - DNA, 2964 bp, Mus musculus
ctgaatcctgctttggcagatggcagtgagagcgaagcagaagacggtatgctgggacctcaggagagtgaccctgaggctccacagaagcagcccccacagagagagtcctactcaactaccgtgtgaccgtcactgtgacagccggagtcttgagggcagcagtgttacaggagaagagctggagccatcccttgtcctgtacatatgtctgtttacagtcttacctgactgtctttgccaaatgctcactgaatttccattgccacagtagactgaagtatgctaattggtaaatggggttctaacagtattactgaatataaatttttcctatttagaaaatactgctatgtctaaatgtgagaattgtttaaaaattgaggactatgggaaattggattctttttaaacaaaactgctcttgtgcaatattttatgctcattgaacaaactgtacatttgtgtttattagtttccaagtcagctgcctgtagacgtgtgaccagcacagagatgtgatttatcctgtgcttggcatgtctgtttcttcactaaaattcagttctgttagtggccattggagactgtcacacaaacaccttttctttgtataatttctaaacacaaagtaattgtctgttctgaaagttttttgttttagtttctaagttttatgtgtattatatttctgtgtgttagtcagaatagtagcaggttagctacagatatattatttgtacatatttataaatctaccacccaacacctcttacttacatgagtagcaaacattgactaggactgccttcagcattccaacagaacttgtgtaaaataacaggttaaaagacaactcaatacagatcagacactactggcttagcagctgtagtaacttgcagattcataactgattgctgtccaaacactactgatgaagccctttactccatctgtaactaataatataagttccacgattaaagaggttatagcacatgctacttcttgctaatctatttaatataatttagcactagaataaagtccaagatgcacacaaatatatctgaaaagaatgttgtgagtattgtattaaatccttcagcttctaaccgacaggtaaagccataaaaaccctttactcagttgtttccttgtgttcagactttttctctagaaagccgagtgcctgttagttgtgaattgagaaaggacactcaacctgtggagaggcggcaggctgctgctgactggatgcctccacactcttttgttagcagcctaggaaaagaagagccatagtgggaaatagaacttagtacatttatggaattacattcttagacagaatgttttatacatgaagaaaaatgttttatgaaatggagtagaagaagcaaaagtagttttcattctatgactgtgtgatgccttatgctgcattgtgggctgggctgtcccagggagactgtgcccaagctactctcttgcttgacagacaagattggaaatgccttctgtgtccagagcacccgctaaattcttgtatttaatttacctgtgatcacaagctagttatttgaggtattaattaaatcttctcaaaaggcctcactaatgagctttttagctccctgctctctggcaatacaataagtcttatttaaatatgtctgcagagactcttctgtagagatggaaattcacgagcatggagtcaagtctctcagtgagagtgggtcctgctctgagagtgacagcactgccagggtcgagtcccttcgggttctcctgtgtggctctgtactcttagttcaggaggttgtcgtagcccagcaaagtgagatgacttgtatctctgttctttatctcgattccacattaggaaacatgaatggggctagcagtacagctcgaaagttagaatgcttacttaaaatgcccatggccctgtgtccaatcccagaaccaccaaaagacaaacaaagacagagaacaacctaatactctttctggtttgaaataggtgtaaaataaccttggtaattagattttaattcattgatgctcttttggtttgtacaggggaaagctagaagcgtttaggtttttgagtcaagtcaggtgcaggggggcatgcctacatcagctactctggaagctgaggcaggaagactgcttgagtacaagaccagcctgggtaatatcaaaaaaatattttttaaaatttacatgcacctgagagaaatataaaatctttatggatatcagggtcctataggatactatgctctgatctgactccatttcactcaaactaatattaagaatctgtttaggactttaaggtgttggactgtggtctaatgatgaatttttacttcatctgatatttttgtgtttttcaaatggtatctattcacaccctaagacttgaaggatgttctaggcagaaaatgagtggatgacagaggacagaaaactttgctgtcttgggatagtgactttccttctcttgtttctgcccaggtgacacactaaaggagagcccagacattaggatccaaaaagcagttcaacaaactttttttttcagtactgggggtggaacccagggccttacacagtgggtaagctctctactgctgtgccacacccagagtctgacttctttaaaatcaatgcataaatttttttatggagaacgaggccaaagagattgttttatcaacttctactctggtttcttgctgtttgaattttttgttttggtttgtttttattttgcttgaccagttgtcagccagtcagcctttgctggttgatggaaacatcatagtccagctaactggccatttatgttgagaacaagagaaaaagccttttccagccctgagcacaatgcagcttgtgaatttccaggcagtgcctttgattgaaaataatgtctactgcttt

SEQ ID NO: 30316 - DNA, 1174 bp, Mus musculus
gaggatgggaagagagagagatctagtaaatgttgaacttggtctttgaggggtcctgtgagacgactcagtgcgaggagacagttgctgcaaggcctcggaggacctgagttgggtcccctggattcacactgtgaaagagaactgactcttgcaggttgtcctctgcgctccatgtatgtgctgtggagcatccccaccccaaaaccagtgatatgtgtaatataattttagaagaacatggcttttaaaaaatgaattttgaaaaatacccaggtttgcaacagtttaaattaagctgggcatggtggtgtgtatctggaatcgcagctcttaggaggcctgagacaggaagagcatatgtctagccaaccaggagtactaattacaaagcaaaagcgtctcttagcaaacagtgcttacacacgtgctctgtaaagtttgttcatcctctatagagtacttgttgcgatatagtaatgttttatgctttagcgtcacttagctcgaacttctggaagatggaaagacccacccaagaaaaatgctgtgaatgagttacaggatgagctgatgagcattcgccttagagaggcggaaacacaggcagaaataagagagatgaagcaaaggatgatggaaatggagacacaggtatggcgggcaggcccaggtgggtggaatacatctctagatccaagtcttacacagttgttttctcaaaagtaactgactataaagttaggaagagtgaaaatgtaggttttaaatgcgaagtttgaatgccatgccactgtgtttaagggagtggtaagtgaatgaggttcacggtggtgtaatcctgagaactgacataaaagctgaggtctagacagtagtttctagtcctcacgcagacagctaaaacctacctattgctgtctgctcctgttcttttaagacagcacctgttaccaaagcgggagctccagcaatgcaccattgttgttgttgttgtttgtttcaattaagctggctggctagcaacttcagtctgtctgtgtaaccctagagttataaatgtgagcccacctttcatatgagtgctggggatctagactcaggtctccaggcttatgcagcaggcgctctcactgggccattgcgccagtactgtttgctttgttttagcttt

SEQ ID NO: 30317 - DNA, 1175 bp, Mus musculus
ttataaaaattgcaagcttgtggtatgttgataaactttattgattaaaaacatgtttctagttgttctttagtgttctagtatatggttgaagtaatttgtttctgtcagtttgaggattctgctttcttttttaaaattttatttatttattcttctctcatactgtataccccaattacagcctcccttccgtccaatccttccagccccttctcccccgactcccaggtctactgctcctctgtttcctttcggaaaacaacatgcctcccagtgatatcaaccaaacttggcataacaagatgcaggaagataggcataaccctcatgtcaaggctggacaagacatcccgtagaagaaaaaaggcacaaggaggcagaagagtcatagaaacccccatttcccttgttaggagtcccaacaaaatccccaagctagagaagcacagaatgtatgcagaggcctggtgcagactcatgcaggcatcatggttggcacttccatctctgtgagctttgctgagttggttctgtcaaccgaggttttcctgactcccctgactcctacagtcttcccgcctcctcttctgtggaggaggattctattttgatgtgagccatttgagctttatattttcttagtgctttcctcatacaggatattggcaagctgattgagcagatcttatcagagctacatcttaagaactaacaatataggtaatgttcacagaataactgatctatgatttcattaatacatatggtacctttagcttggctgaggtcattctgaaagagtatattttgtttgacaaggtgcttactaaggatggttgcaaatgaactttctctataagcattattttaatagatccagaattactagaggtgacatgttggttacagtgccttagattgacttaggtccagtgacataagcaggaagcacaagttcagttcttacctgaccagcttagtggggccaaggtgccctgtgatgtagcttagtgatggaatccttgcctaggtacaaagcctgggggtcagtcaaccgggctagaaggaggccatgtctccatttgtacatctgttaggaaaatggagttttgtaaaattgaaatgctttcatgaaagcatttggtcatttttaatagttttaatttgatatt

SEQ ID NO: 30318 - DNA, 1172 bp, Mus musculus
acctctttgtggcaatgaatatgaattataatggggctaattgtattaaatgcttaaaatacatcttactggctcaggttttgtttttttgtttgtttgtttggttttttcaagacagggtttcctggctgttctggaatggttcagttttttaactgctatgcatagtgaaaaagtgcaagagttgctgatttcaaccaaacaaaaattgttaaaactgtaacttagagctggcatgatggtgcttacttttaagctattctggaggcagaggcatgtggatctttgtgagtttgaggccagcctggtctacagagtgagttccaggacagccagggctacaactagaatccctgtctcagcaacaacaaaagctaataattgtcgtgaagtttttaaatgctgtccttactttatctagtatcatgtgagatggtatcttaaacacctttaattctgtttagattaatagagacagacagtaagtctttaagatcagtgaatgggtcaagaagaaacagtggttcctctcttgtatcaagttcatcagcctccagcaacctcagccacctggaggaagactcttggattctctggggaagaattgtgaatgaatgggatgatgtacgcaagaagaaagaaaagcaagtgaaggtatttacattgtttacggaagttctttctcttatcccagagggtaagaggcattaggagaaatggaaggattctcctagtaacctgtgtgctgtgtaaggaacaggttgcctttatatgtcttcattgtccatgcttgatagaaagaagtctaggttgtagagattcacagttgaaaaaaaatatttttagaagttaaattctcccattttgtaaattcagaaatgaaatggagacatactgtgttagcattttgcctttttccttcagcagccctttattttttattttttttcttttctttttttttttttccattttttattaggtatttcgctcatttacatttgcaatgctataccaaaagtcccccatagccgcccaccccctctcccctacccacccactccccttttatggccctggcgttcccctgtactggggcatataaagtttgcgtgtccaatgggcctctctttccagtgatggccgactaggccatcttttgatgcatatgc

SEQ ID NO: 30319 - DNA, 1245 bp, Mus musculus
tccaattacaaaggttttgtcattttttttttcagctgcacttgagagatattcctgtcttattccttactttgttttgtaggtggaatcgtcccaaaatgtctcttgcccagaagaaagatcgggttgctcaaaagaaggcaagcttcctcagagctcaggaaagggctgctgaaagctaaagcagttttctatgaagattttttcataaagacaataaacatattgatcaagcagctttttctgtgttaagctgttattaatgagactataggaaatagtgtgaaattacaaaagcaaagaagtagatagttatttaattaattaaattaattttaccttttgtgttgcaccataacctaccactggtgggattaagggcaagtattaccatgcctagctgagagtctttctccaggaaaaaccagcttacatgggttcctgcaaatctcatgagtgtttcttgggtttctagtcttcctgggaggtgtccttatctttcagattttcagatctggtaattagcatgatcatcaggacatttattacaaacaaattgattagtgggaagaaagtatctcaaggtcaatcttggaagtgaacaactggtgctaatccatggctttaaagatttgagaacaacggtgaaatttggtttgaggagaagggggtgtctaggacgtttcatttttatggtacatgccagacatgaatgtacataggaaaataacttgaaagggtcaaatattaaaccttgaatatcaggttcacttgggaaagcattaggtgcttatgcctcttagtaaatagcccttcatcccagaaggagcaagaattgtcttcctgacttaatccagtcttagctgaggtgctgtgcatctttatcatctttgccttgcctcacagtgtcaggctctgtggtactggggctacacaggtcaggtaaacagttaactgcttacctacatccccagcaaagataatgtgacgatactaagatgaacctatcagagcttaaagataatgagtttcagtcacagtgataactgcatgctaacttcagcatgtagaatatatgccgaagctaaaagccattccacagttgactccatctgaagttaaagtgtgtaagtacacagtaaatcatgctatattaactgaactttttaataaatgagtcatttgaatttacctgtgtggcattcttaatttgtgttaatgtgcaaagttttaccatgctaaaac

SEQ ID NO: 30320 - DNA, 1192 bp, Mus musculus
gggaaattggagcggcacaatagagggatgaaagttcctactagggaggtgagtcctatttggggggtggtagctttcagcccttagattaaactacctttaatctagtctttaaacagacagttgttacaagtagtttactgactgtgtattgtttatctatgcattgtgtgtgataggtgtacgtgaggatatggtaagcaagccctacagttttctaagaacacagactgtacgtatacagggtgcagagtaaagactcatttttttattgaagaaaaataattgaaattacagattactttgttcattttttttgagaaatgatactatgctaggttcttttttttttttttttttggtttttcgagacagggtttctctgtgtagccctggctgtcctggaactcactctgtagaccaggctggcctcgaactcagaaatccgcctgcttctgcctcccaagtgctgggattaaaggtgtgcgccaccactgcctggcctatgctaggttcttaaatgtattttcacaatctgttacttttaaaaaaaatttttttttgagactttctgtgtagccctggctgtcttagagctcactctgtagaccaggttggcctcaaattcaagagctccacctgcccctggctcctgagtactgggattaaaggcgtgggccactgccatcaagctgatatcttagtcatccccaactcttctcagaccacctcacctctaattcccctactcccacttttgaactatcccactaagcctagatagattgtactggctgtgtgctccagagtgtgaaggccgtatgacttctgtgtcttgaaactgtagcctcagaaagtactttaaatgcatttttgtttgtttgttttgttttcaacacagggttttctctgtgtagccctggctgtcttgtaactgccttgaactcagagatccacctgcctctgcctccccagtgataggattaaagacatgttacacaactgcccagctacattttaaaatgcttgtttgtgtgtgtgcaggtacctgtgtatcatagcatgcatgtggaggtcagaggacaacttgttgcagttagttttttctagtttgtgggttctgaggatcaaactcatgttgtcaaatttgcagcaagatccattacttgctgaggcatattacttactggtc

SEQ ID NO: 30321 - DNA, 1140 bp, Mus musculus
gaaactcactatgtagcgtgagccttgaactcagaaagctctgcctgcctttgcttctcaagggctgtgcttcttaaaagcttttctagggatttggctttggacaggatgcaaaaagtgaggtcaaagggtaaaggtaactgttactaggatgggttcttgttcccaaacgcacatcatcaatttcaggagaagggagaaaaatgacaacgtttaatgcttgatctaagaatgtgtactgtgtaatagaagtaatacagtggagcataagacaagaacataacataaccatcacataaaagacagggtatgttgaaataatagcaaagcatataactgtgtctgaggatgtttgcctctttgattgtatggtttccattccaggattagagagcattctgctggcttatttttcataattatactattcaggtttgggttattgtagtggtttttaagttttatttattttatgtgtatgtgtacactgtagctgtacagatggttgtgagccttcttgtggttgttgggagttgaatttaggatctgtacttgctccagttggccctgctccctccagaaaagggcatcagatttcattatgggtggttgtgagctaccaagtggttgctgggatttgaactcaggacctttgggaaagcagtcagtgttcttacctgctgagccatttcaccagccctattgtagtggtttgaatagatttggcccccatagattcatgtttggaatgcttagccatacagagtggcactattagaaggtgtggccttattggaggaagtgaatcactatgtaggtgggctttgaggcaccacatttgcctgcatgctattgtacttcccaccatgatgataatggactaaacctctgaaactgtaagctagctctatttaaatggttgcctttataagagttgccttggtcatttctttacagcaatggaaatccaaagtgaaacagaaagttggtaccaggaagtgaggtattgttgccataggcctgaccatgcagctgttttgtttttttgtttttggaggaatgtgggttttgggacttttgaaagagtgggattctttaattgggatctgatgcttaataggcctcactagtagaagcatg

SEQ ID NO: 30322 - DNA, 1156 bp, Mus musculus
aaatgacttcttgagtcctggcttagggtatgcagtgagcaagtatcatgaattattgttcttttgttttagttacatctacttagaaagtacttgtcatttgagttatttgttgtttttttcacaaattaaggattttataccaaaagtttggttaacatgtgagatttatctggtataaaatcttatacgtcttctatttggtctatttcctgaacagagactctacaggagcaggtaattcactggtccacaagcggtctcctttacgtcgaaaccaaaagacctcagcatccttgaacaagctgtctttacaggatggacataaagccaaaaaaccagcatgtaaatttgaagagggtcaagatgtcttagctagatggtcagatggcttgttttatcttggaactatcaaaaaggcaagttaccttaataaatttctgctatacttgcattactcattttaataattttaaaatttaacctcatgcttagcagttttaaggggttactgatttcttgtgtattgcagataaacatattgaaacagagctgcttcatcatatttgaggacagttccaaatcctgggttctctggaaggacatccaaacaggcaggtgctatgttactcttgaacatgattgatatcgaaacttagttttcttcaacatgactttttctgatgccagtgatactgaatatactgttcttcagtggctgggtagcatgtataagacgtttaaaaatttattttataaacaaaactctatagtttaattgaatcatttaatactattttctgttattcttctacatgctgaatcagttttagcctttctactttggagattttggtaggtttgacataggtctttatgtctttctgttttttttctaaggcagtttttctgtgtggccctgggtgtcctggaactaattctgtagatcaggctggccttgaactcagatctgcctgctgcctcccaagtgctgggattaaaggcatgcaccaccacttacctacctctttttgccttttaaatcccatctttttccatttttccattctctttttttcctcttcattcatatacatacatatatatatatgtacatatgtatatgagaatggttgaatatatatatatatatata

SEQ ID NO: 30323 - DNA, 1104 bp, Mus musculus
ctaaaagcagattaaagcatgtagacggacatgttaagttagaaaggggaggaacagagctagtgaactgagcagagaatattgtatgttgttgcttgctttgttgaacattctaatatagttaacacatgctcatatgactactgagtcataaaagttctgtggagttcctcatgactttaatactgctttatgtatttcaggagccactgggagtggggaaatggtctgtacaatatgtcaagaagagtattcagaagctcccaatgaaatggttatatgtgataagtgtggtcaaggtaaacattcatttttctcaaattttattaaaaagttagcctattgaagactagtgactgtagatacttgttttgctaatttgaaacattatcataagatctattcatcatttataatatagggaacatgccttcttgaaatcctgttctgcagtacttgctaataaactagaatttgctttctgctcttttgatatgaaggatatcatcagctgtgtcacacacctcatattgactcgagtgtgattgattcagatgaaaagtggctttgtcgacagtgcgtttttgcaacaactacaaaggtatcttttaaaagtgttttggggcccattggacttgcaaactttatctgccacagccagggccaaaaagtgggagtgggtgggtaggggagtgggggagagggtatgggggacttttttttgggatagcattggaaatgtaaatgaggaaaatacctaataaaaaatataaaataaaaaaaagtgttttgggctaaacattattaaatagaatttgtaaagccttattgaaatgaccatgtttgttctgaatgaaagtagcagctaatgttggttagaattgttttattaatgatccttaaatggctcgtagggtttttttttttgtgctttctgataatggtgtggggagtaggacaataaattgaaataatatagtaaatgcattattagtaacagaccagacaatatggtatcatagaaattcagaatggaaattatttcagaagtgtcaggaatttttaaaatgtagaattaaaaattagaaaatttggttaaaaaac

SEQ ID NO: 30324 - DNA, 1101 bp, Mus musculus
gcgtgtacttttgagggttgaatgtgtgctgctttttgttatttttaaaagatttatttattttatgtatttgagtacactgctgttgtcttcagacacactggaagagggccttagatcccattacagaggttgtgagccaccatgtggttcctaggaattgaactcaggacctccaaaagcagccagtgcttttaactgctgagccatctctccagcccctttgttatttctctctatgtatctctggcatcttgaaacttactgtgtagacccgacaagcctcccaagtgctggaattaaacgcaagtgccaccaagccctgcaagcatgtgcttttgatgtgtgaggccctcaaaactccttctaaaactctgttatgggtatctaagattaggaggacaatctgatagtgacaagcataattggcctagtacagttagtactagcaccaaagtgctgatagaatatccacctgagtttaggttctggtgttctttctaatcaggagaatttgagcagtccattttacctttgtatggcctgtgtgctatgaggtgtttggcacttaggatgtccacacaagatttgtcttttgaaccctgaattatacttggtttattcacacaaacattccatataatatgctaatataaaagtcttcgaccaagtagccaacagccaagcaggctgtgcaggcttccactgggtgtccagtaaggaagctttgcaggcttgaaccatgtccactgcatgtcttcctctgaggcaggctgggagaatggcactggtagaggtctttgagaacattacctagcgtcttgcactgagcggtgggcatgcgtgagctcagcaatagtgccagaagttcagtggtcacttaacttaggccccacacaggccagtcataacgtcctcttgctaaggcagaggcttgagaagcaacatctcaggagctttgtagtgcagttctaggggctgcttttaaagttccaattttttattgttcattagactttagttttgtgctttcagggtttacagcgtggggttggttcactagcatatcaatgctaccttaaggttaacttgttagcatat

SEQ ID NO: 30325 - DNA, 3093 bp, Mus musculus
tttaattgtactgaatattatctcagcaaacacatacttaacatagccaggtggtggtagtcagtaatcccagccttggggagtctgtggcagggagagtaagagactttgctagcctagtctataagatgagaacctttgtggaaaacattacccaagtgaaaaagatcttagcagatgtgttcttttccctaccctagattatcagactctagaaaaagaactcgcacaggaagatcatggcctgctgcaataccacatttgcggagaagaagaggtcgccttccacgaagagcactccagactcagaactcagaagttgtgaaagatgatgaaggcaaagaagattatcagtttgaagaacttaacacagaaattctgaataacttagcagatcaggagttgcagctcaatcacctgaaaaactccatcactagttattttggtgccgcaggtagaatagcatgtggcgaaaaatacagagttttggctcgtcgggtgacgcttgatgggaaggtgcagtatcttgtggaatgggaaggagcgactgcatcctgactgtaggactgaacgtaatgttcactgcactcgttttctgttggtacagttaaaaaaaaaaaaaacaaaaaacagagtgtgggttttattatctttcttagaaaaacaaacaaagagaaaacacaaaaatattcacaaaaggagatgatactggccttaaaacatgttcttgtcaatgttatggatattgtcataaaaaaagatatcttttaaaaatcagaggagagacttaatttttttaaatcttaagatttgtagactgtttctaggataggctattaaacatgattcatacccatgcatggtgttagatactttttataattattccattgagtcaatttttgtgattagtggttatcagagcaaacagatcatgtagatagcacaagtatttggagaaacattgtgtgttttgttaacaaaatgttggaaagatttatttcaataccctttagatttcataaagtgcagtgtatataatgtctactgaaagactgtaaaatattgaaatttctttcaagcaaaatgtaaaaaaatatattgagcctgtaaattgctctgtgactagacttcattgtcgtcttaatatattctttgcatgtacatgtatatacacacatgtgtatatatatgtgtgtgattatgtgacctatgcaatacaaattatgggaatgggcagctttggagtatatatcccataattcttatttcaggaatagttgcagtatttacacagcagcatttcttctcaggcgtttattgggtgctgttgcttgctatgtatgaagagaaatgtgtcaagtttagtgtgtactgaagaagggtgtgaacaacagtgtacatgggcttttagagggcttttcagtccttgtaactcagctgttgaatacctaaaacaaattcgagtgataactacattatttcctattagaagtgacgttttcaagtgattgtggcacattatgattgtaaatgtctcagttttaacagcaagtctgtgggagcccagtgaagactcctgaaatgtctgtagtaactgttagtcatgtttgagtaagcgtagtatgaacaaagtcttttattgcacagggttaacaaacagtatgttgctagctgaggctaactgctgttttattacaacattacctcttgtttttataaaatgtaccaagattttaaattgatatctttattttacgtgttaaaaaaaagtttcttttatcaccagtgttagagttgtcttctgtttttttggtttgttttggtttggtttttttcttgttgttttctttcttagccaaagagtaaacagaagaatattattttggtagctcttcattttacttttataatgattggtggattttagactaaaaattggggaaatttctgccaaaatgaaaaaatatgtgacgtgtattgatgacagaatgctaaaattgtggttagtgcttatttattccattaattgattatttgcctgtttttaaagaaacatgctttatttccttaagcatcttcaaaagatgacttttcttgtcacattgtagccaaaagaagcagagaatttcttgtcctgcttttggttcctggttaaccaggtataatgagctttacaaagtgcaaattacaaactgtcacttctgttcacctccaccaaaacttgatttcccctagctattaatttaaagttgcctttcctgcagctgcaatattttgaataacacagagattgtgttaatttttgaatgtttgtttatatctaggggtaatggaaaatgtaattcccgtgtaaccttattcactccagctgtatcatatttcatttttcccaaagttctttaattttaactgaacaccagcagtatttttagtaattctttaagatacttggaagacaatttatcaagctgaactgtctctagacttaattattgtgaatgtctgttttcttttatcatggtggttcacatggctctgatgttcagtttgtatttttgaaattgctttacttagaattaaaacagaccaacattaaatgtgtgtatttttaaaagagctaatgagtttttcttctgtatctgcttgaaaatacacactggtgcagcagttaactgcttttatttagctagggaggaggaattttccaattcttttatatacttgaattagtcttgaagaactttgcttccatttccttttgtcataatgataatagtgtatgttcactgtgagtgatcttttaaaaaaggattacatgctttgtatttgaaagacagtgtttatgtcctttcctcttccaaagactgtagaaaaatcaggcttcacagttgtttcttcttcctaggtattggggcacatgtaaacagacttcccgtttttgctattttttttttttgactctaatctacagaatagaaaagttgtaaaataatataccttccttcctttttcattttaagcatttaagagaaaaagagagcacagaagctgtgaatcttggcagctgctggaataggtaagcgtaggtga

SEQ ID NO: 30326 - DNA, 1581 bp, Mus musculus
taggtttatcatgaaacagaatttaagttacactcacttgtagtgtttataataaatgtattgtcaagtagagatagtcaatagtcagatctgggtattgaacccatataaacatacacatatttttttttgctggaattcttattacgtattaatgatcttgcactaccctgctacctcacacacaaaattatgatacccagagaaatactgatttcatttacaatttatactcagaatagttcaaaaatatagtttcctctttctcaggcccttgggaggaaactagaaatttatttttccctatccagaggcttttcaaaatgtgagataaatactatatgtgatcaataactgaccaagaaaaatgccctaggcttctaaccaagctcctacaatagatgcagaaaagaggccaatgagatcgttgcctaaaaaaactctcttccctactttaagtgcaagagaagcaagctctagacagctatcctaactgataaagcagagtccactgcgtctcttctgaaagactgtgactaagaatcctacctcttagatacagctgatactgtactgtgttcttaactgcttacttaacactgtatctgttacatcatcttgtatgtatggaatttgtgccactgactttttgaattcttactcagttactcactgccatttaaaatggtcatagtagctttgctggaaaatcgaataacttaggaatgttaaaagattttatttttatagacaaaagtaaaaagatactaagaaccatgttgcctgtattaatcataaagaagtaaaattgtaagcaaaaaccaaaatgtttatttttaaatgtgtattttctgcttcatagaagttttttgaccttactgtcttaattatactaaaatcaagtaagccatcacttgctctgatttttgtcttgttaattgtataaattactacagtagcttaacaagtttagagatcattgttcttagttgcagttggactgtgtgctcttttatatgaatgtcaataaacagagactaagtaagtgtaagaagacattgttgaaacataaatcaaaatatacttaggaatatttacaattaaacatgatgttttaaacttagtaaaaaacaaaagcaaaaacaaacaagtacctgtaattttgtacctacagtgaaaattctttatctgaaattttaaaatacattgatatagcatgtaattttttttcttctggagtataatacaatgtggctcatatggcactatatactatatttgtgaacttttatcttaaatgaacaacagactatgtactgagctccatacaactaataaaaggtactatcaaggaagtcttaccaacctatcataattgttacctactccttaaagcttctttaaaaatttcaatcttaagtaaatttgtttttctttcacattttgaaaggccacagctatcaagtttttatattactgtactcacttggtttctccattgcttaaatatattttttacctaaagggtctttaatcccagcactcgggaagcagaggcaggcggatttctgagttcgaggc

SEQ ID NO: 30327 - DNA, 1167 bp, Mus musculus
ctaaagttaaaaatctttcccagatatcatatatgaattaaatgaattaacaatgttcataaacatgccaccagtttgcttttacctagaattttctctgtatatgtggcaggtacaagttaaagaagtttccaataccttacattagaaatcatttgatggccgggcagtggtggcgcacgcctttaatcccagcacttgggaggcagaggcaggtggatttctgagttcgaggccagcctggtctacaaagtgagttccaggacagccagggctatacagagaaaccctgtcttgaaaaaacaaaaataaaaataaaaataaacaaaaaaaaaaaaaaaaagaagaaagaaaagaaaaaaagaagaaatcatttgataattatataatcatggactgaatagatcagcttttctctactaaatctctccaaaaaaagtaaatacaagcataccactgaaaaaatactcctatcatttttacaaccaaatataatgtgaaatattatccacaagtattagtttttatatacttagtctatacttccaaaacctaacatttttataattaaaactggaaagggattctttctttataaaaattagacagtgtctttgtctttgatataaggtatataaagggtagttgatgtttgtgactgagatgcattctgtctagacgttagctaagattaaattagagataagatgaacttatttttatattacgcatcagcagtgttaagttggtattgataatgcattatcacaagcaggtgtgagggacatactaatgaaaagatctgacatcagtgtaaataaacagctcctttctaaattctcaaaaccatcagaaacatgaaggaaaaaaatgagataaatatgacaccagatccaacaagtttacctagagaagtgtaacatctagaatcaggtgggctcttcttgctaacccaattataataaagatcagatcaaaggagggtaatctaaaattccccagaagaaattgtatttgtcatagctttttattctaattactgtttttattataaatgttcagatagattttgtgaaatgtatattcctaccataagacttagcactaggtatgcatatttattacagtttttattatagctctcacaaaattacctctggtcattta

SEQ ID NO: 30328 - DNA, 1100 bp, Mus musculus
ttgcttctttagtattgaatcttgggctatgtgtttgtgtttttaagtctgatttattttgcttagtattccgagattttcaaaatatctttaaaacattagtcagggaacatattttatgtaattttcttatttacttttttagtagtagttattcagcccaagacttcatgtaggccttgctggcctggaacttgctatgtagaccagtctaggcttgaactcagagatcctctgcatctcattttgtggaagtctttcatgagtgcagttgactgtagaagccagcagagtgtatcagattggagctggttataagcaattgtgaattacttgacaggtgttctgtaagacctcttactgctgagccatctatccagctcctttccctatgttttaaaatatcagtcatactaggttgatggttttagttttacattttcttcatacctgatgagtttcaatatatttattgtagcaattattgagagagtagtattaaaaatcttcaaatacatttgattgctgatttatgtgttgttgtacttctgtcaggatggaacctttctagtcctaccttcctcccctacaagcaagtaggaaaaaaaacccactgttttaaaactgaggctggccttgaactggcagtgtaacaaagttggctctatcatagtactttgttttaatcacgcagctctcccagttcctccctgtgctccctgtacctctggctacttccttcctgtccctcttacactttctcagctcatgcattccattcacatgtcctctctctttcccctctcttattctaatttcatgatttacacatgtgtgttgtgcactgtcataaacatttataattgaaatctgagttgcatatattagaagacaaaacatggtacttgtctttctgagtttggcttatttcatttaacattatgatcttcatttgtacccactttccagaaaacaacataatccattctttatgcctattttgtgcagtaataaatacggatatgcaagtatcctgtgtgttgacttagaatctcttgcatatagagtggtctagctgggtcacatgtttgattgtagag

SEQ ID NO: 30329 - DNA, 1690 bp, Mus musculus
agtggagataacagaaagttgtgatcacccatgtgggtgctagaaatcaaccctgatcctctctgtaagaaacccagtactcctaactgctgagccagctctccagccgctctattaacctttcagtttcttcagttgaactaaaaatagtaaagttattgttttctcgatatgtcataattacatagtgcttggagaatatctacatttaatgattaagtctgttagttgatttaatttatattttactggaatgtatacatttgcttttatgtttttaattcttaggctagacagcaacaagcagaattggcccaacaggaatggcttcaaatgcagcaagcagctcaacaagcccagctggctgcagcctcagccagcgcgtccactcaagcaggatcttcacaagacgaagaagatgatgatgacatctgacattcaccacctgggctttcaagaaaacagtgaaagatatgcctatctgtaattctgtatgcatcttggtggacttaccattggtattctagagacgtctgttgtctggtttcaactactgtgctatacatgtaaaactgtctctttgaactattgaaaatttaaggttaagtataatatcacctttggatttgtaatggtgtttctggaatcttagaccagtgtgaaccctttatttggtcaataaacagtgttacagaaaacttcaggtttataaaatacagtgaaatttatagagatctcttaatctgtatttgtattttgtctgccctttgaactgaactaaaattgagaatttatatagcgatggggcatgatgtgatgcagaatacattgaatcaggttggtgaaaaagttcagttctatatagtatctaaattttttgtcttttaaggtgagtatatatgcaggcaacaattatatatgctcagataaatatacttgtttagaggaaatctcaaataagacattcaataactaggaaagaaatgtactcactagtagttgtataaatttggtgagttatatttttgattttgttactgttttgtgtaacagtgaagactggttttattatagtataatttatcttgaactacactatgccatttcagagactggctaatcttgaagattgtcacaattcttactgtttcactccagttcagtaattgttcatagtcttagttgtttcgtccattttttgagtgtataggtgggacttgtgagacagttgcttgggttctgttagtttaactgaggttgctggatattcaaacctttgctaggggaaataaacgaaagctaatgaacatgtttgctatgaaaaagggctttaaatttttatttaacatgtagtgtacttattgtttggttttagtgtagcatttacattttctcgactaggtggcctaaagaatccaatgctaacttttgataataacatcattgtccccgtcatcataatttagtagtagctttaaaagttttgtgtttgcttaaaaagtgtcataactgcagccctatatgaagtgttaacttgcttgttaaaaggaagcagctttaatttggttccagtgcataaagtgtggtagtgtttgtgagagggatccagtgtatttggtgaaatggcatattacttatattttggaaacaaaaaaatgccacctaagataataatataagtcattaagtt

SEQ ID NO: 30330 - DNA, 1141 bp, Mus musculus
acaaacaaacaaacaaacaagaacagactttcttttctcagtttatgccctctgccagtcacaatgcacagtggacaacggacaaattgtgggtttccacggtccgaaaggccagcataagggtctctctgtgtccacagtgattccaagaaaggacaaaaatgtaagcagaaggtttatgggggtaggaaacccgtggtctagatactccggtttcgttcctaactcatgcagttgcctgtcagcgcgcgtcctgaacaacccggcggagtttctccaggtagtgcttctgaccacgcctcctgacccacctctcacctgtgaccacacccccgagctccaccctgcctgtctcgccgagccagcttcctgagtcaattgctgcctgcacgcgcctgcgctctctggcccctcctgcaccccacccctataggctccgcctttcagaggccccgcctctctcgtttgcgaggtgggagctgagccacacactgcgcatgctccagccgcggcgcccccgactccgcactcggctgggttcgggcatttccgcctctttgttttaaactctgcacggcttttttctcctcctcttgggggggacccagagggagcggcgccccctccccctcccggcgagcccccgcgtgcgcccgctcgcccgccgcccgagacgcaggtcagtgagcccgccccgcctggcctggcccgcgcgcccgctcctcaggccgcgggcctcggcccatgggcggcagaaggctgcgagcccagcgcccccggcaggcccgggaggcgggaccctaaaagcctgcgagaaggccaggacttctcgcaggtctggaccccgggagggcagaacccagggccatgctggatcccggaacaatctggacccagggaggacagggaccttggaccagacagaacccggggaagagcctgcacaaggctggacccttgaccaggctagaccggggtgggcagaatcctagaccaggcagaacagcagccgaggtggattccgagcagtctggaccccgagaaaacaggacctagggaagacaaggagctcagtccggctagacctggcaccaggcacgattccagagaacaggaccccggaagaacaggagtctgggcc

SEQ ID NO: 30331 - DNA, 1158 bp, Mus musculus
gaagctatggtaagtgctgaatggtcctgggagcttatctctgccgtccttaccaattttggtcactttctccatcttctgagccccttaagacacactaatctaaaatctactgagtgccctaagacacataatccaaaacctgcctgacccagctgtagctagagagcctcatcccccagagttccttagttcctcagcaaacatgcagaatggttttaattgctatcactgagctcctcgtatgtatgctttcagtagagtaaatgtcaacgtcatttttagtatactgccaggtttcacaaatattataatacggtgttttcacatgtgctttgcttagccaaaatgcttgggccacaagtgtttctgaattggattccccacccccttccccatttcagaaaagttgcatttaatattttaattctgcattttagaacagtttccacttatacctcagaaagttttatatactagaacttttgaattttgggttagagatatttcaacctgtacattttctgtttgtgctaaaaggtgaaaccaaagcagacgacaattcaaataaagagacagcagaggagaagcaggaggaggacaatgactaccacaggagtgacgagcaggtgaacacacgtcctctgtggattttctggcatcagtttatcccgtgtttgcgtacttcatttgaaaatgtaacatgatcaaacaccataacgttttcctcctattaactccttaacttttctttatgttcctttcatttatttgttttaattatcagagcaacacatgctgactgtaaaacatttcaaaccttgtggacagaactacagtccacaattaggttatgttttttacagcccactgcaaatactcactattactaccttctctgctgtgcccccaagggaagtgacccatcagcaaagtgaagggaaataagcatgcaatgttgaagacaacccacatctcatttgctacattatcaggttaaaatatatagaaggatctgatacaattccgtatccctgtctatagaacttcctagtgtattgtctgagttgtcagttctaatagttgtgatgcttttgatgaaacagggagcaatgaaatgccatgactgtggctgtcactgtgcttagatgttctctc

SEQ ID NO: 30332 - DNA, 1103 bp, Mus musculus
tcccctggcttgctcagcctgctctcttatagaaccaagactaccagccctgagatggtcccacccacaaggggcctttcccccttgatcactaattgagaaaatgccttacagttggatctcatggaggcatttcctcaactgaagctcctttctctgtgataactccagctgtgccaagttgacacaaaactagccagtacactccccaagctctgtacaatgtttgaccatggtgtctgcatctgtttcagttggctgctgagtggatgttctcagaggacagttatgctagattcctgtctacaagtataacaaaatatcattattagtgtcaggttcttgcccacaggatggttctcaagttgagccagtcattggttggttattccctcagtctttgtccctgcaattcttgtaggaaggacaaatttttggtcaaaggttttgtggattggctagtgtccttatccctccactgggaatcctgactggctacaggaagtcaaactgcatatcccctactgctaatgaaaaatatcacataaacattaaaagcttgtactccttgcactcaggaggcagaggcaggtggatctctgtgagtgtgaagccagtctggtctacataatgagttccaagacagccagagctgtatacatattaagtcagtcagtctctctgtctgtctgtctgtctgtctgtctctctctctctctttcatagctactagaaaaggcagaggcaggcagacctctgtgagttcaagagcagcctggttgtacatagttccagaccaaccagagctatacgtaatgaaactatctcaagaaggaaggaaggagagaggaaagaaaatttgaaacctaagaaagctgaggatgtagttcaatggtagaacgcttgcttagcatgcacaaggccctacatttcacacactctctctgtgtcttggtttcatctcgactcgtgtcttctcttcctcctcttctctccctcctccctctctttctctttttctttttttctctctctgtaccaaaaaggaaggaaggaaaagaaaagacccaatgaaaagacaagctgcctagcctcctgtatat

SEQ ID NO: 30333 - DNA, 1238 bp, Mus musculus
gacttgctgtaagttcagccagactcagcccacacccagcactctacatggcaaaatgtgctgtggaacgttgcctctgggtgccatgcggaccagatttctgaatagagaatatttataacttttgtatgagagaatccactcccaacaagacactaccagcacgcgtttacagaggatgaaaacacttcgcagtttgctcgtctctgcttcaggtccacaggccagagaagaagtgaaacattagcacgtcccacaccacgtctgacacgcagcacctctgcttgctttccagggcttgagaatcttgagtttcagtttagttcatggattaggtttcataataagcctcaaaaatatttgtactttaagtcctttgtaagttattgaaagtcttttcatggtaaatatttatgttgcttttagcttcctgaagacttaagagatatataaaattttaatttaaagtatacccaaagaggcttgcagcaatgctatgacttagccgcggtgtttaatttctagggtactcagaagcccatccccgaggttgagtctgagactgtgcatcctgagatggcctgtgttggttgggcaagacaagaacccttccatcactccccagtgtcatgtggctgtaatctggctcccccagtaaggcaaactagaggtggtgtggccagtgcagcactggcttgttgaaaagttcttggaaagacagttttccttagagaggccatcactgaagctcctgccttttccattctgttttccttctgctggaaaaatgtagtggtggctgtgtttgtcacttaccaaccagcacatgccatccagtggggagactttataaagacacttaggaggtagcctctagcctccatgttcctggtagatcatggggttaacatgcgttctttgggtctttttcatgaaaggtaactgagcgacctgctcacttgaggaaacagctcgcttcagcagaagtggctttttcagtcatagagaggatagtatttgttaacacacacacctttctcacatacaatttattgctttgttaggttagagaatgaataagacactagcatatccaacttcattccctctgcaggggtatgagggcaagagtaaggagaacgggtcctgacctggggtcccagggacctctcagcctgggtgcccttccaggtccagtgagaattgtaggatcctataatcccagcagtacctctgct

SEQ ID NO: 30334 - DNA, 3047 bp, Mus musculus
gtgtatccctgggggtcaggctttctgagtcttcaccttagcaactggaatattttcttgagtttgctttgacagttggaattgagtttatcaacacccactttttcttctacttcctctttcacatacacagtgtcagaagcagcgattagtgagacttaatgttggtaagtaagaaaaaaaacatccaaattaactcaatctttaatgtctgaccttctaaaacaaaagcaagctctttttgttttgaattaatcaaaattcacctttctatgtaagccagtttggattattcagtttcctgagtttgctgtccattcaaatcatttctagagttactatacaagggtttatgcgtaaatattacctttctacctcagaacacacgtgctgctgaagcattctgcaagaccgtgttctcacaatgcagttacattagaacttaggtattttcccatgtggtgaaattaagcagttacaaacctccaaattcaagtaaagttaatttacagatcagatcaaacttagtatggctgtataatctcatgatatatatttgtaactttgtagctacttttagaatcacttgactctgctatggtgctaagttgatagatctaagtattcagcgaggtggacattgcaaccgatgtcttagctgggcgccaccgccccaacagccctgcttctgtcaccacgttaacctgttaaacctcagcagcaaaatacctatttttctaagattccatccccgcctgtgtgcactgcagacggtctcctgatgcccttctgccctttggtctgacctgtagccttacctcgctcagagatgaagcagagtgagctggcgtccgatggaagcttccgggcgccttatttcactcctgccaagctccacgtgacatccaaggccgaattttatttttccagcatgaacactaggatcagttagcgattggtcctgtcaagctttctcagcaggcggagctcctgcgaagttgttttcatagctgccgatgctagaaatcgggtgcggccggccggcagctctgagaccagcctcccagcacgtggtctcgctcaacaccattttcacaaaaatagaaaactcagatagaatatataatattgaatttaagatttggggggttaaaaaaaagaaaacttaactttataaaattatttattctattttaagccttctatcatattttcccatccaattgtttggtttccgtggtccagctttatttacaggcatataagataaaattgtgagatgttttgcaagcttcttttactttttgtagcctttggtttgtatgtttttatagggatgaagaggcatttttatgcttttgtgcaataggttccaacatgcgtttattagtgtttaaattgtgatctagcatctactaaattgaaagggaatataggtggaatttcaaaatctgtgcgttcagctatttggttttgcctttttcactgttattataagaatgctgttaccgggattatgtgcgtgcaagagtgagtgtgtgtgtgtttgcgtgtgtgtgtgtttgcgtttgtgtgtgtgtgtgtgtgtacgtactttctatcaatattaaaagataaacagccaggcaggaagtgacgaggttagcaccatcttaggcttgcatctctgtgggtgcacccaagtcctcgagctaaatctgtgactaagccaccctgggtgttggggtttcactgtccccacctggtagtgctaccctccactggcctgcagctcctgacacctgccctggccagcagagacttggaggctggtgtgtttcctttctaagggcatacagggtggtgtattacagtgctctgaaatgtatcattagatttaatgttccagtaatgagccaactgagttctactttgtatatggatatgttcctaaaacattgacagtaaattgagtgcagatagtgaaattcccacacacacacctacacacacacacacacacacacacacacacacaacacacgtgtctgtttcctcaggaaatcatttaagccccaacacatcacatgtgaccttaacatgaaaacaaaagttttctctgccttgatattaaatacactaagtaaataaactgagatgcgtagattaggaaatcacttaattgtaccacagtctgcatatctttgcattcctgcaggcagggattagaccatggtctcacacccagtgttcctgttgtcatttacttccatccaagagcacatttggagaaagaactaaggtgtgcctgtgagatggaactgaggtgtgcctgtgtgtcactttagccagtgactcacactcactgtttagttccagctctcaacttgtgccagacacggttttcccaagcgaaggtaacatcaggttacggacagcagcgccacctgagctctcacgctggagcgcagccacagctagcaacggtcacggtgtatgaaatgctgcagatacagagtttttgactgtttaatttgaaagtttacattttttatgattgcgttagtgtgtaatttttgtaccatcagtggctagtttttgtctaaaatcttttttggaatattgcttaatgttttgattttatgatagtgaagcttgtattcagtgttttgccaattaatattatatgcttgtaataaaagcagaagaaaaacttaactaaaatctcccagtctggcaatgtttttacctaaggtatatgttaagagtttgacagataatgtgttacagaacatgatcagccccctccagcttccaggctcagccatctggggatagaaagtatccaggaaaaccaaccaaccaaccaaaatcctccaaacaaggttttgtttgttttatttttctgttcatagtccctaactatagtataataattgcttctatagcatttgctttgttttcattggttttggtttttgagattgagtctctgtgtagtcttgatatcttggaactcactttgtagaccagacaagccttaaactctagatctgcctgactctgcc

SEQ ID NO: 30335 - DNA, 1360 bp, Mus musculus
ggattgaaggcaaggagaggaacattcgtgcactgctgtccactctgcacacggtattgtgggatggggagagccgctggacacctgtgagtatggctgacctggtgactccagagcaggtgaagaagcagtaccgccgtgcagtgctggtagtgcatcctgataaggtaggtgtatagggaggcagttcccaggatgctaggcctgggcttctggaccttgtgcttgtggttgggttgtctctgcctctcatctcctaggggccttttcctgctggctgtattacaagaaaggagctggtgggaaggtcggctgagtagtcaggctggctctcaccccattgcccacaggccacagggcagccgtatgaacagtatgccaagatgatcttcatggagctgaatgatgcatggtctgagtttgaaaaccagggctcgaggcccctcttctgaggcctgtgatggctatggctgcaggagctgttcatgaatcctgaatgctgctggcctgactgaggcacaaatgggaccataacaggtgtggcaggtgatatcgccccaggggcctggaccatctactcccaatcatccctgcattcatcatggacaaataccattccatggctgggagagaaagcattcctcagatctgatgttagttgttttgtttttctttttcttgtaccagaggaaaagtgttgatttatattccttccacagctgtcacagtttgtgatttacttggtgtctggtggctgtcacctcttggatggcacatgtcgctggcacttctctcctgtcatttcttcaaatatgggggtacatccacatcctactctgatcagtttgccaatcatctgtacataattaaactattttctgatggctggtgcagtctctggcttgtaaagcacttcttacctagtacctggtcacctatttgttcctcggtttttttacccatgatggattgtaggattgtgaagttggtctaggattggctgtaaagaccactgcagccagcaccaataccatcttcactgagcattttgctaaagaaaagttctagaaacacatcagaagggagcctgatccacaacattgggtttctcccaaggcctagagtcttaaactattttcagaaattctactgtacttgatcttagcgcataactagagttcttagaggggtgtcaggacacttgccaaaggctgcagagttgggtcatgttattctcagacccttgatctactggctggatctccgtcagcctctagggactaatgaaaactcaagccagtggctcaggcctaaaagtcactgactgaagaaatgttggggtgaatgtgagctcatgtta

SEQ ID NO: 30336 - DNA, 1172 bp, Mus musculus
tccaagcactgtgtcctgaggtaggcatttgggggccaaggcaacaggttgggagaattgagaacaatggaggaagagtatcttagggtgccttatggtggacactcacaaacttggccatatagatgtatgtactaccagatgaacagccagccagattcacacacgcacatgtttaaacgtgtaaacgtgtgcacaactgcacacacaacctgagaaaccttcaggaggatttgtggtgtgactttgcagtgacatgtagcgatggctagttgaaggaatctccctcatgtcttagtggtcatggccacttccccacccctgcccatctgtgttcctgcctggccttggtgtgcttccgtgtgccctgggtatcaggagcctatcatcaacctgactggggtgagcagtgcagccatgcctggaggtttgagccaccctccccttgctagagagaagggcctcaatatttatatttaagaaatgaaataatattaataataatgtaaggagggctgggacacagggactctggccttccctggggcctgggacctgcctggccttgtggttacattgggtaccctcactgtccatggctgcctggtctctgtaattttatatagagtttgagctgaagcctcgtatatttaatttattttgttaaacaagaaattgcctccttttctcattctggtgtttttacctggggttggtctgttcgtgtatttgccagtgagcacactgatgtgctcacttttgggtatactcacatatatgcattgataagtatgtgtgtatacatgtgctagcttgcatgtatccacatgtactgatactgtgcctgggtgtctttcctttagggaagtgcctgcctttcctttcctagaccccagagttgggttttcccaggttttgtcttctgagcttcatagtgtaccaggagtggctgcagctagctggtggtatggggtgttgtgaactactctggggcctgtttggagtgctgttgtacacatagatgagtattatccctctattctgtgcgtgaccctgcccttagccgggaacctactttttgttgtcccattttatgtggccttagcagggaagctgcttagaactgagatcgggtgagccccagaatcacagtaacctctctcctcagggtt

SEQ ID NO: 30337 - DNA, 1184 bp, Mus musculus
ccagtgagcagcctgggaggtgagcgggggtctggggaggacgtgacttctgtcccctcccaccactgactccaattcctgtggtgtcatcactgcccccacttcctgtctgatgtcatcacttcctgtatgaccccgtccatttccttatgacgtcatctgcaggcccctcccacccctgacccccactccctgtgacgtcatcaccacccctacaccctgtccaacctggccacttccttgtgacaatccgccccctgaccccacagggcgcagcccctgtgcagtgccaggaagctgggctatgctgaactcatgtggtgcctgctctcagaggaggacaagatcacgtgaggggcggtgccccagtcagccatgcctcctgcttgctccttacctcgcttctctgtggtcacgcccaccaactctggcttcaccctgacatggccacgcctataggatgctctgtctccgccccccccccccccccccccgcttgatcctggctgactgaccccaaccaccgatgctatgacccccacctcatgaactctgaccctgatctcatgaccccgccaccgtgaccctgctgacctctgacccctgatcctgcccacagacaccatgatctctgacccttaccccttgcctccactccttgactgtgaccccgcccattgacccgcccccgtgacctctgaccccccaaccccacccacccccgcagcactgagtactggttccgctgcgtggtggtcgagctcgagttctatgaggagcaggcctggcacatggccccccaaggcatggagctcctccttttctgccacctcacgcaccaggtgctcgacctcttcgccccgagcccagtgagcagacggctaggatcccggccacgggcaacctctgaccctgtgggggactcctgacccctagggttagcctgtaaattccagggtgacctctgacactacctccccattgtaagctcaggttgctttgtgggtgacccctgaccccaggtgacaacacgggcgaccccgtgtgtgaccccagtttgaccccttacaccaggtgtcgtcacgggtgaccccagcaggggcgccctgtgcgtgacccttgtgacccctgacccctaggtcggatcacgctttgtggcctgaagcgcttgagcctggcaggtg

SEQ ID NO: 30338 - DNA, 1193 bp, Mus musculus
tttccagttttgtggagtactggcttttgaagtatgacctaatggtttttaatttcttcaatttctgttgtgatgcttccttttcatttctgacttcattgatttggatgctgtctctgtgccttttatttagtttagctaagggtttgtccatcttgttgattgttctcaaggaaccagctcttgattttgcagattctttgtattgatttttttgtttctaattgactttcagcctgagtttgattctttcctgctgtctactcctctttggtttgtttgcttctttttgttcaggtgtgctgttaagttgctagtatgagatctctccaatttcctcatgaagggtctttgtggtatgaatttttcctttcatcactgctttcagtatgtcaaataagttttggtatgttgtgccttcattttcattgaattctagaaagtctttaatttctttctttatttctttcctgatcaagtaaccattgagtactgagttattcattttctatgactatgtgggctttctgttgtttctcttattgtggaaatctagccttaattgatggtgatctgatcgagtgcatgtggttctttcaatcttcttgtatatgttgagttttgattatatggtcagttttagagagggttctgtgaggtgctgagaagaaggcacatttattggtttttggattaaggattctgtagatagctgttaaatccatgtggtttataacagttctttctctgttaagtttctgttttgatggcctgtccactggtgagagtgggatgtcgatgtcctcccctattattgtgttggtttaatgtatgatttgagttttagtaatgtttctcttatgaatgtgggttcccttgcattttgtggcatagatattcagaatggagatatcatcatggtggatttttactttcatgagtatgaagtgtccttcccgtttcttttgataacttttggttgaaagtctattttgttagatattagaataggtactccggcttgttttttgggtttgtttgtgcagaaaacctttttccagccgtttatactgaggtagtgtctaactttgttgctgaggtatatttgttgcatgtagcagaatgatagatcctgtttaggtatccagtctgttagcctgtggttttttttttttaattgaggaattgagtac

SEQ ID NO: 30339 - DNA, 1243 bp, Mus musculus
tttcctttttaaattcttctacctgcttaatcatattttcctgtattactttaagggaatcatttatcttctttcaaggcctctatcatcttcatgagatggggtttaaggtcatagtcttgctctcaaggtgttaggatattcggggcttgctgtataggagagctgggttctgatggtaccataatacagtagcttctgttgattatgttcttgtgcttgcctttagccatctggttttcagtggtgttggctggcctggttatccgagttggagcaggcctcctgggatgtaggtagagccatgtgtccagggtgtgagtaggacttctgggaggtaggcaaagccatagggtggggttaagtgcagtgcaccaatcatcactgcaggtgtaggtgcagaccagaaggaggatggagctcccatagggcagggcagagtccatgactagtgggcttgttagggttccagcagataggggtgagaggatgtgccatgtgtgtgtctcaggttagagtagacctcttaggaggcaggtggtgttgtggggtggggtgcagtgcaccaatccatgactgctgagtcaggttttaatgtatgtactgactgtcctggaattcattgagcagacaattctcgaatccatgttgctgagggacacctgctgctgcctcctgagtgctgagatcaaaggcatgagccaatacacccagattacccatctttttttgtgattagtaattgttcctacaatttccctgatgtgtgcttagtactgttgatctgtttgcttctctctctctttttatgtctattagttggcatttcttttgcaaggctatatcctattcaaagagtaaagaaatgagagagatgaatctcatttagttttcttctaaaatgtcatggactacataaaacttctgcttaggaaataagtggaggatacatcagaattaaatgacaatattgtcaatgaagtatacatttattgtgttgtcgtactgtgctttctttcgtaaacatgtatgggatattttagaatgcaatgacatatgataatgtgcatgtgaacttcactcaggaagagtgggctttgctgaatccttcacagaagcgtctttataaagatgtgatgctggagacctacaagaacctcactgcttagatgagacagtaaattttattttcactctttaaaataagggcatgactgtttctttgttattgatgcttttctgc

SEQ ID NO: 30340 - DNA, 1377 bp, Mus musculus
cattggagagaaactgacaagcagatatttctctgcatgtttgataacagaaataacatgttttaaatagtctcttttttccttcccctctccttccattttccacatctatattcgtctacatctcttcctttccatttccccgcccccatgaggacagtatatattaagatagaatctcacatgtagtcgagagttgtcttgaattaaaagtcctcctactacgtctacctcttgaaggttaagattatagttgtgtgtgtcatgcctaggtttttcatggatgtcgaaccctgagctagaaaataactgtctaatcttggggaaattgctaaggtgatgacagtattgatgagtaaactcagaaagtacaaccatgcctctactaataagaggtaccaagatgaccaagatggactagagattgaagcaccgtaaagatctcttaagccagacaaggagtccagtagatgctaacagattaaatgatccttgcctgaaaaggaccaaccgcactgtgttatgaggtctaagagaaagttccaaagtgttccatgggatgtgttgctgatgcattgaagcaattcgagaaagatgactgtcatgtgactattagtttttgaaatgtttaatcccaagctgcttcacaatttgtaaggttcataggaagaacaaacacataatgaccagaatgcctttggctgggttagtgattaaaaagggaaagaaaagtcttgtgagttttcttaaaaggtttcctgcctgtgttcttctatatcatgcaaagcatgaactatgattggtctctgaggtcttgcactgtttctccttggtaatgttgcctgatgagcaggtaatgaattctggtctttactgtgcatgcagagatcatgatttcctaacaattcagtgtgttttcttagagtcaacattgtattgaatatgtaaaacatctaaactgatttactgtgtaaggaggatgtttctgggttctgtgctgttactacacaattctacatgcttgagggtagtttaacttcactacattgttttggctgctcagtattatttattgaccatataactaccagaaagcacattatacactgaaattaacttttctttttttttcttgttttttattattttctttatttacatttcaaatgcttgtatctttggtattctgtttctgggctaatatctacttatcagtgagtgcctatcaagtgagttcttttgtgattggcttgaaactaacttttcaatgtgttatttcctgaaatttgccctagcaaaccttaaactaaaaagtgttatttcggggtttgggattttgctcagtggtagagcgcttgcctagcaagcactaggccc

SEQ ID NO: 30341 - DNA, 1146 bp, Mus musculus
ccattgtctcaaggaaaccctctgcagaccagccctgagctattcttgctcctttctttgaaatgtgtctctactagaagtaaacttgaatgttactgaatagataaccttctcactgaattcctattgaattccaagtttgttggcctcaaggattttctgggatgttggaacactggcgaaggcttagctatgccagaattcaatctttaaaggcacttacaataaaataatagtaaaagaaagcacgcggatccatacaccagactaatgggggtatgagtatatgggttatgagaatgccagggttctaggaggttgagtttctgtgaaactctttgcctcgtgagtgcttccaggcctctccgcctgccaagcaggcttcactggagtgtgcatagcagcaacctgataggaggaagtctcaagatcaagcaaaagaatcagagttacacctgctcccactgttaggagtcccacaaaaacatcaagctaacaaccataacatgtcagcagaggacctgacacagacccatgctgtctctatgcttgccgtttaagtctctgtaaggttcctagaaatccagtcagtgttagtcatgggttccctctcatgtcaagggtctcaggttaaaccaaacattggttggccactcaaacaagtttcttaccatcatgccccagcacatcttgtaggaaggaccagttgtagggatgtgtgtgtgtgtgtgtgtgtgtgtgtgtgtgtttgtgtgtaagggatagtggtcctggtttctctttctgtagccttctctcctctaagagactagaacatagaggttaaggttccaagcctgcaccagcttgatttctgcattcagtgaaatgtgtggaatttgtcctgatggggccctgctgtcagttatctgagagcagaggtttgtcctagcatcagcatggattgtttaaggatctctaaaaccaccttggctaatagctcaaccaaatgtaacccatttccaacactgaagccctggctggctacaaggatagtcagttcagactccatattctccattactcggcgtcttcattagggtcaccctatagcatccaggacgcttctatcatacttggtttttactctaacccctgaataccccg

SEQ ID NO: 30342 - DNA, 1211 bp, Mus musculus
agtgttggggcattagggttagtgttaggatcaggagccaacaagctattaactagcaggtggtcttcctgagatggtttgcttcagattataaaaatccatggcagatttgctcccataggcaaggcccagtagaaaatcattttaggaaagatccctgctattaatattcttttcctgttattaaatatatatgacaatcactaggtattagctcgcccttctgagcagatctacaaagatgtactgtcttgtagtgatgctatttagacaaatagatgatttcttagtgatgatcctataagaattcctaaaattatatcagtgtttattaagatcttttatagcaggactgctactaggtcctttctgatagtcaaaactgcagtgagaactctcccagtctcccatgtgtcaattgttacttgctcttagataataaccagactttctcctactcagagcacattccaagaggttgtaaaacaatttaccaaaggtcataaaaaggtaactaatgatttattataggttctaggacagaagttaaaatattgactgggtttatctacacaaaacttcactaataacttagttatatggtttttaactcttgatgaacctgtggagctgtcacaggtgatggatgtttagccagataaatattcctaatggatatgcatgtaaacattcactgatgtaaacttcttattcaatttatgatttaaatttatgtgtaaacttgtgttgaacttttaaacatgtgatcatgtgttctgaaagatgcataaatgctgaggacaaagaggaaagtgaattttcccccttatccccctttttcattaattctgttttccccctttttcttagagagctttcataggaaactttttagaacttagtaataaatgctaaaatcactattcaaagtgttcctttttcttcctgcgccttcgactagcaggctgaaagatccacgcagttcctgctgagataaaacaaagactacattactgtctaagtcagggtttgtatacctgcacaaaacatcatgaccacgtgttgaggccggccagcggctcacatgtccgggttcgagcctggaaggcatcttggaatctggaagaaaagagggaatctaggcggcgtgagaaagatggagctaagacaagatcctgatcaaagctcaattttactattcggaaacacgg

SEQ ID NO: 30343 - DNA, 1176 bp, Mus musculus
tactagtgctatacaggaaggccacggggaattggggcggcggtgacgcctagttctggaaggggcggagtcacgagaaaggaaggagaagccgagggaggagcactgggggcagggtactatgatggacatcgggcgtacggtagagagtgtggatagtctgggatgtgctgggttcgtggctgctctcctggtggagtcggagtctggcgagcttgcgtgctgggggcgtgatctggctgagcatgtgatggtacctgggcctgcccgatgggtgaggctgcgcgtgctccgggtgggaccttggggcgggactatcctaaatttgtaggcggagtctggggggggggaacattgggcgctgggggcgagtcctagaggttctgcctttccctggtagagctttggatcatggcctggcgagcttcttagggttgtgatgtgagctgcagggtggggacatggtgtgggcgggggatgcggactctgcgcgggcgcggtttcatcccagagctaaccctgtccaccgccgtggtccgaggtcttcccgctcggcccttgactggatggacccttgtgtcctcacagcggagtggcaggtggcagaggcggccgccctggtgcgcgcacttccaggatggtcggtcgcgagtaccctggtggtgcccagcgcagcgcctggcagcaggctggtgttcggcaagggcaactttcaggacgtgacaggtgagcggtacctcacctttggccgctgggcatgcgcctcacctgcgctggtgtaggatgggtcagactgcctcccgtcctcctcctaaccccatgacgggccactccctgtgctccagaaaagatcaagggatgccaggacatcacgtccgtgttcctgaacgtggagaggatggcgccaccgaccaaggttcccttgtgtcccccctgatcctcacatgacccatgacaccatgtgacccctgactgatccctgcgtggcccccatctcctcagaaggagctggagtccgcttggggtttgcgtgtgttcgacagattcaccctagttctgcatatcttccgttgtaacgcacgcacgagggaggcccggatgcagctggcgctggcagagatcccgctcctcaggttcgcgggtgatgttccccgcatgtcctcccctcgtgttttt

SEQ ID NO: 30344 - DNA, 1302 bp, Mus musculus
tttcccttaaaagtactatataggtttttgcttaataataaataggaggggccagccgggtgtggtggcgcacacctttaatcccagcacttgggaggcagagtcaggcggatttctgagtttgaggccagcctggtctacaaagtgagtcccaggacagccagggctatatagagaaccctgtctcgaaaaacccaaaaaaaaaaaaaaaaaaaaaaaaggggcctgagtaattaaaaaaatatatatcagtcttaaatttatataaaaagaagggaatatgggcatacttattcacataaggtatgtttaaaatttcaaataggcttggcgtgattccgtcgtgcgcgtctgttctgtggaacaggaggcagttgttttccgtccggcttcccccacaccgaagtgcgcgcctccacctcatggaagactcgatggatatgtacatgagtcctcttaggcctcagaactaccttttcgctgtgaactaaaggctgacaaagactatcactttaaagtggataatgatgaaaatgagcaccagttgtcattaagaacggtcagtttaggagcaggggcaaaagatgagttacacatcgtagaggcagaagcaatggactataaggcagtccaattaaagtaacactggcaactttgaaaatgtctgtacaaccaacagtttcccttgggggctttgaaattacaccacctgtggtcttacggttgaagtgtggttcaggacctgtgcacattagtggacagcatctagtagctgtagaggaagatgcagagtctgaagatgaagatgaggaggacgtaaaactcttagccatgtctggaaagcgatctgctcctggaggtggtgacaaggttccacagaaaaaagtaaaacttgatgaagatgatgaggaggaggaagatgattttgatgaagaggaaactgaagaaaaggtcccagtgaagaaatcattacgagataccccagccaaaaatgcacaaaaatcaaacccaatggaaaagacttaaaaccatcaacaccaagatcaaagggtcaagagtccttcaaaaaacaggaaaagactcctaaaacaccgaaaggacctagttctgtagaagacattaaggcaaaaatgcaagcaagttttcttcccaaagtggaagccaagttcatcaattatgtgaagaattgtttccggatgactgaccaggaggctattcaagatctctggcagtggagaaagtctctttaagaaaagggtttaaacagtttgaaatattctgtcttacttcatttctgtaata

SEQ ID NO: 30345 - DNA, 1200 bp, Mus musculus
tcacattccaatgcatttggtgagctattgccctcacctgttttttagtagaggcattttggagagcagctgtggcctcttgtgtcagaggtggctgcccttgaatgtctaggagggttttgttcttgctgttgtttgtttttaattttaattaactttccagtatgctattcctcattctgaggattaacaagcctgtccctcaacagttcaatagctgtagcagacatttatgggtatttatcagtgtcagacccagtggtacagaatttatgttcattattttatctgtgtctcattataactcaagactggacctattattatttccattttgtaggtaaggaaactggggtttggggtttcaataattatcctaaggttgaagttagtgatgtataaagtcctgtttatatgttaagttgcagggacaaaaccttctttgaacaactaaagttaaaagcatagcttgatcctgtgaggaaacggagcactcttaagcttgtgcttaactactgagctccattcctgggttcacgtgcatgtttgctttcttgaatttaggtgaagtgacaatggatgccatgatggctcgactgaaactcttgaatccagatgaccttagaaaagaagttatgaaagctggacttaaatgtggacccattacatcaacaacaagatttatttttgagaagaaattagctcaggccttactggaacaaggtggattgctgacctcttcccttcccaagcccagcgcggttactgccatggcatttatccagggcacctcaaggactcctccatctgtggacgggaaacaaactcagcaggcctgtttttctgaagacagagattttggttacagtgtgggcttgaaccctccagaagaggaagcggtagcatccagtgtccacccagtacccttcagtgcctctaccaggaatgacaaccacaaggctggagtgacagctcctaaggagccacttgtgtactatggagtgtgtccagtatatgaggatggccctgtgagacatggtaacgtgctgtgtagtgtctccttacccaaactgggaaactataatcttaccacccaagattaattttattattcatatttgttaccctctgattcttaactgtaaggaatactattttttgttttttggtttgttttttttttcaagatagggtttctct

SEQ ID NO: 30346 - DNA, 2492 bp, Mus musculus
gaaaatacaatgttctgagtataatttgaatgtctgatattttggaagaagttaatgaaagcaaactcagatactaattgtttgaaagtgtagccgtaataatgattcagacttttcaggtggaaacttctaattttgaaatagaacaaagatgcaaaggcatagacaagtgaggtgttgctaattgggtttgttagcagcaacactgcagcacgtgcacacacccactatttctgaaacagatcaattatgtattgtctcttgggggggtgcagctttttgatatgcaatggcaaaactatgtgtttgtcatttcaccctagttattccaaccgagagaaagcaggtggcagaaaagcagatgtgccctgactcagacttcagtaacaatgctcaaaacactgccagaagttgggatggggggttaaagccatcgagaatcatgcgagtaatcatcatagaaaactcaccagcaataactaaaaccaaaactatttctcagtacttgtcagtgtagtaagttgtctagaagttgtacccaggctggagaaatggctcagcggttaagagcaccgactgctcttccaatggtcctgagttcaattcccagcaaccacatggtggctcacaaccatccataataaaatctgatgccttcttttggggtgtctgaaaacagatacagtgtacttacatataataaatacatcttttataaaaaaaagaaattgttcccaagtcttaaaatttagcctgagatttcactaagcatgattacatgacagatgtatgccgtattttagaaattaaagagctttatgctagagtttagcacttgagatctgagttcatttcagtggcttgcagtgttgacttttggctatcccaagagatgtgtaccgagtggcattgcacaccctaaggctccaagataaaaccaccttgctgaagctgggtctcagctgtctgtcagttgcttgcacagagccagtagtgttctggagacacttgcagtgcttcaccccagtacagaactataccactgattttgccaatttcagtgccttttgtgagtcattttgagatcacatagtgctaaatgggggcgttagattctcttttgtttataaaaatgttgaccaggcaagcctttaagcccagcactcattaggcagaagcagggggttctctgaatttgaggccagcctggtctagatagtgagttccaagacagccagaactacacagaggatcttgtctcaaatttaaaacaaaaacaaaaacccaccaaaatgataataaagtaattctgagctcaaatgtttaggtcttttcttttttctttttttttttttttaacttttttaaagcttattttaatgtggtaagaaataccagaattgagattttggactttggatttagtttgttttgttccccttgtaagcagctgagctctaagtacaagacagccaatcaagtgacctggaaacaatcccaaagggaatctttgttctcaaaagaaaccaaaacccacacactatattcagctatgattttgttttctctaaagtcttattgtcctgtgcggttatttttgttgttttttccatactcaaaaactgaagtactagttttgccctattttaacttttttttttttaaactcttctttcttgatatttacttaagacaacttttgggagtcagttctcaaaccatgtaggtctcaggaatccaactccagtcactggaattgagttttacccgagccatcttgctcgcccattttaaaccctaagctgcctttggactatttttccactagtatgaagggtatatacctgttagtaacacctgttgatctatgtcataaacattgtttacttgatctttcgcaaagtgttgggtaggaaacgactccttaatttgttattggacagaatccccttcttagtaaaactgtaagaaatattttcattaaaaaggacattgagtagcacattgatgtctgggagatgtcttactatgttaccccaatggcctggaactggatgagtttacttgctgggatttggcttagtctaacacagttaatagcatttgattatgtggcagtggaagacttcttttaatgtgtgacagggctgtgaaaggcatccttcctgaagtggcatagtatgaatgaacttgtaacagagacactcgctaccaccaccaccacacccacccagccaccctcatttctagagaagaacaggacaccatgtggaaagtaagttcttgcagcaccatggaaggagccaaccgcagatgctaatgaacagttgatctttaatgattttggaaggaatgaatgttaggattttgtcttcctgagttggggcttaaagtttttattaatatttctcatttatctaatagaaaaacattggagccaggcgtggtggtgcacacctttaatcccagcactcgggaggcagaggcaggca

SEQ ID NO: 30347 - DNA, 2109 bp, Mus musculus
gatactccagaagagggcatcagatttcgttatagatggttgtgagccaccatgtggttgctgggatttgaacttgggaccttcagaagagcagtcagcgctcttaaccactgagccatctcgccagcctgagaaaccccatcttaaaaaaacaagagcatgagctatgtacaaggaaccatgcaggggtaacgtgtcatacctttatcctgggggaccagccaagtcctgcctgtcagaaacggttacagtggaaaactttaaatgcggtgatctcactagccctgagcacatttctacttagttgggttaagcccttgtccccacaggttgaatacctcatttagagtactactgagacatttcccctgagaaactctcctctgttactggcttagctgactatctattccagaaggctgtcaggttgcctgaacaaagcagctggctatcaacctgacttttctgctagcatttatttttctctccccagagcgttgcagtttcccccagaaggttggctccgcctgtccctcaacaacggcagtatcacccacctggtgattcgacccaatggtcgtgtggcactcaggacccttggggacacagggttcatgcccccagacaagattactcggtcctgaggctgcctatcagactgcacgctgtcctctgctggtggcctgactacagccttcccttgtcttccacagctgtgctgtggcttcatgttgtctcaaatgtcacatttgggtgctttagttctggctcatgctgaagaaggcaacttaggagttagacggcctttgtgaaagttttctcctttaccattaccaccagcacagccctatgaggtgtgacaggaaccttcctaggtagaaggcaggcctgttatgggtactggcctggctgtactgcatcacgtgattacagtagaccagccaagcaatccataacatcgggcagagacctgactggtagtatggtggtttacaggtgacattacatttcatatactgcaatctaagacctttggttgcttatttattaaagattttcatgtggtttcttgctttgaaaaccaacttctcagctcaattaagagatcctatgtttactgcatctgaatgaaggacaaaggggctggcttcctatatgatagataaaagccatggaagaagtggccctgcaagaagactgtggtctgtataaggcaagtaggtgacagtcctgtaagcgcttctttggaggcaaagatttagcccccgctgactgacagaggaggcagcatgtacttgtaattctagcatttgggaggcagaagcaggatcaggagttactatccagcctgagttatgtttaaagacccagaaaaatatccttgttcaacagttccatcttagtttgctactggctactgttaaccttggacttgtaggttatttagaaatgatgtgtttactccagatagtctgatgacttaagaaaaaaactgtcttttatgtatgtggtttttggttttgctttttgagacagaatcttaattattgcccaggctggcttcaaacttgagacccttctccatcttgtaaatgttgggattgcatgtatatactaccatacctgcttccctctcgccccctcaaaaacccaagtacagtttctatgaagtggttgtgagcatcttctgtaatcaatgcaatgagttggaatatttgatgtacctctctgtcctctttgggaataagtatgtaataaaattttactttgttttgttgtttatttgttttaaagggaaaaagtagtgtttagaaaccctttctcagtgtcttccatcccagggctgaccctaggcatcctgcctggaggacttcctcctacaagctagaaggcacactgcttcagtccaacagcaggcctgagaggtgtcccttggagttaactttagctacccgaatgctgttttctacaagtagttgaagcaagaatggcaagctgtcaacttgactcctcacctgacctgctgggaggaaggtaaaacatttcacaggagaccgggattgctcaggattagtgtactaaggggatccccacgtggtacaaactgta

SEQ ID NO: 30348 - DNA, 1205 bp, Mus musculus
attttctcttggggttgaggacaaccgattgtttctttgctccccagggccctgaccctggttaggtctatgaggataacatcttgagtgacgcttgatagcacttcactgtttatgcagtaagtggagggtcctggtttatgacattcacaggtgtttttgcttccaggtcgggaacaggctgaactcacggggctccgacttgcaagcctgggattaaagtttaataaaattgtccattcctctatgacccgtgcagtagagaccacagacatcatcagcaagcacctgccaggtgagtgctggttgtctgctgtttggggtgtgtagattcactcttgggacaccttgctgaacaggggcctgcttttttccaggtgtctccagagtcagcacagacttgctacgggaaggtgcccccattgaaccggatccacctgtctctcactggaagccagaggctgtggtaaaaatgccatcccttgtgccactggattagggcaaggcctgcccttacccttgtctgcttccacactgacaactccttactctgctcctagcagtattatgaagatggagcccggattgaagctgccttcaggaactacatccaccgagctgatgccaggcaggaggaggacagctatgagatcttcatatgccatgccaatgtcatccgctatattgtttgtaggtaagtgccagcaaccacgcattcctcggtgtgattcggggaatgctggtgaagcctggtcagagaagtcccagtgaagctggctatgacagtgtataacatgattaaggagctgtgttctggcctccactaccttatgaaaacggtgaatgtctaaggcttttcaagacaaggtttctctgtgtagccctggctgccttaaaacttactctggctttgaactcagagattcaaacgcctgccaagtgctgggattaaaagcatgcgtagccatcgcccccttgtctgttttttacatacttgctctagttgtctgttggtagatggtgccggtagcagtcaacatggacttactcagagtttgtctccttcatccttttgctatcagaacttatgtaaggctcgtctttctccatgtttgtttgtgaaaagtttgggcaccttgggggtcgtgattcttttttgctagtcctgtacgtgagattgggcctgttgtacattctgacctgtg

SEQ ID NO: 30349 - DNA, 1141 bp, Mus musculus
caagctagggaaagattgttattgtcacagaactgtctgcctagaagagatagcacctgactgaaggtgctttcaggtaggttaagtctggatgattggagcaggtactggggtggtggtgggctaggctgatcccaagtcacaaagaacatcgttaggagagggtgatttctactcctacctctgctgaactctaacaaaccttgttacacactaaaggctctgggcatccagtagtggggaggtagatcaaacagcaaataattgaagggataaattccatctcgggtgactaatgtgtgagggatgtggtcaggattcccactcaggacttaatgattgttctcttggcagttccgggtgctctttgccaacatggcagctctgttctggtatgcctacctggcgtctctggggaagtgatgtcagatacaccgcggatggggtctggggagatccatccaccagcaggagagaacagaatccatcattaaggacaccatctggctaatatgatgtgattcacgatgccttaaaattacagagggaggaaatgtgtgggtgtcagaatcatgtgcttcagagagtcttggtggagttagtctaagttgtcactgtgagcaaagagattatcttagttgtcactgtgaacaaggagataaaaggtcaataaatggtgatgcagctgtgtctgtaatgggtgtggtttctcagcacagttgctgttgcttggagaaaaaggcatagccagatgtctttaaattctttcatgttgtaccaaagtgcaacaacacttaccacgtaagtatacagttcggtagcaggaagcacaatcatggcacgttgtaaacatttccagcatccatttctaggtgtttttcattataaaacagaactgttcctattaaacaccagctccccattcttccccttctttccatcccaacacccacctggcctctgttgtcttgagtgtgagcctacaaacctcataggatctgtcactacaaaaaagaaaaaaaaagtttcatccgtatcatcgcatgtcagaattcccttcctttttaaggctacacattccaaagtgtatctataccatgttgtgtttattcctatgttggaagacccctgcatcattttt

SEQ ID NO: 30350 - DNA, 1102 bp, Mus musculus
cagcaggtgaggcaaaagccatgggtaccatcctgggccacaaagaccagtgaacctacagaagactttcttcctggtgtgtgttatcctctcttaggtgaagaacccagttccacgtgtcaaacatccagactggctacacaaaaaactactagagaagaatgatatctacaaacagaagaagatcagtgagctctttgtgcttgaaggaaagagacaggtaacacagagcccagggtaccaaggtctgcaagctgctatccgtaaattttatttgttttggttttgtgacagggtctctatatagccttgactattttaaaattccctatgactggtgtgaaactgagatttctgcccctgtatacaccaccctgcttggcccataatttcccaatactacctctaaagagaggttttatctctaaaagtgtgcacttattctttagggccatccagtgtcattttgtgtaaaaagcatatgtgagtcatcagatgggtatgaagaactcatttgcatgtaaatgatgaggtatgcaaattagacatagtgacctcacctatctcactactgtagacttcagtttctttttttgttttttgttttttgttttgtttttcgagacagggtttctctgtgtagccctggctgtcctggaactcaatctgtagaccaggctgacctcgaactcagaaatccgcctgcctctgcctcccaagtggtgggattaaagatgttcgtcaccacgcctggctcctagacttcagtttcttaacaaaatgaagatcattcctggagacacaccaaagactgagtaatgaaagtgtgggtgaaaagctggtggtggtcttctctccagagccctcctccccttcacaggacacaagttctgcttccggcactcctatcaggtggcttacacctgcctaaaacaccagctccagggcatctaagacccttttctggcttctgcagacctctgcataatatggcattcacttacacagacatacacacaaaaataaaaagtaatctttgaaaatacaaaagacagcataacaaaaattagaggaggaggaaattttttttaaaaggttgtat

SEQ ID NO: 30351 - DNA, 1147 bp, Mus musculus
gttttagttgtagtctttgaagctggggagctaactgtcttgggtcctgaaagccctcggagttggttagtgatccactccgtaggctgtggtaggctcatcaccactttgtcaccaggtgaatcgggctcttcctcgttccaacattgtctacaatctctatgagtattcagtaccagaggacatgtaccaagaacacatcaacgagatcaacactgagttgtcagtaccagacattgagggcgtgtatgagacacaggtgattttttttctccctggccaatgacctcctggttgtaaatgaagctggatgatcagagagaatcccacagggaatccggcagtgggcagtggtggggaggtggattagatagtgatgagtgtcagcagcgtatctacctaaggtggtgtcttgtaggtgaagacagactatgatggggtatgtggccacagatagagctgtggtgctagagtctcccatttgacccaacatactaactactctcccaggtcccattgttattccgggccctcgtgcagctgggctgtgtgtgtgtggtcaacaagcagctgacaaggcacctttcgggctgggaagctgaaacttttgccctcgagcaccttgaaatgcgttctctggcccagttcagctacttggaaccaggtattgccttaccaacagccctatcacctaccttgcctcccctgctctcaggcaacgggtttattttcttctacagggagtatccgccatatctacctgtaccatcacactcagggccacaaggcactctttggggtctttatcccctcacagcgaagagcatctgtgtttgtgttggatactgtgagtcattgggcccagggcatgtgagaatttgtgggtcaggcagaatatggggaagaaagatactcctcttgccattcagttagaaatagaaaggcacagtgactgcccagctacacacacacaacaggcctaacagttggtgtctgcttaggtacgaagcaaccaaatgccagggctcagtgccctgtactcatcagaacacagcctgctgctggacaaggtggaccccaagctcctgcctcccccaaaacacacctttgaagttcgtgctgaaaccaacctgaagactatctgcag

SEQ ID NO: 30352 - DNA, 1928 bp, Mus musculus
cccacgcctggctcctggggcgctgcacggggcgctcctggcacgcaccccgccggccgccgcggtgctcggtgcgcctcctccactggtgactgcgggcggggtccccacgccgcccgcgcatcccaggacgacgctggggcctggcgaggcacgggagtactcgcccgcgtgcaaccctcccgaggtggaggcgcggtagtcccggcgtagcgagctggctcacttaaattcttgggacctgagcacagttcccctgagtcccggagcagcgccacgctgcagcctacatagtcgaggacttttcgcttttctgggggtgacttcattttccgagcttgcgattaggtcactgggaaaaatttagctttgtatcttttcccccttcacaagtgacaaaagcatttttaatggttttgtatttttcttaattttgtgctctaacgacattttaaagaacaaaaaaaaaattttttttttaagttgggatttgcagtttaacttctcagatcccatttgagccccagggtttgtcttatttatggaaagaaatggtctttctgtccagcgcactgtgaggctccgaactcaggcccggctctggccttcccttggtacttggaaccgacgttacagatatatattaaaatagtaattaataataatgtacaaaactttgggttttctgccttattctattatgcatagttgtaagaggatttccttggtttgtttttttaggaaaaaatgtaaatactctgttgatataattataaaacttattaaattcttaacctggacagtctataacaagtttctagaaacccctctggttatttgtgtacgtggtcacaaaaacccacccggctgtcagttgtgaacacactcaacagtttaactgcaacaactatccttcaactatgcaagcctgggaggcagagcgggatattcagggggagacggtctctgagcttcctaccaaggtggttgggccttccggagagccacacttgtggatgtttgcttagactcacagtgggcttcaggactggctggctctagtcacaaggaccaacctgcacccgtgtgctagtcttactgcagtgttctcagaatttgtgcaggccaggcagaatcttagacgttcaagagtctaaaggttggttaccagaagacacagtttttttcctcccagcgcccagcatctgggcgttgccctccctgtcactaagcctctcatccctcctttggttttggttttgcactcctgccctctccagctttcccgtgtgctgtgtgtgtggtgtgttgtcagcttgtcctttttggttctcaaccagcacatttatgctgaatcaacactcggcaccccgtctactactctgttccgttccttccagcctggtttccgcagtggactctggttattttaaatagtctgtcttcgtgtcagtcgacacagagagataaatacaaccttgatttggatgaaatgtggtccagtgttttgtttggctttgaggcaagtacctcactgcctgcattcctccctggggtatggggctctgggcttcaaggacatcccgagacagtgtgtggctggcatcagtccttgctgcttgtctccttcctctgcctccctaggagctgtgcttttgtggcacttctgctgcaacaaccccctccctgtctgcatggaactccactgaccttatacgttggttggccctgggtaacaggtgaccctaaccatcctggacacagcagcccatgttaccagaatctatcaggttttctgcatggaacccacccttagagtcccacttcttgtgggtggggtttgtggctcataggaacatgctaccacacggggttggttttgatccccactgtctttagcatggcccaaaatcaggttaaccctttat

SEQ ID NO: 30353 - DNA, 1176 bp, Mus musculus
gtattctacccaagggtgctcaacctcagcggggccctggccagtgtggggcagcaggctgaagtgaaggaagagcctgggaggtttgtgagccagcccttcgagtgtcgtggtggaggggatcttcgaggattctgtacatccctccctactcaggcaggcagcccctactttgcattggcctcctccacctttgctgctcccaacatccagaagaccccgagtaggccccaagtccctcctcttactcctggctggaaccttcaccagtttttaatctctgaaggatttccgagcagtcaccacccatcctgcagggccagtatcccagcctgaggccaccgagggctgtgcgctggacagggctcacagaattctctccttgcctctagatgccagtctgttgatctcattcaaccagccaatcatgtattgccagcctcattcggggattctgattggtacttggtcacaggctcctcctctcttacctccacccctgggcccgcaagtagcgagcagccaccacggcttggcctgccgaccccgggagtgccaggtgactatccgcctcgtcccgctgggagcccatggccgacgtgcctctctgtctctctctctttttctcttgtagatcacgaactgctcaggcaagagctgaacacgcggtttctggtgcagaacgcggagcggcctggcgcctccctgggcccgggggctctgctgcgggccgagttccaccagcacacgcaccagcacacacaccagcacacacaccagcaccaacacacatttgccccctttgcagggctgcccccgacgccgcttatgccgcccaccgcaccctcgccggtgcgtaggcctgagtgctggctgctggcagggcgggctgggtgggtgggacagggagtcgtacacacagatgcacgctcactctcatgcacggccctgatacctcctgccagcgtgtgcaggccccacttggccgtcatgctgggtgctggactgtgggcccgaaccccagcccaccctcaggtcttcccctgccagggcctgagcctgggctagctgcagcagtgctcagtcttaggcctgactgacatcaggtctcagagcctagacaaaactaggaccaggccattgcagacctcttgtgtgtctcttggtccatttcca

SEQ ID NO: 30354 - DNA, 1101 bp, Mus musculus
gagcagggtgccaggaatcgggggacccagaggtgagcgggtctgactagggagatgcccgtggcgtgcgagcagccgtattccagctctcagccccatctgcctgctgaaggggctggggcttaggctggaaacagaggtccaaagctactgtgtgcagagactgtggggagatgaatgtgtgcccaaatggtggacttgtggcccaaggagagcctcatagagatgggccaggatggcattcagcaagctcaggctgcaaacatcatgtgtgggcaggcatacccacgtctaccagaggggcttgacacatgctcagtgaggtccactaggggcatgacctcaggtgcaggcaagtccctccctcatctacctgagcttgtggagtggccctggcactgaccagagcagctcctgcacctcctcatggcttgcttcattttcccttaagtatgcagagaaacattaatgacatcataaaacccagagcttcgtaaaagccattcctgcggatttataggcgttttggctcattggaggactggggctgggactccgcctgcctcatccctgcagctctgatttactgccagttagggcctgcctagttcactctctaaatcacggtagcttttatgggggtatgtagttaacccatttgttacccagtggggcctatcagagcagctctcccaaccctggtgcctaccctgggattcctggacactggaaagaaaacaaggaagaaatgggccagcagctcaggctcagtagacctttcagaggccagagcaaggtggggctacctgtcttgcctggaggagaggcctggcctcttcttcatctacacttcccactccgctaacctcatctcttcttgtccacctgaggtgtagaatgccaaggctcatcagaccttgctccgcgtctagcaaggatttgactgaaaatatccaggatttgggctatggacaccctggagaggtgactcctgttggtggccatcgaaagggatctttcatggcgggacttgggcagccttgttcacacctgagcacagagaacagcggcccttgagagtgattgtgatgcccccagttt

SEQ ID NO: 30355 - DNA, 1762 bp, Mus musculus
gcctggccccccagcctcttctgaggcccctttgtcagctgagacggcagtccctgctggggctggtgccagctcgtcatccccggccttcaatattgggccatcccttcaggcccctgaggtcacagtggactcgacactctgccccaggggtggcccgccaagccccatctgtgagtcctggagcctgaggcttgtacataacttcctgggtgaatttgttaagctacagttggaccacactagtgagaacctgctctctttaagcctaagatggtttcccagactgccccaaggctgtttcctgacctctttggctgattgggcccatcgcatcagaaggagagatggactccatgtcgtcccactgtcccctccatgggtgtcaggcctcttggtgttactgtgctcctcacatgcgctgctttgtgatggacacctcctgggagacgttacacagccagtctaaggacttggagctattgggattcctcagcatcatttggtgcctctattgccaacactgtctttgcatctctgagtctctcacgcatgtgtgcaggtgtgaatggtgtgtatatgtatgcctgtatgtggtggacatgtgtgatcaagtgccagcctaggcctcactccctcttcccaccaatgtagtattccctgccctgagcacagtggcttaggtgactcggccacactgtggatttggttggccaggtttcaggtcgcagttttcttggctgtgggatgatgctagtgtctacttgaagatcttcagccacatgagagatgtgaaggggtggtgactcagtggctgcttccccacttctcagggctcttcttccaccctagaggcagggtagggcaactggaagcccttatctggactctttattcccattataacagtgttcagccctgattttgacacctgttactacagagacatctttaggcctgcacctgtcccacagcccacactacctgtgatcaggggttgtttacccccgccccagccccatctcagggcagccctgcactggagtccaagtggctaaactgagcccctgaaggggaagtgaccagagcagaggacactactagacttggaacttcagtgctggctacctggggttctctgggctgagcgggccagggcccccagtcttacctggtacctgtttaccctgactgtttaccccctttctgttgttcaactacagcctctgaactgagaatttgggacttatttttctgattgtaaaaataaaaagtgccatgccatttttataacattactagtgtcttattatttaagtagataatctgtgattatcccctgacttactccactgagtggttttatgtatctagatttgactttgcatttactaagtgctagatagagggtcctgtgggtctgggaaggcactggcctggccgtgacccaggcataggtaggcggtagagttgaggtggatgttgaattaggtggagctcttgagggcaggattcatgttcctctgaaccagaccctcccatgtcagtgttttgagaagggttggttgcatggggtggtccaaggatcctagggcctgagttaaattgccctggacctacaagggctagggaaattctacacccacataggtccttcagtcctgcccgggtccagaaagtccttttagcatcctctactgccctcttagcctaatccagggttgaaagaccggtcagttgttagcatagaaggttgaggttg

SEQ ID NO: 30356 - DNA, 1127 bp, Mus musculus
attctcacacagacacacacaggcacacagacacagacacacacaggcacacacagatatacacagagacatacacagatatatacacagacaaacacacaggcacacatacagacatacacaaatatactcacacagacacacacaagcacacagacacagacacacacaggcacagacccacacagccacacacacaaacacacagacatacacagatatacacacagacacacacaggcacacatacagacataaacaaatatactcacacagacacacacaagcacacagacacagacacacacaggcacagacccacacaggcacacacacaaacacagacatacacagatatacacacaggcacacatacagacatacacaaatatactcacacagacacatggtcacatacaggcagagagacatacacatacagacactattgattggctttgcacagagtccagcacaaaaggggtggggctcaaaggcaaactccacagaagactgatgaactcagctgatggatcagctggaggcaactaatacccacactgcctctcagagagccagggggaggacactctgctataggcagcagtggccaggtacaggcctgggctgcagcagtggccaggtgcagtcctgcagtgacagagaataggtattgtgagctattgtgggtgaagcaagtagaaagacaaggagaggtctgggttatcgggacttggaaagaaaaacaaggcccttaactccagagtctgaagcctcttggcagttgtgaatcaagaattctagttcagccaggtggtggtggtgcatgcctttaatcctagcagttgggagggagaggcaggcatatcgcaacgtttgaggccagcctgatttacagagctggttccaggacagctagtttctacaaagagaaactctgtctagaaaaacaaaacctgcccagcagtggtggcgcatgcctttaatcctagcatttgggaggcagaagcaggcagatttctgagttcaaggacagcctggtctacaaagtgagttccaggacagccagggctacacagagaaaccctgtctcaaaaataaaaaaataaaaaaataaaaaaaaaaaa

SEQ ID NO: 30357 - DNA, 1158 bp, Mus musculus
ctcctacccccactcacccactcccacctcaccgccctagcgctcccctactctggggcatcaagcctccacaggaccaagggcctcttctcccactgataacagataaggccatcctctgctacataggcagctggagccatgggttcctccatgtgtactctttggttggtggttttagtccctgggagctctgaggagtctggttggttggtattgttgttcttcctatggagttgcaaaccccttcagctccttcagtccttcccttagctcttctattggggttcccctgctcagtcccatggttggctgcgagcattcgcatctgtattggtcaggctccaggggacaaggtgtctcttttccagggcttttgaccactaggaagatagccattgaacaagcacatccatgttgctatgactgctggtaagagctactttgcgactacctagaagaacaagagtcctgacacattctgggagtgagaagggctgacatgtaaaggatgagcagtagttagcttgatgaaagggaacttcacggtttgtgtgtgtgtgtgtaggtgcagaatactgagtgtggtagcaccatctacaaaggccccatgacaagagaggaggctagaggacaggaatgggcaatgagaagggaagaggggagtgagtgagtgagtgagtgagaaaacgaaggaggcagcatggtcagactgcatggcttttggaaacaccagtctattctaaaagcagtctgggcttctagatgcagacaggtgtctcacaggacagatcagcttctctgagcaagggtggtcggactggatgagtacactgggcccgcttccgtccatggtatctgggtgagtatactgggcctgctcccaccatgatatctgggtgagtacactggtcctgctcccacccataatatctgggtcagtacactgggccttctcccatccataatagttagttgagtacactggacttgttcccatccatgatatctgggtcagtacattgggcctgatcacattcatgatatctgggtcagtacactgggcctgctcccatccataataggcgagtacactgggcctgctcccatccatgatatctgggtcagtacactgggcctgtttccatccataatagc

SEQ ID NO: 30358 - DNA, 1991 bp, Mus musculus
tgcagtggttctggtaacatgtgctttctggtcttggcttaggcttctccacagacggtgacgctcacacaggcaacggcagcagggcaacaggtacagatgatcccaacggtgactgcaacagcccagctggtgcagcagaagctcatccagcagcaggtggtgacgacagcctcagcatcactgcagacccctggtggcccaagcccagcacagcttccagccagctctgacagcccaagccagcagccaaagttgcaaatgagagttcctgctgtgaggctgaagacgcccaccaaacctccatgccagtaggatggaaattggttgatactatgttaggctgtcctggcagaactctatactgtttgtggactctgggatctgctgcctatagggtggctggctacacagttgtttgactttgtcctgtgtacatgtgacagtggcaatccatggcagtgcacagtttctcttagtgtgcacagctcagtacttggtaggactccatatcctaccattgttggataccactactgttcagcacatgcattgtagtccttcagcaggagagatccaagtctctttccagagcctccactctggtcctctctcttaaagtgcatatacccttctcagtatggcttttgttacaggcacccatcttgcccccgtgaacattagctttgatttgaatgatgctctggggctgataccatctctgtatagtaagtttgtgtttagacacattttactaggcacctccgtggatcctttacagtgttcttgtgacaagctagtgtgggtctcaggtgctgtagcctggtggagttgaaaccaacgttactttcccttacttttctcctggtctaggcttagtctgggaagcctagtatttgcttaggaaggcatcatttggtccaccccacccctggcagcactttatcaatttcagatgtcatggctgaactgttgtgcctgttacggcccattgcagttgaaggggttagttaaaatgaagccaagtcctatctgtgtttactcttcttactattgcaaggtgactatgccagagcggaaggtccatgttccacatcagtgctgatgcctgtcctctggcctgaattgcctgtgctgtcatgttagcactgcagcctggaagtggttgtgttgtgtgccatcatgtctatcccactgtttgtgtcctgtgtgggcaggaatgtgacaatacctgatgccacccagaactcacttttgagctcttaatgtgaaacatggggaaagtagcaggtgttgaaaaacagaagaggtcctgtatgcagtctcataaacaaaaccccatcattttgtcttggtgtgtgctgtgttgggaagctttggaggttcctaggtacctggtatctggctcccagcagcagctcctgttccttgtagatccatgggctcctttgtgaacaacatacctttttctccatccttctcactgtggtggcagccttcttcagtgtgcccaagccatgtttggtgggacccaaaaggcaatgtgagaagcagagtcttcatttttggcagttgcttttgtttatttttcaaccagatagctgttgtgtttttttaaaaatgtaagaaacaggactgaaattgtaaatactttgtaaacacaagcatttgtacttgaataggattttaaaaggacaagatgtcctactaagcaaaggctaataaataacctttctacacctttcttgttctgtcttaataaacaaaaggagcaatgttggcaccaaaggctttcagtctgtattgctccaaagtcatggccaaggtcttcctctttagctaccaggcaacaggactgcaccaggaatagaaatgtccttatgagcacagtcccccttctaccctagatgatcaggtgaccccagtgtagagccatacacagccctatcctggacaccttccattaggatactggaaaaactgcttcattt

SEQ ID NO: 30359 - DNA, 1120 bp, Mus musculus
gttcagcagaaggtatgggttccttgtctgaagtttgactttagtgcagctttgtgctggagaggagggtccagaacaatcgggctgtgttgggctacaggcttcacgaggtatgggttgcaagctggaggtgctaatgtgctcagtgtctcttgttttcctttcattttgatatgaatgcttatgtaactgatgatggtagggtgagtgggctcaagctagataccaggtatggatttttccactgggactgtgggttcaatcaggatacactgactcctgtatgtagtgacttgccataggtatcctccaatggcttaaaggtagggcaatgccaagatcttaggatagtcctgaccatacttcctaggagatacagaccgtggcagttgctgaggttatgagtagtgaacctagtctcacctggctgagcctctgctgtttcttttttttttttcagctgaccacccaacagatcactactcagggcccgcagcagaaggtcgcttatgctgcccagccagcccttaaaacccagtttctgaccacacccatctcccaggcccagaaactggccgggactcagcaggttcagactcagatccaggtaagcatgaggcagggaggggggtgatttttaaaaagtattaatttgtatgaatgtttgcacacatttttgaatttcagacacatgaacattgctacaacaggctttaggatcccctatatgcatgctagaggttacagaaatctgtctattaaacagatagttagaagattgttttatactgcccaggctagcactgaacgtgctgtatctatagcccatgttgacctcaaactcaccatactggccagcttcagtgtgctggaggttgtaggtgccaccacagtctgtatcgggaacttttatagtgtttgtgattctgagaattcaacctgtggcttcatgagaagaatttcattactgagccacaacttcagcttttaaaaagtaaattttgctgattgagggttgaccctgacatgctggaaaataaacctcttgtttttgcattggaaaaacaaaagtgaattttgacaacagcaagagatttacttctgcagcaactgtctgtag

SEQ ID NO: 30360 - DNA, 1194 bp, Mus musculus
gcttggtgtttctctgagccaatatccactattagaacttcagcctgcaattattctccagaagagttgaggaagcaaaggtttgacaagccaccctctttacagccacaggggttcagctacctggaaaaaccatcacccctgctgctcatttccagcttcttaggcagcagcagcaacagcagcagcagcagcagcagcaacagcagacttcccaggtgcaagttccacagctccagagccaggcccaatctcctgcacagatcaaagctgtgagcaagctaggaccggtaaatatatcctttactgtacgtcacaggcatacctagcctttcttcaattcagaacctattttgtaaaaacccagcattgtctttaggtagagaactgccttccctgtatttaaacagctttccatccagtaagcgtgtgtcatgcctctaagaagcattgggaaaccttagtttcctgctgaaagtgaatcttgaatcctatgcagtgtattgccacagatcattttcttttttcttaaaaaaaatttattaatttctttattttatgtatgtgagtacactgtagctgtacagatggttgtgggccatcatgtggttgttgggaattgaattagaacttctgccccctctggtcagctccgcttgctcagtccctgctctctatagcccaaagatttatttattattataaataagtacactgttgctgtcttcagacacactagaagagggtgtcagatctcattatgggtgtttgtgagccaccatgtggctgctggaaattgaactcaggaccttctgaagagcagtctgtgctcttgcctgctgagcctgccaaaggtctaacaagccacccctttacagccacaggggttcagtcagctacctggaaaaaccatcattttccagaggactaaaatgtaaaccattcttggaggatagtacaaagacactcctcattgctcctcttcaggagcagctaggtccagtatacttctctttgttgcttgtttaaacattgatcctagttttgccagtctgctgttatcttgctattgtttgtgctaatgtgtttcctctaggaggtaatgttatatccttgggaataatgcagaatcacgagtatgcagcatgaaaagaaaccagaaaaatacatacagtgtgaactagaacttttcct

SEQ ID NO: 30361 - DNA, 1211 bp, Mus musculus
cttacatgcattttctatggtgttcatcatcacagtcatggaaaccatgtatagttacatttgaagagaacaggccctgtgctaatgggatgatacttaaggctgtcagccaggcatgaaagtatttgtgtgttgcgtacaagtacacaggaatgctgttccgtacagaggccaaaggtttgcatggtggtctcgggagccatccactctcattttggggatgagccttcacctgggtcttgcagatctggctaagtaggctggccagtggaccccagggatcctcttgtctacatttcaccagttcagggattacaatcacacaccactacttggaggatttgcaaagcaagcactttcccaactgagacattcctcaaaccttgaattgttaacattgagctgtgatgggtttttgtatgtggttgggcaacattctcccttcgctcagatgatacatttacactgtatggttaatgtggggactttcaaagtaaggctcatgggctgtatttcctgcccattgaagtttgtcttcctatgtggaatagagtgatgatcacaagaagaatttggacagtgattggttggtaggaagatactgacgaagtggcatttgaaagttgaggcctgagggacaggaaggcattggtgagaaggaggaaaacagctggaacagaggctcgcatgtggccagcatgagggacaggatgcagggctgaagatgatgcatgtggtgagaggcagcatgggaaggggagccaagctaaagacagccctagtggtaagcagactgaaggcagccaaaggaatatgtctgggatttgcattgactgacgataattgattttgtaaagtttatgtagcagaaggcctgacctgaagttaaacctgagtttctgttttcaataggcaggaaccattaaaacatcagtcactggaacaagcatccctacaggtgaggattgtgcacaggacttgaaaaaagctcagtctttctcctctggcctcactcatgtcctcctctttagggactgtaagtggaaatgtgattgtgaacacaatagctggtgtccctgctgctactttccagtccattaacaagcgtctggcatcacctgtggctcctggaactttgactgtgagttgttcccatgctcagagagcataccattctgggaagactatttgcttcttgaatgttccataga

SEQ ID NO: 30362 - DNA, 1145 bp, Mus musculus
gactccagagcacaggagagcaaagatgggagagggagtgacagtggcttaggcaggtgctacttctctgactaccctttggacacctgtgcctggtatttaatggcttgtgtttctaggtgatgtaatttattttatctgtatatgtatacatatttttcccttttttattttataggcttgtcagtggcaattctattgaagagaaattgttaaaaaatggaactaaagatttgatccgtgaagtagctgctcaaggaaatgactattcaatggccttcttaacgcaggtagctttcatatgttaggaaccctcagtgactgcatatgactacatagggagactgtctcacttcccaactccctcacagtgaagaatgccacagtgaacagaatcatcttttttttttttttttaagtgtgaatttactaatgaggaatgattcttgggtgtgtttttatactgtccatggctcaagtcagattcaggatcgtgtctgttcctggaagttacttactgttcctattatttgtatttagcgaactatccaggagctgtttgaagtctactcacctatggatgatactggctttcctgtgaaagctgaggaattcgtggtgctttctcaggaaccatctgtcagtgaaactatcgcacccaagattgcaagacctttcatagaggtgagaggaaatctggtcttccataagacttgtttgacaatgaatgttctacttgagttgtgactatgcatactttcccagtctggttgtgtgcttttactcacctggcttctgagtgctcagtccttactctttcttgattctcccctctgttgatcctgaagcattcctgccttccttcctgctttgccccaactgtaaagaagtatcaaggcaatggaggagaaaatgctagccattgtcctcttcccactaggactttctgagccatatttgctttctagtattgaaccatgcattccatctggcccgcaagcactctcccagtaaaatacacagctgactttgaagacttagatgaggccctagaatgtgtttgctatctcatgttgggtcctcgttggggtgtaatactccggatgtatgtcagggatattactgtttcagtgcaggcacgggaa

SEQ ID NO: 30363 - DNA, 1185 bp, Mus musculus
agcttcttgtgatactttaatgcctgtcttggtgtggtttaggatctcagagtcagggccatccatgaatgtagttggtggttcttgttcccttttacacatttggtaagaaggttcaggcacgtaataggcaagtggcagacttttgaagagcagccacagagtcatgggcacctagactaagcccagatctttctggtagtttttatccctttggcaatggctacatgtgtctgtgagtgattctgtgaccctcacagccctaggacagctgtgatcaccagtggatatatacctgggtatgtgtagggttagtggtcttcttgatttagtgtaaaacatactttcctcagatggttttctgtctttatctgagatttttaaataatcccttctttgtcagagttactgagctgtacatatatttgcttgtgtaaatgaaactctgtgtgtgcagtatacagactcatttttttctataccatttggaagtggctagtatgtaactatactgtacactcacctgtcactgatgcttctggtggacatgtgattacaggtagtgtactccagatcgtgtcagcccctggacagccctaccttcgagcccctggccctgtggtgatgcagactgtgtctcaggcaggtgctgtgcatagcaccctggggagcaagcccccaaccagtggccccagccctgcacccttgaccccacaaggtagggtgttctgaacaggaagaaggcttggtgagaatttcttgcgggcttttttttgaggagcaggggttactgtcaggagtcatgcacctctggccatggccttatgcatgtcaaagccttattgggataacctggtttccacacatgtgtcatgacatcagcttggtttcttctttctttttctctcaaatgtactacttaaatatgaccaaaccccccctgtcatattctaataaaaaaacttagggggtcagagagatggctcatcagttaagagtatttgttgcattgcagaggccctgggtatctttcctatgcccacacggtggttcacagacatctacaactctagtcccaggggatctgtcacccacttctaatacccataggcaccaggcacaccagttcatgcaggcaaaacactgctacataaagttttttatttatagatatgtataggtata

SEQ ID NO: 30364 - DNA, 1134 bp, Mus musculus
gcttttcttgttttctcaagttctgagaaataaatattagtggtgctgtggaaagcaagacacttgcttttgccactgtcatggtcatgactgatgccctttagtagtaagtagtgtctacacaatgagtgatacagggatcaccaccacacagtgactagcatgtgtgactagcacatagagccaacacctgccctcctttttcttggggaagactgctgtttattcctgcactgttcaaatgatgactggttggttgcatctgctcctctgccactccaggttgtcacatgatgctaaggagggcccagatagctgttgtccccctgtgaaaggagatctgtcctgagcatcagaaggcttaccacaccatataaaacagcctcttcagttgattcctgccttgtagcagattttgcctcttggtcaagtgttttcctctgccacctattacagaacgttttcttctttttttatttctgtttcttcttaggaaaccgacctttctatatttgatctcattgggctagaaaataaaatcactcgccatgaagctgaattactgtgtaagaaaaaagtgactcggaaactcatggaggaagtctttgcttcacctcctccgtcagcccgaccagcagcagtgaagctcaaggccagcaggtatgtgcatgggttagaagcagcatgtggctcacctggcatagtcactgctccaaggactgtgtgctggttgggagtcagatgcctgggctatgatcagtaccttcctatagctgactctaggcattctgttgagaatagaaagtctgtgttcatcgattctcggccttttggctaagatcaagtgtagaaagtctgtgttcttctttttgtttgtttgtttttgttgttgttgtttttggagacagggtttctctgtgtagccctggctgtcctagaactcactctgtagaccaggctgacctcgaactcaaaaatttacctgcctctgcctcccaagtggtgggattaaaggcgtgcaccaccactgcccagtaaaagctgtgttcttgagaatgttcggagtgtccttgttttcagtgagcacaactacattaataagacactcaaatagaggcagcaaatccccagtga

SEQ ID NO: 30365 - DNA, 1177 bp, Mus musculus
gaatatttttggtcaaatattgaacaggtaagtgctaggattcaatgggatctaaaaacaaatataatgtgtccaaggtgtgaggctgtgtgctagggtacagagcctcagcagctccagcattcatgcatgtgcagcagggagccttgtgcaaggcttaggatgatttcattctgactgctttgcttacctttgtaccctcagaagccacagctttgaggtgataatgtagtgcaggcctctcaggtagtacttggtgtactgtggccatcaaaagtaaagtctctttcagaatatctgctcccatctatatattctttcttttaagaacttttaaatttttactatctagtaggatttgagcaggttagacttagatacaaaataaagaatagagtaccaaactgagttttctctttcattgttgtgaatgaggttggttagctgtttaatgttttatgtgtagaattacacagtttatatccttaatgacttgcttatatatttattcttttatttatttattttggtatttaggttgtggaaataaaattacaagtagaattagaagagaaaagaaaaaaagccttaaatttacagaaagtttccagaagaggtatgatgttaagagctgttttttgtattacatttacttacttggtgtggggatgggggaagacaaatgtgtgcattatggaatgtgtgaaggtcagaggacaactttgtggagctagttctccccttccatcatgtgggttctaaggatcaaactcaggtggtaagggtcttcaaaattctgatcttcttactggtccagttgtggtttttgaaaaatgtttttgcaggtttatttattgtgcattgtatgaggtgtatgggtaaatgtgtgccaccatgtgcctgtggagttctaaatacaacttgtttcctcatctgttatatgggttctggggattggccttagactatcaggttgatgataggtgtttttgggccattttgcaaggcttttaaagacagtcttttttttttttttttggtttttggagacagggtttctctatatagctctgtctgtcctggaactcactttgtagaccaggctggtctcgaactcagaaatctgcctgcctctgcctcccaagtgctgggattaaaggcttgcgccaccatgccc

SEQ ID NO: 30366 - DNA, 1226 bp, Mus musculus
ttcagtattgagaaagcccccagagacaggttcttgacattctagtggaagccatacatctgcattgtgctttctggtgattttatttctgtgttcctaattgctactgctgtcagataccttgtgattatttaatgcttgttttgcttagtactaactcgcaatagttgggtgcattctttccttctttgtgtgctcatcctgaccttaggtctgctctaggacactcccattttgactgtaacagttctcatgtgagaggtagaatgtccagtgtgtgtccttgtgactcatttggtagaagctgctatgcactaaggtcagtgctttgggctctttcttatttttcaggagggatgcccccaactcctcaggccacacagctcactggacagaagcagagtcagcagcagtacgacccttccacagggcctcctgtgcagaacgccgccagcttgcataccccaccaccacagcttcctgcgaggctgcctccggccagtgtcccagccacagccctcccttccaccttacagttttcacagcagtcacagatggtggaggcttcaactcagctccaaatccctgtgaagactcaacagctaaatgcccccatccctgcccccctgcccagccagctccctgctccttcttcacagcccgcccagccggccctacatgttccgatgcccgggaaggcgcagatgcagacatctcagctttcctcccagacccaggtactctgtggacattggctgttttactagtgaggtacagaagaaaagaggaaacagtctgcagaggtggcttggcttgctgtctaggtatttggtagggtggtctgcgctgaacctgcacgttcctggaagcagctttacctgccctcttagcacagttggttattgtagaagttgcaaattaattttatttggctttgtaataacaatcattaaagtaatagaaaaccattattattgttgctgttagtagagaaagcctcgacctgttgagttacatgctattcagagggtgttgtattcgtcaccccatttggtcttttgggaactattagatggtgaccaattttaccagtcttgaaagttgtgagactgacccaaagagatgaagtgacaattcagtgttgactctagctttgatcaagggtgaagcccggtttttcaccatcagctagactttctcctttgctttttttccagtgctatgaa

SEQ ID NO: 30367 - DNA, 1543 bp, Mus musculus
tcacactggcccccctgccactgcccaaccccacttctccaggttttcagtttggtgcccagcaaaggcgctttgagcatggctctccatcatacattcaagttacttctccgatgtcgcagcaggtccagactcaaagccccacacagcctagccctgggccagggcaaaccctgcagaatgtgcgtgcaggtgctccaggtcctgggctgggcatatgcagcaacagccccactggaggctttgtggatgccagtgtgcttgtgaggcagatcagcttgagtccatcaagtggtggtcactttgtatttcaggaggcaccaggcctgactcagatggcccagggagcccaggttcaactccagcattcaggagctcccatcactgtccgagaacggagactctcccaacctcatgcacagtcgggaggcaccatccaccatctagggcctcagagccctgcagctgcaggaggcactggacttcaacctctggccagcccaaaccacatcaccacggccagcctgccaccccagatcagcagcattattcagggccagttgatacagcaacagcagcaggtgcttcagggacagccaatgaaccgatctctgggatttgagaggacacctggtgtgctgcttcctggcgtgggagggccttcagcatttgggatgacatccccaccaccacccaccagcccttccagaaccaccatgcctccaggcctttccagtgtgcctcttacatctatgggaagctcaggaatgaagaaggttcccaagaagttggaggagatccccccagcctcccaagagatggcacagatgaggaagcagtgtctggactaccactacaaggaaatggaggcactcaaggaagtcttcaaggagtacctgattgaactgttcttcttgcaacatctacagggaaacatgatggatttcttggcttttaaaaagaagcactatgcccctttacaagcgtatcttaggcagaatgatttggacattgaagaggaggaggaggaagaggaagaggaggaaggaaaatctgaagttatcaacgatgaggtaagaaacagcagttcagtagtctagaagggctatgtaaagcaaaatagatggtgtgcaacagcagactgaaaatgtgtgagcttggggtaatgtagggtttgggtgtcacagaatctaaagagaagtaaaatgtttatttcccttcttccttcatgtagaggaagcgctgttcagtgtagctgtctggggagggagatgaaggactatgttgtgactgatgccttttagaaccaggtgttgtcactgacaaccaaaactcatcctgggcatagagctcagccaatactgtctaggcttctcccctgtctgtatacatgatccttggccaacaagatagtgttgccagtcctctggcaacctacaggaaaggttctccaagaccagtgaagcttagctcttctctcctggcttcctggtttcactgtatgtttatgtaggtctgtccataaaaacaaagtttttaagcc

SEQ ID NO: 30368 - DNA, 1131 bp, Mus musculus
gcccatgcatcgtgtgtatacaccttagcatgaaagggcactttttaaaaaaagtgattttttttttcctattaaatatgttttgcttagtgaattattctttgcctattttccttttctggctgtgagatgagtgcaacactgctgtgttcgggatagctgaggggtaggcacagaaggtcagcacggggtgtggttggctgggcaggcagtagatgtagccactagcagtctgctcccggctgctgctgatactctcttccttccatccggacctgtcctttgagaccatcccggttttctctgaagtggctacactggtgatttcatgctgcctattcttgggagacctcaagggggaccgtgcgtcagcagcccccacctttatgccctagtattcttcacctccttctgggtctccttttttttttttttttttttttttggtttttcgagacagggtttctctgtatggccctggctgtcctggaacttactttgtaggccaggctggcctcgaacttagaaatccgcctgcctctgcctcccgagtgctgggattaaaggcgtgcgccaccacgcccggcactgggtctcctttcttatgtgctaaccatgtatccctcatccctggacagccacggccacttactcagcactaggtttggaatgccctttcagtccacagtgtactcctcccagacctctctcgccttttatgggtgaaggcattctcagatctctagcatagtcagtgttatggggcccttagacctacacagatggcttcatcccatgacctgcatttttggtttgttcggaatggcgagcaagcagttttagaggagtaacagctccgtgaggcagggaggggtcatgtcctcaaaatgggtattccttttttttttttttttttgcagagaagttgggtttgctttccagcagcaatatagtggctccatacaatctgtaactccagttccagatgatccaacaggctgcattcaggcaggcaaaacacttatagacaatttattttggcggttagtgggatggcttagcagttacaagtgcctgctggtcttacagagggcccaagttcagttctcaacacccgtgctgtgcaggtta

SEQ ID NO: 30369 - DNA, 2225 bp, Mus musculus
gcctttccggagcttaagtgggggtggtaggtgtggcctccctgtctcatgctctctcctccacaggcaagctgtgcattgagaggagactctcggccctgctgagtggtgtctatgcctgactacctgctgccaacctgcagggtagggtctgagacctggcagactgtcctcaacactgatcagatccgatggtgctgagactgctgccagccaactccagcagggatgctccacagtggacctgtgcagactggtgcaactcttgcttcctagactgccagtctctgctggcaggtagacatcagagtgccaggggtcccttgcccactgggacaggagtttctgaacatattcttcctagctggctccctggcaagcaggtatggtgccgagaagtggcacctgccacctgaagagcccatggcagccctgtgtcaggcaagggcctgagaccgttgctgactccaagccaaagcaagcttttcctcacagttcacttgccccattgcttgtccaagaaaaaagggtatggtcttctggccccctgttctctctaggaacttctccctctgagactacttacccagctttgtaagtcaccggagcactttatgcatacagagactggagaacctagccagcagtgcagactgctgggaacctgcctcctgttcctggctttcgtcctccaagacgctgtatagatgcagaccacatctttgtgtataaaaagcccagtgttcacctcctcctgtgtctggtctttggaggaaagcaacaggcttgcctcctgagggagagatagtcctcacgtttaaatgttcattagggacagacagttcattgtgtgaagcaccacccatgcttgttaaaactcctcaacttccacactttactcctaagatgtgtctccaccctcccaactcagtttttgttcataaaaggaaacttcagatgtttaaggattgaaagggcggaggcagggcaggccaggtatcacactggatgttgtccttgtaggagacggtgcccgctgtgtggctgaggctgtagcatgtgccagagcgagtgtgctgctggctatctctattaactttccctggaagggcggcagaaaaggcagtgcccaggtgccgtcctccctgtgcagtggaggtgtgggtgaagaataacatatgcaaacatgtcccctgtggagctttcctgtcagtctggctcctgtgcttggtggccttcaggatctgtgctgaagctcgtcttccaggctccagggtggacacatgctaataccttcccagcctccctgacctgccagtcctttgtcacggctctgttcatgcatacttgaaagtatctgagtgtccacaagctgatgtggggtttcagagttataggccacacacacacacacacacacacgtttttctttgcaatacttgaaatattgccactgtgcttggttgtacaagagttgtacaagaaagcagatctctaagaccagtctcttccttagtcaccctatgacctcccttgcatgtaacatgttgtatttattgctttgtggccaactggaacccagagccaccagggaggctagtgcagggattcctgacccaccacctggttcctgaaaggctcctgggtggctgtgtgtgtgtgtggctggctgtgtgtggtatgagccaaacctgctcatgaaagcagtgctcaggcctgtcaattttaagatgaattttgtgagtctcccccttttgtgtttcactgtgtcatatcagtttaagaaaataaaaattggaattatttatgtggtgtcaatttcatcctggggtgccactgtccctccaggagccgggtgtgccttcaggtctgtctgggcaggttgcctgtgtcccccagccagattgagtccagtagtacttcacggtgccggtggtgtggtggcttgctcagcaccggaagcaagcctcagtttgatccagggatagctgggtgggttcattgtatcacccaggaaacaacagttcccactgggtcaggtgaggatccagagagggtggggcaattctccaggccccctagagtggagcatcattgataatgaaccttccccattttgagagacagggtctttgattcctaggctcagatgatcttctgttctctgcctcagacttcatagcagggactgtcgggcaccccattgcacctggcttcacttgtca

SEQ ID NO: 30370 - DNA, 1114 bp, Mus musculus
gaggtctcccagcccatgggactttctcagtgctgtctttccctcctaggccgggccctcctttgacttccccaaaacccccagctctcagaatttgctgaccctgttggctaggcagggggtagtaatgacaccacctcggaaccgtacactgcctgacctctccgaggccagtcctttccatggccagcagctgggctctggccttcggcccgctgaagacacccggggtccctttggacggtaagtggagtgggacgactgctcaggagctgttctccctaccattgctgacccaactcatcttgtgctgctggctgcccagtgtggcaggtgttggagatttgtggtgggcatttgtgccccagcctggttccttgtttgggagattcgagaagtcggttaaatgactgaagctgagtctagttatgcctggcctgaggaatggttgtgtgcaggaatagggccccagctgtctggcccagaggccaccaccacattagtgcctccccccactgccacctcaggtccttcagcaccagccgcattacggacctgctgcttaaggctgcatttgggactcaggcctctgactcaggcagcacagacagcctacaggagaaacctatggagattggtatgtgaggggtctgtggggttacttgtggacagtctggtcccaacccatccctgagcctgtcttgttcttcagctccctctgctggctttggagggactctgcatccaggagctcgtggtggaggggccagcagcccagcacctgtggtatttactgtaggctccccacccagtggtgccaccccaccccagagtacccgtaccagaatgttctcaggtaagatctgtgccaaggaaaagcagcacacagggcggggatttttgagggcagtttcctgttgtgtaacacaggagaccatagaccatagagtatatggcatttctggcatgtctatagagcagggatggtaatcgagatactagtctctatgtccagcgcccctggaaggccagcctgtgctcctgccacttcccagttattgttagtggttgccttttcttcctagaccacctccttctgcacacgccatctcta

SEQ ID NO: 30371 - DNA, 1179 bp, Mus musculus
ctggagagcctttgtgttcaggttcaagagtataaaaaaagggacacggatggtccaggtggtatatatacaatacaaaggtggctgaaaagggctgccactcacttctgtcccagagcagactgcttgcactgggaccctacaaaggcactttatcagcatccagctgcactgcctgactgcaagctctagtgagaagagggactttggacataatatggagagccagagagaaggtcaggtgagccagggagagcagaggaccccttggccagataccatcttcttccacaggtgatctagttgctgaggcagccagtgccaagcccccacctgatagcctgctgtgtagtgggtgagtgagtccctctttacctttgctcagggataagttgggcttttaggagagccagtgctatcctgccaggtccagtctttttggctgggaataaggccatttgggaaggactaaggctgctggggggaagcctgttgagggagtttagaatctgaatgcatgtatcaacctaaaagtgtctacctgtcccttctgccaccaggagctcattggtggcctctgctggcctagagagccacggccgtaccccctctccctctccgacctgcagcagctctcccagcccctctgggtaagtatacgtgagcatcagtcacactctgggtcatggtcacccttcttggcatgatctgttgtatctggaaggtcctgtgtttggtcaaatctggccatggcagtgtggatgtcccactgaaggcctgtggaagtgtggatgggttgatgaagggatcaactgagaatgttgatcaaaggtgctttcaggacctttgctaggttagagtataggcaacaattatgtaggggtcacacaggtacagttttgggtgattacagtgttgtgaaagccagctgccttcagtcctggccaaagttgagacattctgccaaaatgtctgtgtctgagcttcttccagtgctgtctataatggctattctctctccacagccggcctggccccttctccagcaacaggtacggtgcctcggtccccattcctgtccccactcaggtgcacaattaccagcgcatcgagcaaaacctgcaatcgcccactcaacagcagacagccaggttagtgtccctgaccttagtgagaatc

SEQ ID NO: 30372 - DNA, 1374 bp, Mus musculus
gggtgtggggaatgagaataaaaaccttttagctttatgtgtacgagtgttttgtttgtctgacatggagactacatgtatacctgaagtaccttccagagggtattggaaaccctggtactggagttacaaattgtggtgagccaccatgtgggtggtaagaagcagacttaggttctaactgagagtggtggatgttctaactgctgagcatctctctgtgtccacttcacctagacttgctttgtggaagccactgtggtctagggggcaagagacctacctcagaagtagggactaaatctagtgattggattgccatagggacggggaagatctaggaggtgtccaggggaggagtagaaaccaacatgagcagagtgctatcagccaagagctaacagcgcccagttatgtggaaggggagtcctacaaggatgtgtgggaagaggggaggggaccagcttctggaagttgcagtacaagctggccttggtgcctaatgggtcagccctgtgtgctggaggccctctgtagagtggtgctggtgcttagtccctgcacttgtctttccacacagtcatgtacactcctgtctctccagagagagagagagaccatggtgtcccaagtctcctgagcctaccttttcttaacagctatgcgcacactgagtgaagacactgtcaggcttttcctacagcagatcgctggcgccatgcggctgctgcacagcaagggcatcatccaccgggacctgaagccccaaaacatcctgctgtccaaccctgggggccgccgggccaaccccagcaacatccgagtcaagattggtgagatgtgtttgggtggtggctccctgagagactgcagcaggggaccctgcccacagagatttcagatcaagacatctgggtgcttctcctgcagctgactttggattcgctcggtacctccagagcaacatgatggcggccacactctgtggttctcctatgtacatggtatgtacccacttgtggtccaggaccacataaaaccaactccatgtatcctgatgctgcaggcagagctgggctcagcctccaacctgagaccctttgtagaaacatcagaccctctgaggatcagctatggcctcattgtgggttgtagacagttgtgcacgattttgtcatgtcagaactagctggtggagtttgtgtgttatgtgttggttgcttagtgcctagcagctaccatctccaatttgctgatgcctggtacctgttactgattattgcacgctgctgtacagaggtgctgatctgtgttgtcactgtgtaggctcctgaggtcattatgtcccagcactacgatggaaaggctgacctg

SEQ ID NO: 30373 - DNA, 1193 bp, Mus musculus
gaggttatacttacgtagtgggacaatggaaacccttaagaaattcttcttagtgtttaaaaggactaaacctatcaaatatttcctttattatttataaaaaattaattatgacattttgctggtatccccaacttgtgagatcgcagctgtgtattttgtcttttttgttgtggtgtccttgttgcttagttcatgcctgctgtttagtaagcattcagtaccctgtaactagtcatctacaccatgcctgctgtttagtgagcattcagtaacctgtaactagttatctacactgtgcctgctgtttagtgagcattcagtacctgtaactagttatctacaccatgtctgctgtttagtgagtgttcagtaccctggaactagttatctagatgagtaagttgtacagtgatgtaaagtgtatattctttaggctaaacaatttgagagcaagatcataaagtcctgccccgaatgtcagatcatgtctaactttgtcattctaagtgagtactgggtggaggagaaagaagagaagcagaaactcattcagaaatacaaggaggctatgagcaacaaggcgtgcaggtattttgatgaatgacgtgggagctgcccatttggagggaactgtttttacaagcatgtgtaccctgatggccgtacagaggagccacagagacagaaagtgggaacattaagtagataccgggcccaacaaaggagtcacttctgggagctcattgaggagagagagaacaacccctgtgacaatgaggaagagcaggttgtcacctttgagctgggtgagatgtttatgcttttggctgcaggtagggatgaagacgacgacgaggagctgacagactctgaggatgagtgggacttgtttcactacgagctggaggacttttatgacttggctctatagcagggttgcgtggcgcgggcactggtctgcggagcctcagacagtagctgtcccctgcgctgtgtggcagtgtgtgtgactctcctaggcctctcaaactccaggtgctgtgatcactacccagggcctgttcctctacccttacttttccctcaagagtgttgttttctctgtttcaaatgttacaaaaataaatcttaaagttaaaaaaattccaatttcacttttcacagaaataggaaaaagtaattctaacatt

SEQ ID NO: 30374 - DNA, 1221 bp, Mus musculus
taggtggctctgtgtgagggattaggcttttccaaacatgcactgagtaatggatttaagagctattggccatgttgtgtgagagatttctttctcggcagggatacaggcaaaccctatataactacacagtggagtgcttactagattttaacatatatatgtagttatatacagagatgagtatatatatatatatatatatatatatatatatatatatatacacacacacacatgagtatgtatgcaggtgggcatacacatgcctatagactatcatagaaatgcctaggaagactatggactccagagagtaaatttgcttatgagtaattattatacatttatatatctgccttttggcagtttgcattaaatcttttattacttttatttttttagaatccagttgttactccctcctagtttgccctgctgaccatctcacggtgacgtctcccctgccatgtcacagtgacccccccccccccccgctgatcatgtcacagtcgcttcccccctgctgactctctcacagtgacctccccccgctgaccctctcacagtgacctccccctgctgactgtgtcacagtggcctccctctgctgaccgtgtcacagtggcttccccttgctgactctctcacagtggcctccctctgctgaccatatcacagagaccaccctgctactgacccttgcatagtgagctcccccctcttaccctcccacagtggcctccaccctgctgaccatgtcacagtgacctccccctgctgaccctctcacactgacctccccctctgaccgtgtcacagtggcgtcccccctgctaaccttgtcacagtggcctccccctgctgaccctctcacagtgacctccccctctgaccatcatgtcacagtggtgtcccccttgctgaccttgtcacagtggcctccccctgctgaccatctcacagtgacctccccctgctgaccatgtcacactgacctccccttgctgaccgtgtcacagtgacaccccctgctgactgtatcacagtggtgtccccttgctgactctctcacagtgacctaccccctgctgactgtgtcacactgacttctccctgctgaccgtgtcacagtgacctccccctgctgaccgtgtcacagtgacctctcccctgctgacagtgtcccagtggcctccccctgctgaccctctcacagtg

SEQ ID NO: 30375 - DNA, 1199 bp, Mus musculus
ttagtggatgcaaccagaaataaacagtgaaaagtttggaagtagctctcctgtgctcgctccagaagatgagctacatcctgttcctcagcggcctgcttcataaggccaggtattgttcagctcgtgctctgcggtccctgcccacgaggcaaggactggaaaagagacataaagttaacatttgaaagtatagcagaaatgggcagacgccaaccggcggagttgggtgagtctttctgtagaaaatggggtcccagctgggctttgaaagactgggagagcttggcagacatgctggagggggaagtatttttggcagaaatggagcatagaacagaaatagtaaaatgtagaatgtgatcagaaacagggagtagaactgtggatggaattaagactgcacagaggcaacgggatagaggtaattagtgaaagacacagcccagcaaggggttggatacaaatcatagaactctttgaaagccaaactaaaggtccagtgagatgggtcatttggtgctcactgccaaggtggcgtcctgagtttgatggccaaggattcacacagtggaaggagagaaccgacccctgattgttgccctctgacctccatatgcatgtcacggacttacaccccctccatgtatgtacgtctgaatacacaaatcccaattcatgcaagtaaaaataaaaatagaaaataggactaaaggactcgatttgctctcagtagagtggtaagccagttagagttgtaaaggaggggtgacctaatcagagtttggaaaggtgcaaaaaccttgacatgggtgactacatgtataactcagttatacatatggctgacctgtatttatttcccacactagtcctgaaagcattgtatggctagcatttgaaaccatacaatgtttctctgtaccttttgttcaattttgctctgaacctaaaactctttttaaaattgtatctactgagttggtcatggtgatccaccttttgaggctgaggcaggaagatgagatgtctgaggtcaaccggggctacatagtgaaacactgtgtcaaaatcagaaccaaacaaaactaaagaaaaaaaaaaaaaaaaagaccagattatcaattaaggccagaagaaaagccaggagactcgatgggacgttcctgtaatcctagcacgtgtgagatggaagacga

SEQ ID NO: 30376 - DNA, 1205 bp, Mus musculus
cctttcactttgttaatgatattaacattgatataccttcacacaaacatgtgcacacatatgtgaatacacacacatgtgaatgcacacgcatgtgaatgcacacacatgtgcgtacaccacacagacatacagaatgaaaatacaaagagaataaggaaactaaatttacaatcttgagagaaaggcagcattttgaatcatgaaaagaagaagattaagaacaacaaaatggtctttttatgaatgtcttcattcagagcgttacacagagcaccctcacactgaagttagcttgtgaggcctctgggccatgactgtctggtggaattctagagacggcagagtggtgtgaactgcagaccacagtttacagtctccacagagagtatttctagagaacgtctacaactgtctcccgggacaaggctttgcaactctcagggccatcaggcaaccttctcttttatgtccagagtgaattccttagattcgtgctaattaaaaatgtgtctaagtatctgagagtctttgattcagtgacaagagaagtgtaaccctctctgagaaattgtgctctagtctcaaaaaggtggagtgactgtagggtctccaggcccgacctctgaggtaatgtctcagaattgagtcttcagtacaatagataaaatgtctttattcaggccgtcaagctgaggcacatccatgctcttgctctgctgggtggctatttgctgtctagggctgcccacttctgtgagtgctcaggcagctagctgtaagggcgtgcagcctgccccaagggaaaaggacagttggtgcagcctgttctggcaccatcctggtagaggctctgccctcctgtccctgccctcaagaaattcatcagctccccagagactgtaaggcattatctcactcagccctctggctccaagtaggaattcacttaagttatctctgcagaggagaatgtcttcatgttcaacctgcatgattaaaaattagttttaaattaaaaaaaaaaaaaaaagaaacattacccatgggggatttagcaatacctgttcctaaggtggacagggctggagggtcacttggtgcttcgagaaataactgtgatgatacggataattggagcttacatggagtgagtgttctccgtgccagatatggaaacaagggctttatcttttcacttactt

SEQ ID NO: 30377 - DNA, 1177 bp, Mus musculus
acagaagagcaagcaggtgagccaggatgctgtgccaatgtcagctctggactctgcctgtgggacacacctgccgagttctgtgtcacgtgctctgatgcacctgccatgttctgtgtcatgtgctatgaatgtacctgctgtgttccgtgtcatgtgcactggatgtacctgccctgttctgtgtcatgtgccctggatgtacctgctgtgttctgtgtcatgtactctggatgtacctgccgtgttccctgtcaagtgctctggacacatctgccgtgttccgtgtcatgtgctctggacacaactgccgtgctccttgccatgttgagagcatctgatagagaggctctccagactcagacatacttcttccccaagttaggctgtaaggatgtattaggcaaatgtatttatttatttttgtcaggaaagctcatgcctgcccttcattatgaatggaattctttcattgtcttaggccaaaggtccattttaaaacacggatctatgcatattttaaaatcaaatgcaaatatgcatgcataatttgttcccatttcctaggtttaatattcatgttaagaggctgaacagggcttggactgattatctgggggccttgtttctgccagtccctattcgggtcaatctccaacactgacaatcaagtttgacaggttcctttcacagtggaagagactcgacagatgtcgtcctgtgtatgtctgaggacgatgagcctaatagcaagtagacaggcccagaacattccttatcgccaagcacacagtgcaggcctcagaagtggtacctgctggatctcagacagtaaagtgtgtcacacacaggtacactgtgaagactgtctcctcagtcactgagggctaacagttactgtggggttttgtttttgttttctctttgttactgaagagtggggacccgagattgatcacctccttcggatcatgtagatctttctatcacccacagcgaaggcccagggctacacttggggttctctgctgaaagtatgcgggtgacgtgtgctgttccccccacctgccccccacatctgctcatctgagctctcagccccagaatgtctgttttcattcagacgcccagtctttccacaaaatttggagctggttttcagccctccgtgtcaaac

SEQ ID NO: 30378 - DNA, 2993 bp, Mus musculus
ttttaaacagaacaaaattttagggtgcggtatgtggggaatattttctaccaaagtttttccgtgtggagtctctcaggagagcctgtggcttaacttgctgtgtatttctttactttcttacagctacggagtcaaggccaagtgagggggaccagtgcggcctgtgatgactgaagccaccagcgtctcagtgttggacgtttccagtgtgtgtctgacgattcgagcacacgtgtgcacacacacggacggacacacacagacacacacacacacatattctcacacacttatgcgtgtgtgaatatgtgtgtggatgtctgtagctgtatgtaaagcacatatggctacaggtctagatacacacatgagtgtatatatatatgtatgtccatgctagatacacacacgagtgtatatatatgtatgtacatgctagatgcacacatgagtgtatatatatgtatgtacatgtaaagatcgaagggagcagggcgttttctccaaagtactgcacctgccttcaacaaaaatactaaagaaaatattttcaatatatatacctggaacagatattaataatcatcaacatgatgcccttgatggacaaacggactgccctgtggtgccccgtggtgctggctggcgtgcttcgtgaatgccaggtgtggaccagtgtgtacagcctatgattatgtttctgttttttcaagtcaccacatacacacacttagtctcattccatcagcaacaactcctacagaaagatttcttcaaatttttagatactccagtgactctggaatgtaaactctggatgtatttataactatttatttctgggtggccactatcttccagccaaatccaacattatctgtcaagtaaggagtcaaagctctttattggtttgcccgagggttggggaagtccttttttaaaaattgccactttttattggatttttgtattttgaatttcaagtatttttctacatcaaatttagcaaaaaacagtgatgacggtttgtgatttataataaacactagacaatattcagactctggctaagcaaacggcgatcaagcaattaacctgagtggtattgcaggctgtgtggagcacttctgtggagttttgtttctgaaatggcttttctggaattacagcctggagactttgtggatagtctgtattgttctcagctcacagggtgggagagtgatcacgtccagctctttttctgttgtggtccaggccaggaggaaatgaagagctaggaacagcttgagtgtggcccaggtctgtcgccatcctgacgcccagccagacctgagcgttgctgccgactctgcttcctcctcattgctcctcctcttcctcctcctcctcttcctcctcctcctcttcctcctcctcctctgcctctgttttttcctgtaagagaaaggagcagtagctgggtaggattttctttccttatgacctttctgtctgatgctgtttcctcttgttagccctgggaccctgaccagaatcacactgctgaatccttcaggttacacactgcctttttaacccccaacccagagcacagcaccctgccatcagagcacccgagtgacccctttgttggcagacttggccttcatgtcccctccgccctgccctgtgtcccatgggagcaatggcagagattcccactgcatcgcactgcccggttaccctcagcagcaaaccctgggttctaaccccggcactggagagcccaaccgtccccagtggaaccaactcagacatccatgtttccttaggagcttgggcacaaaggcaacggactcctgtgttgttctaacagctgtggagactgagggacgtgtatgagcgtaaagcacctgctttacttgccagtctcctgtgtaaattacagtaaaacaaaggaactgaaacggaaacaaaataaatttgatctcaaaattccacctgtgtgctcctgtggttgtttgcctggtgccacgtgcttgggatagcacagaccactgctggcctttgagttgtggtttttacagccccgctctgaaaagacaaacaggttctgctgtcctgcttctcctgaggggtgtctgtccttggatgtgggcttgtgccagtcaggttgtcacctgtggattctgaggtggtttcctgcccttactggagttgagtgaactcgggtggaggtcctgttagcctcacagttggcaaaagattattctttttttttttttttaaagatttatttatttattatatgtaagtacactgtagctgtcttcagacactccagaagagggcatcagatctcattatagatggttgtgagccaccatgtggttgctgggatttgaactctggaccttcggaagagcagtcaggtgctcttacccactgagccatctcaccagccccaaaagattattcttaaaggaagagatacagagaactcagtgttcttaagtgttctgtcgggttttgctgtcatacctaactgtcccaagagtgtggctctcggatgttttgtccttcagaactgtgttgtcctcctgtgccctgtacggttgcagcactaagcaccggggaaagcctgttgagctttcatgtgcaccatgtttccagagtgtttgcacttcccctcttggtgccagcatgcggcattagtgcgcgtgatgacctgtatctctcttgcatctgtcaacctgagtgtggtcagtcacctggctctcagcagaagctctgaggcatgaaaaggcagatgttcagtccagcatgagagacagacataggaacaggagaccaccagttactgtggtatctcttcaggagtagtgttggagagcagatgtcagctagtcactttgcaaatgagaaatcaagattgtatgcaggtcccagcagctgtgaccccagaagctctgagacccctcagagttctactctgccatggaggtaca

SEQ ID NO: 30379 - DNA, 1172 bp, Mus musculus
aatggaataagacacgctgagggcgggcctcgggggactcggtggtacgcccattctctgatctcgggtgttctgcacacagacccttctacctggggcagacatgtgctttgagtcctttaacgtctcttccctttctcccctcttgccagctttctctcccataggcagctcttttgattactaattgtctaaccccggggcaccccactctgcaccctgctgccccttaactaacggccaccccgctgccttcttctctctagtggctcctgtgtgtgtctgctgatgctgtgctactaacccggccctactaactggtttctcttcttactaacccagccctgccgagctctgggcttcctgggggctggtccctccttttggcaagcagatgtccccaggctgtccaggccagatctgaggcaggggacagccgtatttagtgacgcccagaggaggaggaggaggaggctgtcctgtggacgtgggacgctgggctccgagcatgacctctctcctctgtgcacaagtctggttgccaccaggagtggatgggaccaggggacctcgtgggaaccattgtggtgcccgtggctctagaattggcaattctgggccctacctagctggggccctctgtgatttagggcagggagagaggggtaggaacatcaggggctggccatcttgtacaggagctcaaagtgtgtgtctgaacccaaagccctacctgggagctataaacatgtttcctaagcaggaaacatgtgaggggccatttccctgaaacaccacagcgcagagaagcccgaggagagagggcatcaggaagtttgtaagagggcctttctctcagcctgagaagagatggccgatgaccagtaagaaggttctccaaataggcggtcaactagccaggcctttcccactgagagaggcggaaatctcaaactggaagtctatttgggatcatttttcacacaggaagtaggtgtgaggatatttttttccctcaggaagtgtttagaaacactctctccacacttagagaggacaggctgccagttgtcctgatgcacagtcgggaagcgtctctacgggcccttagggcttatgggaggggcaaatgggtgccaggaagtgaatcttagaagcccacaggcggatgg

SEQ ID NO: 30380 - DNA, 1192 bp, Mus musculus
accggcttttgtctctgctgccacacccagcacatatctggatgaagaatttggagtctggggagggggaaaaatggtgttaaaagctggggccaagcccttttttcctgctgggggaaactgaggcctgagactataaacaacatgcctactgttggagtgaagagtgggggaggggggtggaaagcagagcatcaagagcatttgtcccatgggtgggagagaggcctgccaggctgtccaggggaacgccctcctggcaggggggacctacaaccccaccccaccccagggatccaggccacatgcttcctgctgaaacgttgggtcttagtaaggatgctggggtaagccatgcttcctatgatagagcttgctctctgcggctagagccatggttcagcaggaagtcagctcccagtcttcactcccagaactggtgctgctggagaccgaggaccgggggctgctgcgggcaccggagcacccatggaagaccccagcccctcaccctcttcctgctaaaccttttttcacgggttattcctctctgagatgcacactggtcctgaaggctcttggaggctcccatggggcccaactgtgccttgatgccacccctgcttcctctgcaggacgtctcaggctgccttgtccctgactccctggtttctgctgtctctcttgtcttggaagctgctttgacttcccacgtgattcccgttcttgctctccattctgcctgctgcctccttatctgacccatgagtttttgggcatccgactccttcggtcttcaccgacaccatgaagattgctgggggcatcacctttagctcgttccttggtgtgatgtctgagaaggaacccctcctccccatttgtgttgggtggggccctgtgctggagctcttaggccaggtccagggcctgtctctaaattcaggttttgcagtttgatgtggtgtggcttttggttgtgaaaggtgtcttagtccctctcgttgccgtgagaggacacctgacgtttgtttttgccacagtttgagggtcctgcctgtggtgtggagatgtcctagcagagcagtatcaagtggctggtcacattccgtgaggtgtgaaggacagggctcacactgctaccgctttctctgtttcactcactccaggactctagcctgtgggatagtgc

SEQ ID NO: 30381 - DNA, 1109 bp, Mus musculus
aaatccacctgtctctgcctcctaagtgctgggattaaaggcgtgcgccaccacggcaggatgagaaaccctgtcttgaaaattcacaaaaccaaaaccaaatcaaaccaacaagaaaccccaactccgttctttcccagcgacagagaaataactagagcaaagaggagaacaataaaactgcttcctggagagaactcgacatggggtcgcgaggacattttaatctctcagtgtcctcgtgacgctggtaacgccaagtaagactccagtgcctggcgacggctcgccctggaacgagacggccactcagcctcagttccgatgggaaccagaagcagcgcgaggcgggatcaccggcccttccgggttgcagacacgccccctccggcgtgaagtcgctgccggggcaacagcgcgccacttccgcctctgagcgatgacgtatttccgatgcgccggtaaaggccacatccgggtttgggctggcgggaccctcgcagattcggggacgctgggcgaaggctgtgtggctctcgcggatgctgagcgaggtgagcaggcggcggggtggcgtcccgggagcgcgggctgaggctccgaggctccgtgacgacggctttacggtttccctgcgctccgggcccgctgctgacattgagctgagcgtctcctgtcccctgtgctggggaggtggcggtgctgtaattgagtgggcctagggcttcctgctcctttgaggaaactcaacatgtgctggttgctggggtcggaacctgttgagtttcgccggtgcatagtgaggaggaggaggaggaggagcagcgggggggggggggagctgttagtcaccgcggagccgttttcacgctgtcagtcactggtgtcacatagtgaggatgttactgtgcaatgcacacagtgtcgggtcgggacctttgaatgtgataaccacactcacaggtgttcatagaggcgcgatttagactcaggctggggtgttaagtgttaatgattttcacaatcattttgaaggattcacttcgcagtcctgacttgtaatgagtgtgaacctgaaacccgatcatggagtggaagaagatgctttt

SEQ ID NO: 30382 - DNA, 1151 bp, Mus musculus
tcaggtgcctacatgcagccgggtgcgagagagaacattgcctacctcacccacacagagcgcaggaaggacttccagtacgaggccatgcaggagcgccgggaggctgagaacatggcacagagaggcatcggtgtggccgccagctccgtgcccatgaactttaaggacctcatcgagactaaggcagaggagcacaacattgtgttcatgcctgtcatcggcaagcggcacgagggcaagcagctctacaccttcggccgcatcgtcatctacattgaccggggtgtggtgtttgtgcagggcgagaagacgtgggtgcccacctccctgcagagcctcatcgacatggccaagtagacatcggccacaccagaccggtgtgaataaacagcactgtaaaccaagctgatgaataacgtctctatttgggagaccaggccaccagggcaggatgtgactcagtgtccccagtcggcctgtattcctggccgggcaaaggatctggtgtggtgtgcaccgtggctcctggcccaggtggagagaactgtcctgttactccagctgagcgatctgtagctttcctgatgatctccaggtcctcacagtcctggtagtcaggctcttcctgggatgcccacaggtccccaggcagtccttccagcttcaatagtgggaaccagtggacagatgtatcattaaaggtgtcagtgtactggggagtctgcggcagtgggacctcctccaggcctttcagaatctgagcagagaggaccagatacgggcattaggtacacccctctctatcttcacctggccaccccaccgtccttctgagaaataagggatgggggggttgtatttcagcacttttcagtcccatgccagtgagactgctgggctcgccctaaggatgaaggccactggcacacagtaggagaggcaccagctggttgtgcttagaaacatggacagtgtggctttgcaccctcaccccggcccagctattctgtcagacacctttgcaatgtaggggtaattttcctgcagaatcctcgccaacaacctacaaataaaaacatacatacacaattaggaagtatatgggtgtttgctttctttttcaacaggtaaaaactagttcagaaagg

SEQ ID NO: 30383 - DNA, 1336 bp, Mus musculus
tcccaccacctgtcaatagggagcagatctccaaatacccaggttcccggtgttgcagttcccactctgcatctctgagcgtgcctctgagagagggcctctgttgacgtttcaggaaggtcacattccagaaagcctgaagccatggcagaaggcaggagaatgtggcttcctctgtccctgtccctatcctgtgaccgcctcattacaccctagaacatccctatctctgtggctcccacagtgaaggacacctcatagcctgcatcctttacccaccaagagtctccttcagctgtttatgtcacctgtgctgtgacaatccctggcagctccgagccagctaaaaaaaaaaaacctgttagcctctagaggacaatctgcgttttaaatgtcatcccctgtcgccttacagaatctgttatatggggctcacagaggttgtatattgatctacagaaggcgtttgtaccagactctttcttactctgtcctagaatgatgacggtcctcctcaacacgcgttgtatgctggggtgggagaatggaattatatatatatgatataggatctattttcctaaccgttcctctgggtcctacctgggatgtgtgcatcgcgatggggaaggactcgactcgcaaggctgcagcattctgacagctgccttactaatccacaagctgcaggccttctgaatgacagcagatggtgggcactggagccagtcccaggaagaacctaactgcgtgactgagaattcatctattaaaaaaaaaaacaaactatatttttactgtcaaaacaaatgggcttcccggacttcgcagtggccggatgtcccctgtgcttttatattttgtcactgtaagaggttttttggcacagacaagcaagtcagaaatccagctgactgcactgaatgggtgaactctgcatgtgcgaagggggcacacccagactccaaaagtagtaaataaagctttcctgtcagtggtaactctgaggctgcatgtccacaagacagcaacggggtgggggtggggggtgttctcttgggtccttgaaggaggagctgctggggctattggtgaaaagagaccaggggtgctaatcgacagcctatgcaaggatagtcaataacctttccttgatgagagcactgtggcctaaccagggaaactaatcaacagcctacccagtgatgcctagttaataacttacccaggaatggcaagtgctaacctattcagggaaattaatcagcttactgaatgatgttagtcaatacctacccagggatgcaattggttgacatctagagatacaacagta

SEQ ID NO: 30384 - DNA, 2462 bp, Mus musculus
aaacaagctcccctttccccactaagagcctaccttctgacttctgacttataagcacagctccgccccatcctgtccatacccttatccttcctgcgaggccccgtgcacagttggcctgggtcgcacggctttcatgtttgcttcagaggggcataaagcaataatgcagccaatttcccctgaactttggcaaagtgcttatgtctcagcattgacagcaggaagaggcaggcagtgtccggttgcctccggttacctgatcgctgtccaagcttacgaaggcttgtgacgttcacccttgtccacgtctgggttgctctgatctccgtggggggcagcctttgcccccagtctcgagcgttacgaaccttggttggaattgtccgtgccctggccactcacgtcctggacctgctctttctgaacacccatatcctgctggagagaagacacaacttagctcagcggagcagacgcgaccccaaccccaccttccatggctctcctggacaagtgattatctaggtcccatgtggatgttgctctaactgaaaggcccctgtactgggaggcccaggccagatgctgggccaagaatgaggtctatggtgtcctccattgtgctacctgcatgttcactccagggagtcccaagagcgtctgtactcctgtttacttttcttaagcctccaaggtggcatcagaagccccccagcaccagcggtcacccggaaacacgaggccagctgcccgcagcatgcctgcagcttccagagacctttttccagccttgctttggcgacatgctcagcagttccaaggtggttcaaggtggccatggagggcgctgggtcgggtgttttgatgaatgcctgcctggcgcgtgtgcccaccgctgccctgaggtcctcagagttagaagttgctctctgtaaatccgtttctcacaggtggtattgagacctgcctcccctgtccatggctgcccctctgtctcttgcctctgctccctcccacccgtcctctctgcctggtttcccttgggaagggtgtggtatgaagaacacatggccgtgcttggtgtctcggtttaggacggtcacctgtgcctgtgggctgaggtgttcagcagcaaggagacggcaggccccacctgtaccccaccttgtgctctggctgcaaacaggagccattgtctgtttaccctgttcctgactctcttcctcccctgagctagtggtgagaaatcacttgggcttctgtctccctgcagactctcccatggttgctgtttcctgttctgttttgttttgttttttaagatccattttgtattctgtggcaattttgatctagttgcttgccagggactttttttcaaacacactagcagggctgagagtggggctcagtggacagagtatgtatctaacacacaggaggtcttgggttctgaccccaggaccacatacatcaactgtggtggtacacatctgtgtgattctagcacctggcaggcaggaggaggagggaggaggaagaagagagggggtagtggctgcttagaagtctaaggacatccttggctacataagataggaacaagccagcctgggctataaaacactcaaacagaacaaagcaacattctactcatgattttgagtctaacttgtcttgactcctttcttctggggagtaggagcctagtgtagataaagaccatggtgtcagggagtgctcctgggtgtcagggagtgctcctgtctttagtatcagaaggcacggtggaattaaaatgggcttgccttgtctcctttgctaacccctcaaacctgatgagaaatcagcttgattccttatgaagacccacgtatggacagcagctctggccagggcaagcttctatgtctctcttccccctccaccctccgcccctccaatccaagctctgacagtttcactgggtggcgagtgacctgctgcaagttggctgtgtccccatttatagaattgatgcagctcagagagcagaggcccatgctttggatccttagccgagctgagcaagtcctcttttaaaaaccaggtgaggttctggggccaagtagtgtgctgaatgcctccccaggaccctccttgtaaaggaacctaatatgccttaatcaatgtgtgtacttcaggcacctgcatccctctcccccagccctccctcctggtgactctggctgttttcagaatctcatgtaggctccatcatctcctctttgcccatcagcattttgacatctgaactttgggtccacccctcccatccagtagataggcattctcctacatagtcgatatcctcaaacccagaggcctttgccctgtgaaatggagtggcatggtgctgtcgggtgtcctcagctccagcagagaaactgggtggtcctggggagtaggaacttagtgta

SEQ ID NO: 30385 - DNA, 1174 bp, Mus musculus
aagattctgatgacctgggtagaaggtacagaggtgtgtgtgtgtgtgagtgatgagaacaaaaatcttgtgtatattttagcacaagctgttagtttgtagctttgcttcccatgagaaggccatgaggaatacactctctgctggcatggtaatgacctgcggccctcccacgcctggctcttgcctctcttttctatctttcctataatcagccacatatttcaacatatccggggagaccaagaagctgcaacgtataaaggctttagccccgttgtgtttggtgtcccagcctttgggagggagccttctggtggcctgggtggcagcacaacagacctcatcccggtgccccacctcctcctctgtccaggtgtctgtaacaacagcagctctacctgtcagggttcaagaactgctgaagaaggataccccagatgcaagcagtatgcaaaagcaaagagcgtttcttcagctgaatttcctgcttgctggggtctgtctcccccgtttgggaatggagacccctggtgaaatcaggggctcatcttttattgtcagttaggggaattccagggaggggtttgcgccctcttaccttgattggtcagctctatctcgggggtctgactgattctataatcaagctctgaagacttcccaggggtggcttgctcattctagctacctattcttacttcaggccagatgatgaggtgtcctcggactggctgcccgcggctctggttggctgaccacaggttcctggatcctggctctcatttctgggaaacagaaacttaggcctagtctcccaaacggccagtttgcagctgtcatggagtcagtctggctctcctgacctggtgttcccatttccccttctgatttgcaactggatcaaatcattgatttgtcagggttttttttccctccaatctttttcttcccaccttgtcacttgtcaggggcagaagtcgttattattgagaacagttactgccaagcaagttttcatatgggaacagtaaaaagccacatctgaaacctgtctataccttaatttgatggctattagtaaagcaagcctgtctgccgttttcgaaacaagaaacctagcagtttaacccgataagttaaccaatgaactaacgtcgtggtggattgtttt

SEQ ID NO: 30386 - DNA, 1186 bp, Mus musculus
gaggaagctcgctctcatcttcctccctcatgcctggcacctaggctgacatgaggacatgaaaccaccccctccaccccgaggaatatataaggataagaaaaattttttttctagaactaagtgcactctctcttaacttaggactccctaagcacactggctgtcgcaagatgctctaattccccctcttgaagctaatcttgggagttcactcatcctagctcctgtgcatcgagattatcttttcttggttgattttttttcaaacaatctccatactggattggaaaagccaacctctgccctgacctgagtgactgccttcttgtgaaggctaccaccacaataggtcctcctaatccttttggatacaaacaacaaaccttctagaaagtacttttggtgtgcttcgggctcactctgtgagaaacgagcaggccctgggaaccgcatctccatcacagaatagggaatagacagagactggctggctgagctccttttccagacacacatggcttttatctcaggccatcaaggcaccaaaaaatcacccctccctgtgccctcctaagctgttcacacttaccctacggaaacaagagaactttctgcacagctcttttttgagcattttaaaggccaaggtaataatgtcaactggtggtttcgagtcaggtggcttcctcctacaggctgcgccgtacccatctccagtgtccaacctggaagttatagctatgtagctatctcctctgagttcaaaccttctcttcaggagggaggagactggtttatatgattcaagaagtcaatgaagcttagagatccggtaactcagaaacttcaggagtttcacaagtctcccacccccaggttgtataagcaacagtgatcgcttgagaggggaacccccgtgggggagggcccgacagcagccataaactgtgcaggggagacttgtgacccatgcatgctggggtgtgctgttcagaggggtgtcatgtcctttgggatacctacccatgctcctgtgcaagaccgcaacaaactcattggttcacaaagctacacttgggtggaattcccaagtgactctacctcggtctctgtagaatccagtttttggttctttgttttgtttttttctgctgacacaagagcgacaacagctggagaagtg

SEQ ID NO: 30387 - DNA, 1214 bp, Mus musculus
gtaagacccatgagtatcctgggttccaggtgtccacagggcttgctggagcccaaccccagcgatacaaagtggccagtgttggtaaattctccccagtccctatcccctgtgagagagtgagccttcagtcaatgccatcttctccagaaaaagggattcatttgagggccgtggtatagagtgtcagactgggctggcgccttccccctggggcacgtgtgagagccaagaggggcaagtctctgtccatcatggctctgtccttcccgtgacaatgccacacagtgcacgttctgggaagctctgtcaagacctgtgctgtatattatcaatggacccggcatccacgggcacgccacactgcacacatagaggccagaggacaatttgcagaaaccagttttctcctaccatgtgggtcctgggaatcaaactcttcaggcttggtaacaagccttcttacccactgagccatcttgctggcccaaatctgtgcctttaaaaccaaaaagccagagatgtgcatgtgggcataccagagctgccttgggatgcttcctttgccctctgagtagccaggttatctctgcagacacagcccagctttcccgctgggtacaggaagactcgagagaaatcgtacttcgcacctagtgagctctatccccacagatcttgcttctttctaagatattctacaggagtttcagagagaaaggtggcacacagcggggtcccactcggccgccctgggccaccactgatgatgtcgcttaaccaggcgagtttagtatcccacctcagctatcctcaacctcatacaccctcaccgttagacacaagcaggcaactcctcctgctctgcggctccactgctttgaatccacgaaccgacacactacgtcataggtgtatgccccacgacatactatgacctcatcataggtcgcgatctgtgagtaagccaccctgctccccccgcatcccgagggccgtgaacagccccagcttaccttctctgtgcagaggtccacacacttgtccacagacatgtttggcatggcagctgacacgggcaaggccagggagaggttgttgggtcggcggaagcagcccctgaacactgcacttccatctgaggagccagagggaaacagctgtcagacccagctacggctaatcttgagcaccgagctatcagacctggctaa

SEQ ID NO: 30388 - DNA, 1242 bp, Mus musculus
tcacctttgttgtacagagagccatcaaagtagtagctgccagtgtagaagccggtggccagctcgatgaggtggcgagcccacgtgttgccagcgcccgggaagctggctagagcgatgagcttcttagacttggctgggaggaaccgtctgtccatacagcggttgtctggggagggaggagagggtgacacacaggggtcagcaccgtgtgccctagagacaaggtcacagcgggaagaggagactcttaagtttggcctagccgtacaaatatctctttttagcttgcaacatctcagtgttgtgttttctaggctgtggaaccaacagtctcgactgcctcaccctgactgacttaacactgggtgtctctacgtccttggactgcagtctcctctccgcagggaacagaagtgaacatgccactcagtccaaaatctgctgagaaactttggggagaagtaaagtcctggatcccaactctgccctattttgctgtgcggctctggccatactgatcaacctctctgttttagtcacccatttgtaaactggtcatcacagcatgcataccatcgtgccactggagggttaaacgagttaagcctggtaaagagcatcaggcacatagattgttaatggtgtggttcctatcaggagaaccagggtttattgtgtagtagatgcttaataagtgacacatagagaccatcaccaccaccaccatcatcactaccgtcccagttttcttctctgctgctgtgataaaacaccaagcaaaggaaccgtctctttggctcacacatcccagttccgagggaggtgagggcgggcactcaagcaggagcagaggccagaaccgtggaggaaactgtttcctggcttgctcagcttgctttcctatacaacccaagatcatttgcccaagggtgggtggcaccaccctcagtgggctagagcctcccacccaatcattaataaagatagcaccccacacccatgtctatgtgcaatctgatggggatgtccctcaactgagatcccctcctcccagatatatctcggcttgcgtcccgttgactgaacgaacaaacacaattgcaaccatcacctcccaatcccctctatcctcatcaccactgcctcgtcctcaccagcccagccattgccgtcatcctggcatcccctcgggcagtagagggataaacagtcagtgtgggctcccctggcaaaggggca

SEQ ID NO: 30389 - DNA, 1135 bp, Mus musculus
gggtccctccctggctgcccatcatcttgggccataggcatcaggcaccccagtgaggttgcggctacgtagtgccgtgtccaccattcggatgtaggcggcaatggtcctgcgcatctcggctgtgtaagggtcatactccagcttgcgcagccccgagcgcttgaagttgccgtccttctggctctccacgcacagcagccgatcctccctgaccgccacgcccagcaggctgaccatgcggcccagctgcgtaaacaagtcctgcttcaggtcctcgaagtgcaccaccaggacggtcttgccaaacttgagccagtccagcgtgtgcgtggcccaccacggggcatagttcctcacgaactcgggccactctgcggagagagcagagcgtcagcccgccactagatagatgggcagatgacaaaccttccggacgcctgaaacccacgtgtgcttttttgggtaacacacccctggctggtgcctggtttactacaggcacagccctacctatacacagaaccacagcctgaaaacagataccaccaaactgcggaggcacagagatgctgggttatacaggaagggctgggagcagagagcactcgcttgccaagattgctggaagctctgggtttggaccccaagaagctgtatgggtagagactgtagttctgtgggggaggttggaatgttgcagatccaaggactaattagcttaccttgggctaggcctagacctctggaacacctaggtagtgacaattttggtttctttaggaatataagaatttgcttttgctttaatcccaggtgtgggtaggggccgcttcagactgtccacagcagctgtcttatgatttgccttgtgccctagcaggcagatcattttgccagctgcagatggtttctgcaattgtgtgacaccggggattccggggacttttcagagggtagataaatgcttgagcttagagtggggagagttgttggttgtggtttgttgagtagttgtacataaaagaagagaaagaaaaaataatacataaaaataaataaaaaggagaaagaaaaaataaaaaggggaaagaaaaaataaaaaggagaaagaagaaaaatttggattctaatg

SEQ ID NO: 30390 - DNA, 1151 bp, Mus musculus
ctaccctctaagccatcagcctcccttcccttgcttgcaacccgacagggccagccccaactggggactcctcagagtccccactaagaatggctttccattcccattatgccgctgctctttctcgaagacgcttagacaccaaaggatttctgactcaagtcactgatcacgttttaggaagcatgcatccaggatccccgtctcccccaccttggatccctctggcttcccctccagcccttcaccgttcccattacataaacgcaaaagccatagtcacagccccttgctcttttgaccggagcagcccctcccccacctccacccccgcagcctggggggtgggggggcggggcaaatgaacactccttcccacctagccaaggaaccctggagaagattcgtgaaaagagagatatatttttttaagaggaatatgaccaagacattctgccccttggacactggccacacaaaaaaggactggcttcccttcccaacgccctcatctggagggtttggaccaccccagggctcagccaagggggctctgaatgtattttgtatggtgtttcccccgccccagactaatttctagttttcttttcactgggcagtagagggcctagcctcccctcctgcttggaggtctaagctctctgagagactctgggtccaaaacatgggccagttctttgcaagtggcctcctctggtcacgaactttctgttcgaagattcctcaggtcaacactatcattaaaagagagttttgttgctaactggctgcccagttgtgtatggcatgttcacacatggagtgtttcctcggggggcgggggggagtgtgtgtgtatgtgtgaatgagagaggagagggaaggcctaaggtgtgaacttctctgggtttatcatgcacagatgtggagcagagtgtctgtgggagagagatgcccagggaccccgcagttccccatctccatcaacaaacctcctcctggcttctgtcaccaactagactgggccttctgtggagaaggctgtgaccagagacttccccagtcagtggaaggaggagcttttaatgttgtcttgtgggcagtgagggagtggggctgctgagatgggtggagagaaagcagagaggggc

SEQ ID NO: 30391 - DNA, 1137 bp, Mus musculus
gagtacagactgaatctggaatgcaatgcctgcccgccagcaactcccttccagccccaaattctcagactagggagaggtctgacccaatggctcctctctcctcaacccttgtgaatgaccactagaggggaggcaggaactgaagtagtgatggagaacaaggggagtgagctctctggtcccttcccactctcaccacagggaccaccagcttcccagccagctggaattcaaaccactattttctgtgagctagagggatggctcagtgcctaagagtactcctcactcttgccaaggacccagggccaattccagacatgcacatggtgggtcacaactgtccttaactctagttttgatgaatcctgtggagggttgggcgaatgcaaggctttccccaaggccctggtgtaccgagaaagaaccaggaatatacttggcagagttggttatggcctagggccagagactggagggagttgtggctcctgatcctgagagatcagcttgtccactatgtgggtctataatgttcttgagatacctggtccccgttgtgcgatgctgctggattagcttcctgctgacttcatcctagcgtttgatagtttctgatgactctgtcccatttctcccctggaaatactgtataaggcgctgtacttgttaataaacttgcttgcaggagccatcagcttgtgtgagacttcttggtctgagactttcctgactttatcctctcatcttctggctactccctgacccccattcaggacccgccccatgactataggatgacctgctgctctcttttgaccttcacgggcaccaggcacacatgtggtgcacagacatctgtgagcaaaacactcatgcacataacatttttttttaaaggtcactggtttcttttcaaatagtgaccctgttataaatctcatgccatttccctcgattctttcaaggtgtaaacagatctcttcaaacagtttgttctataacaaatgtcacctatacaggggattttatggtcagtctggtcaagccttccccacatcctctgtactcaactggtcccacaatccatcagtcccaagatgagccatgccagctgcaccttctttcgatggc

SEQ ID NO: 30392 - DNA, 1832 bp, Mus musculus
tttgggaatgctccaatgcccactgaattttgcacaaggcggctcatgttttaagtggggttcccaagtgtggacactcttccagtaaaatggcaggcaagcaacccgagcctctacaacaggagcaggggaccgactgtgactgactcagaaaagggagcatctctgaagccaagacttgagctgtgaccaacatacaggccaacatacacgatgtcgccgtgcatgccctgaacatgctgcgcagtcttcgtgggtgaggaagttaccgcaaacccattgcagacctgttatggcaacatgacagtcaaaccaacaaagcccactacaccccaacatcctccaagaccttgactttggatttcagaagaacggggggtggggggaacgaggacctgaggggcttcatggaactttgcaagggcaacacagggttctgtgtgtgtgtgtgtgtgtgtgtgtgtgtgtgtgtgtgtgtgtgtgtggtaaagaggaggagacggagagcagagaatcccaaaggatgtgggtacaggatatcttacaccatcatgccacggaggagacagagagctatagtggtggttgcttgggggttcaggtggtggcagctctttgcttcagtgtgtatactcacttagcactgaaccctgaggctgggtggaggccttttcacagaagactccatctgatcccatcccatcccctcccctcccctcccctcccctcccctcccctcccctcccctcccctcccctcccctcccagggtctcttctcccctaatcccctcaatgctggctggaaaaagggcttagaatgtcccagagactggtctagaacggagttttgggactccatcttcagagtgtcttcccaaggctgtctggctggtcatctgggcagctgaccagctttcccgagtcctccttgaatgtatcaacagccccgtgggcagcccaggatcaggctttcctcccctggcaggaaaatggctcactcaccccccccccacacacacacactgttcatcagtagcaaaagacccgagccctgctccgtctggcttgacatcattcctcatggaggaggggtggtgtgcacttcgttagcatgtcccatgcatgttaagtatttcacatgcaccttctcatttattcttcacagaaacctcatatgtatgaggacaagcagagactcagagaggttaagcaactggcccgaggggacccagttagatgttggtagagactggattcgaatcgcagtgggcttggctcgaaggaagatgaagagtctggggaaactaataggttggggttttagccataaatgctgttttgttctgttttttccatgtaaacatcttaatggtctttttgacgtcttgcttgttgttttcagagtaatacaatatgcaaagaaaaggcgtactctccagccccagcctccctggctcccatcacacacaccctgaaatctgctaggcaagcagagggagggagcctggtaggtcagcctgtccagtccaaggtcttctggcctgcagtgtcctctgttcccttccaagccacttttccaccggggtgtaacacacagatgtgtgtcctccggccccagccagttcccgtattatagactgctgggagtcacacttcatcagggggacagattgttcctccctggtcgggtcttaagatgaggcagttctgaacagatccaagctggaacctctggcttctgagagagcccaaacaaccaaggattgggagcagtaagggtggtttaaaaatagccttgtgttcccattgtcaccctctccgcgactcccca

SEQ ID NO: 30393 - DNA, 1234 bp, Mus musculus
cgagtactaccatgtactggaagtcgccaacgagggtgacgtgcggcctttcatccgcttcatagccaagtgtacggaggtcacactggacacgttgctccttgccaccaccgagtactcggtggcactgccagaagcccagcccaaccattctgggttcaaggagacgctccctgtgaggccctaaccgccagccctcccttggcatccagagaaggcctttctagaaacagttctcccctggtagcaaaaggaaacccttaaacattctttacctccagatgtttttcagttgagaaagaaaactaaattattaagcctgtcttcaggataatttatagttcagccaagttatttatttaatttttttttcttacttttttggtgagctagcagcgaccgagtggtgctgcgaccacaacacctgtggtgatcccggaacccagtagggcagcagtgcttttctaatgtcctgagcctgggtgtctagacagactttgcacgaagggcagaggcagagagatctgtgagacggaactcagggccacggtgatcactcgggtgccttggaggtcctgagacctcagaaggctgcaaccttgggcagaacctgccctgtgctaaggtggggttttattcctgagaggctgtggcagcagcttctactggcagcccagccctttgccagtaggaggttgcagatttccgaagaccctctgagctattaacttgctaacctgagtggcaggggatagcgcttccctgcccagactgttctaagggtggagggcaggcagaagggctttcccttatctttgccctatacttcacttgcatcaactgaggctagccaagccaacctaccccctcactccacagagcaggtctgccttcacctcccactcagtcttctgaggacacgggaggtgacgcttggcgggagaatactacccagcatgcaccacacacaaggcacctgccctaacattacaaaagggtgtatctgagaaaccgcatcaaccccaaataagcagttctgataaaagactgaaaacgggcaaacacctgtgaccacgacccagcctttccccctttgtcttatgctttgaaaccctcttcccatctgatgccatcacagggtccagtgtccccactgccttggagtggccttcttctagtaacttgtaaagtgatggatggtgtcacatctgatagatacatttccaagttgtca

SEQ ID NO: 30394 - DNA, 1211 bp, Mus musculus
gaggctcctaagatgtccaatgctgattttgcgaagttgcttctgagaaagtgagcaggactctgagatggagatgccttacctgtcctcaagctggccgggctggccaccacgggccctggagacggaagggctgggcacttgcctgcgctcccacagattctcctctggtgtggatgggaagggagagcctatggtgaacatggcggtgaggagtgttccctcacattgagggcggaggccaaccgctctacaggctgtcccaaggtacgttagtgtcctaacaaggagggacccagctttcgaggcccacttgtcctgatgctttcaccgcctctggccccttttctacgaaccccctcccccagccctgcacagcacgtgtgcccatcactctgtaagtgtggaagatggaatgggagagcttgtcactcatcagaatggcctgtcgagaagtgcgggacgtcacagaagacacgtgtgatgggcttttgtccaaagaggctatgagtttttctattatgtatttctaattgacactgtttaatgttccctaaaagtggaatgtctgcgacctttgttcttaggaattgtgtgccagccactctggaccactttctttgcctgatgactggagccctaagccctctgttcagatgctcacttcgaaatgccatgtctagtacaaagttgagtctccccattgagttttgtttattaaactgaagttcttacagaagccttgtgcattgcagctgggtgtgtgtgtgtgtgtgtgtgtgtgtgtgtgtgtgtgtgtgtgtgtgacatagtgtgtgtgtgagacagagtgcacctgcttttcctcaactgtgtgttaacagcttgtgcagatcagtcctgtgtcactgctcatatgactccgcagtgacaggctggagtttctggcagcctggcactgctgggaagagtttacctctcaccttgagacatgcggttgctgccctgaaagcccttcgtcaaggggaagagagagcggtggggcaaggactcactgtctaaaagcaccttggagggaaatgtgagggggccgtgtatgcgtgctggatgccgactgtgtgtgctgttgtgcccatgatgtttgtctaggtgttagcaatggaaccgaggccttgtgcaagctagacccgttctctgcatcgtagccctcggtctgcatttaaagactcgga

SEQ ID NO: 30395 - DNA, 1213 bp, Mus musculus
tggggatgggggcgggggaggggctctgcattctgctgccgggtgtgggaacctgactgtgcagggatgaccgacagtggatgtttatgttcttggtttcattgacgcagcacctttgctggagtgtaaagtgagccccactgaattgagcgtggagacggtgcagtttgtatgaggtggggcaggcccgatgctgaaggagtgcagacctggctaactgcctctgcttgtcttttgaatgcctgcagagcagccttccaaacgcagaaggacggagaacagtctggcctctggagaggcttcggctatgaaggaagaaacagagctctccgggaaatgcttaacgatagatgttggtcctccttccaagcagaaagagaaggcagcctcccttaagcgggacatgcccaaggtggctcacgacagcagtaaggacagtgtcaccgtgtttgtcagcaacctgccctacagcatagaagagcccgaggtgaagctcaggccgctctttgaggtctgtggggaggtggtccagatcaggccaattttcagcaaccgcggggacttccggggctactgctatgtggagtttggagaggagaagtcagcccagcaggccctggagctggacaggaagattgtggagggcaggccgatgtttgtgtccccctgtgtggataagagcaaaaaccctgattttaaggtatgctttttgaagaagggggtcttcagggtgggctgcccgataggcagtgctcagcgctggagcccatgagggctgacagcggcaaaccttgcgaggcgctcaggctgcctcgtggcttggtcgctctgagccgctgcctcttggttggtggtggccacagtagcatttgggaggatggctgctttccttggggtgcttaagagggtggcaagagtggccctcacctgtgttcagtggatggccgtttacagaggtgggatgcccaggcgattttgtcacgtgagtctctgagaccagaatggctcagctgtgcctgcgcaggacacgcacatgctggggcgtgtctgcctgaaccacgggctgtgctgtgtttgcaggtgttcagatacagtaccaccctggagaaacacaaactcttcatctctggcctgcccttttcctgcaccaaagaggagctcgaggacatttgtaaggcccacggcaccgtcaaggacctcaggctggtcacta

SEQ ID NO: 30396 - DNA, 1199 bp, Mus musculus
agccttccgcacaccacagcgcttgccccagcagcgctcagtccgtgtggctgaactccctgtgcttcactgtacccttccctgggtctccatctctgttgtccttcagttctgacccagcatgcaatgaaggtccttctgtgtgaaagggccctggtgaagtccacgcatcagggatgcgtctctgggctgagtccggtgcctaggtcccctgccctgaccatcttgcgctaccctggcgatttcttccttgaggaagctaggccacagcattcttttatttatgttttagtcttcatttcttttgagacaggtgttaatgcgtagcccaagctggcttcaaatgtgtgactgtcatgcctcagcttcctgggtgctgaggtgacaggtgcacacgtgctcatgtcacccggacgtgacgagagacatttccagtgtgctgtgctgggcgtgtctctgatgctctcgagttacttttctcctggctaaaccctgaaaagaagcaacctaaggaagaggctgagggacagcccctggtgccgggctgggtcggtgtgatggtgtgcttatggcagggtatctgcttaccgcatggcctgagtcagggaccagtcggggtgcagggttgggctagggttgagctgtagctctgaaggctctcctctctcccaggcctgccttctcagcaggggctgcctcccaaagtttcagaacttcctaaaacagtgccagtagctgctactaagtgatggaacccgtgagctcgtggggggagtttccgttcaagctctgacactgaggaagtcttccaggctgtcctctcactctggaattctttgtcataggatcgacagctgaaagttaaggacttggttttatctgtacacagccgtgctgtgcggaactgcccatggacagttgccctgtggagtcggtaccttctggccatggagcgacatggactggaccatcaaacgatttctggtgtgaacgtttgtgtgggagcgtgtctgagttatgctttctgagtgttcttcctgtgtagctcactgtggagcccaggcttgctggggtgacaggcacgagccaccgtgccacagctctcagccttctgtctcctctgaggagcagagctgtggcagtgtcgagccagcaccccgggtctgccttgcagcagcagaggctctgtggcctgcaga

SEQ ID NO: 30397 - DNA, 1133 bp, Mus musculus
tcctgcttcaagtaggagtccagacgggcatgcacaggaaggcagagacagccgcgtccgagggaggcttagaaatcaaaatctttaagagctgaaactgctgagatccagcagctatgaaaccacccacgctaacatggcatggtggcacagggcacacaagcctgtaatcccagctcagacaaggaagggacaggaggcttggggtgtgatggtctccctcagctacttagcaattgaaagaccaccccagactgcatgagaccctgtcttagaacagtgtggaccttcacggggcccagtcctggatgctcacaacgccagccagctctaacagagccacctgctccacaggatccaggcgttctggccgttgagctcctgggggccagggagacccacacctgcttgctctgggggaaaatggctcgaaggaagttggttaagaactagccttggagaaaggggaagtgagactgggcacatgctcctggtatttcagggctctgaactacggtcagacagtaggaagaccctttctctgaccttgaggcctcttgtctgagggagaccggctttccttaatgcataagcatgcctctgcctcttcatccatcagaggtctcagacccccaggcatcctcaggcagatgctgcccagcagcctaggcgatgcctgccttcagtgggcagtgagcattcttgttcctgcttacacagccaggaagcccgggttgtgtccccgactagagatcccttggtacacagtggcagccctgcccaggaattgtgttgaattaattatgtagcaggagttccctcagacagcctatcctgaggtgtgttctgcccacgctcagcaaggtcaagttcactgaaactgtactttaccccgccacacttcaggtggaggaagccctgaccatcaaaaacaccgacatcgccaaggagctctgcctgccgcctgtgaaactgcactgctccagtgagtctgccccacctgccaggcagcttggatctgttcagagtctgctgttcccaccccacggtggccgggcagctgagacaggcagctcttcccccaccctgcgcttccccagtctgcctttgctgtctctgagtgtgtctgcagt

SEQ ID NO: 30398 - DNA, 1172 bp, Mus musculus
cagcctttcaagttctgggacgacaggcacacactacctcaccctctggcttttgtttttaaacaactttcatgcaaggcagggtatggccttctctctacaagagtcctgagcctggctttgcaaaactgcagggcagaccctggaggctaatccctttgtccacttccagatccacactgtgcatgcttgacctccagtctttacctcatctatctcacctcatctcctgcctgaccccgtagctcaccctggagtgtcgcttttactggagggtatgtggtcatggtctaccagcctgtttactggctggcctcaccatcccatggacaagggggattgtatgagaccaaggctgctgatcaacctgagatacaggcaaaggaaatctgttgggcaaaggaacagataagggagaaatccattggggaatgaccctccctgtctggcgagtccttgactgttggatttttcatggagcagttaagacagggtcttacttttttgttggtttggtttggtttggttttttggttttttgagacagggtttctctgtgtagccttggctgtcctggaactcactctgagatcaggctggcctcaaacttagaaatctgcctgcctctgcctcccaagtgctgggattaaaggttcgagccaccactgcctggcgagtaactttagcccaggctagcctcagacccacagtactcttcctgctttggcatccccaccactaagattaaaagtgagagccactacacccagttatgtagaaccctgtgagaggaaaagcctcgtagccccagagaaaggaggatcctgaggccaagctgagctgtggagacgtggagaggttggggagtatgcacaagaatgcatgtgactcacacacaagcacatgtacaaacacacgtgtacatgcatgcacacacgtacacaaatgtgcatatacacatgtatacacacatgcacacatgagcatgcacatgtacaaatgcatgcacatacacacatgagcatacacatgtacaaatgcatgcacatacacacatacatacacacatgtgcacacaagcacacacgtgtgcacacaccagcatgcacacacacaaaaaacactctatgcataagctccaaaaaggtgggtgatttgcagttcctgcccct

SEQ ID NO: 30399 - DNA, 2360 bp, Mus musculus
tttccaagttggagcagcagctggcgaagatggctgcctgaggcccgcccacctccacggacggtggctgctcctcctccgcgcactcccagggagggcagagagggagacactgccatttggagacattccatgtcagatctgtcagccagcgataggccacattccagtaagaactcggttcctctcccaaatttccgcaaacctggaagctgagcttttcgtcagggagctttggtgttcggcaggtctgctgacttgctgagctttcctacgtttgaaatgccagatgttctgaattttagagaccaagccccccacttgacccagcgtcctcctcacacacctgatgaccgggccagcgccacctctgctctgtctcttcctttttaatgttgccaaaaccgaaagtagcttttttttctttgtatttttctactttgcagtatttgtggggtttctttctttctttctttctttctttctttctttctttctttctttctttctttcttttctctcctcaatttaaaagggacagcactgtgtatgtttataaactaaatgaagatgagatgattattttgtataaacactcacgagaacaatcagtgcagccgcctgcacagggctggctcactcacagcacaaacctgggcgttagtctaacgactgtgcagaaggaagacttgagaaatcacgtggacccaccacacactgcccccattccattgagtcttcgatcaaaagtcctgtctctctctctccttgctctctctctcctagaagttgggtggttgcacagagggaactcggtgattatactctaacccgaactagctcgcgtttctgcagttttgttctccacagatggttgtgcctgtcccttccagcagtgtggttcccttccgggcagtttggacaagggcacccaaggcgagcggatacctgtgtgttgacagtccttgtctacagaggcagcttgcctggcccttgggtatagtgtggggcttgaacccaggcactgtgtgcacagcctctgccccaggccctctgtttccctcgctcctgtcttccctccttactttgctgcctcctgtctcaagcgcccagccagccctcgagggctcttgaatgttgcagcggagggaaaggtccagaacagagtggaaagggaagttcagagatcgaccatagctggccacgcacaggccctctgccccaccacccagatcaggctgctacttgccagcactggacgtgccctgggcatgcctgctccaagggcagcagctagaccttagccctactctaacctcacagcctcatggtgcgtgtctatggaagcagacgacctgggtagtgtcagatggatcacaaaaggcaagccttggcaagtgttggtgctggtgtgggcccagtgctggctgccagcaaatgtacaggttatcagggcagagcatagtatggcagcagccgcttagagtgtgtggactgactgggtagtgttgtaagaaaaggttctctcagccaccgagatgggggccgctggctccgaagcttcggggctcctgagtctctgtaggtttctgtgtctgtcttgtggtttaatgttggataaggagatggagagaccatggctggaatgactcacactgcattgtctgtacgtgtgctacgctgaggactgtgtgaagattcacaaaggttctggggtccgttgaattaattacgtaacaattgtagaggctgttgatgaagtcagaggggctgtggttgagagaggcgggagtgactgtagtgtgtgcccacctgacacgctgtggtggcctctgtttccctgtggcaccggaggaagacagtgaactgctcctacacccactcttatagagtggccatagtgttctgtcaaaacactcgcttccgttttcagagataaaaggcattgattacagtcgtgtgctgtgcttctttctcgcctcactctgtgaatgttcaacaaacactttacctaccaagccacagccgcagacctgggttttattttgtttattgtttaaaacaaggtttcagtacctaccactcagacgcagaggcagggccagcctggtctacatagtgccaagacagccagggctatttagagagaccctgtctcaaaaagataaaaaagatgaggtacaggtaccccaggctgtctttgaacttgctctgtggctgtagacagccctccctgcctctgaatcctgagtgacagcgtcacacaccccacagggaggtgggtgtgttcaaagcagcattttcagtgaacgggaacccttggctgtgcttctgcccattgggtcctcggtgtcctgact
